United States Patent 11,078,247 (RNA ENCODING A THERAPEUTIC PROTEIN) - sequence listing, part 26

SEQ ID NO: 45246 - RNA, 5175 nt, Artificial Sequence
  derived and/or modified sequence opt2 from LAMA3__Homo_sapiens__NP_000218
augccccccgccguccgccgcuccgccugcuccaugggcuggcucuggaucuucggcgccgcccucggccagugccucggcuacuccucccagcagcagcgcguccccuuccuccagccccccggccagucccagcuccaggccuccuacgucgaguuccgccccucccagggcugcucccccggcuacuaccgcgaccacaagggccucuacaccggccgcugcguccccugcaacugcaacggccacuccaaccagugccaggacggcuccggcaucugcgucaacugccagcacaacaccgccggcgagcacugcgagcgcugccaggagggcuacuacggcaacgccguccacggcuccugccgcgccugccccugcccccacaccaacuccuucgccaccggcugcgucgucaacggcggcgacguccgcugcuccugcaaggccggcuacaccggcacccagugcgagcgcugcgcccccggcuacuucggcaacccccagaaguucggcggcuccugccagcccugcuccugcaacuccaacggccagcucggcuccugccacccccucaccggcgacugcaucaaccaggagcccaaggacuccucccccgccgaggagugcgacgacugcgacuccugcgucaugacccuccucaacgaccucgccaccaugggcgagcagcuccgccucgucaagucccagcuccagggccucuccgccuccgccggccuccucgagcagaugcgccacauggagacccaggccaaggaccuccgcaaccagcuccucaacuaccgcuccgccaucuccaaccacggcuccaagaucgagggccucgagcgcgagcucaccgaccucaaccaggaguucgagacccuccaggagaaggcccaggucaacucccgcaaggcccagacccucaacaacaacgucaaccgcgccacccaguccgccaaggagcucgacgucaagaucaagaacgucauccgcaacguccacauccuccucaagcagaucuccggcaccgacggcgagggcaacaacguccccuccggcgacuucucccgcgagugggccgaggcccagcgcaugaugcgcgagcuccgcaaccgcaacuucggcaagcaccuccgcgaggccgaggccgacaagcgcgagucccagcuccuccucaaccgcauccgcaccuggcagaagacccaccagggcgagaacaacggccucgccaacuccauccgcgacucccucaacgaguacgaggccaagcucuccgaccuccgcgcccgccuccaggaggccgccgcccaggccaagcaggccaacggccucaaccaggagaacgagcgcgcccucggcgccauccagcgccaggucaaggagaucaacucccuccaguccgacuucaccaaguaccucaccaccgccgacuccucccuccuccagaccaacaucgcccuccagcucauggagaagucccagaaggaguacgagaagcucgccgccucccucaacgaggcccgccaggagcucuccgacaagguccgcgagcucucccgcuccgccggcaagaccucccucgucgaggaggccgagaagcacgcccgcucccuccaggagcucgccaagcagcucgaggagaucaagcgcaacgccuccggcgacgagcucguccgcugcgccgucgacgccgccaccgccuacgagaacauccucaacgccaucaaggccgccgaggacgccgccaaccgcgccgccuccgccuccgaguccgcccuccagaccgucaucaaggaggaccucccccgcaaggccaagacccucuccuccaacuccgacaagcuccucaacgaggccaagaugacccagaagaagcucaagcaggaggucucccccgcccucaacaaccuccagcagacccucaacaucgucaccguccagaaggaggucaucgacaccaaccucaccacccuccgcgacggccuccacggcauccagcgcggcgacaucgacgccaugaucuccuccgccaaguccaugguccgcaaggccaacgacaucaccgacgagguccucgacggccucaaccccauccagaccgacgucgagcgcaucaaggacaccuacggccgcacccagaacgaggacuucaagaaggcccucaccgacgccgacaacuccgucaacaagcucaccaacaagcuccccgaccucuggcgcaagaucgaguccaucaaccagcagcuccucccccucggcaacaucuccgacaacauggaccgcauccgcgagcucauccagcaggcccgcgacgccgccuccaaggucgccguccccaugcgcuucaacggcaaguccggcgucgagguccgccuccccaacgaccucgaggaccucaagggcuacaccucccucucccucuuccuccagcgccccaacucccgcgagaacggcggcaccgagaacauguucgucauguaccucggcaacaaggacgccucccgcgacuacaucggcauggccgucgucgacggccagcucaccugcgucuacaaccucggcgaccgcgaggccgagcuccaggucgaccagauccucaccaaguccgagaccaaggaggccgucauggaccgcgucaaguuccagcgcaucuaccaguucgcccgccucaacuacaccaagggcgccaccuccuccaagcccgagacccccggcgucuacgacauggacggccgcaacuccaacacccuccucaaccucgaccccgagaacgucgucuucuacgucggcggcuacccccccgacuucaagcuccccucccgccucuccuucccccccuacaagggcugcaucgagcucgacgaccucaacgagaacguccucucccucuacaacuucaagaagaccuucaaccucaacaccaccgaggucgagcccugccgccgccgcaaggaggaguccgacaagaacuacuucgagggcaccggcuacgcccgcguccccacccagccccacgcccccauccccaccuucggccagaccauccagaccaccgucgaccgcggccuccucuucuucgccgagaacggcgaccgcuucaucucccucaacaucgaggacggcaagcucaugguccgcuacaagcucaacuccgagcuccccaaggagcgcggcgucggcgacgccaucaacaacggccgcgaccacuccauccagaucaagaucggcaagcuccagaagcgcauguggaucaacgucgacguccagaacaccaucaucgacggcgaggucuucgacuucuccaccuacuaccucggcggcauccccaucgccauccgcgagcgcuucaacaucuccacccccgccuuccgcggcugcaugaagaaccucaagaagaccuccggcgucguccgccucaacgacaccgucggcgucaccaagaagugcuccgaggacuggaagcucguccgcuccgccuccuucucccgcggcggccagcucuccuucaccgaccucggccucccccccaccgaccaccuccaggccuccuucggcuuccagaccuuccagcccuccggcauccuccucgaccaccagaccuggacccgcaaccuccaggucacccucgaggacggcuacaucgagcucuccaccuccgacuccggcggccccaucuucaaguccccccagaccuacauggacggccuccuccacuacgucuccgucaucuccgacaacuccggccuccgccuccucaucgacgaccagcuccuccgcaacuccaagcgccucaagcacaucuccuccucccgccagucccuccgccucggcggcuccaacuucgagggcugcaucuccaacgucuucguccagcgccucucccucucccccgagguccucgaccucaccuccaacucccucaagcgcgacgucucccucggcggcugcucccucaacaagccccccuuccucaugcuccucaagggcuccacccgcuucaacaagaccaagaccuuccgcaucaaccagcuccuccaggacacccccgucgccuccccccgcuccgucaaggucuggcaggacgccugcuccccccuccccaagacccaggccaaccacggcgcccuccaguucggcgacauccccaccucccaccuccucuucaagcucccccaggagcuccucaagccccgcucccaguucgccgucgacaugcagaccaccuccucccgcggccucgucuuccacaccggcaccaagaacuccuucauggcccucuaccucuccaagggccgccucgucuucgcccucggcaccgacggcaagaagcuccgcaucaaguccaaggagaagugcaacgacggcaaguggcacaccgucgucuucggccacgacggcgagaagggccgccucgucgucgacggccuccgcgcccgcgagggcucccuccccggcaacuccaccaucuccauccgcgcccccgucuaccucggcuccccccccuccggcaagcccaagucccuccccaccaacuccuucgucggcugccucaagaacuuccagcucgacuccaagccccucuacacccccuccuccuccuucggcgucuccuccugccucggcggcccccucgagaagggcaucuacuucuccgaggagggcggccacgucguccucgcccacuccguccuccucggccccgaguucaagcucgucuucuccauccgcccccgcucccucaccggcauccucauccacaucggcucccagcccggcaagcaccucugcgucuaccucgaggccggcaaggucaccgccuccauggacuccggcgccggcggcaccuccaccuccgucacccccaagcagucccucugcgacggccaguggcacuccgucgccgucaccaucaagcagcacauccuccaccucgagcucgacaccgacuccuccuacaccgccggccagauccccuucccccccgccuccacccaggagccccuccaccucggcggcgcccccgccaaccucaccacccuccgcauccccgucuggaaguccuucuucggcugccuccgcaacauccacgucaaccacauccccguccccgucaccgaggcccucgagguccagggccccgucucccucaacggcugccccgaccaguga

SEQ ID NO: 45247 - RNA, 5472 nt, Artificial Sequence
  derived and/or modified sequence opt2 from LAMA4__Homo_sapiens__NP_001098676
auggcccucuccuccgccuggcgcuccguccucccccucuggcuccucugguccgccgccugcucccgcgccgccuccggcgacgacaacgccuuccccuucgacaucgagggcuccuccgccgucggccgccaggacccccccgagaccuccgagccccgcgucgcccucggccgccucccccccgccgccgagaagugcaacgccggcuucuuccacacccucuccggcgagugcguccccugcgacugcaacggcaacuccaacgagugccucgacggcuccggcuacugcguccacugccagcgcaacaccaccggcgagcacugcgagaagugccucgacggcuacaucggcgacuccauccgcggcgccccccaguucugccagcccugccccugcccccucccccaccucgccaacuucgccgaguccugcuaccgcaagaacggcgccguccgcugcaucugcaacgagaacuacgccggccccaacugcgagcgcugcgcccccggcuacuacggcaacccccuccucaucggcuccaccugcaagaagugcgacugcuccggcaacuccgaccccaaccucaucuucgaggacugcgacgaggucaccggccagugccgcaacugccuccgcaacaccaccggcuucaagugcgagcgcugcgcccccggcuacuacggcgacgcccgcaucgccaagaacugcgccgucugcaacugcggcggcggccccugcgacuccgucaccggcgagugccucgaggagggcuucgagccccccaccggcauggacugccccaccaucuccugcgacaagugcgucugggaccucaccgacgaccuccgccucgccgcccucuccaucgaggagggcaaguccggcguccucuccgucuccuccggcgccgccgcccaccgccacgucaacgagaucaacgccaccaucuaccuccucaagaccaagcucuccgagcgcgagaaccaguacgcccuccgcaagauccagaucaacaacgccgagaacaccaugaagucccuccucuccgacgucgaggagcucgucgagaaggagaaccaggccucccgcaagggccagcucguccagaaggaguccauggacaccaucaaccacgccucccagcucgucgagcaggcccacgacaugcgcgacaagauccaggagaucaacaacaagaugcucuacuacggcgaggagcacgagcucucccccaaggagaucuccgagaagcucguccucgcccagaagaugcucgaggagauccgcucccgccagcccuucuucacccagcgcgagcucgucgacgaggaggccgacgaggccuacgagcuccucucccaggccgaguccuggcagcgccuccacaacgagacccgcacccucuuccccgucguccucgagcagcucgacgacuacaacgccaagcucuccgaccuccaggaggcccucgaccaggcccucaacuacguccgcgacgccgaggacaugaaccgcgccaccgccgcccgccagcgcgaccacgagaagcagcaggagcgcguccgcgagcagauggaggucgucaacaugucccucuccaccuccgccgacucccucaccaccccccgccucacccucuccgagcucgacgacaucaucaagaacgccuccggcaucuacgccgagaucgacggcgccaaguccgagcuccaggucaagcucuccaaccucuccaaccucucccacgaccucguccaggaggccaucgaccacgcccaggaccuccagcaggaggccaacgagcucucccgcaagcuccacuccuccgacaugaacggccucguccagaaggcccucgacgccuccaacgucuacgagaacaucgucaacuacgucuccgaggccaacgagaccgccgaguucgcccucaacaccaccgaccgcaucuacgacgccgucuccggcaucgacacccagaucaucuaccacaaggacgaguccgagaaccuccucaaccaggcccgcgagcuccaggccaaggccgaguccuccuccgacgaggccgucgccgacaccucccgccgcgucggcggcgcccucgcccgcaaguccgcccucaagacccgccucuccgacgccgucaagcagcuccaggccgccgagcgcggcgacgcccagcagcgccucggccagucccgccucaucaccgaggaggccaaccgcaccaccauggagguccagcaggccaccgcccccauggccaacaaccucaccaacuggucccagaaccuccagcacuucgacuccuccgccuacaacaccgccgucaacuccgcccgcgacgccguccgcaaccucaccgaggucgucccccagcuccucgaccagcuccgcaccgucgagcagaagcgccccgccuccaacgucuccgccuccauccagcgcauccgcgagcucaucgcccagacccgcuccgucgccuccaagauccaggucuccaugauguucgacggccaguccgccgucgagguccacucccgcaccuccauggacgaccucaaggccuucaccucccucucccucuacaugaagccccccgucaagcgccccgagcucaccgagaccgccgaccaguucauccucuaccucggcuccaagaacgccaagaaggaguacaugggccucgccaucaagaacgacaaccucgucuacgucuacaaccucggcaccaaggacgucgagaucccccucgacuccaagcccgucuccuccuggcccgccuacuucuccaucgucaagaucgagcgcgucggcaagcacggcaaggucuuccucaccguccccucccucuccuccaccgccgaggagaaguucaucaagaagggcgaguucuccggcgacgacucccuccucgaccucgaccccgaggacaccgucuucuacgucggcggcguccccuccaacuucaagcuccccaccucccucaaccuccccggcuucgucggcugccucgagcucgccacccucaacaacgacgucaucucccucuacaacuucaagcacaucuacaacauggaccccuccaccuccguccccugcgcccgcgacaagcucgccuucacccagucccgcgccgccuccuacuucuucgacggcuccggcuacgccgucguccgcgacaucacccgccgcggcaaguucggccaggucacccgcuucgacaucgagguccgcacccccgccgacaacggccucauccuccucauggucaacggcuccauguucuuccgccucgagaugcgcaacggcuaccuccacgucuucuacgacuucggcuucuccggcggccccguccaccucgaggacacccucaagaaggcccagaucaacgacgccaaguaccacgagaucuccaucaucuaccacaacgacaagaagaugauccucgucgucgaccgccgccacgucaaguccauggacaacgagaagaugaagauccccuucaccgacaucuacaucggcggcgccccccccgagauccuccagucccgcgcccuccgcgcccaccucccccucgacaucaacuuccgcggcugcaugaagggcuuccaguuccagaagaaggacuucaaccuccucgagcagaccgagacccucggcgucggcuacggcugccccgaggacucccucaucucccgccgcgccuacuucaacggccaguccuucaucgccuccauccagaagaucuccuucuucgacggcuucgagggcggcuucaacuuccgcacccuccagcccaacggccuccucuucuacuacgccuccggcuccgacgucuucuccaucucccucgacaacggcaccgucaucauggacgucaagggcaucaagguccaguccgucgacaagcaguacaacgacggccucucccacuucgucaucuccuccgucucccccacccgcuacgagcucaucgucgacaagucccgcgucggcuccaagaaccccaccaagggcaagaucgagcagacccaggccuccgagaagaaguucuacuucggcggcucccccaucuccgcccaguacgccaacuucaccggcugcaucuccaacgccuacuucacccgcgucgaccgcgacgucgaggucgaggacuuccagcgcuacaccgagaagguccacaccucccucuacgagugccccaucgaguccuccccccucuuccuccuccacaagaagggcaagaaccucuccaagcccaaggccucccagaacaagaagggcggcaaguccaaggacgcccccuccugggaccccgucgcccucaagcuccccgagcgcaacaccccccgcaacucccacugccaccucuccaacuccccccgcgccaucgagcacgccuaccaguacggcggcaccgccaacucccgccaggaguucgagcaccucaagggcgacuucggcgccaagucccaguucuccauccgccuccgcacccgcuccucccacggcaugaucuucuacgucuccgaccaggaggagaacgacuucaugacccucuuccucgcccacggccgccucgucuacauguucaacgucggccacaagaagcucaagauccgcucccaggagaaguacaacgacggccucuggcacgacgucaucuucauccgcgagcgcuccuccggccgccucgucaucgacggccuccgcguccucgaggagucccucccccccaccgaggccaccuggaagaucaagggccccaucuaccucggcggcgucgcccccggcaaggccgucaagaacguccagaucaacuccaucuacuccuucuccggcugccucuccaaccuccagcucaacggcgccuccaucaccuccgccucccagaccuucuccgucacccccugcuucgagggccccauggagaccggcaccuacuucuccaccgagggcggcuacgucguccucgacgaguccuucaacaucggccucaaguucgagaucgccuucgagguccgcccccgcuccuccuccggcacccucguccacggccacuccgucaacggcgaguaccucaacguccacaugaagaacggccaggucaucgucaaggucaacaacggcauccgcgacuucuccaccuccgucacccccaagcagucccucugcgacggccgcuggcaccgcaucaccgucauccgcgacuccaacgucguccagcucgacgucgacuccgaggucaaccacgucgucggcccccucaaccccaagcccaucgaccaccgcgagcccgucuucgucggcggcguccccgagucccuccucaccccccgccucgcccccuccaagcccuucaccggcugcauccgccacuucgucaucgacggccaccccgucuccuucuccaaggccgcccucgucuccggcgccgucuccaucaacuccugccccgccgccuga

SEQ ID NO: 45248 - RNA, 11088 nt, Artificial Sequence
  derived and/or modified sequence opt2 from LAMA5__Homo_sapiens__NP_005551
auggccaagcgccucugcgccggcuccgcccucugcguccgcggcccccgcggccccgccccccuccuccucgucggccucgcccuccucggcgccgcccgcgcccgcgaggaggccggcggcggcuucucccuccacccccccuacuucaaccucgccgagggcgcccgcaucgccgccuccgccaccugcggcgaggaggcccccgcccgcggcuccccccgccccaccgaggaccucuacugcaagcucgucggcggccccgucgccggcggcgaccccaaccagaccauccgcggccaguacugcgacaucugcaccgccgccaacuccaacaaggcccaccccgccuccaacgccaucgacggcaccgagcgcugguggcagucccccccccucucccgcggccucgaguacaacgaggucaacgucacccucgaccucggccaggucuuccacgucgccuacguccucaucaaguucgccaacuccccccgccccgaccucuggguccucgagcgcuccauggacuucggccgcaccuaccagcccuggcaguucuucgccuccuccaagcgcgacugccucgagcgcuucggcccccagacccucgagcgcaucacccgcgacgacgccgccaucugcaccaccgaguacucccgcaucgucccccucgagaacggcgagaucgucgucucccucgucaacggccgccccggcgccaugaacuucuccuacuccccccuccuccgcgaguucaccaaggccaccaacguccgccuccgcuuccuccgcaccaacacccuccucggccaccucaugggcaaggcccuccgcgaccccaccgucacccgccgcuacuacuacuccaucaaggacaucuccaucggcggccgcugcgucugccacggccacgccgacgccugcgacgccaaggaccccaccgaccccuuccgccuccagugcaccugccagcacaacaccugcggcggcaccugcgaccgcugcugccccggcuucaaccagcagcccuggaagcccgccaccgccaacuccgccaacgagugccaguccugcaacugcuacggccacgccaccgacugcuacuacgaccccgaggucgaccgccgccgcgccucccagucccucgacggcaccuaccagggcggcggcgucugcaucgacugccagcaccacaccaccggcgucaacugcgagcgcugccuccccggcuucuaccgcucccccaaccacccccucgacuccccccacgucugccgccgcugcaacugcgaguccgacuucaccgacggcaccugcgaggaccucaccggccgcugcuacugccgccccaacuucuccggcgagcgcugcgacgucugcgccgagggcuucaccggcuuccccuccugcuaccccacccccuccuccuccaacgacacccgcgagcagguccuccccgccggccagaucgucaacugcgacugcuccgccgccggcacccagggcaacgccugccgcaaggacccccgcgucggccgcugccucugcaagcccaacuuccagggcacccacugcgagcucugcgcccccggcuucuacggccccggcugccagcccugccagugcuccucccccggcgucgccgacgaccgcugcgaccccgacaccggccagugccgcugccgcgucggcuucgagggcgccaccugcgaccgcugcgcccccggcuacuuccacuucccccucugccagcucugcggcugcucccccgccggcacccuccccgagggcugcgacgaggccggccgcugccucugccagcccgaguucgccggcccccacugcgaccgcugccgccccggcuaccacggcuuccccaacugccaggccugcaccugcgacccccgcggcgcccucgaccagcucugcggcgccggcggccucugccgcugccgccccggcuacaccggcaccgccugccaggagugcucccccggcuuccacggcuuccccuccugcguccccugccacugcuccgccgagggcucccuccacgccgccugcgacccccgcuccggccagugcuccugccgcccccgcgucaccggccuccgcugcgacaccugcguccccggcgccuacaacuuccccuacugcgaggccggcuccugccaccccgccggccucgcccccgucgaccccgcccuccccgaggcccagguccccugcaugugccgcgcccacgucgagggccccuccugcgaccgcugcaagcccggcuucuggggccucucccccuccaaccccgagggcugcacccgcugcuccugcgaccuccgcggcacccucggcggcgucgccgagugccagcccggcaccggccagugcuucugcaagccccacgucugcggccaggccugcgccuccugcaaggacggcuucuucggccucgaccaggccgacuacuucggcugccgcuccugccgcugcgacaucggcggcgcccucggccaguccugcgagccccgcaccggcgucugccgcugccgccccaacacccagggccccaccugcuccgagcccgcccgcgaccacuaccuccccgaccuccaccaccuccgccucgagcucgaggaggccgccacccccgagggccacgccguccgcuucggcuucaacccccucgaguucgagaacuucuccuggcgcggcuacgcccagauggcccccguccagccccgcaucgucgcccgccucaaccucaccucccccgaccucuucuggcucgucuuccgcuacgucaaccgcggcgccauguccgucuccggccgcgucuccguccgcgaggagggccgcuccgccaccugcgccaacugcaccgcccagucccagcccgucgccuucccccccuccaccgagcccgccuucaucaccgucccccagcgcggcuucggcgagcccuucguccucaaccccggcaccugggcccuccgcgucgaggccgagggcguccuccucgacuacgucguccuccuccccuccgccuacuacgaggccgcccuccuccagcuccgcgucaccgaggccugcaccuaccgccccuccgcccagcaguccggcgacaacugccuccucuacacccaccucccccucgacggcuuccccuccgccgccggccucgaggcccucugccgccaggacaacucccucccccgccccugccccaccgagcagcucucccccucccaccccccccucaucaccugcaccggcuccgacgucgacguccagcuccaggucgccgucccccagcccggccgcuacgcccucgucgucgaguacgccaacgaggacgcccgccaggaggucggcgucgccguccacaccccccagcgcgccccccagcagggccuccucucccuccaccccugccucuacuccacccucugccgcggcaccgcccgcgacacccaggaccaccucgccgucuuccaccucgacuccgaggccuccguccgccucaccgccgagcaggcccgcuucuuccuccacggcgucacccucguccccaucgaggaguucucccccgaguucgucgagccccgcgucuccugcaucuccucccacggcgccuucggccccaacuccgccgccugccuccccucccgcuuccccaagcccccccagcccaucauccuccgcgacugccaggucaucccccucccccccggccucccccucacccacgcccaggaccucacccccgccaugucccccgccggcccccgcccccgcccccccaccgccgucgaccccgacgccgagcccacccuccuccgcgagccccaggccaccgucgucuucaccacccacguccccacccucggccgcuacgccuuccuccuccacggcuaccagcccgcccaccccaccuuccccgucgagguccucaucaacgccggccgcgucuggcagggccacgccaacgccuccuucugcccccacggcuacggcugccgcacccucgucgucugcgagggccaggcccuccucgacgucacccacuccgagcucaccgucaccguccgcguccccaagggccgcuggcucuggcucgacuacguccucgucguccccgagaacgucuacuccuucggcuaccuccgcgaggagccccucgacaaguccuacgacuucaucucccacugcgccgcccagggcuaccacaucucccccuccuccuccucccucuucugccgcaacgccgccgccucccucucccucuucuacaacaacggcgcccgccccugcggcugccacgaggucggcgccaccggccccaccugcgagcccuucggcggccagugccccugccacgcccacgucaucggccgcgacugcucccgcugcgccaccggcuacuggggcuuccccaacugccgccccugcgacugcggcgcccgccucugcgacgagcucaccggccagugcaucugccccccccgcaccaucccccccgacugccuccucugccagccccagaccuucggcugccacccccucgucggcugcgaggagugcaacugcuccggccccggcauccaggagcucaccgaccccaccugcgacaccgacuccggccagugcaagugccgccccaacgucaccggccgccgcugcgacaccugcucccccggcuuccacggcuacccccgcugccgccccugcgacugccacgaggccggcaccgcccccggcgucugcgacccccucaccggccagugcuacugcaaggagaacguccagggccccaagugcgaccagugcucccucggcaccuucucccucgacgccgccaaccccaagggcugcacccgcugcuucugcuucggcgccaccgagcgcugccgcuccuccuccuacacccgccaggaguucgucgacauggagggcuggguccuccucuccaccgaccgccaggucgucccccacgagcgccagcccggcaccgagaugcuccgcgccgaccuccgccacguccccgaggccguccccgaggccuuccccgagcucuacuggcaggccccccccuccuaccucggcgaccgcgucuccuccuacggcggcacccuccgcuacgagcuccacuccgagacccagcgcggcgacgucuucguccccauggagucccgccccgacgucguccuccagggcaaccagauguccaucaccuuccucgagcccgccuaccccacccccggccacguccaccgcggccagcuccagcucgucgagggcaacuuccgccacaccgagacccgcaacaccgucucccgcgaggagcucaugaugguccucgccucccucgagcagcuccagauccgcgcccucuucucccagaucuccuccgccgucuuccuccgccgcgucgcccucgaggucgccucccccgccggccagggcgcccucgccuccaacgucgagcucugccucugccccgccuccuaccgcggcgacuccugccaggagugcgcccccggcuucuaccgcgacgucaagggccucuuccucggccgcugcguccccugccagugccacggccacuccgaccgcugccuccccggcuccggcgucugcgucgacugccagcacaacaccgagggcgcccacugcgagcgcugccaggccggcuucgucuccucccgcgacgaccccuccgcccccugcgucuccugccccugcccccucuccguccccuccaacaacuucgccgagggcugcguccuccgcggcggccgcacccagugccucugcaagcccggcuacgccggcgccuccugcgagcgcugcgcccccggcuucuucggcaacccccucguccucggcuccuccugccagcccugcgacugcuccggcaacggcgaccccaaccuccucuucuccgacugcgacccccucaccggcgccugccgcggcugccuccgccacaccaccggcccccgcugcgagaucugcgcccccggcuucuacggcaacgcccuccuccccggcaacugcacccgcugcgacugcacccccugcggcaccgaggccugcgacccccacuccggccacugccucugcaaggccggcgucaccggccgccgcugcgaccgcugccaggagggccacuucggcuucgacggcugcggcggcugccgccccugcgccugcggccccgccgccgagggcuccgagugccacccccaguccggccagugccacugccgccccggcaccaugggcccccagugccgcgagugcgcccccggcuacuggggccuccccgagcagggcugccgccgcugccagugccccggcggccgcugcgacccccacaccggccgcugcaacugcccccccggccucuccggcgagcgcugcgacaccugcucccagcagcaccagguccccguccccggcggccccgucggccacuccauccacugcgaggucugcgaccacugcgucguccuccuccucgacgaccucgagcgcgccggcgcccuccuccccgccauccacgagcagcuccgcggcaucaacgccuccuccauggccugggcccgccuccaccgccucaacgccuccaucgccgaccuccagucccagcuccgcuccccccucggcccccgccacgagaccgcccagcagcucgagguccucgagcagcaguccaccucccucggccaggacgcccgccgccucggcggccaggccgucggcacccgcgaccaggccucccagcuccucgccggcaccgaggccacccucggccacgccaagacccuccucgccgccauccgcgccgucgaccgcacccucuccgagcucaugucccagaccggccaccucggccucgccaacgccuccgcccccuccggcgagcagcuccuccgcacccucgccgaggucgagcgccuccucugggagaugcgcgcccgcgaccucggcgccccccaggccgccgccgaggccgagcucgccgccgcccagcgccuccucgcccgcguccaggagcagcucuccucccucugggaggagaaccaggcccucgccacccagacccgcgaccgccucgcccagcacgaggccggccucauggaccuccgcgaggcccucaaccgcgccgucgacgccacccgcgaggcccaggagcucaacucccgcaaccaggagcgccucgaggaggcccuccagcgcaagcaggagcucucccgcgacaacgccacccuccaggccacccuccacgccgcccgcgacacccucgccuccgucuuccgccuccuccacucccucgaccaggccaaggaggagcucgagcgccucgccgccucccucgacggcgcccgcaccccccuccuccagcgcaugcagaccuucucccccgccggcuccaagcuccgccucgucgaggccgccgaggcccacgcccagcagcucggccagcucgcccucaaccucuccuccaucauccucgacgucaaccaggaccgccucacccagcgcgccaucgaggccuccaacgccuacucccgcauccuccaggccguccaggccgccgaggacgccgccggccaggcccuccagcaggccgaccacaccugggccaccgucguccgccagggccucgucgaccgcgcccagcagcuccucgccaacuccaccgcccucgaggaggccaugcuccaggagcagcagcgccucggccucgucugggccgcccuccagggcgcccgcacccagcuccgcgacguccgcgccaagaaggaccagcucgaggcccacauccaggccgcccaggccaugcucgccauggacaccgacgagaccuccaagaagaucgcccacgccaaggccgucgccgccgaggcccaggacaccgccacccgcguccagucccagcuccaggccaugcaggagaacgucgagcgcuggcagggccaguacgagggccuccgcggccaggaccucggccaggccguccucgacgccggccacuccgucuccacccucgagaagacccucccccagcuccucgccaagcucuccauccucgagaaccgcggcguccacaacgccucccucgcccucuccgccuccaucggccgcguccgcgagcucaucgcccaggcccgcggcgccgccuccaaggucaagguccccaugaaguucaacggccgcuccggcguccagcuccgcaccccccgcgaccucgccgaccucgccgccuacaccgcccucaaguucuaccuccagggccccgagcccgagcccggccagggcaccgaggaccgcuucgucauguacaugggcucccgccaggccaccggcgacuacaugggcgucucccuccgcgacaagaagguccacugggucuaccagcucggcgaggccggccccgccguccucuccaucgacgaggacaucggcgagcaguucgccgccgucucccucgaccgcacccuccaguucggccacauguccgucaccgucgagcgccagaugauccaggagaccaagggcgacaccgucgcccccggcgccgagggccuccucaaccuccgccccgacgacuucgucuucuacgucggcggcuaccccuccaccuucaccccccccccccuccuccgcuuccccggcuaccgcggcugcaucgagauggacacccucaacgaggaggucgucucccucuacaacuucgagcgcaccuuccagcucgacaccgccgucgaccgccccugcgcccgcuccaaguccaccggcgaccccuggcucaccgacggcuccuaccucgacggcaccggcuucgcccgcaucuccuucgacucccagaucuccaccaccaagcgcuucgagcaggagcuccgccucgucuccuacuccggcguccucuucuuccucaagcagcagucccaguuccucugccucgccguccaggagggcucccucguccuccucuacgacuucggcgccggccucaagaaggccgucccccuccagcccccccccccccucaccuccgccuccaaggccauccaggucuuccuccucggcggcucccgcaagcgcguccucguccgcgucgagcgcgccaccgucuacuccgucgagcaggacaacgaccucgagcucgccgacgccuacuaccucggcggcgucccccccgaccagcucccccccucccuccgccgccucuuccccaccggcggcuccguccgcggcugcgucaagggcaucaaggcccucggcaaguacgucgaccucaagcgccucaacaccaccggcgucuccgccggcugcaccgccgaccuccucgucggccgcgccaugaccuuccacggccacggcuuccuccgccucgcccucuccaacgucgccccccucaccggcaacgucuacuccggcuucggcuuccacuccgcccaggacuccgcccuccucuacuaccgcgccucccccgacggccucugccaggucucccuccagcagggccgcgucucccuccagcuccuccgcaccgaggucaagacccaggccggcuucgccgacggcgccccccacuacgucgccuucuacuccaacgccaccggcgucuggcucuacgucgacgaccagcuccagcagaugaagccccaccgcggccccccccccgagcuccagccccagcccgagggccccccccgccuccuccucggcggccuccccgaguccggcaccaucuacaacuucuccggcugcaucuccaacgucuucguccagcgccuccucggcccccagcgcgucuucgaccuccagcagaaccucggcuccgucaacgucuccaccggcugcgcccccgcccuccaggcccagacccccggccucggcccccgcggccuccaggccaccgcccgcaaggccucccgccgcucccgccagcccgcccgccaccccgccugcaugcuccccccccaccuccgcaccacccgcgacuccuaccaguucggcggcucccucuccucccaccucgaguucgucggcauccucgcccgccaccgcaacuggcccucccucuccaugcacguccucccccgcuccucccgcggccuccuccucuucaccgcccgccuccgccccggcucccccucccucgcccucuuccucuccaacggccacuucgucgcccagauggagggccucggcacccgccuccgcgcccagucccgccagcgcucccgccccggccgcuggcacaaggucuccguccgcugggagaagaaccgcauccuccucgucaccgacggcgcccgcgccuggucccaggagggcccccaccgccagcaccagggcgccgagcacccccagccccacacccucuucgucggcggccuccccgccuccucccacuccuccaagcuccccgucaccgucggcuucuccggcugcgucaagcgccuccgccuccacggccgcccccucggcgcccccacccgcauggccggcgucacccccugcauccucggcccccucgaggccggccucuucuuccccggcuccggcggcgucaucacccucgaccuccccggcgccacccuccccgacgucggccucgagcucgagguccgcccccucgccgucaccggccucaucuuccaccucggccaggcccgcaccccccccuaccuccagcuccaggucaccgagaagcagguccuccuccgcgccgacgacggcgccggcgaguucuccaccuccgucacccgccccuccguccucugcgacggccaguggcaccgccucgccgucaugaaguccggcaacguccuccgccucgaggucgacgcccaguccaaccacaccgucggcccccuccucgccgccgccgccggcgcccccgccccccucuaccucggcggccuccccgagcccauggccguccagcccuggccccccgccuacugcggcugcaugcgccgccucgccgucaaccgcucccccgucgccaugacccgcuccgucgagguccacggcgccgucggcgccuccggcugccccgccgccuga

SEQ ID NO: 45249 - RNA, 5361 nt, Artificial Sequence
  derived and/or modified sequence opt2 from LAMB1__Homo_sapiens__NP_002282
augggccuccuccagcuccucgccuucuccuuccucgcccucugccgcgcccgcguccgcgcccaggagcccgaguucuccuacggcugcgccgagggcuccugcuaccccgccaccggcgaccuccucaucggccgcgcccagaagcucuccgucaccuccaccugcggccuccacaagcccgagcccuacugcaucgucucccaccuccaggaggacaagaagugcuucaucugcaacucccaggaccccuaccacgagacccucaaccccgacucccaccucaucgagaacgucgucaccaccuucgcccccaaccgccucaagaucugguggcaguccgagaacggcgucgagaacgucaccauccagcucgaccucgaggccgaguuccacuucacccaccucaucaugaccuucaagaccuuccgccccgccgccaugcucaucgagcgcuccuccgacuucggcaagaccuggggcgucuaccgcuacuucgccuacgacugcgaggccuccuuccccggcaucuccaccggccccaugaagaaggucgacgacaucaucugcgacucccgcuacuccgacaucgagcccuccaccgagggcgaggucaucuuccgcgcccucgaccccgccuucaagaucgaggaccccuacuccccccgcauccagaaccuccucaagaucaccaaccuccgcaucaaguucgucaagcuccacacccucggcgacaaccuccucgacucccgcauggagauccgcgagaaguacuacuacgccgucuacgacauggucguccgcggcaacugcuucugcuacggccacgccuccgagugcgcccccgucgacggcuucaacgaggaggucgagggcaugguccacggccacugcaugugccgccacaacaccaagggccucaacugcgagcucugcauggacuucuaccacgaccuccccuggcgccccgccgagggccgcaacuccaacgccugcaagaagugcaacugcaacgagcacuccaucuccugccacuucgacauggccgucuaccucgccaccggcaacgucuccggcggcgucugcgacgacugccagcacaacaccaugggccgcaacugcgagcagugcaagcccuucuacuaccagcaccccgagcgcgacauccgcgaccccaacuucugcgagcgcugcaccugcgaccccgccggcucccagaacgagggcaucugcgacuccuacaccgacuucuccaccggccucaucgccggccagugccgcugcaagcucaacgucgagggcgagcacugcgacgucugcaaggagggcuucuacgaccucuccuccgaggaccccuucggcugcaaguccugcgccugcaacccccucggcaccauccccggcggcaaccccugcgacuccgagaccggccacugcuacugcaagcgccucgucaccggccagcacugcgaccagugccuccccgagcacuggggccucuccaacgaccucgacggcugccgccccugcgacugcgaccucggcggcgcccucaacaacuccugcuucgccgaguccggccagugcuccugccgcccccacaugaucggccgccagugcaacgaggucgagcccggcuacuacuucgccacccucgaccacuaccucuacgaggccgaggaggccaaccucggccccggcgucuccaucgucgagcgccaguacauccaggaccgcauccccuccuggaccggcgccggcuucguccgcguccccgagggcgccuaccucgaguucuucaucgacaacauccccuacuccauggaguacgacauccucauccgcuacgagccccagcuccccgaccacugggagaaggccgucaucaccguccagcgccccggccgcauccccaccuccucccgcugcggcaacaccauccccgacgacgacaaccaggucgucucccucucccccggcucccgcuacgucguccucccccgccccgucugcuucgagaagggcaccaacuacaccguccgccucgagcucccccaguacaccuccuccgacuccgacgucgagucccccuacacccucaucgacucccucguccucaugcccuacugcaagucccucgacaucuucaccgucggcggcuccggcgacggcgucgucaccaacuccgccugggagaccuuccagcgcuaccgcugccucgagaacucccgcuccgucgucaagacccccaugaccgacgucugccgcaacaucaucuucuccaucuccgcccuccuccaccagaccggccucgccugcgagugcgacccccagggcucccucuccuccgucugcgaccccaacggcggccagugccagugccgccccaacgucgucggccgcaccugcaaccgcugcgcccccggcaccuucggcuucggccccuccggcugcaagcccugcgagugccaccuccagggcuccgucaacgccuucugcaaccccgucaccggccagugccacugcuuccagggcgucuacgcccgccagugcgaccgcugccuccccggccacuggggcuuccccuccugccagcccugccagugcaacggccacgccgacgacugcgaccccgucaccggcgagugccucaacugccaggacuacaccaugggccacaacugcgagcgcugccucgccggcuacuacggcgaccccaucaucggcuccggcgaccacugccgccccugccccugccccgacggccccgacuccggccgccaguucgcccgcuccugcuaccaggaccccgucacccuccagcucgccugcgucugcgaccccggcuacaucggcucccgcugcgacgacugcgccuccggcuacuucggcaaccccuccgaggucggcggcuccugccagcccugccagugccacaacaacaucgacaccaccgaccccgaggccugcgacaaggagaccggccgcugccucaagugccucuaccacaccgagggcgagcacugccaguucugccgcuucggcuacuacggcgacgcccuccagcaggacugccgcaagugcgucugcaacuaccucggcaccguccaggagcacugcaacggcuccgacugccagugcgacaaggccaccggccagugccucugccuccccaacgucaucggccagaacugcgaccgcugcgcccccaacaccuggcagcucgccuccggcaccggcugcgaccccugcaacugcaacgccgcccacuccuucggccccuccugcaacgaguucaccggccagugccagugcaugcccggcuucggcggccgcaccugcuccgagugccaggagcucuucuggggcgaccccgacgucgagugccgcgccugcgacugcgacccccgcggcaucgagaccccccagugcgaccaguccaccggccagugcgucugcgucgagggcgucgagggcccccgcugcgacaagugcacccgcggcuacuccggcgucuuccccgacugcacccccugccaccagugcuucgcccucugggacgucaucaucgccgagcucaccaaccgcacccaccgcuuccucgagaaggccaaggcccucaagaucuccggcgucaucggccccuaccgcgagaccgucgacuccgucgagcgcaaggucuccgagaucaaggacauccucgcccagucccccgccgccgagccccucaagaacaucggcaaccucuucgaggaggccgagaagcucaucaaggacgucaccgagaugauggcccaggucgaggucaagcucuccgacaccaccucccaguccaacuccaccgccaaggagcucgacucccuccagaccgaggccgagucccucgacaacaccgucaaggagcucgccgagcagcucgaguucaucaagaacuccgacauccgcggcgcccucgacuccaucaccaaguacuuccagaugucccucgaggccgaggagcgcgucaacgccuccaccaccgagcccaacuccaccgucgagcaguccgcccucaugcgcgaccgcgucgaggacgucaugauggagcgcgagucccaguucaaggagaagcaggaggagcaggcccgccuccucgacgagcucgccggcaagcuccagucccucgaccucuccgccgccgccgagaugaccugcggcaccccccccggcgccuccugcuccgagaccgagugcggcggccccaacugccgcaccgacgagggcgagcgcaagugcggcggccccggcugcggcggccucgucaccgucgcccacaacgccuggcagaaggccauggaccucgaccaggacguccucuccgcccucgccgaggucgagcagcucuccaagauggucuccgaggccaagcuccgcgccgacgaggccaagcaguccgccgaggacauccuccucaagaccaacgccaccaaggagaagauggacaaguccaacgaggagcuccgcaaccucaucaagcagauccgcaacuuccucacccaggacuccgccgaccucgacuccaucgaggccgucgccaacgagguccucaagauggagaugcccuccaccccccagcagcuccagaaccucaccgaggacauccgcgagcgcgucgagucccucucccaggucgaggucauccuccagcacuccgccgccgacaucgcccgcgccgagaugcuccucgaggaggccaagcgcgccuccaaguccgccaccgacgucaaggucaccgccgacauggucaaggaggcccucgaggaggccgagaaggcccaggucgccgccgagaaggccaucaagcaggccgacgaggacauccagggcacccagaaccuccucaccuccaucgaguccgagaccgccgccuccgaggagacccucuucaacgccucccagcgcaucuccgagcucgagcgcaacgucgaggagcucaagcgcaaggccgcccagaacuccggcgaggccgaguacaucgagaaggucgucuacaccgucaagcaguccgccgaggacgucaagaagacccucgacggcgagcucgacgagaaguacaagaaggucgagaaccucaucgccaagaagaccgaggaguccgccgacgcccgccgcaaggccgagaugcuccagaacgaggccaagacccuccucgcccaggccaacuccaagcuccagcuccucaaggaccucgagcgcaaguacgaggacaaccagcgcuaccucgaggacaaggcccaggagcucgcccgccucgagggcgagguccgcucccuccucaaggacaucucccagaaggucgccgucuacuccaccugccucuga

SEQ ID NO: 45250 - RNA, 5397 nt, Artificial Sequence
  derived and/or modified sequence opt2 from LAMB2__Homo_sapiens__NP_002283
auggagcucaccucccgcgagcgcggccgcggccagccccuccccugggagcuccgccucggccuccuccucuccguccucgccgccacccucgcccaggcccccgcccccgacguccccggcugcucccgcggcuccugcuaccccgccaccggcgaccuccucgucggccgcgccgaccgccucaccgccuccuccaccugcggccucaacggcccccagcccuacugcaucgucucccaccuccaggacgagaagaagugcuuccucugcgacucccgccgccccuucuccgcccgcgacaacccccacucccaccgcauccagaacgucgucaccuccuucgccccccagcgccgcgccgccugguggcaguccgagaacggcauccccgccgucaccauccagcucgaccucgaggccgaguuccacuucacccaccucaucaugaccuucaagaccuuccgccccgccgccaugcucgucgagcgcuccgccgacuucggccgcaccuggcacgucuaccgcuacuucuccuacgacugcggcgccgacuuccccggcgucccccucgcccccccccgccacugggacgacgucgucugcgagucccgcuacuccgagaucgagcccuccaccgagggcgaggucaucuaccgcguccucgaccccgccauccccauccccgaccccuacuccucccgcauccagaaccuccucaagaucaccaaccuccgcgucaaccucacccgccuccacacccucggcgacaaccuccucgacccccgccgcgagauccgcgagaaguacuacuacgcccucuacgagcucgucguccgcggcaacugcuucugcuacggccacgccuccgagugcgcccccgcccccggcgcccccgcccacgccgagggcaugguccacggcgccugcaucugcaagcacaacacccgcggccucaacugcgagcagugccaggacuucuaccgcgaccuccccuggcgccccgccgaggacggccacucccacgccugccgcaagugcgagugccacggccacacccacuccugccacuucgacauggccgucuaccucgccuccggcaacgucuccggcggcgucugcgacggcugccagcacaacaccgccggccgccacugcgagcucugccgccccuucuucuaccgcgaccccaccaaggaccuccgcgaccccgccgucugccgcuccugcgacugcgaccccaugggcucccaggacggcggccgcugcgacucccacgacgaccccgcccucggccucgucuccggccagugccgcugcaaggagcacgucgucggcacccgcugccagcagugccgcgacggcuucuucggccucuccaucuccgaccgccucggcugccgccgcugccagugcaacgcccgcggcaccguccccggcuccacccccugcgaccccaacuccggcuccugcuacugcaagcgccucgucaccggccgcggcugcgaccgcugccuccccggccacuggggccucucccacgaccuccucggcugccgccccugcgacugcgacgucggcggcgcccucgacccccagugcgacgagggcaccggccagugccacugccgccagcacauggucggccgccgcugcgagcagguccagcccggcuacuuccgccccuuccucgaccaccucaucugggaggccgaggacacccgcggccagguccucgacgucgucgagcgccucgucacccccggcgagacccccuccuggaccggcuccggcuucguccgccuccaggagggccagacccucgaguuccucgucgccuccguccccaaggccauggacuacgaccuccuccuccgccucgagccccagguccccgagcagugggccgagcucgagcucaucguccagcgccccggccccguccccgcccacucccucugcggccaccucguccccaaggacgaccgcauccagggcacccuccagccccacgcccgcuaccucaucuuccccaaccccgucugccucgagcccggcaucuccuacaagcuccaccucaagcucguccgcaccggcggcuccgcccagcccgagacccccuacuccggccccggccuccucaucgacucccucguccuccucccccgcguccucguccucgagauguucuccggcggcgacgccgccgcccucgagcgccaggccaccuucgagcgcuaccagugccacgaggagggccucguccccuccaagaccucccccuccgaggccugcgccccccuccucaucucccucuccacccucaucuacaacggcgcccuccccugccagugcaacccccagggcucccucuccuccgagugcaacccccacggcggccagugccucugcaagcccggcgucgucggccgccgcugcgaccucugcgcccccggcuacuacggcuucggccccaccggcugccaggccugccagugcucccacgagggcgcccucuccucccucugcgagaagaccuccggccagugccucugccgcaccggcgccuucggccuccgcugcgaccgcugccagcgcggccaguggggcuuccccuccugccgccccugcgucugcaacggccacgccgacgagugcaacacccacaccggcgccugccucggcugccgcgaccacaccggcggcgagcacugcgagcgcugcaucgccggcuuccacggcgacccccgccuccccuacggcggccagugccgccccugccccugccccgagggccccggcucccagcgccacuucgccaccuccugccaccaggacgaguacucccagcagaucgucugccacugccgcgccggcuacaccggccuccgcugcgaggccugcgcccccggccacuucggcgaccccucccgccccggcggccgcugccagcucugcgagugcuccggcaacaucgaccccauggaccccgacgccugcgacccccacaccggccagugccuccgcugccuccaccacaccgagggcccccacugcgcccacugcaagcccggcuuccacggccaggccgcccgccaguccugccaccgcugcaccugcaaccuccucggcaccaacccccagcagugccccucccccgaccagugccacugcgaccccuccuccggccagugccccugccuccccaacguccagggccccuccugcgaccgcugcgcccccaacuucuggaaccucaccuccggccacggcugccagcccugcgccugccaccccucccgcgcccgcggccccaccugcaacgaguucaccggccagugccacugccgcgccggcuucggcggccgcaccugcuccgagugccaggagcuccacuggggcgaccccggccuccagugccacgccugcgacugcgacucccgcggcaucgacaccccccagugccaccgcuucaccggccacugcuccugccgccccggcgucuccggcguccgcugcgaccagugcgcccgcggcuucuccggcaucuuccccgccugccaccccugccacgccugcuucggcgacugggaccgcgucguccaggaccucgccgcccgcacccagcgccucgagcagcgcgcccaggagcuccagcagaccggcguccucggcgccuucgaguccuccuucuggcacaugcaggagaagcucggcaucguccagggcaucgucggcgcccgcaacaccuccgccgccuccaccgcccagcucgucgaggccaccgaggagcuccgccgcgagaucggcgaggccaccgagcaccucacccagcucgaggccgaccucaccgacguccaggacgagaacuucaacgccaaccacgcccucuccggccucgagcgcgaccgccucgcccucaaccucacccuccgccagcucgaccagcaccucgaccuccucaagcacuccaacuuccucggcgccuacgacuccauccgccacgcccacucccaguccgccgaggccgagcgccgcgccaacaccuccgcccucgccguccccucccccgucuccaacuccgccuccgcccgccaccgcaccgaggcccucauggacgcccagaaggaggacuucaacuccaagcacauggccaaccagcgcgcccucggcaagcucuccgcccacacccacacccucucccucaccgacaucaacgagcucgucugcggcgcccccggcgacgcccccugcgccaccucccccugcggcggcgccggcugccgcgacgaggacggccagccccgcugcggcggccucuccugcaacggcgccgccgccaccgccgaccucgcccucggccgcgcccgccacacccaggccgagcuccagcgcgcccucgccgagggcggcuccauccucucccgcgucgccgagacccgccgccaggccuccgaggcccagcagcgcgcccaggccgcccucgacaaggccaacgccucccgcggccaggucgagcaggccaaccaggagcuccaggagcucauccaguccgucaaggacuuccucaaccaggagggcgccgaccccgacuccaucgagauggucgccacccgcguccucgagcucuccauccccgccuccgccgagcagauccagcaccucgccggcgccaucgccgagcgcguccgcucccucgccgacgucgacgccauccucgcccgcaccgucggcgacguccgccgcgccgagcagcuccuccaggacgcccgccgcgcccgcuccugggccgaggacgagaagcagaaggccgagaccguccaggccgcccucgaggaggcccagcgcgcccagggcaucgcccagggcgccauccgcggcgccgucgccgacacccgcgacaccgagcagacccucuaccagguccaggagcgcauggccggcgccgagcgcgcccucuccuccgccggcgagcgcgcccgccagcucgacgcccuccucgaggcccucaagcucaagcgcgccggcaacucccucgccgccuccaccgccgaggagaccgccggcuccgcccagggccgcgcccaggaggccgagcagcuccuccgcggcccccucggcgaccaguaccagaccgucaaggcccucgccgagcgcaaggcccagggcguccucgccgcccaggcccgcgccgagcagcuccgcgacgaggcccgcgaccuccuccaggccgcccaggacaagcuccagcgccuccaggagcucgagggcaccuacgaggagaacgagcgcgcccucgaguccaaggccgcccagcucgacggccucgaggcccgcaugcgcuccguccuccaggccaucaaccuccagguccagaucuacaacaccugccaguga

SEQ ID NO: 45251 - RNA, 3519 nt, Artificial Sequence
  derived and/or modified sequence opt2 from LAMB3__Homo_sapiens__NP_001121113
augcgccccuucuuccuccucugcuucgcccuccccggccuccuccacgcccagcaggccugcucccgcggcgccugcuacccccccgucggcgaccuccucgucggccgcacccgcuuccuccgcgccuccuccaccugcggccucaccaagcccgagaccuacugcacccaguacggcgaguggcagaugaagugcugcaagugcgacucccgccagccccacaacuacuacucccaccgcgucgagaacgucgccuccuccuccggccccaugcgcugguggcagucccagaacgacgucaaccccgucucccuccagcucgaccucgaccgccgcuuccagcuccaggaggucaugauggaguuccagggccccaugcccgccggcaugcucaucgagcgcuccuccgacuucggcaagaccuggcgcgucuaccaguaccucgccgccgacugcaccuccaccuucccccgcguccgccagggccgcccccaguccuggcaggacguccgcugccagucccucccccagcgccccaacgcccgccucaacggcggcaagguccagcucaaccucauggaccucgucuccggcauccccgccacccagucccagaagauccaggaggucggcgagaucaccaaccuccgcgucaacuucacccgccucgcccccgucccccagcgcggcuaccacccccccuccgccuacuacgccgucucccagcuccgccuccagggcuccugcuucugccacggccacgccgaccgcugcgcccccaagcccggcgccuccgccggccccuccaccgccguccagguccacgacgucugcgucugccagcacaacaccgccggccccaacugcgagcgcugcgcccccuucuacaacaaccgccccuggcgccccgccgagggccaggacgcccacgagugccagcgcugcgacugcaacggccacuccgagaccugccacuucgaccccgccgucuucgccgccucccagggcgccuacggcggcgucugcgacaacugccgcgaccacaccgagggcaagaacugcgagcgcugccagcuccacuacuuccgcaaccgccgccccggcgccuccauccaggagaccugcaucuccugcgagugcgaccccgacggcgccguccccggcgcccccugcgaccccgucaccggccagugcgucugcaaggagcacguccagggcgagcgcugcgaccucugcaagcccggcuucaccggccucaccuacgccaacccccagggcugccaccgcugcgacugcaacauccucggcucccgccgcgacaugcccugcgacgaggaguccggccgcugccucugccuccccaacgucgucggccccaagugcgaccagugcgcccccuaccacuggaagcucgccuccggccagggcugcgagcccugcgccugcgacccccacaacucccucuccccccagugcaaccaguucaccggccagugccccugccgcgagggcuucggcggccucaugugcuccgccgccgccauccgccagugccccgaccgcaccuacggcgacgucgccaccggcugccgcgccugcgacugcgacuuccgcggcaccgagggccccggcugcgacaaggccuccggccgcugccucugccgccccggccucaccggcccccgcugcgaccagugccagcgcggcuacugcaaccgcuaccccgucugcgucgccugccaccccugcuuccagaccuacgacgccgaccuccgcgagcaggcccuccgcuucggccgccuccgcaacgccaccgccucccucugguccggccccggccucgaggaccgcggccucgccucccgcauccucgacgccaaguccaagaucgagcagauccgcgccguccucuccucccccgccgucaccgagcaggaggucgcccaggucgccuccgccauccucucccuccgccgcacccuccagggccuccagcucgaccucccccucgaggaggagacccucucccucccccgcgaccucgagucccucgaccgcuccuucaacggccuccucaccauguaccagcgcaagcgcgagcaguucgagaagaucuccuccgccgaccccuccggcgccuuccgcaugcucuccaccgccuacgagcaguccgcccaggccgcccagcaggucuccgacuccucccgccuccucgaccagcuccgcgacucccgccgcgaggccgagcgccucguccgccaggccggcggcggcggcggcaccggcucccccaagcucgucgcccuccgccucgagauguccucccuccccgaccucacccccaccuucaacaagcucugcggcaacucccgccagauggccugcacccccaucuccugccccggcgagcucugcccccaggacaacggcaccgccugcggcucccgcugccgcggcguccucccccgcgccggcggcgccuuccucauggccggccaggucgccgagcagcuccgcggcuucaacgcccagcuccagcgcacccgccagaugauccgcgccgccgaggaguccgccucccagauccaguccuccgcccagcgccucgagacccaggucuccgccucccgcucccagauggaggaggacguccgccgcacccgccuccucauccagcagguccgcgacuuccucaccgaccccgacaccgacgccgccaccauccaggaggucuccgaggccguccucgcccucuggcuccccaccgacuccgccaccguccuccagaagaugaacgagauccaggccaucgccgcccgccuccccaacgucgaccucguccucucccagaccaagcaggacaucgcccgcgcccgccgccuccaggccgaggccgaggaggcccgcucccgcgcccacgccgucgagggccaggucgaggacgucgucggcaaccuccgccagggcaccgucgcccuccaggaggcccaggacaccaugcagggcaccucccgcucccuccgccucauccaggaccgcgucgccgagguccagcagguccuccgccccgccgagaagcucgucaccuccaugaccaagcagcucggcgacuucuggacccgcauggaggagcuccgccaccaggcccgccagcagggcgccgaggccguccaggcccagcagcucgccgagggcgccuccgagcaggcccucuccgcccaggagggcuucgagcgcaucaagcagaaguacgccgagcucaaggaccgccucggccaguccuccaugcucggcgagcagggcgcccgcauccaguccgucaagaccgaggccgaggagcucuucggcgagaccauggagaugauggaccgcaugaaggacauggagcucgagcuccuccgcggcucccaggccaucaugcuccgcuccgccgaccucaccggccucgagaagcgcgucgagcagauccgcgaccacaucaacggccgcguccucuacuacgccaccugcaaguga

SEQ ID NO: 45252 - RNA, 5286 nt, Artificial Sequence
  derived and/or modified sequence opt2 from LAMB4__Homo_sapiens__NP_031382
augcaguuccagcucacccucuuccuccaccucggcuggcucuccuacuccaaggcccaggacgacugcaaccgcggcgccugccaccccaccaccggcgaccuccucgucggccgcaacacccagcucauggccuccuccaccugcggccucucccgcgcccagaaguacugcauccucuccuaccucgagggcgagcagaagugcuucaucugcgacucccgcuuccccuacgaccccuacgaccagcccaacucccacaccaucgagaacgucaucgucuccuucgagcccgaccgcgagaagaagugguggcaguccgagaacggccucgaccacgucuccauccgccucgaccucgaggcccucuuccgcuucucccaccucauccucaccuucaagaccuuccgccccgccgccaugcucgucgagcgcuccaccgacuacggccacaacuggaaggucuucaaguacuucgccaaggacugcgccaccuccuuccccaacaucaccuccggccaggcccagggcgucggcgacaucgucugcgacuccaaguacuccgacaucgagcccuccaccggcggcgaggucguccucaagguccucgaccccuccuucgagaucgagaaccccuacucccccuacauccaggaccucgucacccucaccaaccuccgcaucaacuucaccaagcuccacacccucggcgacgcccuccucggccgccgccagaacgacucccucgacaaguacuacuacgcccucuacgagaugaucguccgcggcuccugcuucugcaacggccacgccuccgagugccgccccaugcagaagaugcgcggcgacgucuucuccccccccggcaugguccacggccagugcgucugccagcacaacaccgacggccccaacugcgagcgcugcaaggacuucuuccaggacgcccccuggcgccccgccgccgaccuccaggacaacgccugccgcuccugcuccugcaacucccacuccucccgcugccacuucgacaugaccaccuaccucgccuccggcggccucuccggcggcgucugcgaggacugccagcacaacaccgagggccagcacugcgaccgcugccgcccccucuucuaccgcgacccccucaagaccaucuccgaccccuacgccugcauccccugcgagugcgaccccgacggcaccaucuccggcggcaucugcgucucccacuccgaccccgcccucggcuccgucgccggccagugccucugcaaggagaacgucgagggcgccaagugcgaccagugcaagcccaaccacuacggccucuccgccaccgacccccucggcugccagcccugcgacugcaacccccucggcucccuccccuuccucaccugcgacgucgacaccggccagugccucugccucuccuacgucaccggcgcccacugcgaggagugcaccgucggcuacuggggccucggcaaccaccuccacggcugcucccccugcgacugcgacaucggcggcgccuacuccaacgucugcucccccaagaacggccagugcgagugccgcccccacgucaccggccgcuccugcuccgagcccgcccccggcuacuucuucgccccccucaacuucuaccucuacgaggccgaggaggccaccacccuccagggccucgccccccucggcuccgagaccuucggccagucccccgccguccacgucguccucggcgagcccguccccggcaaccccgucaccuggaccggccccggcuucgcccgcguccuccccggcgccggccuccgcuucgccgucaacaacauccccuuccccgucgacuucaccaucgccauccacuacgagacccaguccgccgccgacuggaccguccagaucgucgucaacccccccggcggcuccgagcacugcauccccaagacccuccaguccaagccccaguccuucgcccuccccgccgccacccgcaucaugcuccuccccacccccaucugccucgagcccgacguccaguacuccaucgacgucuacuucucccagccccuccagggcgagucccacgcccacucccacguccucgucgacucccucggccucaucccccagaucaacucccucgagaacuucugcuccaagcaggaccucgacgaguaccagcuccacaacugcgucgagaucgccuccgccaugggcccccagguccuccccggcgccugcgagcgccucaucaucuccauguccgccaagcuccacgacggcgccgucgccugcaagugccacccccagggcuccgucggcuccuccugcucccgccucggcggccagugccagugcaagccccucgucgucggccgcugcugcgaccgcugcuccaccggcuccuacgaccucggccaccacggcugccaccccugccacugccacccccagggcuccaaggacaccgucugcgaccaggucaccggccagugccccugccacggcgaggucuccggccgccgcugcgaccgcugccucgccggcuacuucggcuuccccuccugccaccccugccccugcaaccgcuucgccgagcucugcgaccccgagaccggcuccugcuucaacugcggcggcuucaccaccggccgcaacugcgagcgcugcaucgacggcuacuacggcaaccccuccuccggccagcccugccgccccugccucugccccgacgaccccuccuccaaccaguacuucgcccacuccugcuaccagaaccucugguccuccgacgucaucugcaacugccuccagggcuacaccggcacccagugcggcgagugcuccaccggcuucuacggcaacccccgcaucuccggcgcccccugccagcccugcgccugcaacaacaacaucgacgucaccgaccccgaguccugcucccgcgucaccggcgagugccuccgcugccuccacaacacccagggcgccaacugccagcucugcaagcccggccacuacggcuccgcccucaaccagaccugccgccgcugcuccugccacgccuccggcgucucccccauggagugcccccccggcggcggcgccugccucugcgaccccgucaccggcgccugccccugccuccccaacgucaccggccucgccugcgaccgcugcgccgacggcuacuggaaccucguccccggccgcggcugccaguccugcgacugcgacccccgcaccucccaguccucccacugcgaccagcucaccggccagugccccugcaagcucggcuacggcggcaagcgcugcuccgagugccaggagaacuacuacggcgacccccccggccgcugcauccccugcgacugcaaccgcgccggcacccagaagcccaucugcgaccccgacaccggcaugugccgcugccgcgagggcgucuccggccagcgcugcgaccgcugcgcccgcggccacucccaggaguuccccaccugccuccagugccaccucugcuucgaccagugggaccacaccaucuccucccucuccaaggccguccagggccucaugcgccucgccgccaacauggaggacaagcgcgagacccuccccgucugcgaggccgacuucaaggaccuccgcggcaacgucuccgagaucgagcgcauccucaagcaccccgucuuccccuccggcaaguuccucaaggucaaggacuaccacgacuccguccgccgccagaucaugcagcucaacgagcagcucaaggccgucuacgaguuccaggaccucaaggacaccaucgagcgcgccaagaacgaggccgaccuccuccucgaggaccuccaggaggagaucgaccuccaguccuccguccucaacgccuccaucgccgacuccuccgagaacaucaagaaguacuaccacaucuccuccuccgccgagaagaagaucaacgagaccuccuccaccaucaacaccuccgccaacacccgcaacgaccuccucaccauccucgacacccucaccuccaagggcaaccucucccucgagcgccucaagcagaucaagauccccgacauccagauccucaacgagaaggucugcggcgaccccggcaacguccccugcgucccccuccccugcggcggcgcccucugcaccggccgcaagggccaccgcaagugccgcggccccggcugccacggcucccucacccucuccaccaacgcccuccagaaggcccaggaggccaaguccaucauccgcaaccucgacaagcagguccgcggccucaagaaccagaucgaguccaucuccgagcaggccgaggucuccaagaacaacgcccuccagcuccgcgagaagcucggcaacauccgcaaccaguccgacuccgaggaggagaacaucaaccucuucaucaagaaggucaagaacuuccuccucgaggagaacgucccccccgaggacaucgagaaggucgccaacggcguccucgacauccaccuccccauccccucccagaaccucaccgacgagcucgucaagauccagaagcacaugcagcucugcgaggacuaccgcaccgacgagaaccgccucaacgaggaggccgacggcgcccagaagcuccucgucaaggccaaggccgccgagaaggccgccaacauccuccucaaccucgacaagacccucaaccagcuccagcaggcccagaucacccagggccgcgccaacuccaccaucacccagcucaccgccaacaucaccaagaucaagaagaacguccuccaggccgagaaccagacccgcgagaugaaguccgagcucgagcucgccaagcagcgcuccggccucgaggacggccucucccuccuccagaccaagcuccagcgccaccaggaccacgccgucaacgccaagguccaggccgaguccgcccagcaccaggccggcucccucgagaaggaguucgucgagcucaagaagcaguacgccauccuccagcgcaagaccuccaccaccggccucaccaaggagacccucggcaaggucaagcagcucaaggacgccgccgagaagcucgccggcgacaccgaggccaagauccgccgcaucaccgaccucgagcgcaagauccaggaccucaaccucucccgccaggccaaggccgaccagcuccgcauccucgaggaccaggucgucgccaucaagaacgagaucgucgagcaggagaagaaguacgcccgcugcuacuccuga

SEQ ID NO: 45253 - RNA, 4830 nt, Artificial Sequence
  derived and/or modified sequence opt2 from LAMC1__Homo_sapiens__NP_002284
augcgcggcucccaccgcgccgcccccgcccuccgcccccgcggccgccucuggcccguccucgccguccucgccgccgccgccgccgccggcugcgcccaggccgccauggacgagugcaccgacgagggcggccgcccccagcgcugcaugcccgaguucgucaacgccgccuucaacgucaccgucgucgccaccaacaccugcggcaccccccccgaggaguacugcguccagaccggcgucaccggcgucaccaaguccugccaccucugcgacgccggccagccccaccuccagcacggcgccgccuuccucaccgacuacaacaaccaggccgacaccaccugguggcagucccagaccaugcucgccggcguccaguaccccuccuccaucaaccucacccuccaccucggcaaggccuucgacaucaccuacguccgccucaaguuccacaccucccgccccgaguccuucgccaucuacaagcgcacccgcgaggacggccccuggauccccuaccaguacuacuccggcuccugcgagaacaccuacuccaaggccaaccgcggcuucauccgcaccggcggcgacgagcagcaggcccucugcaccgacgaguucuccgacaucuccccccucaccggcggcaacgucgccuucuccacccucgagggccgccccuccgccuacaacuucgacaacucccccguccuccaggagugggucaccgccaccgacauccgcgucacccucaaccgccucaacaccuucggcgacgaggucuucaacgaccccaagguccucaaguccuacuacuacgccaucuccgacuucgccgucggcggccgcugcaagugcaacggccacgccuccgagugcaugaagaacgaguucgacaagcucgucugcaacugcaagcacaacaccuacggcgucgacugcgagaagugccuccccuucuucaacgaccgccccuggcgccgcgccaccgccgaguccgccuccgagugccuccccugcgacugcaacggccgcucccaggagugcuacuucgaccccgagcucuaccgcuccaccggccacggcggccacugcaccaacugccaggacaacaccgacggcgcccacugcgagcgcugccgcgagaacuucuuccgccucggcaacaacgaggccugcuccuccugccacugcucccccgucggcucccucuccacccagugcgacuccuacggccgcugcuccugcaagcccggcgucaugggcgacaagugcgaccgcugccagcccggcuuccacucccucaccgaggccggcugccgccccugcuccugcgaccccuccggcuccaucgacgagugcaacaucgagaccggccgcugcgucugcaaggacaacgucgagggcuucaacugcgagcgcugcaagcccggcuucuucaaccucgaguccuccaacccccgcggcugcacccccugcuucugcuucggccacuccuccgucugcaccaacgccgucggcuacuccgucuacuccaucuccuccaccuuccagaucgacgaggacggcuggcgcgccgagcagcgcgacggcuccgaggccucccucgagugguccuccgagcgccaggacaucgccgucaucuccgacuccuacuucccccgcuacuucaucgcccccgccaaguuccucggcaagcagguccucuccuacggccagaaccucuccuucuccuuccgcgucgaccgccgcgacacccgccucuccgccgaggaccucguccucgagggcgccggccuccgcgucuccgucccccucaucgcccagggcaacuccuaccccuccgagaccaccgucaaguacgucuuccgccuccacgaggccaccgacuaccccuggcgccccgcccucacccccuucgaguuccagaagcuccucaacaaccucaccuccaucaagauccgcggcaccuacuccgagcgcuccgccggcuaccucgacgacgucacccucgccuccgcccgccccggccccggcguccccgccaccugggucgaguccugcaccugccccgucggcuacggcggccaguucugcgagaugugccucuccggcuaccgccgcgagacccccaaccucggccccuacucccccugcguccucugcgccugcaacggccacuccgagaccugcgaccccgagaccggcgucugcaacugccgcgacaacaccgccggcccccacugcgagaagugcuccgacggcuacuacggcgacuccaccgccggcaccuccuccgacugccagcccugccccugccccggcggcuccuccugcgccgucguccccaagaccaaggaggucgucugcaccaacugccccaccggcaccaccggcaagcgcugcgagcucugcgacgacggcuacuucggcgacccccucggccgcaacggccccguccgccucugccgccucugccagugcuccgacaacaucgaccccaacgccgucggcaacugcaaccgccucaccggcgagugccucaagugcaucuacaacaccgccggcuucuacugcgaccgcugcaaggacggcuucuucggcaacccccucgcccccaaccccgccgacaagugcaaggccugcaacugcaaccucuacggcaccaugaagcagcaguccuccugcaaccccgucaccggccagugcgagugccucccccacgucaccggccaggacugcggcgccugcgaccccggcuucuacaaccuccaguccggccagggcugcgagcgcugcgacugccacgcccucggcuccaccaacggccagugcgacauccgcaccggccagugcgagugccagcccggcaucaccggccagcacugcgagcgcugcgaggucaaccacuucggcuucggccccgagggcugcaagcccugcgacugccaccccgagggcucccucucccuccagugcaaggacgacggccgcugcgagugccgcgagggcuucgucggcaaccgcugcgaccagugcgaggagaacuacuucuacaaccgcuccuggcccggcugccaggagugccccgccugcuaccgccucgucaaggacaaggucgccgaccaccgcgucaagcuccaggagcucgagucccucaucgccaaccucggcaccggcgacgagauggucaccgaccaggccuucgaggaccgccucaaggaggccgagcgcgaggucauggaccuccuccgcgaggcccaggacgucaaggacgucgaccagaaccucauggaccgccuccagcgcgucaacaacacccucuccucccagaucucccgccuccagaacauccgcaacaccaucgaggagaccggcaaccucgccgagcaggcccgcgcccacgucgagaacaccgagcgccucaucgagaucgccucccgcgagcucgagaaggccaaggucgccgccgccaacgucuccgucacccagcccgaguccaccggcgaccccaacaacaugacccuccucgccgaggaggcccgcaagcucgccgagcgccacaagcaggaggccgacgacaucguccgcgucgccaagaccgccaacgacaccuccaccgaggccuacaaccuccuccuccgcacccucgccggcgagaaccagaccgccuucgagaucgaggagcucaaccgcaaguacgagcaggccaagaacaucucccaggaccucgagaagcaggccgcccgcguccacgaggaggccaagcgcgccggcgacaaggccgucgagaucuacgccuccgucgcccagcucuccccccucgacuccgagacccucgagaacgaggccaacaacaucaagauggaggccgagaaccucgagcagcucaucgaccagaagcucaaggacuacgaggaccuccgcgaggacaugcgcggcaaggagcucgaggucaagaaccuccucgagaagggcaagaccgagcagcagaccgccgaccagcuccucgcccgcgccgacgccgccaaggcccucgccgaggaggccgccaagaagggccgcgacacccuccaggaggccaacgacauccucaacaaccucaaggacuucgaccgccgcgucaacgacaacaagaccgccgccgaggaggcccuccgcaagauccccgccaucaaccagaccaucaccgaggccaacgagaagacccgcgaggcccagcaggcccucggcuccgccgccgccgacgccaccgaggccaagaacaaggcccacgaggccgagcgcaucgccuccgccguccagaagaacgccaccuccaccaaggccgaggccgagcgcaccuucgccgaggucaccgaccucgacaacgaggucaacaacaugcucaagcagcuccaggaggccgagaaggagcucaagcgcaagcaggacgacgccgaccaggacaugaugauggccggcauggccucccaggccgcccaggaggccgagaucaacgcccgcaaggccaagaacuccgucaccucccuccucuccaucaucaacgaccuccucgagcagcucggccagcucgacaccgucgaccucaacaagcucaacgagaucgagggcacccucaacaaggccaaggacgagaugaaggucuccgaccucgaccgcaaggucuccgaccucgagaacgaggccaagaagcaggaggccgccaucauggacuacaaccgcgacaucgaggagaucaugaaggacauccgcaaccucgaggacauccgcaagacccuccccuccggcugcuucaacacccccuccaucgagaagcccuga

SEQ ID NO: 45254 - RNA, 3582 nt, Artificial Sequence
  derived and/or modified sequence opt2 from LAMC2__Homo_sapiens__NP_005553
augcccgcccucuggcucggcugcugccucugcuucucccuccuccuccccgccgcccgcgccaccucccgccgcgaggucugcgacugcaacggcaagucccgccagugcaucuucgaccgcgagcuccaccgccagaccggcaacggcuuccgcugccucaacugcaacgacaacaccgacggcauccacugcgagaagugcaagaacggcuucuaccgccaccgcgagcgcgaccgcugccuccccugcaacugcaacuccaagggcucccucuccgcccgcugcgacaacuccggccgcugcuccugcaagcccggcgucaccggcgcccgcugcgaccgcugccuccccggcuuccacaugcucaccgacgccggcugcacccaggaccagcgccuccucgacuccaagugcgacugcgaccccgccggcaucgccggccccugcgacgccggccgcugcgucugcaagcccgccgucaccggcgagcgcugcgaccgcugccgcuccggcuacuacaaccucgacggcggcaaccccgagggcugcacccagugcuucugcuacggccacuccgccuccugccgcuccuccgccgaguacuccguccacaagaucaccuccaccuuccaccaggacgucgacggcuggaaggccguccagcgcaacggcucccccgccaagcuccaguggucccagcgccaccaggacgucuucuccuccgcccagcgccucgaccccgucuacuucgucgcccccgccaaguuccucggcaaccagcaggucuccuacggccagucccucuccuucgacuaccgcgucgaccgcggcggccgccaccccuccgcccacgacgucauccucgagggcgccggccuccgcaucaccgccccccucaugccccucggcaagacccuccccugcggccucaccaagaccuacaccuuccgccucaacgagcaccccuccaacaacugguccccccagcucuccuacuucgaguaccgccgccuccuccgcaaccucaccgcccuccgcauccgcgccaccuacggcgaguacuccaccggcuacaucgacaacgucacccucaucuccgcccgccccgucuccggcgcccccgcccccugggucgagcagugcaucugccccgucggcuacaagggccaguucugccaggacugcgccuccggcuacaagcgcgacuccgcccgccucggccccuucggcaccugcauccccugcaacugccagggcggcggcgccugcgaccccgacaccggcgacugcuacuccggcgacgagaaccccgacaucgagugcgccgacugccccaucggcuucuacaacgacccccacgacccccgcuccugcaagcccugccccugccacaacggcuucuccugcuccgucaugcccgagaccgaggaggucgucugcaacaacugcccccccggcgucaccggcgcccgcugcgagcucugcgccgacggcuacuucggcgaccccuucggcgagcacggccccguccgccccugccagcccugccagugcaacaacaacgucgaccccuccgccuccggcaacugcgaccgccucaccggccgcugccucaagugcauccacaacaccgccggcaucuacugcgaccagugcaaggccggcuacuucggcgacccccucgcccccaaccccgccgacaagugccgcgccugcaacugcaaccccaugggcuccgagcccgucggcugccgcuccgacggcaccugcgucugcaagcccggcuucggcggccccaacugcgagcacggcgccuucuccugccccgccugcuacaaccaggucaagauccagauggaccaguucaugcagcagcuccagcgcauggaggcccucaucuccaaggcccagggcggcgacggcgucguccccgacaccgagcucgagggccgcaugcagcaggccgagcaggcccuccaggacauccuccgcgacgcccagaucuccgagggcgccucccgcucccucggccuccagcucgccaagguccgcucccaggagaacuccuaccagucccgccucgacgaccucaagaugaccgucgagcgcguccgcgcccucggcucccaguaccagaaccgcguccgcgacacccaccgccucaucacccagaugcagcucucccucgccgaguccgaggccucccucggcaacaccaacauccccgccuccgaccacuacgucggccccaacggcuucaagucccucgcccaggaggccacccgccucgccgagucccacgucgaguccgccuccaacauggagcagcucacccgcgagaccgaggacuacuccaagcaggcccucucccucguccgcaaggcccuccacgagggcgucggcuccggcuccggcucccccgacggcgccgucguccagggccucgucgagaagcucgagaagaccaagucccucgcccagcagcucacccgcgaggccacccaggccgagaucgaggccgaccgcuccuaccagcacucccuccgccuccucgacuccgucucccgccuccagggcgucuccgaccaguccuuccaggucgaggaggccaagcgcaucaagcagaaggccgacucccucuccucccucgucacccgccacauggacgaguucaagcgcacccagaagaaccucggcaacuggaaggaggaggcccagcagcuccuccagaacggcaaguccggccgcgagaaguccgaccagcuccucucccgcgccaaccucgccaagucccgcgcccaggaggcccucuccaugggcaacgccaccuucuacgaggucgaguccauccucaagaaccuccgcgaguucgaccuccaggucgacaaccgcaaggccgaggccgaggaggccaugaagcgccucuccuacaucucccagaaggucuccgacgccuccgacaagacccagcaggccgagcgcgcccucggcuccgccgccgccgacgcccagcgcgccaagaacggcgccggcgaggcccucgagaucuccuccgagaucgagcaggagaucggcucccucaaccucgaggccaacgucaccgccgacggcgcccucgccauggagaagggccucgccucccucaaguccgagaugcgcgaggucgagggcgagcucgagcgcaaggagcucgaguucgacaccaacauggacgccguccagauggucaucaccgaggcccagaaggucgacacccgcgccaagaacgccggcgucaccauccaggacacccucaacacccucgacggccuccuccaccucauggaccagccccucuccgucgacgaggagggccucguccuccucgagcagaagcucucccgcgccaagacccagaucaacucccagcuccgccccaugauguccgagcucgaggagcgcgcccgccagcagcgcggccaccuccaccuccucgagaccuccaucgacggcauccucgccgacgucaagaaccucgagaacauccgcgacaaccucccccccggcugcuacaacacccaggcccucgagcagcaguga

SEQ ID NO: 45255 - RNA, 4728 nt, Artificial Sequence
  derived and/or modified sequence opt2 from LAMC3__Homo_sapiens__NP_006050
auggccgccgccgcccuccuccucggccucgcccuccucgccccccgcgccgccggcgccggcaugggcgccugcuacgacggcgccggccgcccccagcgcugccuccccgucuucgagaacgccgccuucggccgccucgcccaggccucccacaccugcggcuccccccccgaggacuucugcccccacgucggcgccgccggcgccggcgcccacugccagcgcugcgacgccgccgacccccagcgccaccacaacgccuccuaccucaccgacuuccacucccaggacgaguccaccugguggcagucccccuccauggccuucggcguccaguaccccaccuccgucaacaucacccuccgccucggcaaggccuacgagaucaccuacguccgccucaaguuccacaccucccgccccgaguccuucgccaucuacaagcgcucccgcgccgacggccccugggagcccuaccaguucuacuccgccuccugccagaagaccuacggccgccccgagggccaguaccuccgccccggcgaggacgagcgcgucgccuucugcaccuccgaguucuccgacaucuccccccucuccggcggcaacgucgccuucuccacccucgagggccgccccuccgccuacaacuucgaggagucccccggccuccaggagugggucaccuccaccgagcuccucaucucccucgaccgccucaacaccuucggcgacgacaucuucaaggaccccaagguccuccaguccuacuacuacgccgucuccgacuucuccgucggcggccgcugcaagugcaacggccacgccuccgagugcggccccgacgucgccggccagcucgccugccgcugccagcacaacaccaccggcaccgacugcgagcgcugccuccccuucuuccaggaccgccccugggcccgcggcaccgccgaggccgcccacgagugccuccccugcaacugcuccggccgcuccgaggagugcaccuucgaccgcgagcucuuccgcuccaccggccacggcggccgcugccaccacugccgcgaccacaccgccggcccccacugcgagcgcugccaggagaacuucuaccacugggacccccgcaugcccugccagcccugcgacugccaguccgccggcucccuccaccuccagugcgacgacaccggcaccugcgccugcaagcccaccgucaccggcuggaagugcgaccgcugccuccccggcuuccacucccucuccgagggcggcugccgccccugcaccugcaaccccgccggcucccucgacaccugcgacccccgcuccggccgcugccccugcaaggagaacgucgagggcaaccucugcgaccgcugccgccccggcaccuucaaccuccagccccacaaccccgccggcugcuccuccugcuucugcuacggccacuccaaggucugcgccuccaccgcccaguuccagguccaccacauccucuccgacuuccaccagggcgccgagggcuggugggcccgcuccgucggcggcuccgagcaccccccccaguggucccccaacggcguccuccucucccccgaggacgaggaggagcucaccgcccccgagaaguuccucggcgaccagcgcuucuccuacggccagccccucauccucaccuuccgcgucccccccggcgacuccccccuccccguccagcuccgccucgagggcaccggccucgcccucucccuccgccacuccucccucuccggcccccaggacgccggccacccccgcgaggucgagcuccgcuuccaccuccaggagaccuccgaggacgucgcccccccccucccccccuuccacuuccagcgccuccucgccaaccucaccucccuccgccuccgcgucucccccggccccucccccgccggccccgucuuccucaccgagguccgccucaccuccgcccgccccggccucuccccccccgccuccugggucgagaucugcuccugccccaccggcuacaccggccaguucugcgaguccugcgcccccggcuacaagcgcgagaugccccagggcggccccuacgccuccugcguccccugcaccugcaaccagcacggcaccugcgaccccaacaccggcaucugcgucugcucccaccacaccgagggccccuccugcgagcgcugccuccccggcuucuacggcaaccccuucgccggccaggccgacgacugccagcccugccccugccccggccaguccgccugcaccaccauccccgagucccgcgaggucgucugcacccacugcccccccggccagcgcggccgccgcugcgaggucugcgacgacggcuucuucggcgacccccucggccucuucggccacccccagcccugccaccagugccagugcuccggcaacgucgaccccaacgccgucggcaacugcgacccccucuccggccacugccuccgcugccuccacaacaccaccggcgaccacugcgagcacugccaggagggcuucuacggcuccgcccucgccccccgccccgccgacaagugcaugcccugcuccugccacccccagggcuccgucuccgagcagaugcccugcgaccccgucaccggccagugcuccugccucccccacgucaccgcccgcgacugcucccgcugcuaccccggcuucuucgaccuccagcccggccgcggcugccgcuccugcaagugccacccccucggcucccaggaggaccagugccaccccaagaccggccagugcaccugccgccccggcgucaccggccaggccugcgaccgcugccagcucggcuucuucggcuucuccaucaagggcugccgcgccugccgcugcuccccccucggcgccgccuccgcccagugccacgagaacggcaccugcgucugccgccccggcuucgagggcuacaagugcgaccgcugccacgacaacuucuuccucaccgccgacggcacccacugccagcagugccccuccugcuacgcccucgucaaggaggaggccgccaagcucaaggcccgccucacccucaccgagggcuggcuccagggcuccgacugcggcucccccuggggcccccucgacauccuccucggcgaggccccccgcggcgacgucuaccagggccaccaccuccuccccggcgcccgcgaggccuuccucgagcagaugaugucccucgagggcgccgucaaggccgcccgcgagcagcuccagcgccucaacaagggcgcccgcugcgcccaggccggcucccagaagaccugcacccagcucgccgaccucgaggccguccucgaguccuccgaggaggagauccuccacgccgccgccauccucgccucccucgagaucccccaggagggccccucccagcccaccaaguggucccaccucgccaccgaggcccgcgcccucgcccgcucccaccgcgacaccgccaccaagaucgccgccaccgccuggcgcgcccuccucgccuccaacaccuccuacgcccuccucuggaaccuccucgagggccgcgucgcccucgagacccagcgcgaccucgaggaccgcuaccaggagguccaggccgcccagaaggcccuccgcaccgccgucgccgagguccuccccgaggccgaguccguccucgccaccguccagcaggucggcgccgacaccgcccccuaccucgcccuccucgccucccccggcgcccucccccagaagucccgcgccgaggaccucggccucaaggccaaggcccucgagaagaccgucgccuccuggcagcacauggccaccgaggccgcccgcacccuccagaccgccgcccaggccacccuccgccagaccgagccccucaccaagcuccaccaggaggcccgcgccgcccucacccaggccuccuccuccguccaggccgccaccgucaccgucaugggcgcccgcacccuccucgccgaccucgagggcaugaagcuccaguucccccgccccaaggaccaggccgcccuccagcgcaaggccgacuccgucuccgaccgccuccucgccgacacccgcaagaagaccaagcaggccgagcgcaugcucggcaacgccgccccccucuccuccuccgccaagaagaagggccgcgaggccgagguccucgccaaggacuccgccaagcucgccaaggcccuccuccgcgagcgcaagcaggcccaccgccgcgccucccgccucaccucccagacccaggccacccuccagcaggccucccagcagguccucgccuccgaggcccgccgccaggagcucgaggaggccgagcgcgucggcgccggccucuccgagauggagcagcagauccgcgagucccgcaucucccucgagaaggacaucgagacccucuccgagcuccucgcccgccucggcucccucgacacccaccaggcccccgcccaggcccucaacgagacccagugggcccucgagcgccuccgccuccagcucggcucccccggcucccuccagcgcaagcucucccuccucgagcaggagucccagcagcaggagcuccagauccagggcuucgaguccgaccucgccgagauccgcgccgacaagcagaaccucgaggccauccuccacucccuccccgagaacugcgccuccuggcaguga

SEQ ID NO: 45256 - RNA, 1254 nt, Artificial Sequence
  derived and/or modified sequence opt2 from LAMP1__Homo_sapiens__NP_005552
auggccgcccccggcuccgcccgccgcccccuccuccuccuccuccuccuccuccuccucggccucaugcacugcgccuccgccgccauguucauggucaagaacggcaacggcaccgccugcaucauggccaacuucuccgccgccuucuccgucaacuacgacaccaaguccggccccaagaacaugaccuucgaccuccccuccgacgccaccgucguccucaaccgcuccuccugcggcaaggagaacaccuccgaccccucccucgucaucgccuucggccgcggccacacccucacccucaacuucacccgcaacgccacccgcuacuccguccagcucauguccuucgucuacaaccucuccgacacccaccucuuccccaacgccuccuccaaggagaucaagaccgucgaguccaucaccgacauccgcgccgacaucgacaagaaguaccgcugcgucuccggcacccagguccacaugaacaacgucaccgucacccuccacgacgccaccauccaggccuaccucuccaacuccuccuucucccgcggcgagacccgcugcgagcaggaccgccccucccccaccaccgccccccccgccccccccucccccucccccucccccguccccaagucccccuccgucgacaaguacaacgucuccggcaccaacggcaccugccuccucgccuccaugggccuccagcucaaccucaccuacgagcgcaaggacaacaccaccgucacccgccuccucaacaucaaccccaacaagaccuccgccuccggcuccugcggcgcccaccucgucacccucgagcuccacuccgagggcaccaccguccuccucuuccaguucggcaugaacgccuccuccucccgcuucuuccuccagggcauccagcucaacaccauccuccccgacgcccgcgaccccgccuucaaggccgccaacggcucccuccgcgcccuccaggccaccgucggcaacuccuacaagugcaacgccgaggagcacguccgcgucaccaaggccuucuccgucaacaucuucaaggucuggguccaggccuucaaggucgagggcggccaguucggcuccgucgaggagugccuccucgacgagaacuccaugcucauccccaucgccgucggcggcgcccucgccggccucguccucaucguccucaucgccuaccucgucggccgcaagcgcucccacgccggcuaccagaccaucuga

SEQ ID NO: 45257 - RNA, 1236 nt, Artificial Sequence
  derived and/or modified sequence opt2 from LAMP2__Homo_sapiens__NP_001116078
auggucugcuuccgccucuuccccguccccggcuccggccucguccucgucugccucguccucggcgccguccgcuccuacgcccucgagcucaaccucaccgacuccgagaacgccaccugccucuacgccaaguggcagaugaacuucaccguccgcuacgagaccaccaacaagaccuacaagaccgucaccaucuccgaccacggcaccgucaccuacaacggcuccaucugcggcgacgaccagaacggccccaagaucgccguccaguucggccccggcuucuccuggaucgccaacuucaccaaggccgccuccaccuacuccaucgacuccgucuccuucuccuacaacaccggcgacaacaccaccuuccccgacgccgaggacaagggcauccucaccgucgacgagcuccucgccauccgcaucccccucaacgaccucuuccgcugcaacucccucuccacccucgagaagaacgacgucguccagcacuacugggacguccucguccaggccuucguccagaacggcaccgucuccaccaacgaguuccucugcgacaaggacaagaccuccaccgucgcccccaccauccacaccaccguccccucccccaccaccacccccacccccaaggagaagcccgaggccggcaccuacuccgucaacaacggcaacgacaccugccuccucgccaccaugggccuccagcucaacaucacccaggacaaggucgccuccgucaucaacaucaaccccaacaccacccacuccaccggcuccugccgcucccacaccgcccuccuccgccucaacuccuccaccaucaaguaccucgacuucgucuucgccgucaagaacgagaaccgcuucuaccucaaggaggucaacaucuccauguaccucgucaacggcuccgucuucuccaucgccaacaacaaccucuccuacugggacgccccccucggcuccuccuacaugugcaacaaggagcagaccgucuccgucuccggcgccuuccagaucaacaccuucgaccuccgcguccagcccuucaacgucacccagggcaaguacuccaccgccgaggagugcuccgccgacuccgaccucaacuuccucauccccgucgccgucggcgucgcccucggcuuccucaucaucgucgucuucaucuccuacaugaucggccgccgcaagucccgcaccggcuaccaguccgucuga

SEQ ID NO: 45258 - RNA, 1251 nt, Artificial Sequence
  derived and/or modified sequence opt2 from LAMP3__Homo_sapiens__NP_055213
augccccgccagcucuccgccgccgccgcccucuucgccucccucgccgucauccuccacgacggcucccagaugcgcgccaaggccuuccccgagacccgcgacuacucccagcccaccgccgccgccaccguccaggacaucaagaagcccguccagcagcccgccaagcaggccccccaccagacccucgccgcccgcuucauggacggccacaucaccuuccagaccgccgccaccgucaagauccccaccaccacccccgccaccaccaagaacaccgccaccaccucccccaucaccuacacccucgucaccacccaggccacccccaacaacucccacaccgccccccccgucaccgaggucaccgucggccccucccucgcccccuacucccucccccccaccaucaccccccccgcccacaccaccggcaccuccuccuccaccgucucccacaccaccggcaacaccacccagcccuccaaccagaccacccuccccgccacccucuccaucgcccuccacaaguccaccaccggccagaagcccguccagcccacccacgcccccggcaccaccgccgccgcccacaacaccacccgcaccgccgcccccgccuccaccguccccggccccacccucgccccccagcccuccuccgucaagaccggcaucuaccagguccucaacggcucccgccucugcaucaaggccgagaugggcauccagcucaucguccaggacaaggaguccgucuucuccccccgccgcuacuucaacaucgaccccaacgccacccaggccuccggcaacugcggcacccgcaaguccaaccuccuccucaacuuccagggcggcuucgucaaccucaccuucaccaaggacgaggaguccuacuacaucuccgaggucggcgccuaccucaccgucuccgaccccgagaccaucuaccagggcaucaagcacgccgucgucauguuccagaccgccgucggccacuccuucaagugcgucuccgagcagucccuccagcucuccgcccaccuccaggucaagaccaccgacguccagcuccaggccuucgacuucgaggacgaccacuucggcaacgucgacgagugcuccuccgacuacaccaucguccuccccgucaucggcgccaucgucgucggccucugccucaugggcaugggcgucuacaagauccgccuccgcugccaguccuccggcuaccagcgcaucuga

SEQ ID NO: 45259 - RNA, 486 nt, Artificial Sequence
  derived and/or modified sequence opt2 from LAMTOR1__Homo_sapiens__NP_060377
augggcugcugcuacuccuccgagaacgaggacuccgaccaggaccgcgaggagcgcaagcuccuccucgaccccuccuccccccccaccaaggcccucaacggcgccgagcccaacuaccacucccuccccuccgcccgcaccgacgagcaggcccuccucuccuccauccucgccaagaccgccuccaacaucaucgacgucuccgccgccgacucccagggcauggagcagcacgaguacauggaccgcgcccgccaguacuccacccgccucgccguccucuccuccucccucacccacuggaagaagcuccccccccuccccucccucaccucccagccccaccagguccucgccuccgagcccauccccuucuccgaccuccagcaggucucccgcaucgccgccuacgccuacuccgcccucucccagauccgcgucgacgccaaggaggagcucgucguccaguucggcauccccuga

SEQ ID NO: 45260 - RNA, 288 nt, Artificial Sequence
  derived and/or modified sequence opt2 from LAMTOR2__Homo_sapiens__NP_001138736
augcuccgccccaaggcccucacccagguccucucccaggccaacaccggcggcguccaguccacccuccuccucaacaacgagggcucccuccucgccuacuccggcuacggcgacaccgacgcccgcgucaccgccgccaucgccuccaacaucugggccgccuacgaccgcaacggcaaccaggccuucaacgaggacaaccucaaguucauccucauggacugcauggcccaggcccucguccaguaccucgaggagccccucacccaggucgccgccuccuga

SEQ ID NO: 45261 - RNA, 375 nt, Artificial Sequence
  derived and/or modified sequence opt2 from LAMTOR3__Homo_sapiens__NP_068805
auggccgacgaccucaagcgcuuccucuacaagaagcuccccuccgucgagggccuccacgccaucgucgucuccgaccgcgacggcguccccgucaucaaggucgccaacgacaacgcccccgagcacgcccuccgccccggcuuccucuccaccuucgcccucgccaccgaccagggcuccaagcucggccucuccaagaacaaguccaucaucugcuacuacaacaccuaccaggucguccaguucaaccgccucccccucgucgucuccuucaucgccuccuccuccgccaacaccggccucaucgucucccucgagaaggagcucgccccccucuucgaggagcuccgccaggucgucgaggucuccuga

SEQ ID NO: 45262 - RNA, 1200 nt, Artificial Sequence
  derived and/or modified sequence opt2 from LANCL1__Homo_sapiens__NP_001130047
auggcccagcgcgccuuccccaaccccuacgccgacuacaacaagucccucgccgagggcuacuucgacgccgccggccgccucacccccgaguucucccagcgccucaccaacaagauccgcgagcuccuccagcagauggagcgcggccucaaguccgccgacccccgcgacggcaccggcuacaccggcugggccggcaucgccguccucuaccuccaccucuacgacgucuucggcgaccccgccuaccuccagcucgcccacggcuacgucaagcagucccucaacugccucaccaagcgcuccaucaccuuccucugcggcgacgccggcccccucgccgucgccgccguccucuaccacaagaugaacaacgagaagcaggccgaggacugcaucacccgccucauccaccucaacaagaucgacccccacgcccccaacgagaugcucuacggccgcaucggcuacaucuacgcccuccucuucgucaacaagaacuucggcgucgagaagaucccccagucccacauccagcagaucugcgagaccauccucaccuccggcgagaaccucgcccgcaagcgcaacuucaccgccaaguccccccucauguacgagugguaccaggaguacuacgucggcgccgcccacggccucgccggcaucuacuacuaccucaugcagcccucccuccaggucucccagggcaagcuccacucccucgucaagcccuccgucgacuacgucugccagcucaaguuccccuccggcaacuacccccccugcaucggcgacaaccgcgaccuccucguccacuggugccacggcgcccccggcgucaucuacaugcucauccaggccuacaaggucuuccgcgaggagaaguaccucugcgacgccuaccagugcgccgacgucaucuggcaguacggccuccucaagaagggcuacggccucugccacggcuccgccggcaacgccuacgccuuccucacccucuacaaccucacccaggacaugaaguaccucuaccgcgccugcaaguucgccgaguggugccucgaguacggcgagcacggcugccgcacccccgacacccccuucucccucuucgagggcauggccggcaccaucuacuuccucgccgaccuccucguccccaccaaggcccgcuuccccgccuucgagcucuga

SEQ ID NO: 45263 - RNA, 1353 nt, Artificial Sequence
  derived and/or modified sequence opt2 from LANCL2__Homo_sapiens__NP_061167
augggcgagaccauguccaagcgccucaagcuccaccucggcggcgaggccgagauggaggagcgcgccuucgucaaccccuuccccgacuacgaggccgccgccggcgcccuccucgccuccggcgccgccgaggagaccggcugcguccgcccccccgccaccaccgacgagcccggccuccccuuccaccaggacggcaagaucauccacaacuucauccgccgcauccagaccaagaucaaggaccuccuccagcagauggaggagggccucaagaccgccgacccccacgacugcuccgccuacaccggcuggaccggcaucgcccuccucuaccuccagcucuaccgcgucaccugcgaccagaccuaccuccuccgcucccucgacuacgucaagcgcacccuccgcaaccucaacggccgccgcgucaccuuccucugcggcgacgccggcccccucgccgucggcgccgucaucuaccacaagcuccgcuccgacugcgagucccaggagugcgucaccaagcuccuccagcuccagcgcuccgucgucugccaggaguccgaccuccccgacgagcuccucuacggccgcgccggcuaccucuacgcccuccucuaccucaacaccgagaucggccccggcaccgucugcgaguccgccaucaaggaggucgucaacgccaucaucgaguccggcaagacccucucccgcgaggagcgcaagaccgagcgcugcccccuccucuaccaguggcaccgcaagcaguacgucggcgccgcccacggcauggccggcaucuacuacaugcucaugcagcccgccgccaaggucgaccaggagacccucaccgagauggucaagcccuccaucgacuacguccgccacaagaaguuccgcuccggcaacuaccccuccucccucuccaacgagaccgaccgccucguccacuggugccacggcgcccccggcgucauccacaugcucaugcaggccuacaaggucuucaaggaggagaaguaccucaaggaggccauggagugcuccgacgucaucuggcagcgcggccuccuccgcaagggcuacggcaucugccacggcaccgccggcaacggcuacuccuuccucucccucuaccgccucacccaggacaagaaguaccucuaccgcgccugcaaguucgccgaguggugccucgacuacggcgcccacggcugccgcauccccgaccgccccuacucccucuucgagggcauggccggcgccauccacuuccucuccgacguccucggccccgagaccucccgcuuccccgccuucgagcucgacuccuccaagcgcgacuga

SEQ ID NO: 45264 - RNA, 1560 nt, Artificial Sequence
  derived and/or modified sequence opt2 from LAP3__Homo_sapiens__NP_056991
auguuccuccucccccuccccgccgccggccgcgucgucguccgccgccucgccguccgccgcuucggcucccgcucccucuccaccgccgacaugaccaagggccucguccucggcaucuacuccaaggagaaggaggacgacgucccccaguucaccuccgccggcgagaacuucgacaagcuccucgccggcaagcuccgcgagacccucaacaucuccggccccccccucaaggccggcaagacccgcaccuucuacggccuccaccaggacuuccccuccgucguccucgucggccucggcaagaaggccgccggcaucgacgagcaggagaacuggcacgagggcaaggagaacauccgcgccgccgucgccgccggcugccgccagauccaggaccucgagcucuccuccgucgaggucgaccccugcggcgacgcccaggccgccgccgagggcgccguccucggccucuacgaguacgacgaccucaagcagaagaagaagauggccgucuccgccaagcucuacggcuccggcgaccaggaggccuggcagaagggcguccucuucgccuccggccagaaccucgcccgccagcucauggagacccccgccaacgagaugacccccacccgcuucgccgagaucaucgagaagaaccucaaguccgccuccuccaagaccgagguccacauccgccccaaguccuggaucgaggagcaggccaugggcuccuuccucuccgucgccaagggcuccgacgagccccccgucuuccucgagauccacuacaagggcucccccaacgccaacgagcccccccucgucuucgucggcaagggcaucaccuucgacuccggcggcaucuccaucaaggccuccgccaacauggaccucaugcgcgccgacaugggcggcgccgccaccaucugcuccgccaucgucuccgccgccaagcucaaccuccccaucaacaucaucggccucgccccccucugcgagaacaugcccuccggcaaggccaacaagcccggcgacgucguccgcgccaagaacggcaagaccauccaggucgacaacaccgacgccgagggccgccucauccucgccgacgcccucugcuacgcccacaccuucaaccccaaggucauccucaacgccgccacccucaccggcgccauggacgucgcccucggcuccggcgccaccggcgucuucaccaacuccuccuggcucuggaacaagcucuucgaggccuccaucgagaccggcgaccgcgucuggcgcaugccccucuucgagcacuacacccgccaggucgucgacugccagcucgccgacgucaacaacaucggcaaguaccgcuccgccggcgccugcaccgccgccgccuuccucaaggaguucgucacccaccccaagugggcccaccucgacaucgccggcgucaugaccaacaaggacgagguccccuaccuccgcaagggcaugaccggccgccccacccgcacccucaucgaguuccuccuccgcuucucccaggacaacgccuga

SEQ ID NO: 45265 - RNA, 954 nt, Artificial Sequence
  derived and/or modified sequence opt2 from LAPTM4B__Homo_sapiens__NP_060877
augaccucccgcacccgcgucaccuggcccucccccccccgcccccuccccguccccgccgccgccgccgucgccuucggcgccaagggcaccgaccccgccgaggcccgcuccucccgcggcaucgaggaggccggcccccgcgcccacggccgcgccggccgcgagcccgagcgccgccgcucccgccagcagcgccgcggcggccuccaggcccgccgcuccacccuccucaagaccugcgcccgcgcccgcgccaccgcccccggcgccaugaagauggucgcccccuggacccgcuucuacuccaacuccugcugccucugcugccacguccgcaccggcaccauccuccucggcgucugguaccucaucaucaacgccgucguccuccucauccuccucuccgcccucgccgaccccgaccaguacaacuucuccuccuccgagcucggcggcgacuucgaguucauggacgacgccaacaugugcaucgccaucgccaucucccuccucaugauccucaucugcgccauggccaccuacggcgccuacaagcagcgcgccgccuggaucauccccuucuucugcuaccagaucuucgacuucgcccucaacaugcucgucgccaucaccguccucaucuaccccaacuccauccaggaguacauccgccagcucccccccaacuuccccuaccgcgacgacgucauguccgucaaccccaccugccucguccucaucauccuccucuucaucuccaucauccucaccuucaagggcuaccucaucuccugcgucuggaacugcuaccgcuacaucaacggccgcaacuccuccgacguccucgucuacgucaccuccaacgacaccaccguccuccucccccccuacgacgacgccaccgucaacggcgccgccaaggagccccccccccccuacgucuccgccuga

SEQ ID NO: 45266 - RNA, 2271 nt, Artificial Sequence
  derived and/or modified sequence opt2 from LARGE__Homo_sapiens__XP_005261889
augcucggcaucugccgcggccgccgcaaguuccucgccgccucccucucccuccucugcauccccgccaucaccuggaucuaccucuucuccggcuccuucgaggacggcaagcccgucucccucuccccccucgagucccaggcccacuccccccgcuacaccgccuccucccagcgcgagcgcgagucccucgagguccgcaugcgcgaggucgaggaggagaaccgcgcccuccgccgccagcucucccucgcccagggccgcgcccccucccaccgccgcggcaaccacuccaagaccuacuccauggaggagggcaccggcgacuccgagaaccuccgcgccggcaucgucgccggcaacuccuccgagugcggccagcagcccgucgucgagaagugcgagaccauccacgucgccaucgucugcgccggcuacaacgccucccgcgacgucgucacccucgucaaguccguccucuuccaccgccgcaacccccuccacuuccaccucaucgccgacuccaucgccgagcagauccucgccacccucuuccagaccuggaugguccccgccguccgcgucgacuucuacaacgccgacgagcucaaguccgaggucuccuggauccccaacaagcacuacuccggcaucuacggccucaugaagcucguccucaccaagacccuccccgccaaccucgagcgcgucaucguccucgacaccgacaucaccuucgccaccgacaucgccgagcucugggccgucuuccacaaguucaagggccagcagguccucggccucgucgagaaccaguccgacugguaccucggcaaccucuggaagaaccaccgccccuggcccgcccucggccgcggcuacaacaccggcgucauccuccuccuccucgacaagcuccgcaagaugaagugggagcagauguggcgccucaccgccgagcgcgagcucaugggcaugcucuccaccucccucgccgaccaggacaucuucaacgccgucaucaagcagaaccccuuccucgucuaccagcuccccugcuucuggaacguccagcucuccgaccacacccgcuccgagcagugcuaccgcgacgucuccgaccucaaggucauccacuggaacucccccaagaagcuccgcgucaagaacaagcacgucgaguucuuccgcaaccucuaccucaccuuccucgaguacgacggcaaccuccuccgccgcgagcucuucggcugccccuccgaggccgacgucaacuccgagaaccuccagaagcagcucuccgagcucgacgaggacgaccucugcuacgaguuccgccgcgagcgcuucaccguccaccgcacccaccucuacuuccuccacuacgaguacgagcccgccgccgacuccaccgacgucacccucgucgcccagcucuccauggaccgccuccagaugcucgaggccaucugcaagcacugggagggccccaucucccucgcccucuaccucuccgacgccgaggcccagcaguuccuccgcuacgcccagggcuccgagguccucaugucccgccacaacgucggcuaccacaucgucuacaaggagggccaguucuaccccgucaaccuccuccgcaacgucgccaugaagcacaucuccacccccuacauguuccucuccgacaucgacuuccuccccauguacggccucuacgaguaccuccgcaaguccgucauccagcucgaccucgccaacaccaagaaggccaugaucguccccgccuucgagacccuccgcuaccgccucuccuuccccaaguccaaggccgagcuccucuccaugcucgacaugggcacccucuucaccuuccgcuaccacgucuggaccaagggccacgcccccaccaacuucgccaaguggcgcaccgccaccacccccuaccgcgucgagugggaggccgacuucgagcccuacgucgucguccgccgcgacugccccgaguacgaccgccgcuucgucggcuucggcuggaacaaggucgcccacaucauggagcucgacguccaggaguacgaguucaucguccuccccaacgccuacaugauccacaugccccacgcccccuccuucgacaucaccaaguuccgcuccaacaagcaguaccgcaucugccucaagacccucaaggaggaguuccagcaggacaugucccgccgcuacggcuucgccgcccucaaguaccucaccgccgagaacaacuccuga

SEQ ID NO: 45267 - RNA, 3060 nt, Artificial Sequence
  derived and/or modified sequence opt2 from LARP1__Homo_sapiens__NP_056130
augcucuggcgcguccuccucuccaagcgcccccccuucccccaccccgagcucgacuuccaggaggcccccauccccuccugccccggccgccuccccggccgcaagaacuccgucgcccucgccgccgccccccgcaaggagcccaccggcgaccgcgagaagccccuccccuuccccguccucgcccccuucuccaaccccgagcacuccgcccccgccaaggucguccgcgccgccguccccaagcagcgcaagggcuccaaggucggcgacuucggcgacgccaucaacuggcccacccccggcgagaucgcccacaaguccguccagccccagucccacaagccccagcccacccgcaagcucccccccaagaaggacaugaaggagcaggagaagggcgagggcuccgacuccaaggagucccccaagaccaaguccgacgaguccggcgaggagaagaacggcgacgaggacugccagcgcggcggccagaagaagaagggcaacaagcacaagugggucccccuccagaucgacaugaagcccgaggucccccgcgagaagcucgccucccgccccacccgcccccccgagccccgccacauccccgccaaccgcggcgagaucaagggcuccgaguccgccaccuacguccccgucgccccccccacccccgccuggcagcccgagaucaagcccgagcccgccuggcacgaccaggacgagaccuccuccgucaaguccgacggcgccggcggcgcccgcgccuccuuccgcggccgcggccgcggccgcggccgcggccgcggccgcggccgcggcggcacccgcacccacuucgacuaccaguucggcuaccgcaaguucgacggcgucgagggcccccgcacccccaaguacaugaacaacaucaccuacuacuucgacaacgucuccuccaccgagcucuacuccgucgaccaggagcuccucaaggacuacaucaagcgccagaucgaguacuacuucuccgucgacaaccucgagcgcgacuucuuccuccgccgcaagauggacgccgacggcuuccuccccaucacccucaucgccuccuuccaccgcguccaggcccucaccaccgacaucucccucaucuucgccgcccucaaggacuccaaggucgucgagaucgucgacgagaagguccgccgccgcgaggagcccgagaaguggccccucccccccaucgucgacuacucccagaccgacuucucccagcuccucaacugccccgaguucgucccccgccagcacuaccagaaggagaccgaguccgcccccggcuccccccgcgccgucacccccguccccaccaagaccgaggaggucuccaaccucaagacccuccccaagggccucuccgccucccuccccgaccucgacuccgagaacuggaucgaggucaagaagcgcccccgccccucccccgcccgccccaagaaguccgaggagucccgcuucucccaccucaccucccucccccagcagcuccccucccagcagcucauguccaaggaccaggacgagcaggaggagcucgacuuccucuucgacgaggagauggagcagauggacggccgcaagaacaccuucaccgccugguccgacgaggaguccgacuacgagaucgacgaccgcgacgucaacaagauccucaucgucacccagaccccccacuacaugcgccgccaccccggcggcgaccgcaccggcaaccacaccucccgcgccaagauguccgccgagcucgccaaggucaucaacgacggccucuucuacuacgagcaggaccucugggccgagaaguucgagcccgaguacucccagaucaagcaggaggucgagaacuucaagaaggucaacaugaucucccgcgagcaguucgacacccucacccccgagccccccgucgaccccaaccaggaggucccccccggccccccccgcuuccagcagguccccaccgacgcccucgccaacaagcucuucggcgcccccgagcccuccaccaucgcccgcucccuccccaccaccguccccgagucccccaacuaccgcaacacccgcaccccccgcaccccccgcaccccccagcucaaggacuccucccagaccucccgcuucuaccccgucgucaaggagggccgcacccucgacgccaagaugccccgcaagcgcaagacccgccacuccuccaaccccccccucgagucccacgucggcugggucauggacucccgcgagcaccgcccccgcaccgccuccaucuccuccucccccuccgagggcacccccaccgucggcuccuacggcugcaccccccagucccuccccaaguuccagcaccccucccacgagcuccucaaggagaacggcuucacccagcacgucuaccacaaguaccgccgccgcugccucaacgagcgcaagcgccucggcaucggccagucccaggagaugaacacccucuuccgcuucugguccuucuuccuccgcgaccacuucaacaagaagauguacgaggaguucaagcagcucgcccucgaggacgccaaggagggcuaccgcuacggccucgagugccucuuccgcuacuacuccuacggccucgagaagaaguuccgccucgacaucuucaaggacuuccaggaggagaccgucaaggacuacgaggccggccagcucuacggccucgagaaguucugggccuuccucaaguacuccaaggccaagaaccucgacaucgaccccaagcuccaggaguaccucggcaaguuccgccgccucgaggacuuccgcgucgacccccccaugggcgaggagggcaaccacaagcgccacuccgucgucgccggcggcggcggcggcgagggccgcaagcgcugccccucccaguccuccucccgccccgccgccaugaucucccagccccccaccccccccaccggccagcccguccgcgaggacgccaaguggaccucccagcacuccaacacccagacccucggcaaguga

SEQ ID NO: 45268 - RNA, 1749 nt, Artificial Sequence
  derived and/or modified sequence opt2 from LARP4__Homo_sapiens__NP_001164274
augcuccucuucgucgagcaggucgccuccaagggcaccggccucaaccccaacgccaaggucuggcaggagaucgcccccggcaacaccgacgccacccccgucacccacggcaccgaguccuccuggcacgagaucgccgccaccuccggcgcccaccccgagggcaacgccgagcucuccgaggacaucugcaaggaguacgaggucauguacuccuccuccugcgagaccacccgcaacaccaccggcaucgaggaguccaccgacggcaugauccucggccccgaggaccucuccuaccagaucuacgacgucuccggcgaguccaacuccgccgucuccaccgaggaccucaaggagugccucaagaagcagcucgaguucugcuucucccgcgagaaccucuccaaggaccucuaccucaucucccagauggacuccgaccaguucauccccaucuggaccgucgccaacauggaggagaucaagaagcucaccaccgaccccgaccucauccucgagguccuccgcuccucccccaugguccaggucgacgagaagggcgagaagguccgccccucccacaagcgcugcaucgucauccuccgcgagauccccgagaccacccccaucgaggaggucaagggccucuucaaguccgagaacugccccaaggucaucuccugcgaguucgcccacaacuccaacugguacaucaccuuccaguccgacaccgacgcccagcaggccuucaaguaccuccgcgaggaggucaagaccuuccagggcaagcccaucauggcccccuuccccaacggcuccuucgucaacggcuucaacucccccggcuccuacaagaccaacgccgccgccaugaacaugggccgccccuuccagaagaaccgccgcacccucuuccgcggccgccgccgccgcgaggacgaccgcaucucccgcccccaccccuccaccgccgaguccaaggcccccacccccaaguucgaccuccucgccuccaacuuccccccccuccccggcuccuccucccgcaugcccggcgagcucguccucgagaaccgcauguccgacgucgucaagggcgucuacaaggagaaggacaacgaggagcucaccaucuccugccccguccccgccgacgagcagaccgagugcaccuccgcccagcagcucaacauguccaccuccucccccugcgccgccgagcucaccgcccucuccaccacccagcaggagaaggaccucaucgaggacuccuccguccagaaggacggccucaaccagaccaccauccccgucuccccccccuccaccaccaagcccucccgcgccuccaccgccucccccugcaacaacaacaucaacgccgccaccgccgucgcccuccaggagccccgcaagcucuccuacgccgaggucugccagaagccccccaaggagcccuccuccguccucguccagccccuccgcgagcuccgcuccaacgucgucucccccaccaagaacgaggacaacggcgcccccgagaacuccgucgagaagccccacgagaagcccgaggcccgcgccuccaaggacuacuccggcuuccgcggcaacaucaucccccgcggcgccgccggcaagauccgcgagcagcgccgccaguucucccaccgcgccaucccccagggcgucacccgccgcaacggcaaggagcaguacguccccccccgcucccccaaguga

SEQ ID NO: 45269 - RNA, 1476 nt, Artificial Sequence
  derived and/or modified sequence opt2 from LARP6__Homo_sapiens__NP_060827
auggcccaguccggcggcgaggcccgccccggccccaagaccgccguccagauccgcgucgccauccaggaggccgaggacgucgacgagcucgaggacgaggaggagggcgccgagacccgcggcgccggcgaccccgcccgcuaccucucccccggcuggggcuccgccuccgaggaggagcccucccgcggccacuccggcaccaccgccuccggcggcgagaacgagcgcgaggaccucgagcaggaguggaagccccccgacgaggagcucaucaagaagcucgucgaccagaucgaguucuacuucuccgacgagaaccucgagaaggacgccuuccuccucaagcacguccgccgcaacaagcucggcuacgucuccgucaagcuccucaccuccuucaagaaggucaagcaccucacccgcgacuggcgcaccaccgcccacgcccucaaguacuccgucguccucgagcucaacgaggaccaccgcaagguccgccgcaccacccccgucccccucuuccccaacgagaaccuccccuccaagaugcuccucgucuacgaccucuaccucucccccaagcucugggcccucgccaccccccagaagaacggccgcguccaggagaaggucauggagcaccuccucaagcucuucggcaccuucggcgucaucuccuccguccgcauccucaagcccggccgcgagcucccccccgacauccgccgcaucuccucccgcuacucccaggucggcacccaggagugcgccaucgucgaguucgaggaggucgaggccgccaucaaggcccacgaguucaugaucaccgagucccagggcaaggagaacaugaaggccguccucaucggcaugaagccccccaagaagaagcccgccaaggacaagaaccacgacgaggagcccaccgccuccauccaccucaacaagucccucaacaagcgcgucgaggagcuccaguacaugggcgacgaguccuccgccaacuccuccuccgaccccgaguccaaccccaccucccccauggccggccgccgccacgccgccaccaacaagcucucccccuccggccaccagaaccucuuccucucccccaacgccucccccugcaccucccccugguccuccccccucgcccagcgcaagggcgucucccgcaaguccccccucgccgaggagggccgccucaacugcuccaccucccccgagaucuuccgcaagugcauggacuacuccuccgacuccuccgucacccccuccggcucccccuggguccgccgccgccgccaggccgagaugggcacccaggagaagucccccggcaccuccccccuccucucccgcaagaugcagaccgccgacggccuccccgucggcguccuccgccucccccgcggccccgacaacacccgcggcuuccacggccacgagcgcucccgcgccugcgucuga

SEQ ID NO: 45270 - RNA, 1770 nt, Artificial Sequence
  derived and/or modified sequence opt2 from LARP7__Homo_sapiens__NP_001253968
augauccccaacaucgagggcauggagaccgaguccggcaaccaggagaaggucauggaggaggaguccaccgagaagaagaaggaggucgagaagaagaagcgcucccgcgucaagcagguccucgccgacaucgccaagcaggucgacuucugguucggcgacgccaaccuccacaaggaccgcuuccuccgcgagcagaucgagaagucccgcgacggcuacgucgacaucucccuccucgucuccuucaacaagaugaagaagcucaccaccgacggcaagcucaucgcccgcgcccuccgcuccuccgccgucgucgagcucgaccucgagggcacccgcauccgccgcaagaagccccucggcgagcgccccaaggacgaggacgagcgcaccgucuacgucgagcuccuccccaagaacgucaaccacuccuggaucgagcgcgucuucggcaagugcggcaacgucgucuacaucuccaucccccacuacaaguccaccggcgaccccaagggcuucgccuucgucgaguucgagaccaaggagcaggccgccaaggccaucgaguuccucaacaacccccccgaggaggccccccgcaagcccggcaucuuccccaagaccgucaagaacaagcccauccccgcccuccgcgucgucgaggagaagaagaagaagaagaagaagaagggccgcaugaagaaggaggacaacauccaggccaaggaggagaacauggacaccuccaacaccuccaucuccaagaugaagcgcucccgccccaccuccgagggcuccgacaucgaguccaccgagccccagaagcagugcuccaagaagaagaagaagcgcgaccgcgucgaggccuccucccuccccgagguccgcaccggcaagcgcaagcgcuccuccuccgaggacgccgagucccucgccccccgcuccaaggucaagaagaucauccagaaggacaucaucaaggaggccuccgaggccuccaaggagaaccgcgacaucgagaucuccaccgaggaggagaaggacaccggcgaccucaaggacuccucccuccucaagaccaagcgcaagcacaagaagaagcacaaggagcgccacaagaugggcgaggaggucaucccccuccgcguccucuccaaguccgaguggauggaccucaagaaggaguaccucgcccuccagaaggccuccauggccucccucaagaagaccaucucccagaucaaguccgaguccgagauggagaccgacuccggcgucccccagaacaccggcaugaagaacgagaagaccgccaaccgcgaggagugccgcacccaggagaaggucaacgccaccggcccccaguucgucuccggcgucaucgucaagaucaucuccaccgagccccuccccggccgcaagcagguccgcgacacccucgccgccaucuccgagguccucuacgucgaccuccucgagggcgacaccgagugccacgcccgcuucaagacccccgaggacgcccaggccgucaucaacgccuacaccgagaucaacaagaagcacugcuggaagcucgagauccucuccggcgaccacgagcagcgcuacuggcagaagauccucgucgaccgccaggccaagcucaaccagccccgcgagaagaagcgcggcaccgagaagcucaucaccaaggccgagaagauccgccucgccaagacccagcaggccuccaagcacauccgcuucuccgaguacgacuga

SEQ ID NO: 45271 - RNA, 2712 nt, Artificial Sequence
  derived and/or modified sequence opt2 from LARS2__Homo_sapiens__NP_056155
auggccuccgucuggcagcgccucggcuucuacgccucccuccucaagcgccagcucaacggcggccccgacgucaucaagugggagcgccgcgucauccccggcugcacccgcuccaucuacuccgccaccggcaaguggaccaaggaguacacccuccagacccgcaaggacgucgagaagugguggcaccagcgcaucaaggagcaggccuccaagaucuccgaggccgacaaguccaagcccaaguucuacguccucuccauguuccccuaccccuccggcaagcuccacaugggccacguccgcgucuacaccaucuccgacaccaucgcccgcuuccagaagaugcgcggcaugcaggucaucaaccccaugggcugggacgccuucggccuccccgccgagaacgccgccgucgagcgcaaccuccacccccaguccuggacccaguccaacaucaagcacaugcgcaagcagcucgaccgccucggccucugcuucuccugggaccgcgagaucaccaccugccuccccgacuacuacaaguggacccaguaccucuucaucaagcucuacgaggccggccucgccuaccagaaggaggcccucgucaacugggaccccgucgaccagaccguccucgccaacgagcaggucgacgagcacggcugcuccuggcgcuccggcgccaaggucgagcagaaguaccuccgccagugguucaucaagaccaccgccuacgccaaggccaugcaggacgcccucgccgaccuccccgagugguacggcaucaagggcaugcaggcccacuggaucggcgacugcgucggcugccaccucgacuucacccucaagguccacggccaggccaccggcgagaagcucaccgccuacaccgccacccccgaggccaucuacggcaccucccacgucgccaucucccccucccaccgccuccuccacggccacuccucccucaaggaggcccuccgcauggcccucguccccggcaaggacugccucacccccgucauggccgucaacaugcucacccagcaggagguccccgucgucauccucgccaaggccgaccucgagggcucccucgacuccaagaucggcauccccuccaccuccuccgaggacaccauccucgcccagacccucggccucgccuacuccgaggucaucgagacccuccccgacggcaccgagcgccucuccuccuccgccgaguucaccggcaugacccgccaggacgccuuccucgcccucacccagaaggcccgcggcaagcgcgucggcggcgacgucaccuccgacaagcucaaggacuggcucaucucccgccagcgcuacuggggcacccccauccccaucguccacugccccgucugcggccccacccccgucccccucgaggaccuccccgucacccuccccaacaucgccuccuucaccggcaagggcggccccccccucgccauggccuccgagugggucaacugcuccugcccccgcugcaagggcgccgccaagcgcgagaccgacaccauggacaccuucgucgacuccgccugguacuacuuccgcuacaccgacccccacaacccccacucccccuucaacaccgccgucgccgacuacuggaugcccgucgaccucuacaucggcggcaaggagcacgccgucaugcaccucuucuacgcccgcuucuucucccacuucugccacgaccagaagauggucaagcaccgcgagcccuuccacaagcuccucgcccagggccucaucaagggccagaccuuccgccuccccuccggccaguaccuccagcgcgaggaggucgaccucaccggcuccguccccguccacgccaagaccaaggagaagcucgaggucaccugggagaagauguccaaguccaagcacaacggcgucgaccccgaggaggucgucgagcaguacggcaucgacaccauccgccucuacauccucuucgccgccccccccgagaaggacauccucugggacgucaagaccgacgcccuccccggcguccuccgcuggcagcagcgccucuggacccucaccacccgcuucaucgaggcccgcgccuccggcaaguccccccagccccagcuccucuccaacaaggagaaggccgaggcccgcaagcucugggaguacaagaacuccgucaucucccaggucaccacccacuucaccgaggacuucucccucaacuccgccaucucccagcucaugggccucuccaacgcccucucccaggccucccaguccgucauccuccacucccccgaguucgaggacgcccucugcgcccucauggucauggccgccccccucgccccccacgucaccuccgagaucugggccggccucgcccucgucccccgcaagcucugcgcccacuacaccugggacgccuccguccuccuccaggccuggcccgccgucgaccccgaguuccuccagcagcccgaggucguccagauggccguccucaucaacaacaaggccugcggcaagauccccgucccccagcaggucgcccgcgaccaggacaagguccacgaguucguccuccaguccgagcucggcguccgccuccuccagggccgcuccaucaagaaguccuuccucuccccccgcaccgcccucaucaacuuccucguccaggacuga

SEQ ID NO: 45272 - RNA, 3531 nt, Artificial Sequence
  derived and/or modified sequence opt2 from LARS__Homo_sapiens__NP_064502
auggccgagcgcaagggcaccgccaaggucgacuuccucaagaagaucgagaaggagauccagcagaagugggacaccgagcgcgucuucgaggucaacgccuccaaccucgagaagcagaccuccaagggcaaguacuucgucaccuuccccuaccccuacaugaacggccgccuccaccucggccacaccuucucccucuccaagugcgaguucgccgucggcuaccagcgccucaagggcaagugcugccucuuccccuucggccuccacugcaccggcaugcccaucaaggccugcgccgacaagcucaagcgcgagaucgagcucuacggcugcccccccgacuuccccgacgaggaggaggaggaggaggagaccuccgucaagaccgaggacaucaucaucaaggacaaggccaagggcaagaaguccaaggccgccgccaaggccggcuccuccaaguaccaguggggcaucaugaagucccucggccucuccgacgaggagaucgucaaguucuccgaggccgagcacuggcucgacuacuuccccccccucgccauccaggaccucaagcgcaugggccucaaggucgacuggcgccgcuccuucaucaccaccgacgucaaccccuacuacgacuccuucguccgcuggcaguuccucacccuccgcgagcgcaacaagaucaaguucggcaagcgcuacaccaucuacucccccaaggacggccagcccugcauggaccacgaccgccagaccggcgagggcgucggcccccaggaguacacccuccucaagcucaagguccucgagcccuaccccuccaagcucuccggccucaagggcaagaacaucuuccucgucgccgccacccuccgccccgagaccauguucggccagaccaacugcuggguccgccccgacaugaaguacaucggcuucgagaccgucaacggcgacaucuucaucugcacccagaaggccgcccgcaacauguccuaccagggcuucaccaaggacaacggcgucguccccgucgucaaggagcucaugggcgaggagauccucggcgccucccucuccgccccccucaccuccuacaaggucaucuacguccuccccaugcucaccaucaaggaggacaagggcaccggcgucgucaccuccguccccuccgacucccccgacgacaucgccgcccuccgcgaccucaagaagaagcaggcccuccgcgccaaguacggcauccgcgacgacaugguccuccccuucgagcccguccccgucaucgagauccccggcuucggcaaccucuccgccgucaccaucugcgacgagcucaagauccagucccagaacgaccgcgagaagcucgccgaggccaaggagaagaucuaccucaagggcuucuacgagggcaucaugcucgucgacggcuucaagggccagaagguccaggacgucaagaagaccauccagaagaagaugaucgacgccggcgacgcccucaucuacauggagcccgagaagcaggucaugucccgcuccuccgacgagugcgucgucgcccucugcgaccagugguaccucgacuacggcgaggagaacuggaagaagcagaccucccagugccucaagaaccucgagaccuucugcgaggagacccgccgcaacuucgaggccacccucggcuggcuccaggagcacgccugcucccgcaccuacggccucggcacccaccuccccugggacgagcaguggcucaucgagucccucuccgacuccaccaucuacauggccuucuacaccgucgcccaccuccuccagggcggcaaccuccacggccaggccgaguccccccucggcauccgcccccagcagaugaccaaggaggucugggacuacgucuucuucaaggaggcccccuuccccaagacccagaucgccaaggagaagcucgaccagcucaagcaggaguucgaguucugguaccccgucgaccuccgcgucuccggcaaggaccucguccccaaccaccucuccuacuaccucuacaaccacgucgccauguggcccgagcaguccgacaaguggcccaccgccguccgcgccaacggccaccuccuccucaacuccgagaagauguccaaguccaccggcaacuuccucacccucacccaggccaucgacaaguucuccgccgacggcaugcgccucgcccucgccgacgccggcgacaccgucgaggacgccaacuucgucgaggccauggccgacgccggcauccuccgccucuacaccugggucgagugggucaaggagauggucgccaacugggacucccuccgcuccggccccgccuccaccuucaacgaccgcgucuucgccuccgagcucaacgccggcaucaucaagaccgaccagaacuacgagaagaugauguucaaggaggcccucaagaccggcuucuucgaguuccaggccgccaaggacaaguaccgcgagcucgccgucgagggcaugcaccgcgagcucgucuuccgcuucaucgagguccagacccuccuccucgcccccuucugcccccaccucugcgagcacaucuggacccuccucggcaagcccgacuccaucaugaacgccuccuggcccgucgccggccccgucaacgagguccucauccacuccucccaguaccucauggaggucacccacgaccuccgccuccgccucaagaacuacaugaugcccgccaagggcaagaagaccgacaagcagccccuccagaagcccucccacugcaccaucuacgucgccaagaacuacccccccuggcagcacaccacccucuccguccuccgcaagcacuucgaggccaacaacggcaagcuccccgacaacaaggucaucgccuccgagcucggcuccaugcccgagcucaagaaguacaugaagaaggucaugcccuucgucgccaugaucaaggagaaccucgagaagaugggcccccgcauccucgaccuccagcucgaguucgacgagaaggccguccucauggagaacaucgucuaccucaccaacucccucgagcucgagcacaucgaggucaaguucgccuccgaggccgaggacaagauccgcgaggacugcugccccggcaagccccucaacgucuuccgcaucgagcccggcgucuccgucucccucgucaacccccagcccuccaacggccacuucuccaccaagaucgagauccgccagggcgacaacugcgacuccaucauccgccgccucaugaagaugaaccgcggcaucaaggaccucuccaaggucaagcucaugcgcuucgacgacccccuccucggcccccgccgcguccccguccucggcaaggaguacaccgagaagacccccaucuccgagcacgccgucuucaacgucgaccucauguccaagaagauccaccucaccgagaacggcauccgcgucgacaucggcgacaccaucaucuaccucguccacuga

SEQ ID NO: 45273 - RNA, 2154 nt, Artificial Sequence
  derived and/or modified sequence opt2 from LAS1L__Homo_sapiens__NP_001164120
auguccugggaguccggcgccggccccggccucggcucccagggcauggaccucgucugguccgccugguacggcaagugcgucaagggcaagggcucccucccccucuccgcccacggcaucgucgucgccuggcucucccgcgccgagugggaccaggucaccgucuaccucuucugcgacgaccacaagcuccagcgcuacgcccucaaccgcaucaccgucuggcgcucccgcuccggcaacgagcucccccucgccgucgccuccaccgccgaccucauccgcugcaagcuccucgacgucaccggcggccucggcaccgacgagcuccgccuccucuacggcauggcccucguccgcuucgucaaccucaucuccgagcgcaagaccaaguucgccaaggucccccucaagugccucgcccaggaggucaacauccccgacuggaucgucgaccuccgccacgagcucacccacaagaagaugccccacaucaacgacugccgccgcggcugcuacuucguccucgacuggcuccagaagaccuacuggugccgccagcucgagaacucccuccgcgagaccugggagcucgaggaguuccgcgagggcaucgaggaggaggaccaggaggaggacaagaacaucgucgucgacgacaucaccgagcagaagcccgagccccaggacgacggcaaguccaccgaguccgacgucaaggccgacggcgacuccaagggcuccgaggaggucgacucccacugcaagaaggcccucucccacaaggagcucuacgagcgcgcccgcgagcuccucgucuccuacgaggaggagcaguucaccguccucgagaaguuccgcuaccuccccaaggccaucaaggccuggaacaaccccuccccccgcgucgagugcguccucgccgagcucaagggcgucaccugcgagaaccgcgaggccguccucgacgccuuccucgacgacggcuuccucguccccaccuucgagcagcucgccgcccuccagaucgaguacgaggagaacgucgaccucaacgacguccucguccccaagcccuucucccaguucuggcagccccuccuccgcggccuccacucccagaacuucacccaggcccuccucgagcgcaugcucuccgagcuccccgcccucggcaucuccggcauccgccccaccuacauccuccgcuggaccgucgagcucaucgucgccaacaccaagaccggccgcaacgcccgccgcuucuccgccggccagugggaggcccgccgcggcuggcgccucuucaacugcuccgccucccucgacuggccccgcauggucgaguccugccucggcucccccugcugggccuccccccagcuccuccgcaucaucuucaaggccaugggccagggccuccccgacgaggagcaggagaagcuccuccgcaucugcuccaucuacacccaguccggcgagaacucccucguccaggagggcuccgaggccucccccaucggcaagucccccuacacccucgacucccucuacugguccgucaagcccgccuccuccuccuucggcuccgaggccaaggcccagcagcaggaggagcagggcuccgucaacgacgucaaggaggaggagaaggaggagaaggagguccuccccgaccaggucgaggaggaggaggagaacgacgaccaggaggaggaggaggaggacgaggacgacgaggacgacgaggaggaggaccgcauggaggucggccccuucuccaccggccaggagucccccaccgccgagaacgcccgccuccucgcccagaagcgcggcgcccuccagggcuccgccuggcaggucuccuccgaggacguccgcugggacaccuucccccucggccgcaugcccggccagaccgaggaccccgccgagcucaugcucgagaacuacgacaccauguaccuccucgaccagcccguccucgagcagcgccucgagcccuccaccugcaagaccgacacccucggccucuccugcggcgucggcuccggcaacugcuccaacuccuccuccuccaacuucgagggccuccucuggucccagggccagcuccacggccucaagaccggccuccagcucuucuga

SEQ ID NO: 45274 - RNA, 618 nt, Artificial Sequence
  derived and/or modified sequence opt2 from LASP1__Homo_sapiens__NP_001258537
augcucccccuccgcgaccuccaggacgacaccgagcacgaggagcuccagggccuccgcgaggaggcccuccuccagcgcguccgcuacaaggaggaguucgagaagaacaagggcaagggcuucuccgucgucgccgacacccccgagcuccagcgcaucaagaagacccaggaccagaucuccaacaucaaguaccacgaggaguucgagaagucccgcaugggccccuccggcggcgagggcauggagcccgagcgccgcgacucccaggacggcuccuccuaccgccgcccccucgagcagcagcagccccaccacauccccaccuccgcccccgucuaccagcagccccagcagcagcccgucgcccaguccuacggcggcuacaaggagcccgccgcccccgucuccauccagcgcuccgcccccggcggcggcggcaagcgcuaccgcgccgucuacgacuacuccgccgccgacgaggacgaggucuccuuccaggacggcgacaccaucgucaacguccagcagaucgacgacggcuggauguacggcaccgucgagcgcaccggcgacaccggcaugcuccccgccaacuacgucgaggccaucuga

SEQ ID NO: 45275 - RNA, 732 nt, Artificial Sequence
  derived and/or modified sequence opt2 from LAT2__Homo_sapiens__NP_115852
auguccuccggcaccgagcuccucuggcccggcgccgcccuccucguccuccucggcgucgccgccucccucugcguccgcugcucccgccccggcgccaagcgcuccgagaagaucuaccagcagcgcucccuccgcgaggaccagcaguccuucaccggcucccgcaccuacucccucgucggccaggccuggcccggcccccucgccgacauggcccccacccgcaaggacaagcuccuccaguucuaccccucccucgaggaccccgccuccucccgcuaccagaacuucuccaagggcucccgccacggcuccgaggaggccuacaucgaccccaucgccauggaguacuacaacuggggccgcuucuccaagccccccgaggacgacgacgccaacuccuacgagaacguccucaucugcaagcagaagaccaccgagaccggcgcccagcaggagggcaucggcggccucugccgcggcgaccucucccucucccucgcccucaagaccggccccaccuccggccucugccccuccgccucccccgaggaggacgaggaguccgaggacuaccagaacuccgccuccauccaccaguggcgcgagucccgcaaggucaugggccagcuccagcgcgaggccucccccggccccgucggcucccccgacgaggaggacggcgagcccgacuacgucaacggcgaggucgccgccaccgaggccuga

SEQ ID NO: 45276 - RNA, 702 nt, Artificial Sequence
  derived and/or modified sequence opt2 from LAT__Homo_sapiens__NP_001014987
auggaggaggccauccucguccccugcguccucggccuccuccuccuccccauccucgccaugcucauggcccucugcguccacugccaccgccuccccggcuccuacgacuccaccuccuccgacucccucuacccccgcggcauccaguucaagcgcccccacaccgucgcccccuggccccccgccuacccccccgucaccuccuaccccccccucucccagcccgaccuccuccccaucccccgcuccccccagccccucggcggcucccaccgcacccccuccucccgccgcgacuccgacggcgccaacuccgucgccuccuacgagaacgaggagcccgccugcgaggacgccgacgaggacgaggacgacuaccacaaccccggcuaccucgucguccuccccgacuccacccccgccaccuccaccgccgcccccuccgcccccgcccucuccacccccggcauccgcgacuccgccuucuccauggaguccaucgacgacuacgucaacguccccgaguccggcgaguccgccgaggccucccucgacggcucccgcgaguacgucaacgucucccaggagcuccaccccggcgccgccaagaccgagcccgccgcccucuccucccaggaggccgaggaggucgaggaggagggcgcccccgacuacgagaaccuccaggagcucaacuga

SEQ ID NO: 45277 - RNA, 2073 nt, Artificial Sequence
  derived and/or modified sequence opt2 from LATS1__Homo_sapiens__NP_001257448
augaagcgcuccgagaagcccgagggcuaccgccagaugcgccccaagaccuuccccgccuccaacuacaccgucuccucccgccagaugcuccaggagauccgcgagucccuccgcaaccucuccaagcccuccgacgccgccaaggccgagcacaacauguccaagauguccaccgaggacccccgccagguccgcaacccccccaaguucggcacccaccacaaggcccuccaggagauccgcaacucccuccuccccuucgccaacgagaccaacuccucccgcuccaccuccgaggucaacccccagaugcuccaggaccuccaggccgccggcuucgacgaggacauggucauccaggcccuccagaagaccaacaaccgcuccaucgaggccgccaucgaguucaucuccaagauguccuaccaggacccccgccgcgagcagauggccgccgccgccgcccgccccaucaacgccuccaugaagcccggcaacguccagcaguccgucaaccgcaagcaguccuggaagggcuccaaggagucccucgucccccagcgccacggccccccccucggcgaguccgucgccuaccacuccgagucccccaacucccagaccgacgucggccgcccccucuccggcuccggcaucuccgccuucguccaggcccaccccuccaacggccagcgcgucaacccccccccccccccccagguccgcuccgucaccccccccccccccccccgcggccagaccccccccccccgcggcaccaccccccccccccccuccugggagcccaacucccagaccaagcgcuacuccggcaacauggaguacgucaucucccgcaucucccccgucccccccggcgccuggcaggagggcuaccccccccccccccucaacaccucccccaugaacccccccaaccagggccagcgcggcaucuccuccguccccgucggccgccagcccaucaucaugcaguccuccuccaaguucaacuuccccuccggccgccccggcaugcagaacggcaccggccagaccgacuucaugauccaccagaacgucguccccgccggcaccgucaaccgccagccccccccccccuacccccucaccgccgccaacggccagucccccuccgcccuccagaccggcggcuccgccgcccccuccuccuacaccaacggcuccaucccccaguccaugaugguccccaaccgcaacucccacaacauggagcucuacaacaucuccguccccggccuccagaccaacuggccccaguccuccuccgcccccgcccaguccucccccuccuccggccacgagauccccaccuggcagcccaacauccccguccgcuccaacuccuucaacaacccccucggcaaccgcgccucccacuccgccaacucccagcccuccgccaccaccgucaccgccaucacccccgcccccauccagcagcccgucaaguccaugcgcguccucaagcccgagcuccagaccgcccucgcccccacccaccccuccuggaucccccagcccauccagaccguccagcccucccccuuccccgagggcaccgccuccaacgucaccgucaugccccccgucgccgaggcccccaacuaccagggcccccccccccccuaccccaagcaccuccuccaccagaaccccuccgucccccccuacgaguccaucuccaagcccuccaaggaggaccagcccucccuccccaaggaggacgaguccgagaaguccuacgagaacgucgacuccggcgacaaggagaagaagcagaucaccaccucccccaucaccguccgcaagaacaagaaggacgaggagcgccgcgagucccgcauccaguccuacuccccccaggccuucaaguucuucauggagcagcacgucgagaacguccucaagucccaccagcagcgccuccaccgcaagaagcagcucgagaacgagaugaugcgcgucaagcccuucaagauguccaucuucauccucaaccaccucuucgccuggugccucuucuga

SEQ ID NO: 45278 - RNA, 3267 nt, Artificial Sequence
  derived and/or modified sequence opt2 from LATS2__Homo_sapiens__XP_005266399
augcgccccaagaccuuccccgccaccaccuacuccggcaacucccgccagcgccuccaggagauccgcgagggccucaagcagcccuccaaguccuccguccagggccuccccgccggccccaacuccgacaccucccucgacgccaagguccucggcuccaaggacgccacccgccagcagcagcagaugcgcgccacccccaaguucggccccuaccagaaggcccuccgcgagauccgcuacucccuccuccccuucgccaacgaguccggcaccuccgccgccgccgaggucaaccgccagaugcuccaggagcucgucaacgccggcugcgaccaggagauggccggccgcgcccucaagcagaccggcucccgcuccaucgaggccgcccucgaguacaucuccaagaugggcuaccucgacccccgcaacgagcagaucguccgcgucaucaagcagaccucccccggcaagggccucaugcccacccccgucacccgccgccccuccuucgagggcaccggcgacuccuucgccuccuaccaccagcucuccggcacccccuacgagggccccuccuucggcgccgacggccccaccgcccucgaggagaugccccgccccuacgucgacuaccucuuccccggcgucggcccccacggccccggccaccagcaccagcacccccccaagggcuacggcgccuccgucgaggccgccggcgcccacuucccccuccagggcgcccacuacggccgcccccaccuccucguccccggcgagccccucggcuacggcguccagcgcucccccuccuuccaguccaagaccccccccgagaccggcggcuacgccucccuccccaccaagggccagggcggcccccccggcgccggccucgccuuccccccccccgccgccggccucuacgucccccacccccaccacaagcaggccggccccgccgcccaccagcuccacguccucggcucccgcucccaggucuucgccuccgacucccccccccagucccuccucacccccucccgcaacucccucaacgucgaccucuacgagcucggcuccaccuccguccagcaguggcccgccgccacccucgcccgccgcgacucccuccagaagcccggccucgaggcccccccccgcgcccacgucgccuuccgccccgacugccccguccccucccgcaccaacuccuucaacucccaccagccccgccccggcccccccggcaaggccgagcccucccuccccgcccccaacaccgucaccgccgucaccgccgcccacauccuccaccccgucaaguccguccgcguccuccgccccgagccccagaccgccgucggccccucccaccccgccuggguccccgcccccgcccccgcccccgcccccgcccccgcccccgccgccgagggccucgacgccaaggaggagcacgcccucgcccucggcggcgccggcgccuucccccucgacgucgaguacggcggccccgaccgccgcugcccccccccccccuaccccaagcaccuccuccuccgcuccaaguccgagcaguacgaccucgacucccucugcgccggcauggagcagucccuccgcgccggccccaacgagcccgagggcggcgacaagucccgcaaguccgccaagggcgacaagggcggcaaggacaagaagcagauccagaccucccccguccccguccgcaagaacucccgcgacgaggagaagcgcgagucccgcaucaaguccuacucccccuacgccuucaaguucuucauggagcagcacgucgagaacgucaucaagaccuaccagcagaaggucaaccgccgccuccagcucgagcaggagauggccaaggccggccucugcgaggccgagcaggagcagaugcgcaagauccucuaccagaaggaguccaacuacaaccgccucaagcgcgccaagauggacaaguccauguucgucaagaucaagacccucggcaucggcgccuucggcgaggucugccucgccugcaaggucgacacccacgcccucuacgccaugaagacccuccgcaagaaggacguccucaaccgcaaccaggucgcccacgucaaggccgagcgcgacauccucgccgaggccgacaacgagugggucgucaagcucuacuacuccuuccaggacaaggacucccucuacuucgucauggacuacauccccggcggcgacaugaugucccuccucauccgcauggaggucuuccccgagcaccucgcccgcuucuacaucgccgagcucacccucgccaucgaguccguccacaagaugggcuucauccaccgcgacaucaagcccgacaacauccucaucgaccucgacggccacaucaagcucaccgacuucggccucugcaccggcuuccgcuggacccacaacuccaaguacuaccagaagggcucccacguccgccaggacuccauggagcccuccgaccucugggacgacgucuccaacugccgcugcggcgaccgccucaagacccucgagcagcgcgcccgcaagcagcaccagcgcugccucgcccacucccucgucggcacccccaacuacaucgcccccgagguccuccuccgcaagggcuacacccagcucugcgacuggugguccgucggcgucauccucuucgagaugcucgucggccagccccccuuccucgcccccacccccaccgagacccagcucaaggucaucaacugggagaacacccuccacauccccgcccaggucaagcucucccccgaggcccgcgaccucaucaccaagcucugcugcuccgccgaccaccgccucggccgcaacggcgccgacgaccucaaggcccaccccuucuucuccgccaucgacuucuccuccgacauccgcaagcagcccgcccccuacguccccaccaucucccaccccauggacaccuccaacuucgaccccgucgacgaggagucccccuggaacgacgccuccgagggcuccaccaaggccugggacacccucaccucccccaacaacaagcaccccgagcacgccuucuacgaguucaccuuccgccgcuucuucgacgacaacggcuaccccuuccgcugccccaagcccuccggcgccgaggccucccaggccgaguccuccgaccucgaguccuccgaccucgucgaccagaccgagggcugccagcccgucuacgucuga

SEQ ID NO: 45279 - RNA, 1149 nt, Artificial Sequence
  derived and/or modified sequence opt2 from LAX1__Homo_sapiens__NP_001129662
augcgcucccacuuccuccagugggcccucgccaccucccgcaacaaggaccagaucaccaacaucuucuccggcuucgccggccuccucgccauccuccucgucgucgccgucuucugcauccucuggaacuggaacaagcgcaagaagcgccagguccccuaccuccgcgucaccgucaugccccuccucacccucccccagacccgccagcgcgccaagaacaucuacgacauccuccccuggcgccaggaggaccucggccgccacgagucccgcuccaugcgcaucuucuccaccgagucccuccucucccgcaacuccgagucccccgagcacguccccucccaggccggcaacgccuuccaggagcacaccgcccacauccacgccaccgaguacgccgucggcaucuacgacaacgccauggucccccagaugugcggcaaccucacccccuccgcccacugcaucaacguccgcgccucccgcgacugcgccuccaucuccuccgaggacucccacgacuacgucaacguccccaccgccgaggagaucgccgagacccucgccuccaccaagucccccucccgcaaccucuucguccuccccuccacccagaagcucgaguucaccgaggagcgcgacgagggcugcggcgacgccggcgacugcaccucccucuacucccccggcgccgaggacuccgacucccucuccaacggcgagggcuccucccagaucuccaacgacuacgucaacaugaccggccucgaccucuccgccauccaggagcgccagcucugggucgccuuccagugcugccgcgacuacgagaacguccccgccgccgaccccuccggcucccagcagcaggccgagaaggacguccccuccuccaacaucggccacgucgaggacaagaccgacgaccccggcacccacguccagugcgucaagcgcaccuuccucgccuccggcgacuacgccgacuuccagcccuucacccaguccgaggacucccagaugaagcaccgcgaggagauguccaacgaggacuccuccgacuacgagaacguccucaccgccaagcucggcggccgcgacuccgagcagggccccggcacccagcuccuccccgacgaguga

SEQ ID NO: 45280 - RNA, 1149 nt, Artificial Sequence
  derived and/or modified sequence opt2 from LAYN__Homo_sapiens__NP_001245319
augcgccccggcaccgcccuccaggccguccuccucgccguccuccucgucggccuccgcgccgccaccggccgccuccucuccgccuccgaccucgaccuccgcggcggccagcccgucugccgcggcggcacccagcgccccugcuacaaggucaucuacuuccacgacaccucccgccgccucaacuucgaggaggccaaggaggccugccgccgcgacggcggccagcucgucuccaucgaguccgaggacgagcagaagcucaucgagaaguucaucgagaaccuccuccccuccgacggcgacuucuggaucggccuccgccgccgcgaggagaagcaguccaacuccaccgccugccaggaccucuacgccuggaccgacggcuccaucucccaguuccgcaacugguacgucgacgagcccuccugcggcuccgaggucugcgucgucauguaccaccagcccuccgcccccgccggcaucggcggccccuacauguuccaguggaacgacgaccgcugcaacaugaagaacaacuucaucugcaaguacuccgacgagaagcccgccguccccucccgcgaggccgagggcgaggagaccgagcucaccacccccguccuccccgaggagacccaggaggaggacgccaagaagaccuucaaggagucccgcgaggccgcccucaaccucgccuacauccucauccccuccaucccccuccuccuccuccucgucgucaccaccgucgucugcugggucuggaucugccgcaagcgcaagcgcgagcagcccgaccccuccaccaagaagcagcacaccaucuggcccuccccccaccagggcaacucccccgaccucgaggucuacaacgucauccgcaagcaguccgaggccgaccucgccgagacccgccccgaccucaagaacaucuccuuccgcgucugcuccggcgaggccacccccgacgacauguccugcgacuacgacaacauggccgucaaccccuccgaguccggcuucgucacccucgucuccgucgaguccggcuucgucaccaacgacaucuacgaguucucccccgaccagaugggccgcuccaaggaguccggcugggucgagaacgagaucuacggcuacuga

SEQ ID NO: 45281 - RNA, 318 nt, Artificial Sequence
  derived and/or modified sequence opt2 from LBH__Homo_sapiens__NP_112177
auguccaucuacuuccccauccacugccccgacuaccuccgcuccgccaagaugaccgaggucaugaugaacacccagcccauggaggagaucggccucuccccccgcaaggacggccucuccuaccagaucuuccccgaccccuccgacuucgaccgcugcugcaagcucaaggaccgccuccccuccaucgucgucgagcccaccgagggcgaggucgaguccggcgagcuccgcuggccccccgaggaguuccucguccaggaggacgagcaggacaacugcgaggagaccgccaaggagaacaaggagcaguga

SEQ ID NO: 45282 - RNA, 1446 nt, Artificial Sequence
  derived and/or modified sequence opt2 from LBP__Homo_sapiens__NP_004130
augggcgcccucgcccgcgcccuccccuccauccuccucgcccuccuccucaccuccacccccgaggcccucggcgccaaccccggccucgucgcccgcaucaccgacaagggccuccaguacgccgcccaggagggccuccucgcccuccaguccgagcuccuccgcaucacccuccccgacuucaccggcgaccuccgcaucccccacgucggccgcggccgcuacgaguuccacucccucaacauccacuccugcgagcuccuccacuccgcccuccgccccguccccggccagggccucucccucuccaucuccgacuccuccauccgcguccagggccgcuggaagguccgcaaguccuucuucaagcuccagggcuccuucgacgucuccgucaagggcaucuccaucuccgucaaccuccuccucggcuccgaguccuccggccgccccaccgucaccgccuccuccugcuccuccgacaucgccgacgucgaggucgacauguccggcgaccucggcuggcuccucaaccucuuccacaaccagaucgaguccaaguuccagaagguccucgagucccgcaucugcgagaugauccagaaguccgucuccuccgaccuccagcccuaccuccagacccuccccgucaccaccgagaucgacuccuucgccgacaucgacuacucccucgucgaggccccccgcgccaccgcccagaugcucgaggucauguucaagggcgagaucuuccaccgcaaccaccgcucccccgucacccuccucgccgccgucaugucccuccccgaggagcacaacaagauggucuacuucgccaucuccgacuacgucuucaacaccgccucccucgucuaccacgaggagggcuaccucaacuucuccaucaccgacgacaugaucccccccgacuccaacauccgccucaccaccaaguccuuccgccccuucgucccccgccucgcccgccucuaccccaacaugaaccucgagcuccagggcuccguccccuccgccccccuccucaacuucucccccggcaaccucuccgucgaccccuacauggagaucgacgccuucguccuccuccccuccuccuccaaggagcccgucuuccgccucuccgucgccaccaacgucuccgccacccucaccuucaacaccuccaagaucaccggcuuccucaagcccggcaaggucaaggucgagcucaaggaguccaaggucggccucuucaacgccgagcuccucgaggcccuccucaacuacuacauccucaacaccuucuaccccaaguucaacgacaagcucgccgagggcuucccccucccccuccucaagcgcguccagcucuacgaccucggccuccagauccacaaggacuuccucuuccucggcgccaacguccaguacaugcgcgucuga

SEQ ID NO: 45283 - RNA, 1722 nt, Artificial Sequence
  derived and/or modified sequence opt2 from LBR__Homo_sapiens__XP_005273182
augcccucccgcaaguucgccgacggcgaggucguccgcggccgcuggcccggcuccucccucuacuacgaggucgagauccucucccacgacuccaccucccagcucuacaccgucaaguacaaggacggcaccgagcucgagcucaaggagaacgacaucaagccccucaccuccuuccgccagcgcaagggcggcuccaccuccuccucccccucccgccgccgcggcucccgcucccgcucccgcucccgcucccccggccgcccccccaaguccgcccgccgcuccgccuccgccucccaccaggccgacaucaaggaggcccgccgcgaggucgaggucaagcucaccccccucauccucaagcccuucggcaacuccaucucccgcuacaacggcgagcccgagcacaucgagcgcaacgacgccccccacaagaacacccaggagaaguucucccucucccaggaguccuccuacaucgccacccaguacucccuccgcccccgccgcgaggaggucaagcucaaggagaucgacuccaaggaggagaaguacgucgccaaggagcucgccguccgcaccuucgaggucacccccauccgcgccaaggaccucgaguucggcggcguccccggcgucuuccucaucauguucggccuccccgucuuccucuuccuccuccuccucaugugcaagcagaaggaccccucccuccucaacuucccccccccccuccccgcccucuacgagcucugggagacccgcgucuucggcgucuaccuccucugguuccucauccagguccucuucuaccuccuccccaucggcaaggucgucgagggcaccccccucaucgacggccgccgccucaaguaccgccucaacggcuucuacgccuucauccucaccuccgccgucaucggcaccucccucuuccagggcgucgaguuccacuacgucuacucccacuuccuccaguucgcccucgccgccaccgucuucugcgucguccucuccgucuaccucuacaugcgcucccucaaggccccccgcaacgaccucucccccgccuccuccggcaacgccgucuacgacuucuucaucggccgcgagcucaacccccgcaucggcaccuucgaccucaaguacuucugcgagcuccgccccggccucaucggcugggaggcccuccucaccaccauggacaucauccacgacggcuucggcuucaugcucgccuucggcgaccucgucuggguccccuucaucuacuccuuccaggccuucuaccucgucucccaccccaacgaggucuccuggcccauggccucccucaucaucguccucaagcucugcggcuacgucaucuuccgcggcgccaacucccagaagaacgccuuccgcaagaaccccuccgaccccaagcucgcccaccucaagaccauccacaccuccaccggcaagaaccuccucgucuccggcugguggggcuucguccgccaccccaacuaccucggcgaccucaucauggcccucgccuggucccuccccugcggcuucaaccacauccuccccuacuucuacaucaucuacuucaccaugcuccucguccaccgcgaggcccgcgacgaguaccacugcaagaagaaguacggcgucgccugggagaaguacugccagcgcguccccuaccgcaucuuccccuacaucuacuga

SEQ ID NO: 45284 - RNA, 846 nt, Artificial Sequence
  derived and/or modified sequence opt2 from LBX1__Homo_sapiens__XP_005269500
augaccuccaaggaggacggcaaggccgcccccggcgaggagcgccgccgcuccccccucgaccaccuccccccccccgccaacuccaacaagccccucacccccuucuccaucgaggacauccucaacaagcccuccguccgccgcuccuacucccucugcggcgccgcccaccuccucgccgccgccgacaagcacgcccagggcggccucccccucgccggccgcgcccuccucucccagaccuccccccucugcgcccucgaggagcucgccuccaagaccuucaagggccucgaggucuccguccuccaggccgccgagggccgcgacggcaugaccaucuucggccagcgccagacccccaagaagcgccgcaagucccgcaccgccuucaccaaccaccagaucuacgagcucgagaagcgcuuccucuaccagaaguaccucucccccgccgaccgcgaccagaucgcccagcagcucggccucaccaacgcccaggucaucaccugguuccagaaccgccgcgccaagcucaagcgcgaccucgaggagaugaaggccgacgucgaguccgccaagaagcucggccccuccggccagauggacaucgucgcccucgccgagcucgagcagaacuccgaggccaccgccggcggcggcggcggcugcggccgcgccaagucccgccccggcucccccguccucccccccggcgcccccaaggcccccggcgccggcgcccuccagcucucccccgccuccccccucaccgaccagcccgccuccucccaggacugcuccgaggacgaggaggacgaggagaucgacgucgacgacuga

SEQ ID NO: 45285 - RNA, 585 nt, Artificial Sequence
  derived and/or modified sequence opt2 from LBX2__Homo_sapiens__NP_001009812
augggcaagcgcaccucccucgaggucucccucggcgagcucggcggcgagaagugccgcggcggccgccgcuccuuccccccccucgccgccucccgccccgcccgccccggcggcuggcgcugggcccgccgcgaccucugcaagaccgccucccgcgccgagaacaacucccaggccugccgcccccagcgccgcgccggccccgacgcccucggccccggccccuucggccgcaagcgccgcaagucccgcaccgccuucaccgcccagcagguccucgagcucgagcgccgcuucgucuuccagaaguaccucgcccccuccgagcgcgacggccucgccacccgccucggccucgccaacgcccaggucgucaccugguuccagaaccgccgcgccaagcucaagcgcgacgucgaggagaugcgcgccgacgucgccucccuccgcgcccucucccccgagguccucugcucccucgcccuccccgagggcgcccccgaccccggccucugccucggccccgccggccccgacucccgcccccaccucuccgacgaggagauccaggucgacgacuga

SEQ ID NO: 45286 - RNA, 2094 nt, Artificial Sequence
  derived and/or modified sequence opt2 from LCA5__Homo_sapiens__NP_001116241
augggcgagcgcgccggcucccccggcaccgaccaggagcgcaaggccggcaagcaccacuacuccuaccucuccgacuucgagaccccccaguccuccggccgcuccucccucgucuccuccucccccgccuccguccgccgcaagaaccccaagcgccagaccuccgacggccagguccaccaccaggccccccgcaagcccucccccaagggccuccccaaccgcaagggcguccgcgucggcuuccgcucccagucccucaaccgcgagccccuccgcaaggacaccgaccucgucaccaagcgcauccucuccgcccgccuccucaagaucaacgagcuccagaacgaggucuccgagcuccaggucaagcucgccgagcuccucaaggagaacaagucccucaagcgccuccaguaccgccaggagaaggcccucaacaaguucgaggacgccgagaacgagaucucccagcucaucuuccgccacaacaacgagaucaccgcccucaaggagcgccuccgcaagucccaggagaaggagcgcgccaccgagaagcgcgucaaggacaccgaguccgagcucuuccgcaccaaguucucccuccagaagcucaaggagaucuccgaggcccgccaccuccccgagcgcgacgaccucgccaagaagcucgucuccgccgagcucaagcucgacgacaccgagcgccgcaucaaggagcucuccaagaaccucgagcucuccaccaacuccuuccagcgccagcuccucgccgagcgcaagcgcgccuacgaggcccacgacgagaacaagguccuccagaaggagguccagcgccucuaccacaagcucaaggagaaggagcgcgagcucgacaucaagaacaucuacuccaaccgccuccccaaguccucccccaacaaggagaaggagcucgcccuccgcaagaacgccgccugccaguccgacuucgccgaccucugcaccaagggcguccagaccauggaggacuucaagcccgaggaguacccccucacccccgagaccaucaugugcuacgagaacaagugggaggagcccggccaccucacccucgaccuccagucccagaagcaggaccgccacggcgaggccggcauccucaaccccaucauggagcgcgaggagaaguucgucaccgacgaggagcuccacgucgucaagcaggaggucgagaagcucgaggacgagugggagcgcgaggagcucgacaagaagcagaaggagaaggccucccuccucgagcgcgaggagaagcccgagugggagaccggccgcuaccagcucggcauguaccccauccagaacauggacaagcuccagggcgaggaggaggagcgccucaagcgcgagaugcuccucgccaagcucaacgagaucgaccgcgagcuccaggacucccgcaaccucaaguaccccguccucccccuccuccccgacuucgaguccaagcuccacucccccgagcgcucccccaagaccuaccgcuucuccgaguccuccgagcgccucuucaacggccaccaccuccaggacaucuccuucuccacccccaagggcgagggccagaacuccggcaacguccgcucccccgccucccccaacgaguucgccuucggcuccuacguccccuccuucgccaagaccuccgagcgcuccaaccccuucucccagaaguccuccuuccucgacuuccagcgcaacuccauggagaagcucuccaaggacggcgucgaccucaucacccgcaaggagaagaaggccaaccucauggagcagcucuucggcgccuccggcuccuccaccaucuccuccaaguccuccgaccccaacuccgucgccuccuccaagggcgacaucgacccccucaacuuccuccccggcaacaagggcucccgcgaccaggagcacgacgaggacgagggcuucuuccucuccgagggccgcuccuucaaccccaaccgccaccgccucaagcacgccgacgacaagcccgccgucaaggccgccgacuccgucgaggacgagaucgaggaggucgcccuccgcuga

SEQ ID NO: 45287 - RNA, 1323 nt, Artificial Sequence
  derived and/or modified sequence opt2 from LCAT__Homo_sapiens__NP_000220
augggcccccccggcucccccuggcagugggucacccuccuccucggccuccuccucccccccgccgcccccuucuggcuccucaacguccucuuccccccccacaccacccccaaggccgagcucuccaaccacacccgccccgucauccucguccccggcugccucggcaaccagcucgaggccaagcucgacaagcccgacgucgucaacuggaugugcuaccgcaagaccgaggacuucuucaccaucuggcucgaccucaacauguuccucccccucggcgucgacugcuggaucgacaacacccgcgucgucuacaaccgcuccuccggccucgucuccaacgcccccggcguccagauccgcguccccggcuucggcaagaccuacuccgucgaguaccucgacuccuccaagcucgccggcuaccuccacacccucguccagaaccucgucaacaacggcuacguccgcgacgagaccguccgcgccgcccccuacgacuggcgccucgagcccggccagcaggaggaguacuaccgcaagcucgccggccucgucgaggagaugcacgccgccuacggcaagcccgucuuccucaucggccacucccucggcugccuccaccuccucuacuuccuccuccgccagccccaggccuggaaggaccgcuucaucgacggcuucaucucccucggcgcccccuggggcggcuccaucaagcccaugcucguccucgccuccggcgacaaccagggcauccccaucauguccuccaucaagcucaaggaggagcagcgcaucaccaccaccucccccuggauguuccccucccgcauggccuggcccgaggaccacgucuucaucuccacccccuccuucaacuacaccggccgcgacuuccagcgcuucuucgccgaccuccacuucgaggagggcugguacauguggcuccagucccgcgaccuccucgccggccuccccgcccccggcgucgaggucuacugccucuacggcgucggccuccccaccccccgcaccuacaucuacgaccacggcuuccccuacaccgaccccgucggcguccucuacgaggacggcgacgacaccgucgccacccgcuccaccgagcucugcggccucuggcagggccgccagccccagcccguccaccuccucccccuccacggcauccagcaccucaacauggucuucuccaaccucacccucgagcacaucaacgccauccuccucggcgccuaccgccagggcccccccgccucccccaccgccucccccgagccccccccccccgaguga

SEQ ID NO: 45288 - RNA, 267 nt, Artificial Sequence
  derived and/or modified sequence opt2 from LCE1C__Homo_sapiens__NP_001263260
auguccugccagcagucccagcagcagugccagcccccccccaacgucuccuccggcggcugcugcggcuccuccuccggcggcuccugcggcuccuccuccggcggcugcugcuccuccggcggcggcggcugcugccucucccaccaccgccgccgccgcucccacugccaccgcccccaguccuccggcugcugcucccagcccuccggcggcuccuccugcugcggcggcggcuccggccagcacuccggcggcugcugcuga

SEQ ID NO: 45289 - RNA, 270 nt, Artificial Sequence
  derived and/or modified sequence opt2 from LCE3A__Homo_sapiens__NP_848518
auguccugccagcagaaccagcagcagugccagcccccccccaagugccccgccaagucccccgcccagugccucccccccgccuccuccuccugcgcccccuccuccggcggcugcggccccuccuccgagcgcuccugcugccucucccaccaccgcugccgccgcucccaccgcugccgcugccaguccuccaacuccugcgaccgcggcuccggccagcagggcggcuccuccuccugcggccacuccuccgccggcugcugcuga

SEQ ID NO: 45290 - RNA, 288 nt, Artificial Sequence
  derived and/or modified sequence opt2 from LCE3B__Homo_sapiens__NP_848520
auguccugccagcagaaccagcagcagugccagccccuccccaagugccccucccccaagugcccccccaaguccuccgcccagugccucccccccgccuccuccugcugcgccccccgccccggcugcugcggcggccccuccuccgagggcggcugcugccucucccaccaccgcugcugccgcucccaccgcugccgccgccaguccuccaacuccugcgaccgcggcuccggccagcaggacggcgccuccgacugcggcuacggcuccggcggcugcugcuga

SEQ ID NO: 45291 - RNA, 285 nt, Artificial Sequence
  derived and/or modified sequence opt2 from LCE3C__Homo_sapiens__NP_848521
auguccugccagcagaaccagcagcagugccagcccccccccuccugccccucccccaagugcccccccaagucccccgcccagugccuccccccccccuccuccgacugcgcccucuccuccggcggcugcggccccuccuccgaguccggcugcugccucucccaccaccgccacuuccgcucccaccagugccgccgccagcgcuccaacuccugcgaccgcggcuccggccagcagggcggcggcuccugccgcggccacggcuccggcggcugcugcuga

SEQ ID NO: 45292 - RNA, 279 nt, Artificial Sequence
  derived and/or modified sequence opt2 from LCE3D__Homo_sapiens__NP_115952
auguccugccagcagaaccagcagcagugccagcccccccccaagugccccucccccaagugcccccccaagucccccguccagugccucccccccgccuccuccggcugcgcccccuccuccggcggcugcggccccuccuccgagggcggcugcuuccucaaccaccaccgccgccaccaccgcugccgccgccagcgccccaacuccugcgaccgcggcuccggccagcagggcggcggcuccggcugcggccacggcuccggcggcugcugcuga

SEQ ID NO: 45293 - RNA, 279 nt, Artificial Sequence
  derived and/or modified sequence opt2 from LCE3E__Homo_sapiens__NP_848522
auguccugccagcagaaccagaagcagugccagcccccccccaagugccccucccccaagugcccccccaagaaccccguccagugccucccccccgccuccuccggcugcgcccccuccuccggcggcugcggccccuccuccgagggcggcugcuuccucaaccaccaccgccgccaccaccgcugccgccgccagcgcuccaacuccugcgaccgcggcuccggccagcagggcggcggcuccggcugcugccacggcuccggcggcugcugcuga

SEQ ID NO: 45294 - RNA, 357 nt, Artificial Sequence
  derived and/or modified sequence opt2 from LCE5A__Homo_sapiens__NP_848525
auguccugccagcagucccagcagcagugccagcccccccccaagugcacccccaagugcccccccaagugcacccccaagugcccccccaagugcccccccaagugccccccccagugcuccgcccccugccccccccccgucuccuccugcugcggcuccuccuccggcggcugcugcuccuccgagggcggcggcugcugccucucccaccaccgcccccgccagucccuccgccgccgcccccaguccuccuccugcugcggcuccggcuccggccagcaguccggcggcuccuccugcugccacuccuccggcggcuccggcugcugccacuccuccggcggcugcugcuga

SEQ ID NO: 45295 - RNA, 1551 nt, Artificial Sequence
  derived and/or modified sequence opt2 from LCK__Homo_sapiens__XP_011539756
augggcugcggcugcuccucccaccccgaggacgacuggauggagaacaucgacgucugcgagaacugccacuaccccaucgucccccucgacggcaagggcacccuccucauccgcaacggcuccgagguccgcgacccccucgucaccuacgagggcuccaacccccccgccuccccccuccagggcgacccccgccagcagggccucaaggacaaggccugcggcucccucgccgucggcuuccaccucucccccaccuacuuccuccccggccucgccuuccucgucccccaccccgucacccccggcuuccuccccauccccgcccgcuucucccucaugccccucgucuucaccgacaaccucgucaucgcccuccacuccuacgagcccucccacgacggcgaccucggcuucgagaagggcgagcagcuccgcauccucgagcaguccggcgagugguggaaggcccagucccucaccaccggccaggagggcuucauccccuucaacuucgucgccaaggccaacucccucgagcccgagcccugguucuucaagaaccucucccgcaaggacgccgagcgccagcuccucgcccccggcaacacccacggcuccuuccucauccgcgaguccgaguccaccgccggcuccuucucccucuccguccgcgacuucgaccagaaccagggcgaggucgucaagcacuacaagauccgcaaccucgacaacggcggcuucuacaucuccccccgcaucaccuuccccggccuccacgagcucguccgccacuacacccgcuacuacaacggccacaccaaggucgccgucaagucccucaagcagggcuccaugucccccgacgccuuccucgccgaggccaaccucaugaagcagcuccagcaccagcgccucguccgccucuacgccgucgucacccaggagcccaucuacaucaucaccgaguacauggagaacggcucccucgucgacuuccucaagacccccuccggcaucaagcucaccaucaacaagcuccucgacauggccgcccagaucgccgagggcauggccuucaucgaggagcgcaacuacauccaccgcgaccuccgcgccgccaacauccucgucuccgacacccucuccugcaagaucgccgacuucggccucgcccgccucaucgaggacaacgaguacaccgcccgcgagggcgccaaguuccccaucaaguggaccgcccccgaggccaucaacuacggcaccuucaccaucaaguccgacgucugguccuucggcauccuccucaccgagaucgucacccacggccgcauccccuaccccggcaugaccaaccccgaggucauccagaaccucgagcgcggcuaccgcaugguccgccccgacaacugccccgaggagcucuaccagcucaugcgccucugcuggaaggagcgccccgaggaccgccccaccuucgacuaccuccgcuccguccucgaggacuucuucaccgccaccgagggccaguaccagccccagcccuga

SEQ ID NO: 45296 - RNA, 1131 nt, Artificial Sequence
  derived and/or modified sequence opt2 from LCLAT1__Homo_sapiens__NP_001291374
auggucuccuggaagggcaucuacuucauccucacccucuucuggggcuccuucuucggcuccaucuucaugcucucccccuuccucccccucauguucgucaaccccuccugguaccgcuggaucaacaaccgccucgucgccaccuggcucacccuccccgucgcccuccucgagaccauguucggcgucaaggucaucaucaccggcgacgccuucguccccggcgagcgcuccgucaucaucaugaaccaccgcacccgcauggacuggauguuccucuggaacugccucaugcgcuacuccuaccuccgccucgagaagaucugccucaaggccucccucaagggcguccccggcuucggcugggccaugcaggccgccgccuacaucuucauccaccgcaaguggaaggacgacaagucccacuucgaggacaugaucgacuacuucugcgacauccacgagccccuccagcuccucaucuuccccgagggcaccgaccucaccgagaacuccaagucccgcuccaacgccuucgccgagaagaacggccuccagaaguacgaguacguccuccacccccgcaccaccggcuucaccuucgucgucgaccgccuccgcgagggcaagaaccucgacgccguccacgacaucaccgucgccuacccccacaacaucccccaguccgagaagcaccuccuccagggcgacuucccccgcgagauccacuuccacguccaccgcuaccccaucgacacccuccccaccuccaaggaggaccuccagcucuggugccacaagcgcugggaggagaaggaggagcgccuccgcuccuucuaccagggcgagaagaacuucuacuucaccggccaguccgucaucccccccugcaaguccgagcuccgcguccucgucgucaagcuccucuccauccucuacuggacccucuucucccccgccaugugccuccucaucuaccucuacucccucgucaagugguacuucaucaucaccaucgucaucuucguccuccaggagcgcaucuucggcggccucgagaucaucgagcucgccugcuaccgccuccuccacaagcagccccaccucaacuccaagaagaacgaguga

SEQ ID NO: 45297 - RNA, 840 nt, Artificial Sequence
  derived and/or modified sequence opt2 from LCMT1__Homo_sapiens__NP_001027563
auggccacccgccagcgcgaguccuccaucaccuccugcugcuccaccuccuccugcgacgccgacgacgagggcguccgcggcaccugcgaggacgccucccucugcaagcgcuucgccgucuccaucggcuacuggcacgaccccuacauccagcacuucguccgccucuccaaggagcgcaaggcccccgagaucaaccgcggcuacuucgcccgcguccacggcgucucccagcucaucaaggccuuccuccgcaagaccgagugccacugccagaucgucaaccucggcgccggcauggacaccaccuucuggcgccucaaggacgaggaccuccuccccuccaaguacuucgaggucgacuuccccaugaucgucacccgcaagcuccacuccaucaagcuccccacccuccucaucgccgagugcguccucgucuacaugacccccgagcaguccgccaaccuccucaagugggccgccaacuccuucgagcgcgccauguucaucaacuacgagcaggucaacaugggcgaccgcuucggccagaucaugaucgagaaccuccgccgccgccagugcgaccucgccggcgucgagaccugcaagucccucgagucccagaaggagcgccuccucuccaacggcugggagaccgccuccgccgucgacaugauggagcucuacaaccgccucccccgcgccgaggucucccgcaucgagucccucgaguuccucgacgagauggagcuccucgagcagcucaugcgccacuacugccucugcugggccaccaagggcggcaacgagcucggccucaaggagaucaccuacuga

SEQ ID NO: 45298 - RNA, 531 nt, Artificial Sequence
  derived and/or modified sequence opt2 from LCN1__Homo_sapiens__NP_001239546
augaagccccuccuccucgccgucucccucggccucaucgccgcccuccaggcccaccaccuccucgccuccgacgaggagauccaggacgucuccggcaccugguaccucaaggccaugaccgucgaccgcgaguuccccgagaugaaccucgaguccgucacccccaugacccucaccacccucgagggcggcaaccucgaggccaaggucaccaugcucaucuccggccgcugccaggaggucaaggccguccucgagaagaccgacgagcccggcaaguacaccgccgacggcggcaagcacgucgccuacaucauccgcucccacgucaaggaccacuacaucuucuacugcgagggcgagcuccacggcaagcccguccgcggcgucaagcucgucggccgcgaccccaagaacaaccucgaggcccucgaggacuucgagaaggccgccggcgcccgcggccucuccaccgaguccauccucaucccccgccaguccgagaccugcucccccggcuccgacuga

SEQ ID NO: 45299 - RNA, 597 nt, Artificial Sequence
  derived and/or modified sequence opt2 from LCN2__Homo_sapiens__NP_005555
augccccucggccuccucuggcucggccucgcccuccucggcgcccuccacgcccaggcccaggacuccaccuccgaccucauccccgcccccccccucuccaaggucccccuccagcagaacuuccaggacaaccaguuccagggcaagugguacgucgucggccucgccggcaacgccauccuccgcgaggacaaggacccccagaagauguacgccaccaucuacgagcucaaggaggacaaguccuacaacgucaccuccguccucuuccgcaagaagaagugcgacuacuggauccgcaccuucguccccggcugccagcccggcgaguucacccucggcaacaucaaguccuaccccggccucaccuccuaccucguccgcgucgucuccaccaacuacaaccagcacgccauggucuucuucaagaaggucucccagaaccgcgaguacuucaagaucacccucuacggccgcaccaaggagcucaccuccgagcucaaggagaacuucauccgcuucuccaagucccucggccuccccgagaaccacaucgucuuccccguccccaucgaccagugcaucgacggcuga

SEQ ID NO: 45300 - RNA, 1221 nt, Artificial Sequence
  derived and/or modified sequence opt2 from LCOR__Homo_sapiens__NP_001164237
augcagcgcaugauccagcaguucgccgccgaguacaccuccaagaacuccuccacccaggaccccucccagcccaacuccaccaagaaccagucccuccccaaggccucccccgucaccaccucccccaccgccgccaccacccagaaccccguccucuccaagcuccucauggccgaccaggacuccccccucgaccucaccguccgcaagucccaguccgagcccuccgagcaggacggcguccucgaccucuccaccaagaagucccccugcgccggcuccaccucccucucccacucccccggcugcuccuccacccagggcaacggccgccccggccgccccucccaguaccgccccgacggccuccgcuccggcgacggcguccccccccgcucccuccaggacggcacccgcgagggcuucggccacuccaccucccucaaggucccccucgcccgcucccuccagaucuccgaggagcuccucucccgcaaccagcucuccaccgccgccucccucggccccuccggccuccagaaccacggccagcaccucauccucucccgcgaggccuccugggccaagccccacuacgaguucaaccucucccgcaugaaguuccgcggcaacggcgcccucuccaacaucuccgaccuccccuuccucgccgagaacuccgccuuccccaagauggcccuccaggccaagcaggacggcaagaaggacgucucccacuccucccccgucgaccucaagaucccccagguccgcggcauggaccucuccugggagucccgcaccggcgaccaguacuccuacuccucccucgucaugggcucccagaccgaguccgcccucuccaagaagcuccgcgccauccuccccaagcagucccgcaaguccaugcucgacgccggccccgacuccuggggcuccgacgccgagcaguccaccuccggccagcccuaccccaccuccgaccaggagggcgaccccggcuccaagcagccccgcaagaagcgcggccgcuaccgccaguacaacuccgagauccucgaggaggccaucuccgucgucauguccggcaagauguccgucuccaaggcccaguccaucuacggcaucccccacuccacccucgaguacaaggucaaggagcgccucggcacccucaagaacccccccaagaagaagaugaagcucauguccggcuga

SEQ ID NO: 45301 - RNA, 1884 nt, Artificial Sequence
  derived and/or modified sequence opt2 from LCP1__Homo_sapiens__XP_005266431
auggcccgcggcuccgucuccgacgaggagaugauggagcuccgcgaggccuucgccaaggucgacaccgacggcaacggcuacaucuccuucaacgagcucaacgaccucuucaaggccgccugccucccccuccccggcuaccgcguccgcgagaucaccgagaaccucauggccaccggcgaccucgaccaggacggccgcaucuccuucgacgaguucaucaagaucuuccacggccucaaguccaccgacgucgccaagaccuuccgcaaggccaucaacaagaaggagggcaucugcgccaucggcggcaccuccgagcaguccuccgucggcacccagcacuccuacuccgaggaggagaaguacgccuucgucaacuggaucaacaaggcccucgagaacgaccccgacugccgccacgucauccccaugaaccccaacaccaacgaccucuucaacgccgucggcgacggcaucguccucugcaagaugaucaaccucuccguccccgacaccaucgacgagcgcaccaucaacaagaagaagcucacccccuucaccauccaggagaaccucaaccucgcccucaacuccgccuccgccaucggcugccacgucgucaacaucggcgccgaggaccucaaggagggcaagcccuaccucguccucggccuccucuggcaggucaucaagaucggccucuucgccgacaucgagcucucccgcaacgaggcccucaucgcccuccuccgcgagggcgagucccucgaggaccucaugaagcucucccccgaggagcuccuccuccgcugggccaacuaccaccucgagaacgccggcugcaacaagaucggcaacuucuccaccgacaucaaggacuccaaggccuacuaccaccuccucgagcaggucgcccccaagggcgacgaggagggcguccccgccgucgucaucgacauguccggccuccgcgagaaggacgacauccagcgcgccgagugcaugcuccagcaggccgagcgccucggcugccgccaguucgucaccgccaccgacgucguccgcggcaaccccaagcucaaccucgccuucaucgccaaccucuucaaccgcuaccccgcccuccacaagcccgagaaccaggacaucgacuggggcgcccucgagggcgagacccgcgaggagcgcaccuuccgcaacuggaugaacucccucggcgucaacccccgcgucaaccaccucuacuccgaccucuccgacgcccucgucaucuuccagcucuacgagaagaucaagguccccgucgacuggaaccgcgucaacaagccccccuaccccaagcucggcggcaacaugaagaagcucgagaacugcaacuacgccgucgagcucggcaagaaccaggccaaguucucccucgucggcaucggcggccaggaccucaacgagggcaaccgcacccucacccucgcccucaucuggcagcucaugcgccgcuacacccucaacauccucgaggagaucggcggcggccagaaggucaacgacgacaucaucgucaacugggucaacgagacccuccgcgaggccaagaaguccuccuccaucuccuccuucaaggaccccaagaucuccaccucccuccccguccucgaccucaucgacgccauccagcccggcuccaucaacuacgaccuccucaagaccgagaaccucaacgacgacgagaagcucaacaacgccaaguacgccaucuccauggcccgcaagaucggcgcccgcgucuacgcccuccccgaggaccucgucgaggucaaccccaagauggucaugaccgucuucgccugccucaugggcaagggcaugaagcgcgucuga

SEQ ID NO: 45302 - RNA, 1602 nt, Artificial Sequence
  derived and/or modified sequence opt2 from LCP2__Homo_sapiens__NP_005556
auggcccuccgcaacguccccuuccgcuccgagguccucggcugggaccccgacucccucgccgacuacuucaagaagcucaacuacaaggacugcgagaaggccgucaagaaguaccacaucgacggcgcccgcuuccucaaccucaccgagaacgacauccagaaguuccccaagcuccgcguccccauccucuccaagcucucccaggagaucaacaagaacgaggagcgccgcuccaucuucacccgcaagccccaggucccccgcuuccccgaggagaccgagucccacgaggaggacaacggcggcugguccuccuucgaggaggacgacuacgagucccccaacgacgaccaggacggcgaggacgacggcgacuacgagucccccaacgaggaggaggaggcccccgucgaggacgacgccgacuacgagcccccccccuccaacgacgaggaggcccuccagaacuccauccuccccgccaagcccuuccccaacuccaacuccauguacaucgaccgcccccccuccggcaagaccccccagcagccccccguccccccccagcgccccauggccgcccucccccccccccccgccggccgcaaccacuccccccucccccccccccagaccaaccacgaggagcccucccgcucccgcaaccacaagaccgccaagcuccccgcccccuccaucgaccgcuccaccaagcccccccucgaccgcucccucgcccccuucgaccgcgagcccuucacccucggcaagaagccccccuucuccgacaagcccuccauccccgccggccgcucccucggcgagcaccuccccaagauccagaagcccccccucccccccaccaccgagcgccacgagcgcuccuccccccuccccggcaagaagccccccguccccaagcacggcuggggccccgaccgccgcgagaacgacgaggacgacguccaccagcgcccccucccccagcccgcccuccuccccauguccuccaacaccuuccccucccgcuccaccaagcccucccccaugaacccccuccccuccucccacaugcccggcgccuucuccgaguccaacuccuccuucccccaguccgccucccucccccccuacuucucccagggccccuccaaccgcccccccauccgcgccgagggccgcaacuucccccucccccuccccaacaagccccgcccccccucccccgccgaggaggagaacucccucaacgaggagugguacgucuccuacaucacccgccccgaggccgaggccgcccuccgcaagaucaaccaggacggcaccuuccucguccgcgacuccuccaagaagaccaccaccaaccccuacguccucaugguccucuacaaggacaaggucuacaacauccagauccgcuaccagaaggagucccaggucuaccuccucggcaccggccuccgcggcaaggaggacuuccucuccgucuccgacaucaucgacuacuuccgcaagaugccccuccuccucaucgacggcaagaaccgcggcucccgcuaccagugcacccucacccacgccgccggcuaccccuga

SEQ ID NO: 45303 - RNA, 5784 nt, Artificial Sequence
  derived and/or modified sequence opt2 from LCT__Homo_sapiens__NP_002290
auggagcucuccuggcacgucgucuucaucgcccuccucuccuucuccugcuggggcuccgacugggaguccgaccgcaacuucaucuccaccgccggcccccucaccaacgaccuccuccacaaccucuccggccuccucggcgaccaguccuccaacuucgucgccggcgacaaggacauguacgucugccaccagccccuccccaccuuccuccccgaguacuucuccucccuccacgccucccagaucacccacuacaaggucuuccucuccugggcccagcuccuccccgccggcuccacccagaaccccgacgagaagaccguccagugcuaccgccgccuccucaaggcccucaagaccgcccgccuccagcccauggucauccuccaccaccagacccuccccgccuccacccuccgccgcaccgaggccuucgccgaccucuucgccgacuacgccaccuucgccuuccacuccuucggcgaccucgucggcaucugguucaccuucuccgaccucgaggaggucaucaaggagcucccccaccaggagucccgcgccucccagcuccagacccucuccgacgcccaccgcaaggccuacgagaucuaccacgaguccuacgccuuccagggcggcaagcucuccgucguccuccgcgccgaggacauccccgagcuccuccucgagccccccaucuccgcccucgcccaggacaccgucgacuuccucucccucgaccucuccuacgagugccagaacgaggccucccuccgccagaagcucuccaagcuccagaccaucgagcccaaggucaaggucuucaucuucaaccucaagcuccccgacugccccuccaccaugaagaaccccgccucccuccucuucucccucuucgaggccaucaacaaggaccagguccucaccaucggcuucgacaucaacgaguuccucuccugcuccuccuccuccaagaaguccauguccugcucccucaccggcucccucgcccuccagcccgaccagcagcaggaccacgagaccaccgacuccucccccgccuccgccuaccagcgcaucugggaggccuucgccaaccagucccgcgccgagcgcgacgccuuccuccaggacaccuuccccgagggcuuccucuggggcgccuccaccggcgccuucaacgucgagggcggcugggccgagggcggccgcggcgucuccaucugggacccccgccgcccccucaacaccaccgagggccaggccacccucgaggucgccuccgacuccuaccacaaggucgccuccgacgucgcccuccucugcggccuccgcgcccaggucuacaaguucuccaucuccuggucccgcaucuuccccaugggccacggcuccucccccucccuccccggcgucgccuacuacaacaagcucaucgaccgccuccaggacgccggcaucgagcccauggccacccucuuccacugggaccucccccaggcccuccaggaccacggcggcuggcagaacgaguccgucgucgacgccuuccucgacuacgccgccuucugcuucuccaccuucggcgaccgcgucaagcucugggucaccuuccacgagcccugggucauguccuacgccggcuacggcaccggccagcacccccccggcaucuccgaccccggcgucgccuccuucaaggucgcccaccucguccucaaggcccacgcccgcaccuggcaccacuacaacucccaccaccgcccccagcagcagggccacgucggcaucguccucaacuccgacugggccgagccccucucccccgagcgccccgaggaccuccgcgccuccgagcgcuuccuccacuucaugcucggcugguucgcccaccccgucuucgucgacggcgacuaccccgccacccuccgcacccagauccagcagaugaaccgccagugcucccaccccgucgcccagcuccccgaguucaccgaggccgagaagcagcuccucaagggcuccgccgacuuccucggccucucccacuacaccucccgccucaucuccaacgccccccagaacaccugcauccccuccuacgacaccaucggcggcuucucccagcacgucaaccacgucuggccccagaccuccuccuccuggauccgcgucguccccuggggcauccgccgccuccuccaguucgucucccucgaguacacccgcggcaagguccccaucuaccucgccggcaacggcaugcccaucggcgaguccgagaaccucuucgacgacucccuccgcgucgacuacuucaaccaguacaucaacgagguccucaaggccaucaaggaggacuccgucgacguccgcuccuacaucgcccgcucccucaucgacggcuucgagggccccuccggcuacucccagcgcuucggccuccaccacgucaacuucuccgacuccuccaagucccgcaccccccgcaaguccgccuacuucuucaccuccaucaucgagaagaacggcuuccucaccaagggcgccaagcgccuccucccccccaacaccgucaaccuccccuccaagguccgcgccuucaccuuccccuccgagguccccuccaaggccaaggucgucugggagaaguucuccucccagcccaaguucgagcgcgaccucuucuaccacggcaccuuccgcgacgacuuccucuggggcgucuccuccuccgccuaccagaucgagggcgccugggacgccgacggcaagggccccuccaucugggacaacuucacccacacccccggcuccaacgucaaggacaacgccaccggcgacaucgccugcgacuccuaccaccagcucgacgccgaccucaacaugcuccgcgcccucaaggucaaggccuaccgcuucuccaucuccuggucccgcaucuuccccaccggccgcaacuccuccaucaacucccacggcgucgacuacuacaaccgccucaucaacggccucgucgccuccaacaucuuccccauggucacccucuuccacugggaccucccccaggcccuccaggacaucggcggcugggagaaccccgcccucaucgaccucuucgacuccuacgccgacuucugcuuccagaccuucggcgaccgcgucaaguucuggaugaccuucaacgagcccauguaccucgccuggcucggcuacggcuccggcgaguucccccccggcgucaaggaccccggcugggcccccuaccgcaucgcccacgccgucaucaaggcccacgcccgcgucuaccacaccuacgacgagaaguaccgccaggagcagaagggcgucaucucccucucccucuccacccacugggccgagcccaagucccccggcgucccccgcgacgucgaggccgccgaccgcaugcuccaguucucccucggcugguucgcccaccccaucuuccgcaacggcgacuaccccgacaccaugaaguggaaggucggcaaccgcuccgagcuccagcaccucgccaccucccgccuccccuccuucaccgaggaggagaagcgcuucauccgcgccaccgccgacgucuucugccucaacaccuacuacucccgcaucguccagcacaagaccccccgccucaacccccccuccuacgaggacgaccaggagauggccgaggaggaggaccccuccuggcccuccaccgccaugaaccgcgccgcccccuggggcacccgccgccuccucaacuggaucaaggaggaguacggcgacauccccaucuacaucaccgagaacggcgucggccucaccaaccccaacaccgaggacaccgaccgcaucuucuaccacaagaccuacaucaacgaggcccucaaggccuaccgccucgacggcaucgaccuccgcggcuacgucgccuggucccucauggacaacuucgaguggcucaacggcuacaccgucaaguucggccucuaccacgucgacuucaacaacaccaaccgcccccgcaccgcccgcgccuccgcccgcuacuacaccgaggucaucaccaacaacggcaugccccucgcccgcgaggacgaguuccucuacggccgcuuccccgagggcuucaucugguccgccgccuccgccgccuaccagaucgagggcgccuggcgcgccgacggcaagggccucuccaucugggacaccuucucccacaccccccuccgcgucgagaacgacgccaucggcgacgucgccugcgacuccuaccacaagaucgccgaggaccucgucacccuccagaaccucggcgucucccacuaccgcuucuccaucuccuggucccgcauccuccccgacggcaccacccgcuacaucaacgaggccggccucaacuacuacguccgccucaucgacacccuccucgccgccuccauccagccccaggucaccaucuaccacugggaccucccccagacccuccaggacgucggcggcugggagaacgagaccaucguccagcgcuucaaggaguacgccgacguccucuuccagcgccucggcgacaaggucaaguucuggaucacccucaacgagcccuucgucaucgccuaccagggcuacggcuacggcaccgccgcccccggcgucuccaaccgccccggcaccgcccccuacaucgucggccacaaccucaucaaggcccacgccgaggccuggcaccucuacaacgacgucuaccgcgccucccagggcggcgucaucuccaucaccaucuccuccgacugggccgagccccgcgaccccuccaaccaggaggacgucgaggccgcccgccgcuacguccaguucaugggcggcugguucgcccaccccaucuucaagaacggcgacuacaacgaggucaugaagacccgcauccgcgaccgcucccucgccgccggccucaacaagucccgccuccccgaguucaccgaguccgagaagcgccgcaucaacggcaccuacgacuucuucggcuucaaccacuacaccaccguccucgccuacaaccucaacuacgccaccgccaucuccuccuucgacgccgaccgcggcgucgccuccaucgccgaccgcuccuggcccgacuccggcuccuucuggcucaagaugacccccuucggcuuccgccgcauccucaacuggcucaaggaggaguacaacgacccccccaucuacgucaccgagaacggcgucucccagcgcgaggagaccgaccucaacgacaccgcccgcaucuacuaccuccgcaccuacaucaacgaggcccucaaggccguccaggacaaggucgaccuccgcggcuacaccgucugguccgccauggacaacuucgagugggccaccggcuucuccgagcgcuucggccuccacuucgucaacuacuccgaccccucccucccccgcauccccaaggccuccgccaaguucuacgccuccgucguccgcugcaacggcuuccccgaccccgccaccggcccccacgccugccuccaccagcccgacgccggccccaccaucucccccguccgccaggaggagguccaguuccucggccucaugcucggcaccaccgaggcccagaccgcccucuacguccucuucucccucguccuccucggcgucugcggccucgccuuccucuccuacaaguacugcaagcgcuccaagcagggcaagacccagcgcucccagcaggagcucucccccgucuccuccuucuga

SEQ ID NO: 45304 - RNA, 1236 nt, Artificial Sequence
  derived and/or modified sequence opt2 from LDB1__Homo_sapiens__NP_001106878
auguccgucggcugcgccugccccggcugcuccuccaaguccuucaagcucuacucccccaaggagccccccaacggcaacgccuucccccccuuccaccccggcaccaugcucgaccgcgacgucggccccacccccauguacccccccaccuaccucgagcccggcaucggccgccacacccccuacggcaaccagaccgacuaccgcaucuucgagcucaacaagcgccuccagaacuggaccgaggagugcgacaaccucuggugggacgccuucaccaccgaguucuucgaggacgacgccaugcucaccaucaccuucugccucgaggacggccccaagcgcuacaccaucggccgcacccucaucccccgcuacuuccgcuccaucuucgagggcggcgccaccgagcucuacuacguccucaagcaccccaaggaggccuuccacuccaacuucgucucccucgacugcgaccagggcuccauggucacccagcacggcaagcccauguucacccaggucugcgucgagggccgccucuaccucgaguucauguucgacgacaugaugcgcaucaagaccuggcacuucuccauccgccagcaccgcgagcucaucccccgcuccauccucgccaugcacgcccaggacccccagaugcucgaccagcucuccaagaacaucacccgcugcggccucuccaacuccacccucaacuaccuccgccucugcgucauccucgagcccaugcaggagcucaugucccgccacaagaccuacucccucuccccccgcgacugccucaagaccugccucuuccagaaguggcagcgcauggucgccccccccgccgagcccacccgccagcagcccuccaagcgccgcaagcgcaagauguccggcggcuccaccauguccuccggcggcggcaacaccaacaacuccaacuccaagaagaagucccccgccuccaccuucgcccucuccucccagguccccgacgucauggucgucggcgagcccacccucaugggcggcgaguucggcgacgaggacgagcgccucaucacccgccucgagaacacccaguucgacgccgccaacggcaucgacgacgaggacuccuucaacaacucccccgcccucggcgccaacucccccuggaacuccaagccccccuccucccaggaguccaaguccgagaaccccaccucccaggccucccaguga

SEQ ID NO: 45305 - RNA, 996 nt, Artificial Sequence
  derived and/or modified sequence opt2 from LDB2__Homo_sapiens__NP_001124306
auguccuccaccccccacgaccccuucuacuccucccccuucggccccuucuaccgccgccacacccccuacaugguccagcccgaguaccgcaucuacgagaugaacaagcgccuccagucccgcaccgaggacuccgacaaccucuggugggacgccuucgccaccgaguucuucgaggacgacgccacccucacccucuccuucugccucgaggacggccccaagcgcuacaccaucggccgcacccucaucccccgcuacuucuccaccgucuucgagggcggcgucaccgaccucuacuacauccucaagcacuccaaggaguccuaccacaacuccuccaucaccgucgacugcgaccagugcaccauggucacccagcacggcaagcccauguucaccaaggucugcaccgagggccgccucauccucgaguucaccuucgacgaccucaugcgcaucaagaccuggcacuucaccauccgccaguaccgcgagcucgucccccgcuccauccucgccaugcacgcccaggacccccagguccucgaccagcucuccaagaacaucacccgcaugggccucaccaacuucacccucaacuaccuccgccucugcgucauccucgagcccaugcaggagcucaugucccgccacaagaccuacaaccucuccccccgcgacugccucaagaccugccucuuccagaaguggcagcgcauggucgccccccccgccgagcccacccgccagcccaccaccaagcgccgcaagcgcaagaacuccaccuccuccaccuccaacuccuccgccggcaacaacgccaacuccaccggcuccaagaagaagaccaccgccgccaaccucucccucuccucccagguccccggccucggcgccauccccaacugcucccucaaccccggccgcgacggcgaccucugccacuccaccgccgucacccccuccggccaguucaaggagaagcacuga

SEQ ID NO: 45306 - RNA, 1854 nt, Artificial Sequence
  derived and/or modified sequence opt2 from LDB3__Homo_sapiens__NP_001073583
auguccuacuccgucacccucaccggccccggccccuggggcuuccgccuccagggcggcaaggacuucaacaugccccucaccaucucccgcaucacccccggcuccaaggccgcccagucccagcucucccagggcgaccucgucgucgccaucgacggcgucaacaccgacaccaugacccaccucgaggcccagaacaagaucaaguccgccuccuacaaccucucccucacccuccagaaguccaagcgccccauccccaucuccaccaccgccccccccguccagaccccccuccccgucaucccccaccagaaggucgucgucaacucccccgccaacgccgacuaccaggagcgcuucaaccccuccgcccucaaggacuccgcccucuccacccacaagcccaucgaggucaagggccucggcggcaaggccaccaucauccacgcccaguacaacacccccaucuccauguacucccaggacgccaucauggacgccaucgccggccaggcccaggcccagggcuccgacuucuccggcucccuccccaucaaggaccucgccgucgacuccgccucccccgucuaccaggccgucaucaagucccagaacaagcccgaggacgaggccgacgagugggcccgccgcuccuccaaccuccagucccgcuccuuccgcauccucgcccagaugaccggcaccgaguucaugcaggaccccgacgaggaggcccuccgccgcucccgcccccaggccuccuccuacucccccgccgucgccgccuccuccgcccccgccacccacaccuccuacuccgagggccccgccgcccccgcccccaagccccgcgucgucaccaccgccuccauccgccccuccgucuaccagcccguccccgccuccaccuacucccccucccccggcgccaacuacucccccacccccuacacccccucccccgcccccgccuacacccccucccccgcccccgccuacacccccucccccguccccaccuacacccccucccccgcccccgccuacacccccucccccgcccccaacuacaaccccgcccccuccgucgccuacuccggcggccccgccgagcccgccucccgcccccccugggucaccgacgacuccuucucccagaaguucgcccccggcaaguccaccaccuccaucuccaagcagacccucccccgcggcggccccgccuacacccccgccggcccccagguccccccccucgcccgcggcaccguccagcgcgccgagcgcuuccccgccuccucccgcaccccccucugcggccacugcaacaacgucauccgcggccccuuccucgucgccaugggccgcuccuggcaccccgaggaguucaccugcgccuacugcaagaccucccucgccgacgucugcuucgucgaggagcagaacaacgucuacugcgagcgcugcuacgagcaguucuucgccccccucugcgccaagugcaacaccaagaucaugggcgaggucaugcacgcccuccgccagaccuggcacaccaccugcuucgucugcgccgccugcaagaagcccuucggcaacucccucuuccacauggaggacggcgagcccuacugcgagaaggacuacaucaaccucuucuccaccaagugccacggcugcgacuuccccgucgaggccggcgacaaguucaucgaggcccucggccacaccuggcacgacaccugcuucaucugcgccgucugccacgucaaccucgagggccagcccuucuacuccaagaaggaccgcccccucugcaagaagcacgcccacaccaucaaccucuga

SEQ ID NO: 45307 - RNA, 825 nt, Artificial Sequence
  derived and/or modified sequence opt2 from LDHA__Homo_sapiens__NP_001128711
auggccacccucaaggaccagcucaucuacaaccuccucaaggaggagcagaccccccagaacaagaucaccgucgucggcgucggcgccgucggcauggccugcgccaucuccauccucaugaaggaccucgccgacgagcucgcccucgucgacgucaucgaggacaagcucaagggcgagaugauggaccuccagcacggcucccucuuccuccgcacccccaagaucgucuccggcaaggucgacauccucaccuacgucgccuggaagaucuccggcuuccccaagaaccgcgucaucggcuccggcugcaaccucgacuccgcccgcuuccgcuaccucaugggcgagcgccucggcguccacccccucuccugccacggcuggguccucggcgagcacggcgacuccuccguccccgucugguccggcaugaacgucgccggcgucucccucaagacccuccaccccgaccucggcaccgacaaggacaaggagcaguggaaggagguccacaagcaggucgucgaguccgccuacgaggucaucaagcucaagggcuacaccuccugggccaucggccucuccgucgccgaccucgccgaguccaucaugaagaaccuccgccgcguccaccccgucuccaccaugaucaagggccucuacggcaucaaggacgacgucuuccucuccguccccugcauccucggccagaacggcaucuccgaccucgucaaggucacccucaccuccgaggaggaggcccgccucaagaaguccgccgacacccucuggggcauccagaaggagcuccaguucuga

SEQ ID NO: 45308 - RNA, 1146 nt, Artificial Sequence
  derived and/or modified sequence opt2 from LDHAL6B__Homo_sapiens__NP_149972
auguccuggaccguccccgucguccgcgccucccagcgcgucuccuccgucggcgccaacuuccucugccucggcauggcccucugcccccgccaggccacccgcaucccccucaacggcaccuggcucuucacccccgucuccaagauggccaccgucaaguccgagcucaucgagcgcuucaccuccgagaagcccguccaccacuccaaggucuccaucaucggcaccggcuccgucggcauggccugcgccaucuccauccuccucaagggccucuccgacgagcucgcccucgucgaccucgacgaggacaagcucaagggcgagaccauggaccuccagcacggcucccccuucaccaagaugcccaacaucgucugcuccaaggacuacuucgucaccgccaacuccaaccucgucaucaucaccgccggcgcccgccaggagaagggcgagacccgccucaaccucguccagcgcaacgucgccaucuucaagcucaugaucuccuccaucguccaguacuccccccacugcaagcucaucaucgucuccaaccccgucgacauccucaccuacgucgccuggaagcucuccgccuuccccaagaaccgcaucaucggcuccggcugcaaccucgacaccgcccgcuuccgcuuccucaucggccagaagcucggcauccacuccgaguccugccacggcuggauccucggcgagcacggcgacuccuccguccccgucugguccggcgucaacaucgccggcgucccccucaaggaccucaacuccgacaucggcaccgacaaggaccccgagcaguggaagaacguccacaaggaggucaccgccaccgccuacgagaucaucaagaugaagggcuacaccuccugggccaucggccucuccgucgccgaccucaccgaguccauccucaagaaccuccgccgcauccaccccgucuccaccaucaucaagggccucuacggcaucgacgaggaggucuuccucuccauccccugcauccucggcgagaacggcaucaccaaccucaucaagaucaagcucacccccgaggaggaggcccaccucaagaaguccgccaagacccucugggagauccagaacaagcucaagcucuga

SEQ ID NO: 45309 - RNA, 1005 nt, Artificial Sequence
  derived and/or modified sequence opt2 from LDHB__Homo_sapiens__NP_002291
auggccacccucaaggagaagcucaucgcccccgucgccgaggaggaggccaccguccccaacaacaagaucaccgucgucggcgucggccaggucggcauggccugcgccaucuccauccucggcaagucccucgccgacgagcucgcccucgucgacguccucgaggacaagcucaagggcgagaugauggaccuccagcacggcucccucuuccuccagacccccaagaucgucgccgacaaggacuacuccgucaccgccaacuccaagaucgucgucgucaccgccggcguccgccagcaggagggcgagucccgccucaaccucguccagcgcaacgucaacgucuucaaguucaucaucccccagaucgucaaguacucccccgacugcaucaucaucgucgucuccaaccccgucgacauccucaccuacgucaccuggaagcucuccggccuccccaagcaccgcgucaucggcuccggcugcaaccucgacuccgcccgcuuccgcuaccucauggccgagaagcucggcauccaccccuccuccugccacggcuggauccucggcgagcacggcgacuccuccgucgccgucugguccggcgucaacgucgccggcgucucccuccaggagcucaaccccgagaugggcaccgacaacgacuccgagaacuggaaggagguccacaagauggucgucgaguccgccuacgaggucaucaagcucaagggcuacaccaacugggccaucggccucuccgucgccgaccucaucgaguccaugcucaagaaccucucccgcauccaccccgucuccaccauggucaagggcauguacggcaucgagaacgaggucuuccucucccuccccugcauccucaacgcccgcggccucaccuccgucaucaaccagaagcucaaggacgacgaggucgcccagcucaagaaguccgccgacacccucugggacauccagaaggaccucaaggaccucuga

SEQ ID NO: 45310 - RNA, 999 nt, Artificial Sequence
  derived and/or modified sequence opt2 from LDHC__Homo_sapiens__NP_059144
auguccaccgucaaggagcagcucaucgagaagcucaucgaggacgacgagaacucccagugcaagaucaccaucgucggcaccggcgccgucggcauggccugcgccaucuccauccuccucaaggaccucgccgacgagcucgcccucgucgacgucgcccucgacaagcucaagggcgagaugauggaccuccagcacggcucccucuucuucuccaccuccaagaucaccuccggcaaggacuacuccgucuccgccaacucccgcaucgucaucgucaccgccggcgcccgccagcaggagggcgagacccgccucgcccucguccagcgcaacgucgccaucaugaaguccaucauccccgccaucguccacuacucccccgacugcaagauccucgucgucuccaaccccgucgacauccucaccuacaucgucuggaagaucuccggccuccccgucacccgcgucaucggcuccggcugcaaccucgacuccgcccgcuuccgcuaccucaucggcgagaagcucggcguccaccccaccuccugccacggcuggaucaucggcgagcacggcgacuccuccgucccccucugguccggcgucaacgucgccggcgucgcccucaagacccucgaccccaagcucggcaccgacuccgacaaggagcacuggaagaacauccacaagcaggucauccaguccgccuacgagaucaucaagcucaagggcuacaccuccugggccaucggccucuccgucauggaccucgucggcuccauccucaagaaccuccgccgcguccaccccgucuccaccauggucaagggccucuacggcaucaaggaggagcucuuccucuccauccccugcguccucggccgcaacggcgucuccgacgucgucaagaucaaccucaacuccgaggaggaggcccucuucaagaaguccgccgagacccucuggaacauccagaaggaccucaucuucuga

SEQ ID NO: 45311 - RNA, 1524 nt, Artificial Sequence
  derived and/or modified sequence opt2 from LDHD__Homo_sapiens__NP_705690
auggcccgccuccuccgcuccgccaccugggagcucuuccccuggcgcggcuacugcucccagaaggccaagggcgagcucugccgcgacuucgucgaggcccucaaggccgucgucggcggcucccacgucuccaccgccgccgucguccgcgagcagcacggccgcgacgaguccguccaccgcugcgagccccccgacgccgucgucuggccccagaacgucgagcaggucucccgccucgccgcccucugcuaccgccagggcguccccaucauccccuucggcaccggcaccggccucgagggcggcgucugcgccguccagggcggcgucugcgucaaccucacccacauggaccgcauccucgagcucaaccaggaggacuucuccgucgucgucgagcccggcgucacccgcaaggcccucaacgcccaccuccgcgacuccggccucugguuccccgucgaccccggcgccgacgccucccucugcggcauggccgccaccggcgccuccggcaccaacgccguccgcuacggcaccaugcgcgacaacguccucaaccucgaggucguccuccccgacggccgccuccuccacaccgccggccgcggccgccacuuccgcuucggcuucuggcccgagaucccccaccacaccgccugguacucccccugcgucucccucggccgccgcaaguccgccgccggcuacaaccucaccggccucuucgucggcuccgagggcacccucggccucaucaccgccaccacccuccgccuccaccccgcccccgaggccaccgucgccgccaccugcgccuuccccuccguccaggccgccgucgacuccaccguccacauccuccaggccgccguccccgucgcccgcaucgaguuccucgacgaggucaugauggacgccugcaaccgcuacuccaagcucaacugccucgucgcccccacccucuuccucgaguuccacggcucccagcaggcccucgaggagcagcuccagcgcaccgaggagaucguccagcagaacggcgccuccgacuucuccugggccaaggaggccgaggagcgcucccgccucuggaccgcccgccacaacgccugguacgccgcccucgccacccgccccggcugcaagggcuacuccaccgacgucugcguccccaucucccgccuccccgagaucgucguccagaccaaggaggaccucaacgccuccggccucaccggcuccaucgucggccacgucggcgacggcaacuuccacugcauccuccucgucaaccccgacgacgccgaggagcucggccgcgucaaggccuucgccgagcagcucggccgccgcgcccucgcccuccacggcaccugcaccggcgagcacggcaucggcaugggcaagcgccagcuccuccaggaggaggucggcgccgucggcgucgagaccaugcgccagcucaaggccguccucgacccccagggccucaugaaccccggcaagguccucuga

SEQ ID NO: 45312 - RNA, 1038 nt, Artificial Sequence
  derived and/or modified sequence opt2 from LDLRAD3__Homo_sapiens__NP_777562
auguggcuccucggcccccucugccuccuccucuccuccgccgccgagucccagcuccuccccggcaacaacuucaccaacgagugcaacauccccggcaacuucaugugcuccaacggccgcugcauccccggcgccuggcagugcgacggccuccccgacugcuucgacaaguccgacgagaaggagugccccaaggccaaguccaagugcggccccaccuucuuccccugcgccuccggcauccacugcaucaucggccgcuuccgcugcaacggcuucgaggacugccccgacggcuccgacgaggagaacugcaccgccaacccccuccucugcuccaccgcccgcuaccacugcaagaacggccucugcaucgacaaguccuucaucugcgacggccagaacaacugccaggacaacuccgacgaggaguccugcgaguccucccaggagcccggcuccggccaggucuucgucaccuccgagaaccagcucgucuacuaccccuccaucaccuacgccaucaucggcuccuccgucaucuucguccucgucgucgcccuccucgcccucguccuccaccaccagcgcaagcgcaacaaccucaugacccuccccguccaccgccuccagcaccccguccuccucucccgccucgucguccucgaccacccccaccacugcaacgucaccuacaacgucaacaacggcauccaguacgucgccucccaggccgagcagaacgccuccgaggucggcuccccccccuccuacuccgaggcccuccucgaccagcgccccgccugguacgaccucccccccccccccuacuccuccgacaccgagucccucaaccaggccgaccucccccccuaccgcucccgcuccggcuccgccaacuccgccuccucccaggccgccuccucccuccucuccgucgaggacaccucccacucccccggccagcccggcccccaggagggcaccgccgagccccgcgacuccgagcccucccagggcaccgaggaggucuga

SEQ ID NO: 45313 - RNA, 810 nt, Artificial Sequence
  derived and/or modified sequence opt2 from LDLRAD4__Homo_sapiens__NP_001003674
auguccuccgaccaccucaacaacuccacccucaaggaggcccaguucaaggaccucuuccucaagaaggccgagcucgaguucgcccagaucaucaucaucgucgucgucgucaccgucauggucgucgucaucgucugccuccucaaccacuacaaggucuccacccgcuccuucaucaaccgccccaaccagucccgccgccgcgaggacggccucccccaggagggcugccucuggcccuccgacuccgccgccccccgccucggcgccuccgagaucaugcacgccccccgcucccgcgaccgcuucaccgcccccuccuucauccagcgcgaccgcuucucccgcuuccagcccaccuaccccuacguccagcacgagaucgaccucccccccaccaucucccucuccgacggcgaggagcccccccccuaccagggccccugcacccuccagcuccgcgaccccgagcagcagauggagcucaaccgcgaguccguccgcgccccccccaaccgcaccaucuucgacuccgaccucaucgacaucgccauguacuccggcggccccugcccccccuccuccaacuccggcaucuccgccuccaccugcuccuccaacggccgcauggagggccccccccccaccuacuccgaggucaugggccaccaccccggcgccuccuuccuccaccaccagcgcuccaacgcccaccgcggcucccgccuccaguuccagcagaacaacgccgaguccaccaucguccccaucaagggcaaggaccgcaagcccggcaaccucgucuga

SEQ ID NO: 45314 - RNA, 2583 nt, Artificial Sequence
  derived and/or modified sequence opt2 from LDLR__Homo_sapiens__NP_000518
augggccccuggggcuggaagcuccgcuggaccgucgcccuccuccucgccgccgccggcaccgccgucggcgaccgcugcgagcgcaacgaguuccagugccaggacggcaagugcaucuccuacaagugggucugcgacggcuccgccgagugccaggacggcuccgacgagucccaggagaccugccucuccgucaccugcaaguccggcgacuucuccugcggcggccgcgucaaccgcugcaucccccaguucuggcgcugcgacggccaggucgacugcgacaacggcuccgacgagcagggcugcccccccaagaccugcucccaggacgaguuccgcugccacgacggcaagugcaucucccgccaguucgucugcgacuccgaccgcgacugccucgacggcuccgacgaggccuccugccccguccucaccugcggccccgccuccuuccagugcaacuccuccaccugcaucccccagcucugggccugcgacaacgaccccgacugcgaggacggcuccgacgaguggccccagcgcugccgcggccucuacgucuuccagggcgacuccucccccugcuccgccuucgaguuccacugccucuccggcgagugcauccacuccuccuggcgcugcgacggcggccccgacugcaaggacaaguccgacgaggagaacugcgccgucgccaccugccgccccgacgaguuccagugcuccgacggcaacugcauccacggcucccgccagugcgaccgcgaguacgacugcaaggacauguccgacgaggucggcugcgucaacgucacccucugcgagggccccaacaaguucaagugccacuccggcgagugcaucacccucgacaaggucugcaacauggcccgcgacugccgcgacugguccgacgagcccaucaaggagugcggcaccaacgagugccucgacaacaacggcggcugcucccacgucugcaacgaccucaagaucggcuacgagugccucugccccgacggcuuccagcucgucgcccagcgccgcugcgaggacaucgacgagugccaggaccccgacaccugcucccagcucugcgucaaccucgagggcggcuacaagugccagugcgaggagggcuuccagcucgacccccacaccaaggccugcaaggccgucggcuccaucgccuaccucuucuucaccaaccgccacgagguccgcaagaugacccucgaccgcuccgaguacaccucccucauccccaaccuccgcaacgucgucgcccucgacaccgaggucgccuccaaccgcaucuacugguccgaccucucccagcgcaugaucugcuccacccagcucgaccgcgcccacggcgucuccuccuacgacaccgucaucucccgcgacauccaggcccccgacggccucgccgucgacuggauccacuccaacaucuacuggaccgacuccguccucggcaccgucuccgucgccgacaccaagggcgucaagcgcaagacccucuuccgcgagaacggcuccaagccccgcgccaucgucgucgaccccguccacggcuucauguacuggaccgacuggggcacccccgccaagaucaagaagggcggccucaacggcgucgacaucuacucccucgucaccgagaacauccaguggcccaacggcaucacccucgaccuccucuccggccgccucuacugggucgacuccaagcuccacuccaucuccuccaucgacgucaacggcggcaaccgcaagaccauccucgaggacgagaagcgccucgcccaccccuucucccucgccgucuucgaggacaaggucuucuggaccgacaucaucaacgaggccaucuucuccgccaaccgccucaccggcuccgacgucaaccuccucgccgagaaccuccucucccccgaggacaugguccucuuccacaaccucacccagccccgcggcgucaacuggugcgagcgcaccacccucuccaacggcggcugccaguaccucugccuccccgccccccagaucaacccccacucccccaaguucaccugcgccugccccgacggcaugcuccucgcccgcgacaugcgcuccugccucaccgaggccgaggccgccgucgccacccaggagaccuccaccguccgccucaaggucuccuccaccgccguccgcacccagcacaccaccacccgccccguccccgacaccucccgccuccccggcgccacccccggccucaccaccgucgagaucgucaccaugucccaccaggcccucggcgacgucgccggccgcggcaacgagaagaagcccuccuccguccgcgcccucuccaucguccuccccaucguccuccucgucuuccucugccucggcgucuuccuccucuggaagaacuggcgccucaagaacaucaacuccaucaacuucgacaaccccgucuaccagaagaccaccgaggacgagguccacaucugccacaaccaggacggcuacuccuaccccucccgccagauggucucccucgaggacgacgucgccuga

SEQ ID NO: 45315 - RNA, 441 nt, Artificial Sequence
  derived and/or modified sequence opt2 from LDOC1__Homo_sapiens__NP_036449
auggucgacgagcucguccuccuccuccacgcccuccucaugcgccaccgcgcccucuccaucgagaacucccagcucauggagcagcuccgccuccucgucugcgagcgcgccucccuccuccgccagguccgcccccccuccugccccguccccuuccccgagaccuucaacggcgaguccucccgccuccccgaguucaucguccagaccgccuccuacaugcucgucaacgagaaccgcuucugcaacgacgccaugaaggucgccuuccucaucucccuccucaccggcgaggccgaggagugggucguccccuacaucgagauggacucccccauccucggcgacuaccgcgccuuccucgacgagaugaagcagugcuucggcugggacgacgacgaggacgacgacgacgaggaggaggaggacgacuacuga

SEQ ID NO: 45316 - RNA, 720 nt, Artificial Sequence
  derived and/or modified sequence opt2 from LDOC1L__Homo_sapiens__NP_115663
augguccagccccagaccuccaaggccgagucccccgcccucgccgccucccccaacgcccagauggacgacgucaucgacacccucaccucccuccgccucaccaacuccgcccuccgccgcgaggccuccacccuccgcgccgagaaggccaaccucaccaacaugcucgaguccgucauggccgagcucacccuccuccgcacccgcgcccgcauccccggcgcccuccagaucaccccccccaucuccuccaucaccuccaacggcacccgccccaugaccaccccccccaccucccuccccgagcccuucuccggcgaccccggccgccucgccggcuuccucaugcagauggaccgcuucaugaucuuccaggccucccgcuuccccggcgaggccgagcgcgucgccuuccucgucucccgccucaccggcgaggccgagaagugggccaucccccacaugcagcccgacuccccccuccgcaacaacuaccagggcuuccucgccgagcuccgccgcaccuacaaguccccccuccgccacgcccgccgcgcccagauccgcaagaccuccgccuccaaccgcgccguccgcgagcgccagaugcucugccgccagcucgccuccgccggcaccggccccugccccguccaccccgccuccaacggcaccucccccgcccccgcccuccccgcccgcgcccgcaaccucuga

SEQ ID NO: 45317 - RNA, 234 nt, Artificial Sequence
  derived and/or modified sequence opt2 from LEAP2__Homo_sapiens__NP_443203
auguggcaccucaagcucugcgccguccucaugaucuuccuccuccuccucggccagaucgacggcucccccauccccgaggucuccuccgccaagcgccgcccccgccgcaugacccccuucuggcgcggcgucucccuccgccccaucggcgccuccugccgcgacgacuccgagugcaucacccgccucugccgcaagcgccgcugcucccucuccgucgcccaggaguga

SEQ ID NO: 45318 - RNA, 1002 nt, Artificial Sequence
  derived and/or modified sequence opt2 from LECT1__Homo_sapiens__NP_001011705
augaccgagaacuccgacaagguccccaucgcccucgucggccccgacgacgucgaguucugcuccccccccgccuacgccacccucaccgucaagcccuccucccccgcccgccuccucaaggucggcgccgucguccucaucuccggcgccguccuccuccucuucggcgccaucggcgccuucuacuucuggaagggcuccgacucccacaucuacaacguccacuacaccauguccaucaacggcaagcuccaggacggcuccauggagaucgacgccggcaacaaccucgagaccuucaagaugggcuccggcgccgaggaggccaucgccgucaacgacuuccagaacggcaucaccggcauccgcuucgccggcggcgagaagugcuacaucaaggcccaggucaaggcccgcauccccgaggucggcgccgucaccaagcaguccaucuccuccaagcucgagggcaagaucaugcccgucaaguacgaggagaacucccucaucugggucgccgucgaccagcccgucaaggacaacuccuuccucuccuccaagguccucgagcucugcggcgaccuccccaucuucuggcucaagcccaccuaccccaaggagauccagcgcgagcgccgcgaggucguccgcaagaucguccccaccaccaccaagcgcccccacuccggcccccgcuccaaccccggcgccggccgccucaacaacgagacccgccccuccguccaggaggacucccaggccuucaaccccgacaaccccuaccaccaggagggcgaguccaugaccuucgacccccgccucgaccacgagggcaucugcugcaucgagugccgccgcuccuacacccacugccagaagaucugcgagccccucggcggcuacuaccccuggcccuacaacuaccagggcugccgcuccgccugccgcgucaucaugcccugcuccuggugggucgcccgcauccucggcauggucuga

SEQ ID NO: 45319 - RNA, 456 nt, Artificial Sequence
  derived and/or modified sequence opt2 from LECT2__Homo_sapiens__NP_002293
auguucuccaccaaggcccuccuccucgccggccucaucuccaccgcccucgccggccccugggccaacaucugcgccggcaaguccuccaacgagauccgcaccugcgaccgccacggcugcggccaguacuccgcccagcgcucccagcgcccccaccagggcgucgacauccucugcuccgccggcuccaccgucuacgcccccuucaccggcaugaucgucggccaggagaagcccuaccagaacaagaacgccaucaacaacggcguccgcaucuccggccgcggcuucugcgucaagauguucuacaucaagcccaucaaguacaagggccccaucaagaagggcgagaagcucggcacccuccucccccuccagaaggucuaccccggcauccagucccacguccacaucgagaacugcgacuccuccgaccccaccgccuaccucuga

SEQ ID NO: 45320 - RNA, 1116 nt, Artificial Sequence
  derived and/or modified sequence opt2 from LEF1__Homo_sapiens__NP_001124185
augccccagcucuccggcggcggcggcggcggcggcggcgaccccgagcucugcgccaccgacgagaugauccccuucaaggacgagggcgacccccagaaggagaagaucuucgccgagaucucccaccccgaggaggagggcgaccucgccgacaucaaguccucccucgucaacgaguccgagaucauccccgccuccaacggccacgaggucgcccgccaggcccagaccucccaggagcccuaccacgacaaggcccgcgagcaccccgacgacggcaagcaccccgacggcggccucuacaacaagggccccuccuacuccuccuacuccggcuacaucaugaugcccaacaugaacaacgaccccuacauguccaacggcucccucuccccccccaucccccgcaccuccaacaagguccccgucguccagcccucccacgccguccacccccucaccccccucaucaccuacuccgacgagcacuucucccccggcucccaccccucccacauccccuccgacgucaacuccaagcagggcaugucccgccacccccccgcccccgacauccccaccuucuacccccucucccccggcggcgucggccagaucacccccccccucggcugguucucccaccacaugauccccggcccccccggcccccacaccaccggcaucccccaccccgccaucgucaccccccaggucaagcaggagcacccccacaccgacuccgaccucaugcacgucaagccccagcacgagcagcgcaaggagcaggagcccaagcgcccccacaucaagaagccccucaacgccuucaugcucuacaugaaggagaugcgcgccaacgucgucgccgagugcacccucaaggaguccgccgccaucaaccagauccucggccgccgcuggcacgcccucucccgcgaggagcaggccaaguacuacgagcucgcccgcaaggagcgccagcuccacaugcagcucuaccccggcugguccgcccgcgacaacuacggcaagaagaagaagcgcaagcgcgagaagcuccaggaguccgccuccggcaccggcccccgcaugaccgccgccuacaucuga

SEQ ID NO: 45321 - RNA, 1101 nt, Artificial Sequence
  derived and/or modified sequence opt2 from LEFTY1__Homo_sapiens__NP_066277
augcagccccucuggcucugcugggcccucuggguccucccccucgccucccccggcgccgcccucaccggcgagcagcuccucggcucccuccuccgccagcuccagcucaaggagguccccacccucgaccgcgccgacauggaggagcucgucauccccacccacguccgcgcccaguacgucgcccuccuccagcgcucccacggcgaccgcucccgcggcaagcgcuucucccaguccuuccgcgaggucgccggccgcuuccucgcccucgaggccuccacccaccuccucgucuucggcauggagcagcgccucccccccaacuccgagcucguccaggccguccuccgccucuuccaggagcccguccccaaggccgcccuccaccgccacggccgccucuccccccgcuccgcccgcgcccgcgucaccgucgaguggcuccgcguccgcgacgacggcuccaaccgcaccucccucaucgacucccgccucgucuccguccacgaguccggcuggaaggccuucgacgucaccgaggccgucaacuucuggcagcagcucucccgcccccgccagccccuccuccuccaggucuccguccagcgcgagcaccucggcccccucgccuccggcgcccacaagcucguccgcuucgccucccagggcgcccccgccggccucggcgagccccagcucgagcuccacacccucgaccucggcgacuacggcgcccagggcgacugcgaccccgaggcccccaugaccgagggcacccgcugcugccgccaggagauguacaucgaccuccagggcaugaagugggccgagaacuggguccucgagccccccggcuuccucgccuacgagugcgucggcaccugccgccagccccccgaggcccucgccuucaaguggcccuuccucggcccccgccagugcaucgccuccgagaccgacucccuccccaugaucgucuccaucaaggagggcggccgcacccgcccccaggucgucucccuccccaacaugcgcguccagaagugcuccugcgccuccgacggcgcccucgucccccgccgccuccagcccuga

SEQ ID NO: 45322 - RNA, 999 nt, Artificial Sequence
  derived and/or modified sequence opt2 from LEFTY2__Homo_sapiens__NP_001165896
auguggccccucuggcucugcugggcccucuggguccucccccucgccggccccggcgccgcccucaccgaggagcagcuccucggcucccuccuccgccagcuccagcucuccgagguccccguccucgaccgcgccgacauggagaagcucgucauccccgcccacguccgcgcccaguacgucguccuccuccgccgcucccacggcgaccgcucccgcggcaagcgcuucucccaguccuuccgcgaggucgccggccgcuuccucgccuccgaggccgcccuccaccgccacggccgccucuccccccgcuccgcccaggcccgcgucaccgucgaguggcuccgcguccgcgacgacggcuccaaccgcaccucccucaucgacucccgccucgucuccguccacgaguccggcuggaaggccuucgacgucaccgaggccgucaacuucuggcagcagcucucccgcccccgccagccccuccuccuccaggucuccguccagcgcgagcaccucggcccccucgccuccggcgcccacaagcucguccgcuucgccucccagggcgcccccgccggccucggcgagccccagcucgagcuccacacccucgaccuccgcgacuacggcgcccagggcgacugcgaccccgaggcccccaugaccgagggcacccgcugcugccgccaggagauguacaucgaccuccagggcaugaagugggccaagaacuggguccucgagccccccggcuuccucgccuacgagugcgucggcaccugccagcagccccccgaggcccucgccuucaacuggcccuuccucggcccccgccagugcaucgccuccgagaccgccucccuccccaugaucgucuccaucaaggagggcggccgcacccgcccccaggucgucucccuccccaacaugcgcguccagaagugcuccugcgccuccgacggcgcccucgucccccgccgccuccagcccuga

SEQ ID NO: 45323 - RNA, 2079 nt, Artificial Sequence
  derived and/or modified sequence opt2 from LEKR1__Homo_sapiens__NP_001004316
auggaccaccacauccccaugcacgcccuccccgaggagauccagaagaugcuccccgaggagaaggucugcaaguacugcggcgucuccuaccucauccuccacgaguucaaggccauggaggagaaggucaaggccauggagaaggagaugaaguucuaccagggcuccgucgaccgcgagaagcgccuccaggagaagcuccacucccucucccaggagcucgagcaguacaagaucgacaacaaguccaagaccgagcgcaucuacgacgucggcaugcagcucaagucccagcagaacgaguuccagaaggucaagaagcagcucucccaccuccaggacgagcucaagaucaaguaccgccaguccuacaucuucucccagcgccucuccgaguacaaguacuucuggaacaagacccucucccuccucaccuucaccaagcgcgagcucaccuccaucaagaacgaggucuacgacaacuaccagaacuggaccucccucaagggcgccgucuuccuccagaucaaguccaucuccgagaccgcccucaccgagaucgacauccucaacaagucccucaccgucucccagcgcaacaaggucugccucgagaaggagaugaagaaccucaagcuccucuccgacgccgccauccuccgcucccagcagauccgcaccucccgccagcaggaggucaaccuccagacccgcugcuacgaccuccagaaggagguccucgaccuccagugccucgucgaggcccucggccucaagcuccagaaggccgucaccgagauggacaacuacaaggagaugcucaugaacaaguccaacgaggccgacgacugccagcgcgagcucaagaagcucaaguucgaguccaucaucuccgagucccagcacaccaugcuccucaaggagaaggaggacucccucaugaccugccagcagaucuacaaggcccuccaggaggagcucaccgucaaggagaagcaggaggaggacaucaagcgccgcaucaaccucgccgagaacgagcucgagaucaccaagacccuccucaaccagacccgcgaggagguccucacccucaagaacgagcgcgagcucaugcucaucucccaccagaaguccaucgagcagcuccaggagacccuccgccagaagcuccucuccgacgacaacuggaaggagaagaucgaggccgagcucgccaaggagcgcgcccagcaccucgucgaguucgaggagcaggcccuccucuucaaggaggagaccaagcuccagcucgacaucgagaaggagaagcaccaggacgucauccagaaguacaagaaggagcaggaggagcuccagaugaagaucuccgaccucaucaccggcgccacccgcgaccuccgccaggaggucaccacccucaaggagaagcuccacaagucccacauccgcuacaccgaggaguccaacuccaaggagaaggagaucgagaaccucaagaaccucgucgccgaguucgagucccgccucaagaaggagaucgacuccaacgacuccgucuccgagaaccuccgcaaggagauggagcagaaguccgacgagcucaagcgcgucaugcucgcccagacccagcucaucgagcaguucaaccagucccaggaggagaacaccuuccuccaggagaccguccgccgcgagugcgaggagcgcuucgagcucaccgaggcccucucccaggcccgcgagcagcuccucgagcucuccaagcuccgcggcucccuccccuucucccccugcucccucuccaagggcucccucaccucccccgccgccgccgucuccaaccacggcgagcgcucccucgcccgccucaacuccgagaagggcauccagauccccaaccuccgcggcgucuccaagcccaccaccuuccccaccuccgacaagcccaagcgcguccgcuccggcguccccauccucccccagccccaccccccccgcggcggcgccuccuccgccaacgagacccgccagcgccucgccgccauccuccgccgccgccgcucccagcaguga

SEQ ID NO: 45324 - RNA, 606 nt, Artificial Sequence
  derived and/or modified sequence opt2 from LEMD2__Homo_sapiens__NP_001137416
auggaggcccaggaguacaucgccaacgucaccuccuccuccuccgccaaguucgaggccgcccucaccuggauccucuccuccaacaaggacgucggcaucuggcucaagggcgaggaccaguccgagcucgucaccaccgucgacaaggucgucugccucgaguccgcccacccccgcaugggcgucggcugccgccucucccgcgcccuccucaccgccgucaccaacguccucaucuucuucuggugccucgccuuccucuggggccuccucauccuccucaaguaccgcuggcgcaagcucgaggaggaggagcaggccauguacgagauggucaagaagaucaucgacgucguccaggaccacuacgucgacugggagcaggacauggagcgcuaccccuacgucggcauccuccacguccgcgacucccucauccccccccagucccgccgccgcaugaagcgcgucugggaccgcgccgucgaguuccucgccuccaacgagucccgcauccagaccgagucccaccgcgucgccggcgaggacaugcucgucuggcgcuggaccaagcccuccuccuucuccgacuccgagcgcuga

SEQ ID NO: 45325 - RNA, 2736 nt, Artificial Sequence
  derived and/or modified sequence opt2 from LEMD3__Homo_sapiens__NP_055134
auggccgccgccgccgccuccgccccccagcagcucuccgacgaggagcucuucucccagcuccgccgcuacggccucucccccggccccgucaccgaguccacccgccccgucuaccucaagaagcucaagaagcuccgcgaggaggagcagcagcagcaccgcuccggcggccgcggcaacaagacccgcaacuccaacaacaacaacaccgccgccgccaccgucgccgccgccggccccgccgccgccgccgccgccggcaugggcguccgccccgucuccggcgaccucuccuaccuccgcacccccggcggccucugccgcaucuccgccuccggccccgagucccuccucggcggccccggcggcgccuccgccgcccccgccgccggcuccaagguccuccucggcuucuccuccgacgaguccgacgucgaggccuccccccgcgaccaggccggcggcggcggccgcaaggaccgcgccucccuccaguaccgcggccucaaggccccccccgccccccucgccgccuccgaggucaccaacuccaacuccgccgagcgccgcaagccccacuccugguggggcgcccgccgccccgccggccccgagcuccagaccccccccggcaaggacggcgccgucgaggacgaggagggcgagggcgaggacggcgaggagcgcgaccccgagaccgaggagccccucugggccucccgcaccgucaacggcucccgccucguccccuacuccugccgcgagaacuacuccgacuccgaggaggaggacgacgacgacgucgccuccucccgccagguccucaaggacgacucccucucccgccaccgcccccgccgcacccacuccaagccccuccccccccucaccgccaaguccgccggcggccgccucgagaccuccguccagggcggcggcggccucgccaugaacgaccgcgccgccgccgccggcucccucgaccgcucccgcaaccucgaggaggccgccgccgccgagcagggcggcggcugcgaccaggucgacuccucccccgucccccgcuaccgcgucaacgccaagaagcucaccccccuccucccccccccccucaccgacauggacuccacccucgacuccuccaccggcucccuccucaagaccaacaaccacaucggcggcggcgccuucuccgucgacuccccccgcaucuacuccaacucccucccccccuccgccgccgucgccgccuccuccucccuccgcaucaaccacgccaaccacaccggcuccaaccacaccuaccucaagaacaccuacaacaagcccaagcucuccgagcccgaggaggagcuccuccagcaguucaagcgcgaggaggucucccccaccggcuccuucuccgcccacuaccucuccauguuccuccucaccgccgccugccucuucuuccucauccucggccucaccuaccucggcaugcgcggcaccggcgucuccgaggacggcgagcucuccaucgagaaccccuucggcgagaccuucggcaagauccaggaguccgagaagacccucaugaugaacacccucuacaagcuccacgaccgccucgcccagcucgccggcgaccacgagugcggcuccuccucccagcgcacccucuccguccaggaggccgccgccuaccucaaggaccucggccccgaguacgagggcaucuucaacaccucccuccaguggauccucgagaacggcaaggacgucggcauccgcugcgucggcuucggccccgaggaggagcucaccaacaucaccgacguccaguuccuccaguccacccgcccccucauguccuucuggugccgcuuccgccgcgccuucgucaccgucacccaccgccuccuccuccucugccucggcgucgucauggucugcgucguccuccgcuacaugaaguaccgcuggaccaaggaggaggaggagacccgccagauguacgacauggucgucaagaucaucgacguccuccgcucccacaacgaggccugccaggagaacaaggaccuccagcccuacaugcccaucccccacguccgcgacucccucauccagccccacgaccgcaagaagaugaagaaggucugggaccgcgccgucgacuuccucgccgccaacgagucccgcguccgcaccgagacccgccgcaucggcggcgccgacuuccucgucuggcgcuggauccagcccuccgccuccugcgacaagauccucgucauccccuccaaggucuggcagggccaggccuuccaccucgaccgccgcaacuccccccccaacucccucacccccugccucaagauccgcaacauguucgaccccgucauggagaucggcgaccaguggcaccucgccauccaggaggccauccucgagaagugcuccgacaacgacggcaucguccacaucgccgucgacaagaacucccgcgagggcugcgucuacgucaagugccucucccccgaguacgccggcaaggccuucaaggcccuccacggcuccugguucgacggcaagcucgucaccgucaaguaccuccgccucgaccgcuaccaccaccgcuucccccaggcccucaccuccaacaccccccucaagcccuccaacaagcacaugaacuccaugucccaccuccgccuccgcaccggccucaccaacucccagggcuccuccuga

SEQ ID NO: 45326 - RNA, 1821 nt, Artificial Sequence
  derived and/or modified sequence opt2 from LEO1__Homo_sapiens__NP_001273359
auggccgacauggaggaccucuucggcuccgacgccgacuccgaggccgagcgcaaggacuccgacuccggcuccgacuccgacuccgaccaggagaacgccgccuccggcuccaacgccuccggcuccgaguccgaccaggacgagcgcggcgacuccggccagcccuccaacaaggagcucuucggcgacgacuccgaggacgagggcgccucccaccacuccggcuccgacaaccacuccgagcgcuccgacaaccgcuccgaggccuccgagcgcuccgaccacgaggacaacgaccccuccgacgucgaccagcacuccggcuccgaggcccccaacgacgacgaggacgagggccaccgcuccgacggcggcucccaccacuccgaggccgagggcuccgagaaggcccacuccgacgacgagaaguggggccgcgaggacaaguccgaccaguccgacgacgagaagauccagaacuccgacgacgaggagcgcgcccagggcuccgacgaggacaagcuccagaacuccgacgacgacgagaagaugcagaacaccgacgacgaggagcgcccccagcucuccgacgacgagcgccagcagcucuccgaggaggagaaggccaacuccgacgacgagcgccccgucgccuccgacaacgacgacgagaagcagaacuccgacgacgaggagcagccccagcucuccgacgaggagaagaugcagaacuccgacgacgagcgcccccaggccuccgacgaggagcaccgccacuccgacgacgaggaggagcaggaccacaaguccgaguccgcccgcggcuccgacuccgaggacgagguccuccgcaugaagcgcaagaacgccaucgccuccgacuccgaggccgacuccgacaccgagguccccaaggacaacuccggcaccauggaccucuucggcggcgccgacgacaucuccuccggcuccgacggcgaggacaagccccccacccccggccagcccgucgacgagaacggccucccccaggaccagcaggaggaggagcccauccccgagacccgcaucgaggucgagauccccaaggucaacaccgaccucggcaacgaccucuacuucgucaagcuccccaacuuccucuccgucgagcccuccaugucccuccaccucggcaacgaggucuucgacgucuacaaggccccccuccagggcgaccacaaccaccucuucauccgccagggcaccggccuccagggccaggccgucuucaagaccaagcucaccuuccgcccccacuccaccgacuccgccacccaccgcaagaugacccucucccucgccgaccgcugcuccaagacccagaagauccgcauccuccccauggccggccgcgaccccgagugccagcgcaccgagaugaucaagaaggaggaggagcgccuccgcgccuccauccgccgcgagucccagcagcgccgcaugcgcgagaagcagcaccagcgcggccucuccgccuccuaccucgagcccgaccgcuacgacgaggaggaggagggcgaggaguccaucucccucgccgccaucaagaaccgcuacaagggcggcauccgcgaggagcgcgcccgcaucuacuccuccgacuccgacgagggcuccgaggaggacaaggcccagcgccuccucaaggccaagaagcucaccuccgacgaggagggcgagcccuccggcaagcgcaaggccgaggacgacgacaaggccaacaagaagcacaagaaguacgucaucuccgacgaggaggaggaggacgacgacuga

SEQ ID NO: 45327 - RNA, 504 nt, Artificial Sequence
  derived and/or modified sequence opt2 from LEP__Homo_sapiens__NP_000221
augcacuggggcacccucugcggcuuccucuggcucuggcccuaccucuucuacguccaggccguccccauccagaagguccaggacgacaccaagacccucaucaagaccaucgucacccgcaucaacgacaucucccacacccaguccgucuccuccaagcagaaggucaccggccucgacuucauccccggccuccaccccauccucacccucuccaagauggaccagacccucgccgucuaccagcagauccucaccuccaugcccucccgcaacgucauccagaucuccaacgaccucgagaaccuccgcgaccuccuccacguccucgccuucuccaaguccugccaccuccccugggccuccggccucgagacccucgacucccucggcggcguccucgaggccuccggcuacuccaccgaggucgucgcccucucccgccuccagggcucccuccaggacaugcucuggcagcucgaccucucccccggcugcuga

SEQ ID NO: 45328 - RNA, 510 nt, Artificial Sequence
  derived and/or modified sequence opt2 from LEPROTL1__Homo_sapiens__NP_001121680
auggccggcaucaaggcccucaucucccucuccuucggcggcgccaucggccucauguuccucaugcucggcugcgcccuccccaucuacaacaaguacuggccccucuucguccucuucuucuacauccucucccccauccccuacugcaucgcccgccgccucgucgacgacaccgacgccauguccaacgccugcaaggagcucgccaucuuccucaccaccggcaucgucgucuccgccuucggccuccccaucgucuucgcccgcgcccaccucaugggccgccuccccuucuucuccaagaugggcaccgccgaguccgagggccgcgagacccucacccagcagcucccccuccccgccgccgccaugcgccgccuccuccccgccucccgcgucuccacccagcccguccuccgccucgccgacuccgccgagucccuccucggccgccccgcccucugggcccucggcuuccuccucugcccccccucccaggcccaguga

SEQ ID NO: 45329 - RNA, 2220 nt, Artificial Sequence
  derived and/or modified sequence opt2 from LETM1__Homo_sapiens__NP_036450
auggccuccauccuccuccgcuccugccgcggccgcgcccccgcccgccuccccccccccccccgcuacaccgucccccgcggcucccccggcgaccccgcccaccucuccugcgccuccacccucggccuccgcaacugccucaacguccccuucggcugcugcacccccauccaccccgucuacaccuccucccgcggcgaccaccucggcugcugggcccuccgccccgagugccuccgcaucgucucccgcgcccccuggaccuccaccuccgucggcuucgucgccgucggcccccagugccuccccguccgcggcuggcacuccucccgccccguccgcgacgacuccgucgucgagaagucccucaagucccucaaggacaagaacaagaagcucgaggagggcggccccgucuacuccccccccgccgaggucgucgucaagaagucccucggccagcgcguccucgacgagcucaagcacuacuaccacggcuuccgccuccucuggaucgacaccaagaucgccgcccgcaugcucuggcgcauccucaacggccacucccucacccgccgcgagcgccgccaguuccuccgcaucugcgccgaccucuuccgccucguccccuuccucgucuucgucgucguccccuucauggaguuccuccuccccgucgccgucaagcucuuccccaacaugcuccccuccaccuucgagacccagucccucaaggaggagcgccucaagaaggagcuccgcgucaagcucgagcucgccaaguuccuccaggacaccaucgaggagauggcccucaagaacaaggccgccaagggcuccgccaccaaggacuucuccgucuucuuccagaagauccgcgagaccggcgagcgccccuccaacgaggagaucaugcgcuucuccaagcucuucgaggacgagcucacccucgacaaccucacccgcccccagcucgucgcccucugcaagcuccucgagcuccaguccaucggcaccaacaacuuccuccgcuuccagcucaccaugcgccuccgcuccaucaaggccgacgacaagcucaucgccgaggagggcgucgacucccucaacgucaaggagcuccaggccgccugccgcgcccgcggcaugcgcgcccucggcgucaccgaggaccgccuccgcggccagcucaagcaguggcucgaccuccaccuccaccaggagauccccaccucccuccucauccucucccgcgccauguaccuccccgacacccucucccccgccgaccagcucaaguccacccuccagacccuccccgagaucgucgccaaggaggcccaggucaaggucgccgaggucgagggcgagcaggucgacaacaaggccaagcucgaggccacccuccaggaggaggccgccauccagcaggagcaccgcgagaaggagcuccagaagcgcuccgaggucgccaaggacuucgagcccgagcgcgucgucgccgccccccagcgccccggcaccgagccccagcccgagaugcccgacaccguccuccaguccgagacccucaaggacaccgcccccguccucgagggccucaaggaggaggagaucaccaaggaggagaucgacauccucuccgacgccugcuccaagcuccaggagcagaagaagucccucaccaaggagaaggaggagcucgagcuccucaaggaggacguccaggacuacuccgaggaccuccaggagaucaagaaggagcucuccaagaccggcgaggagaaguacgucgaggaguccaaggccuccaagcgccucaccaagcgcguccagcagaugaucggccagaucgacggccucaucucccagcucgagauggaccagcaggccggcaagcucgcccccgccaacggcaugcccaccggcgagaacgucaucuccgucgccgagcucaucaacgccaugaagcaggucaagcacauccccgaguccaagcucaccucccucgccgccgcccucgacgagaacaaggacggcaaggucaacaucgacgaccucgucaaggucaucgagcucgucgacaaggaggacguccacaucuccaccucccaggucgccgagaucgucgccacccucgagaaggaggagaaggucgaggagaaggagaaggccaaggagaaggccgagaaggaggucgccgaggucaaguccuga

SEQ ID NO: 45330 - RNA, 1122 nt, Artificial Sequence
  derived and/or modified sequence opt2 from LETMD1__Homo_sapiens__NP_001230618
auggcccucucccgcgucugcugggcccgcuccgccgucuggggcuccgccgucacccccggccacuucgucacccgccgccuccagcucggccgcuccggccucgccuggggcgccccccgcuccuccaagcuccaccucucccccaaggccgacgucaagaaccucauguccuacgucgucaccaagaccaaggccaucaacggcaaguaccaccgcuuccucggccgccacuucccccgcuucuacguccucuacaccaucuucaugaagggccuccagaugcucugggccgacgccaagaaggcccgccgcaucaagaccaacauguggaagcacaacaucaaguuccaccagcuccccuaccgcgagauggagcaccuccgccaggucugggcccgcggccgcuaccccgagguccacggcgaguuccgccaggacgucaccaagugccucuuccucggcaucaucuccaucccccccuucgccaacuaccucgucuuccuccucauguaccucuucccccgccagcuccucauccgccacuucuggacccccaagcagcagaccgacuuccucgacaucuaccacgccuuccgcaagcagucccaccccgagaucaucuccuaccucgagaaggucaucccccucaucuccgacgccggccuccgcuggcgccucaccgaccucugcaccaagauccagcgcggcacccaccccgccauccacgacauccucgcccuccgcgagugcuucuccaaccacccccucggcaugaaccagcuccaggcccuccacgucaaggcccucucccgcgccaugcuccucaccuccuaccucccccccccccuccuccgccaccgccucaagacccacaccaccgucauccaccagcucgacaaggcccucgccaagcucggcaucggccagcucaccgcccaggaggucaaguccgccugcuaccuccgcggccucaacuccacccacaucggcgaggaccgcugccgcaccuggcucggcgaguggcuccagaucuccugcucccucaaggaggccgagcucucccuccuccuccacaacgucguccuccucuccaccaacuaccucggcacccgccgcuga

SEQ ID NO: 45331 - RNA, 507 nt, Artificial Sequence
  derived and/or modified sequence opt2 from LEUTX__Homo_sapiens__NP_001137304
augcaccccucccucgccaccaugggcaagcucgccuccaagcuccagcucgaccucuccgucgucaagaucugguucaagaaccagcgcgccaaguggaagcgccagcagcgccagcagaugcagacccgccccucccucggccccgccaaccagaccaccuccgucaagaaggaggagacccccuccgccaucaccaccgccaacauccgccccgucucccccggcaucuccgacgccaacgaccacgaccuccgcgagcccuccggcaucaagaaccccggcggcgccuccgccuccgcccgcgucuccuccugggacucccaguccuacgacaucgagcagaucugccucggcgccuccaacccccccugggccuccacccucuucgagaucgacgaguucgucaagaucuacgaccuccccggcgaggacgacaccuccucccucaaccaguaccucuuccccgucugccucgaguacgaccagcuccaguccuccgucuga

SEQ ID NO: 45332 - RNA, 1140 nt, Artificial Sequence
  derived and/or modified sequence opt2 from LFNG__Homo_sapiens__NP_001035257
augcucaagcgcugcggccgccgccuccuccucgcccucgccggcgcccuccucgccugccuccucguccucaccgccgacccccccccccccccccuccccgccgagcgcggccgccgcgcccuccgcucccucgccggccccgccggcgccgcccccgcccccggccucggcgccgccgccgccgcccccggcgcccucguccgcgacguccacucccucuccgaguacuucucccuccucacccgcgcccgccgcgacgccggccccccccccggcgccgccccccgccccgccgacggccacccccgcccccucgccgagccccucgccccccgcgacgucuucaucgccgucaagaccaccaagaaguuccaccgcgcccgccucgaccuccuccucgagaccuggaucucccgccacaaggagaugaccuucaucuucaccgacggcgaggacgaggcccucgcccgccacaccggcaacgucgucaucaccaacugcuccgccgcccacucccgccaggcccucuccugcaagauggccgucgaguacgaccgcuucaucgaguccggccgcaagugguucugccacgucgacgacgacaacuacgucaaccuccgcgcccuccuccgccuccucgccuccuacccccacacccgcgacgucuacgucggcaagcccucccucgaccgccccauccaggccauggagcgcgucuccgagaacaagguccgccccguccacuucugguucgccaccggcggcgccggcuucugcaucucccgcggccucgcccucaagaugucccccugggccuccggcggccacuucaugaacaccgccgagcgcauccgccuccccgacgacugcaccaucggcuacaucgucgaggcccuccucggcgucccccucauccgcuccggccucuuccacucccaccucgagaaccuccagcagguccccaccuccgagcuccacgagcaggucacccucuccuacggcauguucgagaacaagcgcaacgccguccacgucaagggccccuucuccgucgaggccgaccccucccgcuuccgcuccauccacugccaccucuaccccgacacccccuggugcccccgcaccgccaucuucuga

SEQ ID NO: 45333 - RNA, 1014 nt, Artificial Sequence
  derived and/or modified sequence opt2 from LGALS12__Homo_sapiens__NP_001136007
augucccagcccuccggcggccgcgcccccggcacccgcaucuacuccugguccugccccaccgucaugucccccggcgagaagcucgaccccauccccgacuccuucauccuccagccccccgucuuccaccccgucguccccuacgucaccaccaucuucggcggccuccacgccggcaagauggucaugcuccagggcgucgucccccucgacgcccacucccgcuuccaggucgacuuccagugcggcugcucccucugcccccgccccgacaucgccuuccacuucaacccccgcuuccacaccaccaagccccacgucaucugcaacacccuccacggcggccgcuggcagcgcgaggcccgcuggccccaccucgcccuccgccgcggcuccuccuuccucauccucuuccucuucggcaacgaggaggucaaggucuccgucaacggccagcacuuccuccacuuccgcuaccgccucccccucucccacgucgacacccucggcaucuucggcgacauccucgucgaggccgucggcuuccucaacaucaaccccuucgucgagggcucccgcgaguaccccgccggccaccccuuccuccucauguccccccgccucgagguccccugcucccacgcccucccccagggccucucccccggccaggucaucaucguccgcggccucguccuccaggagcccaagcacuucaccgucucccuccgcgaccaggccgcccacgcccccgucacccuccgcgccuccuucgccgaccgcacccucgccuggaucucccgcuggggccagaagaagcucaucuccgcccccuuccucuucuacccccagcgcuucuucgagguccuccuccucuuccaggagggcggccucaagcucgcccucaacggccagggccucggcgccaccuccaugaaccagcaggcccucgagcagcuccgcgagcuccgcaucuccggcuccguccagcucuacugcguccacuccuga

SEQ ID NO: 45334 - RNA, 420 nt, Artificial Sequence
  derived and/or modified sequence opt2 from LGALS13__Homo_sapiens__NP_037400
auguccucccuccccguccccuacaagcuccccgucucccucuccgucggcuccugcgucaucaucaagggcacccccauccacuccuucaucaacgacccccagcuccaggucgacuucuacaccgacauggacgaggacuccgacaucgccuuccgcuuccgcguccacuucggcaaccacgucgucaugaaccgccgcgaguucggcaucuggaugcucgaggagaccaccgacuacguccccuucgaggacggcaagcaguucgagcucugcaucuacguccacuacaacgaguacgagaucaaggucaacggcauccgcaucuacggcuucguccaccgcaucccccccuccuucgucaagaugguccaggucucccgcgacaucucccucaccuccgucugcgucugcaacuga

SEQ ID NO: 45335 - RNA, 420 nt, Artificial Sequence
  derived and/or modified sequence opt2 from LGALS14__Homo_sapiens__NP_064514
auguccucccuccccguccccuacacccuccccgucucccuccccgucggcuccugcgucaucaucaccggcacccccauccucaccuucgucaaggacccccagcucgaggucaacuucuacaccggcauggacgaggacuccgacaucgccuuccaguuccgccuccacuucggccaccccgccaucaugaacuccugcgucuucggcaucuggcgcuacgaggagaagugcuacuaccuccccuucgaggacggcaagcccuucgagcucugcaucuacguccgccacaaggaguacaaggucauggucaacggccagcgcaucuacaacuucgcccaccgcuucccccccgccuccgucaagaugcuccaggucuuccgcgacaucucccucacccgcguccucaucuccgacuga

SEQ ID NO: 45336 - RNA, 429 nt, Artificial Sequence
  derived and/or modified sequence opt2 from LGALS16__Homo_sapiens__NP_001177370
auguccuuccucaccguccccuacaagcuccccgucucccucuccgucggcuccugcgucaucaucaagggcacccucaucgacuccuccaucaacgagccccagcuccaggucgacuucuacaccgagaugaacgaggacuccgagaucgccuuccaccuccgcguccaccucggccgccgcgucgucaugaacucccgcgaguucggcaucuggaugcucgaggagaaccuccacuacguccccuucgaggacggcaagcccuucgaccuccgcaucuacgucugccacaacgaguacgaggucaaggucaacggcgaguacaucuacgccuucguccaccgcaucccccccuccuacgucaagaugauccaggucuggcgcgacgucucccucgacuccguccucgucaacaacggccgccgcuga

SEQ ID NO: 45337 - RNA, 408 nt, Artificial Sequence
  derived and/or modified sequence opt2 from LGALS1__Homo_sapiens__NP_002296
auggccugcggccucgucgccuccaaccucaaccucaagcccggcgagugccuccgcguccgcggcgaggucgcccccgacgccaaguccuucguccucaaccucggcaaggacuccaacaaccucugccuccacuucaacccccgcuucaacgcccacggcgacgccaacaccaucgucugcaacuccaaggacggcggcgccuggggcaccgagcagcgcgaggccgucuuccccuuccagcccggcuccgucgccgaggucugcaucaccuucgaccaggccaaccucaccgucaagcuccccgacggcuacgaguucaaguuccccaaccgccucaaccucgaggccaucaacuacauggccgccgacggcgacuucaagaucaagugcgucgccuucgacuga

SEQ ID NO: 45338 - RNA, 399 nt, Artificial Sequence
  derived and/or modified sequence opt2 from LGALS2__Homo_sapiens__NP_006489
augaccggcgagcucgaggucaagaacauggacaugaagcccggcuccacccucaagaucaccggcuccaucgccgacggcaccgacggcuucgucaucaaccucggccagggcaccgacaagcucaaccuccacuucaacccccgcuucuccgaguccaccaucgucugcaacucccucgacggcuccaacuggggccaggagcagcgcgaggaccaccucugcuucucccccggcuccgaggucaaguucaccgucaccuucgaguccgacaaguucaaggucaagcuccccgacggccacgagcucaccuuccccaaccgccucggccacucccaccucuccuaccucuccguccgcggcggcuucaacauguccuccuucaagcucaaggaguga

SEQ ID NO: 45339 - RNA, 1758 nt, Artificial Sequence
  derived and/or modified sequence opt2 from LGALS3BP__Homo_sapiens__NP_005558
augacccccccccgccucuucugggucuggcuccucgucgccggcacccagggcgucaacgacggcgacaugcgccucgccgacggcggcgccaccaaccagggccgcgucgagaucuucuaccgcggccaguggggcaccgucugcgacaaccucugggaccucaccgacgccuccgucgucugccgcgcccucggcuucgagaacgccacccaggcccucggccgcgccgccuucggccagggcuccggccccaucaugcucgacgagguccagugcaccggcaccgaggccucccucgccgacugcaagucccucggcuggcucaaguccaacugccgccacgagcgcgacgccggcgucgucugcaccaacgagacccgcuccacccacacccucgaccucucccgcgagcucuccgaggcccucggccagaucuucgacucccagcgcggcugcgaccucuccaucuccgucaacguccagggcgaggacgcccucggcuucugcggccacaccgucauccucaccgccaaccucgaggcccaggcccucuggaaggagcccggcuccaacgucaccauguccgucgacgccgagugcguccccaugguccgcgaccuccuccgcuacuucuacucccgccgcaucgacaucacccucuccuccgucaagugcuuccacaagcucgccuccgccuacggcgcccgccagcuccagggcuacugcgccucccucuucgccauccuccucccccaggaccccuccuuccagaugccccucgaccucuacgccuacgccgucgccaccggcgacgcccuccucgagaagcucugccuccaguuccucgccuggaacuucgaggcccucacccaggccgaggccuggcccuccguccccaccgaccuccuccagcuccuccucccccgcuccgaccucgccguccccuccgagcucgcccuccucaaggccgucgacaccugguccuggggcgagcgcgccucccacgaggaggucgagggccucgucgagaagauccgcuuccccaugaugcuccccgaggagcucuucgagcuccaguucaaccucucccucuacuggucccacgaggcccucuuccagaagaagacccuccaggcccucgaguuccacaccguccccuuccagcuccucgcccgcuacaagggccucaaccucaccgaggacaccuacaagccccgcaucuacaccucccccaccugguccgccuucgucaccgacuccuccugguccgcccgcaagucccagcucgucuaccagucccgccgcggcccccucgucaaguacuccuccgacuacuuccaggcccccuccgacuaccgcuacuaccccuaccaguccuuccagaccccccagcaccccuccuuccucuuccaggacaagcgcgucuccuggucccucgucuaccuccccaccauccaguccugcuggaacuacggcuucuccugcuccuccgacgagcuccccguccucggccucaccaaguccggcggcuccgaccgcaccaucgccuacgagaacaaggcccucaugcucugcgagggccucuucgucgccgacgucaccgacuucgagggcuggaaggccgccauccccuccgcccucgacaccaacuccuccaaguccaccuccuccuuccccugccccgccggccacuucaacggcuuccgcaccgucauccgccccuucuaccucaccaacuccuccggcgucgacuga

SEQ ID NO: 45340 - RNA, 603 nt, Artificial Sequence
  derived and/or modified sequence opt2 from LGALS3__Homo_sapiens__NP_001170859
auggccgacaacuucucccuccacgacgcccucuccggcuccggcaaccccaacccccagggcuggcccggcgccuggggcaaccagcccgccggcgccggcggcuaccccggcgccuccuaccccggcgccuaccccggccaggccccccccggcgccuaccccggccaggccccccccggcgccuaccccggcgcccccggcgccuaccccggcgcccccgcccccggcgucuaccccggcccccccuccggccccggcgccuaccccuccuccggccagcccuccgccaccggcgccuaccccgccaccggccccuacggcgcccccgccggcccccucaucguccccuacaaccucccccuccccggcggcgucgucccccgcaugcucaucaccauccucggcaccgucaagcccaacgccaaccgcaucgcccucgacuuccagcgcggcaacgacgucgccuuccacuucaacccccgcuucaacgagaacaaccgccgcgucaucgucugcaccuacaugugcaagggcuucauguucaccgucuccgagaacuucuacauccaccaguaccccuccugcaaguccuccaccuga

SEQ ID NO: 45341 - RNA, 972 nt, Artificial Sequence
  derived and/or modified sequence opt2 from LGALS4__Homo_sapiens__NP_006140
auggccuacguccccgcccccggcuaccagcccaccuacaaccccacccuccccuacuaccagcccauccccggcggccucaacgucggcauguccgucuacauccagggcgucgccuccgagcacaugaagcgcuucuucgucaacuucgucgucggccaggaccccggcuccgacgucgccuuccacuucaacccccgcuucgacggcugggacaaggucgucuucaacacccuccagggcggcaaguggggcuccgaggagcgcaagcgcuccaugcccuucaagaagggcgccgccuucgagcucgucuucaucguccucgccgagcacuacaaggucgucgucaacggcaaccccuucuacgaguacggccaccgccucccccuccagauggucacccaccuccaggucgacggcgaccuccagcuccaguccaucaacuucaucggcggccagccccuccgcccccagggcccccccaugaugccccccuaccccggccccggccacugccaccagcagcucaacucccuccccaccauggagggcccccccaccuucaacccccccguccccuacuucggccgccuccagggcggccucaccgcccgccgcaccaucaucaucaagggcuacgucccccccaccggcaaguccuucgccaucaacuucaaggucggcuccuccggcgacaucgcccuccacaucaacccccgcaugggcaacggcaccgucguccgcaacucccuccucaacggcuccuggggcuccgaggagaagaagaucacccacaaccccuucggccccggccaguucuucgaccucuccauccgcugcggccucgaccgcuucaaggucuacgccaacggccagcaccucuucgacuucgcccaccgccucuccgccuuccagcgcgucgacacccucgagauccagggcgacgucacccucuccuacguccagaucuga

SEQ ID NO: 45342 - RNA, 411 nt, Artificial Sequence
  derived and/or modified sequence opt2 from LGALS7B__Homo_sapiens__NP_001035972
auguccaacgucccccacaaguccucccuccccgagggcauccgccccggcaccguccuccgcauccgcggccucgucccccccaacgccucccgcuuccacgucaaccuccucugcggcgaggagcagggcuccgacgccgcccuccacuucaacccccgccucgacaccuccgaggucgucuucaacuccaaggagcagggcuccuggggccgcgaggagcgcggccccggcguccccuuccagcgcggccagcccuucgagguccucaucaucgccuccgacgacggcuucaaggccgucgucggcgacgcccaguaccaccacuuccgccaccgccucccccucgcccgcguccgccucgucgaggucggcggcgacguccagcucgacuccguccgcaucuucuga

SEQ ID NO: 45343 - RNA, 1080 nt, Artificial Sequence
  derived and/or modified sequence opt2 from LGALS8__Homo_sapiens__NP_006490
augaugcucucccucaacaaccuccagaacaucaucuacaaccccgucauccccuucgucggcaccauccccgaccagcucgaccccggcacccucaucgucauccgcggccacguccccuccgacgccgaccgcuuccaggucgaccuccagaacggcuccuccaugaagccccgcgccgacgucgccuuccacuucaacccccgcuucaagcgcgccggcugcaucgucugcaacacccucaucaacgagaaguggggccgcgaggagaucaccuacgacacccccuucaagcgcgagaaguccuucgagaucgucaucaugguccucaaggacaaguuccaggucgccgucaacggcaagcacacccuccucuacggccaccgcaucggccccgagaagaucgacacccucggcaucuacggcaaggucaacauccacuccaucggcuucuccuucuccuccgaccuccaguccacccaggccuccucccucgagcucaccgagaucucccgcgagaacguccccaaguccggcaccccccagcuccccuccaaccgcggcggcgacaucuccaagaucgccccccgcaccgucuacaccaaguccaaggacuccaccgucaaccacacccucaccugcaccaagaucccccccaugaacuacgucuccaagcgccuccccuucgccgcccgccucaacacccccaugggccccggccgcaccgucgucgucaagggcgaggucaacgccaacgccaaguccuucaacgucgaccuccucgccggcaaguccaaggacaucgcccuccaccucaacccccgccucaacaucaaggccuucguccgcaacuccuuccuccaggaguccuggggcgaggaggagcgcaacaucaccuccuuccccuucucccccggcauguacuucgagaugaucaucuacugcgacguccgcgaguucaaggucgccgucaacggcguccacucccucgaguacaagcaccgcuucaaggagcucuccuccaucgacacccucgagaucaacggcgacauccaccuccucgagguccgcuccugguga

SEQ ID NO: 45344 - RNA, 972 nt, Artificial Sequence
  derived and/or modified sequence opt2 from LGALS9__Homo_sapiens__NP_002299
auggccuucuccggcucccaggcccccuaccucucccccgccguccccuucuccggcaccauccagggcggccuccaggacggccuccagaucaccgucaacggcaccguccucuccuccuccggcacccgcuucgccgucaacuuccagaccggcuucuccggcaacgacaucgccuuccacuucaacccccgcuucgaggacggcggcuacgucgucugcaacacccgccagaacggcuccuggggccccgaggagcgcaagacccacaugcccuuccagaagggcaugcccuucgaccucugcuuccucguccaguccuccgacuucaaggucauggucaacggcauccucuucguccaguacuuccaccgcguccccuuccaccgcgucgacaccaucuccgucaacggcuccguccagcucuccuacaucuccuuccagccccccggcgucuggcccgccaaccccgcccccaucacccagaccgucauccacaccguccaguccgcccccggccagauguucuccacccccgccaucccccccaugauguacccccaccccgccuaccccaugcccuucaucaccaccauccucggcggccucuaccccuccaaguccauccuccucuccggcaccguccuccccuccgcccagcgcuuccacaucaaccucugcuccggcaaccacaucgccuuccaccucaacccccgcuucgacgagaacgccgucguccgcaacacccagaucgacaacuccuggggcuccgaggagcgcucccucccccgcaagaugcccuucguccgcggccaguccuucuccgucuggauccucugcgaggcccacugccucaaggucgccgucgacggccagcaccucuucgaguacuaccaccgccuccgcaaccuccccaccaucaaccgccucgaggucggcggcgacauccagcucacccacguccagaccuga

SEQ ID NO: 45345 - RNA, 519 nt, Artificial Sequence
  derived and/or modified sequence opt2 from LGALSL__Homo_sapiens__NP_054900
auggccggcuccgucgccgacuccgacgccgucgucaagcucgacgacggccaccucaacaacucccucuccucccccguccaggccgacgucuacuucccccgccucaucguccccuucugcggccacaucaagggcggcaugcgccccggcaagaagguccucgucaugggcaucgucgaccucaaccccgaguccuucgccaucucccucaccugcggcgacuccgaggacccccccgccgacgucgccaucgagcucaaggccgucuucaccgaccgccagcuccuccgcaacuccugcaucuccggcgagcgcggcgaggagcaguccgccauccccuacuuccccuucauccccgaccagcccuuccgcgucgagauccucugcgagcacccccgcuuccgcgucuucgucgacggccaccagcucuucgacuucuaccaccgcauccagacccucuccgccaucgacaccaucaagaucaacggcgaccuccagaucaccaagcucggcuga

SEQ ID NO: 45346 - RNA, 1674 nt, Artificial Sequence
  derived and/or modified sequence opt2 from LGI1__Homo_sapiens__NP_005088
auggaguccgagcgcuccaagcgcaugggcaacgccugcaucccccucaagcgcaucgccuacuuccucugccuccucuccgcccuccuccucaccgagggcaagaagcccgccaagcccaagugccccgccgucugcaccugcaccaaggacaacgcccucugcgagaacgcccgcuccaucccccgcaccgucccccccgacgucaucucccucuccuucguccgcuccggcuucaccgagaucuccgagggcuccuuccucuucacccccucccuccagcuccuccucuucaccuccaacuccuucgacgucaucuccgacgacgccuucaucggccucccccaccucgaguaccucuucaucgagaacaacaacaucaaguccaucucccgccacaccuuccgcggccucaagucccucauccaccucucccucgccaacaacaaccuccagacccuccccaaggacaucuucaagggccucgacucccucaccaacgucgaccuccgcggcaacuccuucaacugcgacugcaagcucaaguggcucgucgaguggcucggccacaccaacgccaccgucgaggacaucuacugcgagggcccccccgaguacaagaagcgcaagaucaacucccucuccuccaaggacuucgacugcaucaucaccgaguucgccaagucccaggaccuccccuaccagucccucuccaucgacaccuucuccuaccucaacgacgaguacgucgucaucgcccagcccuucaccggcaagugcaucuuccucgagugggaccacgucgagaagaccuuccgcaacuacgacaacaucaccggcaccuccaccgucgucugcaagcccaucgucaucgagacccagcucuacgucaucgucgcccagcucuucggcggcucccacaucuacaagcgcgacuccuucgccaacaaguucaucaagauccaggacaucgagauccucaagauccgcaagcccaacgacaucgagaccuucaagaucgagaacaacugguacuucgucgucgccgacuccuccaaggccggcuucaccaccaucuacaaguggaacggcaacggcuucuacucccaccagucccuccacgccugguaccgcgacaccgacgucgaguaccucgagaucguccgcaccccccagacccuccgcaccccccaccucauccucuccuccuccucccagcgccccgucaucuaccaguggaacaaggccacccagcucuucaccaaccagaccgacauccccaacauggaggacgucuacgccgucaagcacuucuccgucaagggcgacgucuacaucugccucacccgcuucaucggcgacuccaaggucaugaaguggggcggcuccuccuuccaggacauccagcgcaugcccucccgcggcuccauggucuuccagccccuccagaucaacaacuaccaguacgccauccucggcuccgacuacuccuucacccaggucuacaacugggacgccgagaaggccaaguucgucaaguuccaggagcucaacguccaggccccccgcuccuucacccacgucuccaucaacaagcgcaacuuccucuucgccuccuccuucaagggcaacacccagaucuacaagcacgucaucgucgaccucuccgccuga

SEQ ID NO: 45347 - RNA, 1638 nt, Artificial Sequence
  derived and/or modified sequence opt2 from LGI2__Homo_sapiens__NP_060646
auggcccuccgccgcggcggcugcggcgcccucggccuccuccuccuccuccucggcgccgccugccucaucccccgcuccgcccagguccgccgccucgcccgcugccccgccaccugcuccugcaccaaggaguccaucaucugcgucggcuccuccugggucccccgcaucguccccggcgacaucuccucccucucccucgucaacggcaccuucuccgagaucaaggaccgcauguucucccaccuccccucccuccagcuccuccuccucaacuccaacuccuucaccaucauccgcgacgacgccuucgccggccucuuccaccucgaguaccucuucaucgagggcaacaagaucgagaccaucucccgcaacgccuuccgcggccuccgcgaccucacccaccucucccucgccaacaaccacaucaaggcccucccccgcgacgucuucuccgaccucgacucccucaucgagcucgaccuccgcggcaacaaguucgagugcgacugcaaggccaaguggcucuaccucuggcucaagaugaccaacuccaccgucuccgacguccucugcaucggcccccccgaguaccaggagaagaagcucaacgacgucaccuccuucgacuacgagugcaccaccaccgacuucgucguccaccagacccuccccuaccaguccgucuccgucgacaccuucaacuccaagaacgacgucuacgucgccaucgcccagcccuccauggagaacugcaugguccucgagugggaccacaucgagaugaacuuccgcuccuacgacaacaucaccggccaguccaucgucggcugcaaggccauccucaucgacgaccaggucuucgucgucgucgcccagcucuucggcggcucccacaucuacaaguacgacgaguccuggaccaaguucgucaaguuccaggacaucgaggucucccgcaucuccaagcccaacgacaucgagcucuuccagaucgacgacgagaccuucuucgucaucgccgacuccuccaaggccggccucuccaccgucuacaaguggaacuccaagggcuucuacuccuaccagucccuccacgagugguuccgcgacaccgacgccgaguucgucgacaucgacggcaagucccaccucauccucuccucccgcucccagguccccaucauccuccaguggaacaaguccuccaagaaguucgucccccacggcgacauccccaacauggaggacguccucgccgucaaguccuuccgcaugcagaacacccucuaccucucccucacccgcuucaucggcgacucccgcgucaugcgcuggaacuccaagcaguucgucgagauccaggcccuccccucccgcggcgccaugacccuccagcccuucuccuucaaggacaaccacuaccucgcccucggcuccgacuacaccuucucccagaucuaccagugggacaaggagaagcagcucuucaagaaguucaaggagaucuacguccaggccccccgcuccuucaccgccgucuccaccgaccgccgcgacuucuucuucgccuccuccuucaagggcaagaccaagaucuucgagcacaucaucgucgaccucucccucuga

SEQ ID NO: 45348 - RNA, 1614 nt, Artificial Sequence
  derived and/or modified sequence opt2 from LGI4__Homo_sapiens__NP_644813
augggcggcgccggcauccuccuccuccuccucgccggcgccggcgucgucgucgccuggcgcccccccaagggcaagugcccccuccgcugcuccugcuccaaggacuccgcccucugcgagggcucccccgaccuccccgucuccuucucccccacccuccucucccucucccucguccgcaccggcgucacccagcucaaggccggcuccuuccuccgcauccccucccuccaccuccuccucuucaccuccaacuccuucuccgucaucgaggacgacgccuucgccggccucucccaccuccaguaccucuucaucgaggacaacgagaucggcuccaucuccaagaacgcccuccgcggccuccgcucccucacccaccucucccucgccaacaaccaccucgagacccucccccgcuuccucuuccgcggccucgacacccucacccacgucgaccuccgcggcaaccccuuccagugcgacugccgcguccucuggcuccuccaguggaugcccaccgucaacgccuccgucggcaccggcgccugcgccggccccgccucccucucccacaugcagcuccaccaccucgaccccaagaccuucaagugccgcgccaucgagcucuccugguuccagaccgucggcgaguccgcccucuccgucgagcccuucuccuaccagggcgagccccacaucguccucgcccagcccuucgccggccgcugccucauccucuccugggacuacucccuccagcgcuuccgccccgaggaggagcuccccgccgccuccgucgucuccugcaagccccucguccucggccccucccucuucguccucgccgcccgccucuggggcggcucccagcucugggcccgccccucccccggccuccgccucgcccccacccagacccucgccccccgccgccuccuccgccccaacgacgccgagcuccucuggcucgagggccagcccugcuucgucgucgccgacgccuccaaggccggcuccaccacccuccucugccgcgacggccccggcuucuacccccaccagucccuccacgccuggcaccgcgacaccgacgccgaggcccucgagcucgacggccgcccccaccuccuccucgccuccgccucccagcgccccguccucuuccacuggaccggcggccgcuucgagcgccgcaccgacauccccgaggccgaggacgucuacgccacccgccacuuccaggccggcggcgacgucuuccucugccucacccgcuacaucggcgacuccauggucaugcgcugggacggcuccauguuccgccuccuccagcagcuccccucccgcggcgcccacgucuuccagccccuccucaucgcccgcgaccagcucgccauccucggcuccgacuucgccuucucccagguccuccgccucgagcccgacaagggccuccucgagccccuccaggagcucggcccccccgcccucgucgccccccgcgccuucgcccacaucaccauggccggccgccgcuuccucuucgccgccugcuucaagggccccacccagaucuaccagcaccacgagaucgaccucuccgccuga

SEQ ID NO: 45349 - RNA, 1302 nt, Artificial Sequence
  derived and/or modified sequence opt2 from LGMN__Homo_sapiens__NP_005597
auggucuggaaggucgccgucuuccucuccgucgcccucggcaucggcgccguccccaucgacgaccccgaggacggcggcaagcacugggucgucaucgucgccggcuccaacggcugguacaacuaccgccaccaggccgacgccugccacgccuaccagaucauccaccgcaacggcauccccgacgagcagaucgucgucaugauguacgacgacaucgccuacuccgaggacaaccccacccccggcaucgucaucaaccgccccaacggcaccgacgucuaccagggcguccccaaggacuacaccggcgaggacgucaccccccagaacuuccucgccguccuccgcggcgacgccgaggccgucaagggcaucggcuccggcaagguccucaaguccggcccccaggaccacgucuucaucuacuucaccgaccacggcuccaccggcauccucgucuuccccaacgaggaccuccacgucaaggaccucaacgagaccauccacuacauguacaagcacaagauguaccgcaagauggucuucuacaucgaggccugcgaguccggcuccaugaugaaccaccuccccgacaacaucaacgucuacgccaccaccgccgccaacccccgcgaguccuccuacgccugcuacuacgacgagaagcgcuccaccuaccucggcgacugguacuccgucaacuggauggaggacuccgacgucgaggaccucaccaaggagacccuccacaagcaguaccaccucgucaagucccacaccaacaccucccacgucaugcaguacggcaacaagaccaucuccaccaugaaggucaugcaguuccagggcaugaagcgcaaggccuccucccccgucccccucccccccgucacccaccucgaccucacccccucccccgacgucccccucaccaucaugaagcgcaagcucaugaacaccaacgaccucgaggagucccgccagcucaccgaggagauccagcgccaccucgacgcccgccaccucaucgagaaguccguccgcaagaucgucucccuccucgccgccuccgaggccgaggucgagcagcuccucuccgagcgcgccccccucaccggccacuccugcuaccccgaggcccuccuccacuuccgcacccacugcuucaacuggcacucccccaccuacgaguacgcccuccgccaccucuacguccucgucaaccucugcgagaagcccuacccccuccaccgcaucaagcucuccauggaccacgucugccucggccacuacuga

SEQ ID NO: 45350 - RNA, 2856 nt, Artificial Sequence
  derived and/or modified sequence opt2 from LGR4__Homo_sapiens__NP_060960
augcccggcccccucggccuccucugcuuccucgcccucggccuccucggcuccgccggccccuccggcgccgcccccccccucugcgccgcccccugcuccugcgacggcgaccgccgcgucgacugcuccggcaagggccucaccgccguccccgagggccucuccgccuucacccaggcccucgacaucuccaugaacaacaucacccagcuccccgaggacgccuucaagaacuuccccuuccucgaggagcuccagcucgccggcaacgaccucuccuucauccaccccaaggcccucuccggccucaaggagcucaagguccucacccuccagaacaaccagcucaagaccguccccuccgaggccauccgcggccucuccgcccuccagucccuccgccucgacgccaaccacaucaccuccguccccgaggacuccuucgagggccucguccagcuccgccaccucuggcucgacgacaacucccucaccgagguccccguccacccccucuccaaccuccccacccuccaggcccucacccucgcccucaacaagaucuccuccauccccgacuucgccuucaccaaccucuccucccucgucguccuccaccuccacaacaacaagauccgcucccucucccagcacugcuucgacggccucgacaaccucgagacccucgaccucaacuacaacaaccucggcgaguucccccaggccaucaaggcccuccccucccucaaggagcucggcuuccacuccaacuccaucuccgucauccccgacggcgccuucgacggcaacccccuccuccgcaccauccaccucuacgacaacccccucuccuucgucggcaacuccgccuuccacaaccucuccgaccuccacucccucgucauccgcggcgccuccaugguccagcaguuccccaaccucaccggcaccguccaccucgagucccucacccucaccggcaccaagaucuccuccauccccaacaaccucugccaggagcagaagaugcuccgcacccucgaccucuccuacaacaacauccgcgaccuccccuccuucaacggcugccacgcccucgaggagaucucccuccagcgcaaccagaucuaccagaucaaggagggcaccuuccagggccucaucucccuccgcauccucgaccucucccgcaaccucauccacgagauccacucccgcgccuucgccacccucggccccaucaccaaccucgacgucuccuucaacgagcucaccuccuuccccaccgagggccucaacggccucaaccagcucaagcucgucggcaacuucaagcucaaggaggcccucgccgccaaggacuucgucaaccuccgcucccucuccguccccuacgccuaccagugcugcgccuucuggggcugcgacuccuacgccaaccucaacaccgaggacaacucccuccaggaccacuccgucgcccaggagaagggcaccgccgacgccgccaacgucaccuccacccucgagaacgaggagcacucccagaucaucauccacugcacccccuccaccggcgccuucaagcccugcgaguaccuccucggcuccuggaugauccgccucaccgucugguucaucuuccucgucgcccucuucuucaaccuccucgucauccucaccaccuucgccuccugcaccucccuccccuccuccaagcucuucaucggccucaucuccgucuccaaccucuucaugggcaucuacaccggcauccucaccuuccucgacgccgucuccuggggccgcuucgccgaguucggcaucuggugggagaccggcuccggcugcaaggucgccggcuuccucgccgucuucuccuccgaguccgccaucuuccuccucaugcucgccaccgucgagcgcucccucuccgccaaggacaucaugaagaacggcaaguccaaccaccucaagcaguuccgcgucgccgcccuccucgccuuccucggcgccaccgucgccggcugcuucccccucuuccaccgcggcgaguacuccgccuccccccucugccuccccuuccccaccggcgagacccccucccucggcuucaccgucacccucguccuccucaacucccucgccuuccuccucauggccgucaucuacaccaagcucuacugcaaccucgagaaggaggaccucuccgagaacucccaguccuccaugaucaagcacgucgccuggcucaucuucaccaacugcaucuucuucugccccgucgccuucuucuccuucgccccccucaucaccgccaucuccaucucccccgagaucaugaaguccgucacccucaucuucuucccccuccccgccugccucaaccccguccucuacgucuucuucaaccccaaguucaaggaggacuggaagcuccucaagcgccgcgucaccaagaaguccggcuccgucuccgucuccaucuccucccagggcggcugccucgagcaggacuucuacuacgacugcggcauguacucccaccuccagggcaaccucaccgucugcgacugcugcgaguccuuccuccucaccaagcccgucuccugcaagcaccucaucaagucccacuccugccccgcccucgccgucgccuccugccagcgccccgagggcuacugguccgacugcggcacccaguccgcccacuccgacuacgccgacgaggaggacuccuucgucuccgacuccuccgaccagguccaggccugcggccgcgccugcuucuaccagucccgcggcuucccccucguccgcuacgccuacaaccucccccgcgucaaggacuga

SEQ ID NO: 45351 - RNA, 2652 nt, Artificial Sequence
  derived and/or modified sequence opt2 from LGR5__Homo_sapiens__NP_001264155
auggacaccucccgccucggcguccuccucucccuccccguccuccuccagcucgccaccggcggcuccuccccccgcuccggcguccuccuccgcggcugccccacccacugccacugcgagcccgacggccgcaugcuccuccgcgucgacugcuccgaccucggccucuccgagcuccccuccaaccucuccgucuucaccuccuaccucgaccucuccaugaacaacaucucccagcuccuccccaacccccuccccucccuccgcuuccucgaggagcuccgccucgccggcaacgcccucaccuacauccccaagggcgccuucaccggccucuacucccucaagguccucaugcuccagaacaaccagcuccgccacguccccaccgaggcccuccagaaccuccgcucccuccagucccuccgccucgacgccaaccacaucuccuacgucccccccuccugcuucuccggccuccacucccuccgccaccucuggcucgacgacaacgcccucaccgagauccccguccaggccuuccgcucccucuccgcccuccaggccaugacccucgcccucaacaagauccaccacauccccgacuacgccuucggcaaccucuccucccucgucguccuccaccuccacaacaaccgcauccacucccucggcaagaagugcuucgacggccuccacucccucgagacccucgaccucaacuacaacaaccucgacgaguuccccaccgccauccgcacccucuccaaccucaaggagcuccacuucuacgacaaccccauccaguucgucggccgcuccgccuuccagcaccuccccgagcuccgcacccucacccucaacggcgccucccagaucaccgaguuccccgaccucaccggcaccgccaaccucgagucccucacccucaccggcgcccagaucuccucccucccccagaccgucugcaaccagcuccccaaccuccagguccucgaccucuccuacaaccuccucgaggaccuccccuccuucuccgucugccagaagcuccagaagaucgaccuccgccacaacgagaucuacgagaucaaggucgacaccuuccagcagcuccucucccuccgcucccucaaccucgccuggaacaagaucgccaucauccaccccaacgccuucuccacccuccccucccucaucaagcucgaccucuccuccaaccuccucuccuccuuccccaucaccggccuccacggccucacccaccucaagcucaccggcaaccacgcccuccagucccucaucuccuccgagaacuuccccgagcucaaggucaucgagaugcccuacgccuaccagugcugcgccuucggcgucugcgagaacgccuacaagaucuccaaccaguggaacaagggcgacaacuccuccauggacgaccuccacaagaaggacgccggcauguuccaggcccaggacgagcgcgaccucgaggacuuccuccucgacuucgaggaggaccucaaggcccuccacuccguccagugcucccccucccccggccccuucaagcccugcgagcaccuccucgacggcuggcucauccgcaucggcgucuggaccaucgccguccucgcccucaccugcaacgcccucgucaccuccaccgucuuccgcuccccccucuacaucucccccaucaagcuccucaucggcgucaucgccgccgucaacaugcucaccggcgucuccuccgccguccucgccggcgucgacgccuucaccuucggcuccuucgcccgccacggcgccuggugggagaacggcgucggcugccacgucaucggcuuccucuccaucuucgccuccgaguccuccgucuuccuccucacccucgccgcccucgagcgcggcuucuccgucaaguacuccgccaaguucgagaccaaggcccccuucuccucccucaaggucaucauccuccucugcgcccuccucgcccucaccauggccgccgucccccuccucggcggcuccaaguacggcgccuccccccucugccucccccuccccuucggcgagcccuccaccaugggcuacauggucgcccucauccuccucaacucccucugcuuccucaugaugaccaucgccuacaccaagcucuacugcaaccucgacaagggcgaccucgagaacaucugggacugcuccauggucaagcacaucgcccuccuccucuucaccaacugcauccucaacugccccgucgccuuccucuccuucuccucccucaucaaccucaccuucaucucccccgaggucaucaaguucauccuccucgucgucgucccccuccccgccugccucaacccccuccucuacauccucuucaacccccacuucaaggaggaccucgucucccuccgcaagcagaccuacgucuggacccgcuccaagcaccccucccucauguccaucaacuccgacgacgucgagaagcaguccugcgacuccacccaggcccucgucaccuucaccuccuccuccaucaccuacgaccucccccccuccuccguccccucccccgccuaccccgucaccgaguccugccaccucuccuccgucgccuucguccccugccucuga

SEQ ID NO: 45352 - RNA, 2904 nt, Artificial Sequence
  derived and/or modified sequence opt2 from LGR6__Homo_sapiens__NP_001017403
augcccuccccccccggccuccgcgcccucuggcucugcgccgcccucugcgccucccgccgcgccggcggcgccccccagcccggccccggccccaccgccugccccgcccccugccacugccaggaggacggcaucaugcucuccgccgacugcuccgagcucggccucuccgccguccccggcgaccucgacccccucaccgccuaccucgaccucuccaugaacaaccucaccgagcuccagcccggccucuuccaccaccuccgcuuccucgaggagcuccgccucuccggcaaccaccucucccacauccccggccaggccuucuccggccucuacucccucaagauccucaugcuccagaacaaccagcucggcggcauccccgccgaggcccucugggagcuccccucccuccagucccuccgccucgacgccaaccucaucucccucguccccgagcgcuccuucgagggccucuccucccuccgccaccucuggcucgacgacaacgcccucaccgagauccccguccgcgcccucaacaaccuccccgcccuccaggccaugacccucgcccucaaccgcaucucccacauccccgacuacgccuuccagaaccucaccucccucgucguccuccaccuccacaacaaccgcauccagcaccucggcacccacuccuucgagggccuccacaaccucgagacccucgaccucaacuacaacaagcuccaggaguuccccgucgccauccgcacccucggccgccuccaggagcucggcuuccacaacaacaacaucaaggccauccccgagaaggccuucaugggcaacccccuccuccagaccauccacuucuacgacaaccccauccaguucgucggccgcuccgccuuccaguaccuccccaagcuccacacccucucccucaacggcgccauggacauccaggaguuccccgaccucaagggcaccaccucccucgagauccucacccucacccgcgccggcauccgccuccuccccuccggcaugugccagcagcucccccgccuccgcguccucgagcucucccacaaccagaucgaggagcuccccucccuccaccgcugccagaagcucgaggagaucggccuccagcacaaccgcaucugggagaucggcgccgacaccuucucccagcucuccucccuccaggcccucgaccucuccuggaacgccauccgcuccauccaccccgaggccuucuccacccuccacucccucgucaagcucgaccucaccgacaaccagcucaccacccucccccucgccggccucggcggccucaugcaccucaagcucaagggcaaccucgcccucucccaggccuucuccaaggacuccuuccccaagcuccgcauccucgagguccccuacgccuaccagugcugccccuacggcaugugcgccuccuucuucaaggccuccggccagugggaggccgaggaccuccaccucgacgacgaggaguccuccaagcgcccccucggccuccucgcccgccaggccgagaaccacuacgaccaggaccucgacgagcuccagcucgagauggaggacuccaagccccaccccuccguccagugcucccccacccccggccccuucaagcccugcgaguaccucuucgaguccuggggcauccgccucgccgucugggccaucguccuccucuccguccucugcaacggccucguccuccucaccgucuucgccggcggccccgucccccucccccccgucaaguucgucgucggcgccaucgccggcgccaacacccucaccggcaucuccugcggccuccucgccuccgucgacgcccucaccuucggccaguucuccgaguacggcgcccgcugggagaccggccucggcugccgcgccaccggcuuccucgccguccucggcuccgaggccuccguccuccuccucacccucgccgccguccagugcuccgucuccgucuccugcguccgcgccuacggcaagucccccucccucggcuccguccgcgccggcguccucggcugccucgcccucgccggccucgccgccgcccucccccucgccuccgucggcgaguacggcgccuccccccucugccuccccuacgccccccccgagggccagcccgccgcccucggcuucaccgucgcccucgucaugaugaacuccuucugcuuccucgucgucgccggcgccuacaucaagcucuacugcgaccucccccgcggcgacuucgaggccgucugggacugcgccaugguccgccacgucgccuggcucaucuucgccgacggccuccucuacugccccgucgccuuccucuccuucgccuccaugcucggccucuuccccgucacccccgaggccgucaaguccguccuccucgucguccucccccuccccgccugccucaacccccuccucuaccuccucuucaacccccacuuccgcgacgaccuccgccgccuccgcccccgcgccggcgacuccggcccccucgccuacgccgccgccggcgagcucgagaaguccuccugcgacuccacccaggcccucgucgccuucuccgacgucgaccucauccucgaggccuccgaggccggccgcccccccggccucgagaccuacggcuuccccuccgucacccucaucuccugccagcagcccggcgccccccgccucgagggcucccacugcgucgagcccgagggcaaccacuucggcaacccccagcccuccauggacggcgagcuccuccuccgcgccgagggcuccacccccgccggcggcggccucuccggcggcggcggcuuccagcccuccggccucgccuucgccucccacgucuga

SEQ ID NO: 45353 - RNA, 627 nt, Artificial Sequence
  derived and/or modified sequence opt2 from LGSN__Homo_sapiens__NP_001137412
augaacaacgaggaggaccuccuccaggaggacuccacccgcgacgagggcaacgagaccgaggccaacuccaugaacacccuccgccgcacccgcaagaaggucaccaagcccuacgucugcuccaccgaggucggcgagaccgacauguccaacuccaacgacugcaugcgcgacuccucccagauccucacccccccccagcucuccucccgcaugaagcacauccgccaggccauggccaagaaccgccuccaguucguccgcuucgaggccaccgaccuccacggcgucucccgcuccaagaccauccccgcccacuucuuccaggagaaggucucccacggcgucugcaugccccgcggcuaccucgaggucauccccaaccccaaggacaacgagaugaacaacauccgcgccaccugcuucaacuccgacaucguccucaugcccgagcucuccaccuuccgcguccuccccugggccgaccgcaccgcccgcgucaucugcgacaccuucaccgucaccgucuccggcauguccaucggccgcaagaccugcuccgccgcccuccucgagcucuccuccucccgcucccucggcaagaacggcuggcaggacuccuga

SEQ ID NO: 45354 - RNA, 426 nt, Artificial Sequence
  derived and/or modified sequence opt2 from LHB__Homo_sapiens__NP_000885
auggagaugcuccagggccuccuccuccuccuccuccucuccaugggcggcgccugggccucccgcgagccccuccgccccuggugccaccccaucaacgccauccucgccgucgagaaggagggcugccccgucugcaucaccgucaacaccaccaucugcgccggcuacugccccaccaugaugcgcguccuccaggccguccuccccccccucccccaggucgucugcaccuaccgcgacguccgcuucgaguccauccgccuccccggcugcccccgcggcgucgaccccgucgucuccuuccccgucgcccucuccugccgcugcggccccugccgccgcuccaccuccgacugcggcggccccaaggaccacccccucaccugcgaccacccccagcucuccggccuccucuuccucuga

SEQ ID NO: 45355 - RNA, 2100 nt, Artificial Sequence
  derived and/or modified sequence opt2 from LHCGR__Homo_sapiens__NP_000224
augaagcagcgcuucuccgcccuccagcuccucaagcuccuccuccuccuccagcccccccucccccgcgcccuccgcgaggcccucugccccgagcccugcaacugcguccccgacggcgcccuccgcugccccggccccaccgccggccucacccgccucucccucgccuaccuccccgucaaggucauccccucccaggccuuccgcggccucaacgaggucaucaagaucgagaucucccagaucgacucccucgagcgcaucgaggccaacgccuucgacaaccuccucaaccucuccgagauccucauccagaacaccaagaaccuccgcuacaucgagcccggcgccuucaucaaccucccccgccucaaguaccucuccaucugcaacaccggcauccgcaaguuccccgacgucaccaaggucuucuccuccgaguccaacuucauccucgagaucugcgacaaccuccacaucaccaccauccccggcaacgccuuccagggcaugaacaacgaguccgucacccucaagcucuacggcaacggcuucgaggagguccagucccacgccuucaacggcaccacccucaccucccucgagcucaaggagaacguccaccucgagaagaugcacaacggcgccuuccgcggcgccaccggccccaagacccucgacaucuccuccaccaagcuccaggcccuccccuccuacggccucgaguccauccagcgccucaucgccaccuccuccuacucccucaagaagcuccccucccgcgagaccuucgucaaccuccucgaggccacccucaccuaccccucccacugcugcgccuuccgcaaccuccccaccaaggagcagaacuucucccacuccaucuccgagaacuucuccaagcagugcgaguccaccguccgcaaggucaacaacaagacccucuacuccuccaugcucgccgaguccgagcucuccggcugggacuacgaguacggcuucugccuccccaagaccccccgcugcgcccccgagcccgacgccuucaaccccugcgaggacaucaugggcuacgacuuccuccgcguccucaucuggcucaucaacauccucgccaucaugggcaacaugaccguccucuucguccuccucaccucccgcuacaagcucaccgucccccgcuuccucaugugcaaccucuccuucgccgacuucugcaugggccucuaccuccuccucaucgccuccgucgacucccagaccaagggccaguacuacaaccacgccaucgacuggcagaccggcuccggcugcuccaccgccggcuucuucaccgucuucgccuccgagcucuccgucuacacccucaccgucaucacccucgagcgcuggcacaccaucaccuacgccauccaccucgaccagaagcuccgccuccgccacgccauccucaucaugcucggcggcuggcucuucuccucccucaucgccaugcucccccucgucggcgucuccaacuacaugaaggucuccaucugcuuccccauggacgucgagaccacccucucccaggucuacauccucaccauccucauccucaacgucgucgccuucuucaucaucugcgccugcuacaucaagaucuacuucgccguccgcaaccccgagcucauggccaccaacaaggacaccaagaucgccaagaagauggccauccucaucuucaccgacuucaccugcauggcccccaucuccuucuucgccaucuccgccgccuucaaggucccccucaucaccgucaccaacuccaagguccuccucguccucuucuaccccaucaacuccugcgccaaccccuuccucuacgccaucuucaccaagaccuuccagcgcgacuucuuccuccuccucuccaaguucggcugcugcaagcgccgcgccgagcucuaccgccgcaaggacuucuccgccuacaccuccaacugcaagaacggcuucaccggcuccaacaagcccucccaguccacccucaagcucuccacccuccacugccagggcaccgcccuccucgacaagacccgcuacaccgagugcuga

SEQ ID NO: 45356 - RNA, 603 nt, Artificial Sequence
  derived and/or modified sequence opt2 from LHFP__Homo_sapiens__XP_011533163
auggccuccucccucaccugcaccggcgucaucugggcccuccucuccuuccucugcgccgccaccuccugcgucggcuucuucaugcccuacuggcucuggggcucccagcucggcaagcccgucuccuucggcaccuuccgccgcugcuccuaccccguccacgacgagucccgccagaugauggucauggucgaggagugcggccgcuacgccuccuuccagggcauccccuccgccgaguggcgcaucugcaccaucgucaccggccucggcugcggccuccuccuccucgucgcccucaccgcccucaugggcugcugcgucuccgaccucaucucccgcaccgucggccgcgucgccggcggcauccaguuccucggcggccuccucaucggcgccggcugcgcccucuacccccucggcugggacuccgaggagguccgccagaccugcggcuacaccuccggccaguucgaccucggcaagugcgagaucggcugggccuacuacugcaccggcgccggcgccaccgccgccaugcuccucugcaccuggcucgccugcuucuccggcaagaagcagaagcacuaccccuacuga

SEQ ID NO: 45357 - RNA, 732 nt, Artificial Sequence
  derived and/or modified sequence opt2 from LHFPL1__Homo_sapiens__XP_011529245
auggucaccuacugcaucuggugcugcgaccccacccaccuccccauccccgccgagaagcccgucaccaugcgcuccucccucaccauggucggcacccucugggccuuccucucccucgucaccgccgucaccuccuccaccuccuacuuccuccccuacuggcucuucggcucccagaugggcaagcccgucuccuucuccaccuuccgccgcugcaacuaccccguccgcggcgagggccacucccucaucauggucgaggagugcggccgcuacgccuccuucaacgccauccccucccucgccuggcagaugugcaccgucgucaccggcgccggcugcgcccuccuccuccucgucgcccucgccgccguccucggcugcugcauggaggagcucaucucccgcaugaugggccgcugcaugggcgccgcccaguucgucggcggccuccucaucuccuccggcugcgcccucuacccccucggcuggaacucccccgagaucaugcagaccugcggcaacgucuccaaccaguuccagcucggcaccugccgccucggcugggccuacuacugcgccggcggcggcgccgccgccgccaugcucaucugcaccuggcucuccugcuucgccggccgcaaccccaagcccgucauccucgucgaguccaucaugcgcaacaccaacuccuacgccauggagcucgaccacugccucaagcccuga

SEQ ID NO: 45358 - RNA, 687 nt, Artificial Sequence
  derived and/or modified sequence opt2 from LHFPL2__Homo_sapiens__NP_005770
augugccacgucaucgucaccugccgcuccaugcucuggacccuccucuccaucgucgucgccuucgccgagcucaucgccuucauguccgccgacuggcucaucggcaaggcccgcucccgcggcggcgucgagcccgccggccccggcggcggcucccccgagcccuaccaccccacccucggcaucuacgcccgcugcauccgcaaccccggcguccagcacuuccagcgcgacacccucugcggccccuacgccgaguccuucggcgagaucgccuccggcuucuggcaggccaccgccaucuuccucgccgucggcaucuucauccucugcauggucgcccucgucuccgucuucaccaugugcguccaguccaucaugaagaaguccaucuucaacgucugcggccuccuccagggcaucgccggccucuuccucauccucggccucauccucuaccccgccggcuggggcugccagaaggccaucgacuacugcggccacuacgccuccgccuacaagcccggcgacugcucccucggcugggccuucuacaccgccaucggcggcaccguccucaccuucaucugcgccgucuucuccgcccaggccgagaucgccaccuccuccgacaagguccaggaggagaucgaggagggcaagaaccucaucugccuccucuga

SEQ ID NO: 45359 - RNA, 711 nt, Artificial Sequence
  derived and/or modified sequence opt2 from LHFPL3__Homo_sapiens__NP_945351
augcccggcgccgccgccgccgccgccgccgccgccgccgccaugcuccccgcccaggaggccgccaagcucuaccacaccaacuacguccgcaacucccgcgccaucggcguccucugggccaucuucaccaucugcuucgccaucgucaacgucgucugcuucauccagcccuacuggaucggcgacggcgucgacaccccccaggccggcuacuucggccucuuccacuacugcaucggcaacggcuucucccgcgagcucaccugccgcggcuccuucaccgacuucuccacccuccccuccggcgccuucaaggccgccuccuucuucaucggccucuccaugaugcucaucaucgccugcaucaucugcuucacccucuucuucuucugcaacaccgccaccgucuacaagaucugcgccuggaugcagcucaccuccgccgccugccucguccucggcugcaugaucuuccccgacggcugggacuccgacgaggucaagcgcaugugcggcgagaagaccgacaaguacacccucggcgccugcuccguccgcugggccuacauccucgccaucaucggcauccucgacgcccucauccucuccuuccucgccuucguccucggcaaccgccaggacucccucauggccgaggagcucaaggccgagaacaagguccuccucucccaguacucccucgaguga

SEQ ID NO: 45360 - RNA, 744 nt, Artificial Sequence
  derived and/or modified sequence opt2 from LHFPL4__Homo_sapiens__XP_011531995
augcuccccucccaggaggccuccaagcucuaccacgagcacuacaugcgcaacucccgcgccaucggcguccucugggccaucuucaccaucugcuucgccaucaucaacgucgucgucuucauccagcccuacugggucggcgacuccgucuccacccccaagcccggcuacuucggccucuuccacuacugcgucggcuccggccucgccggccgcgagcucaccugccgcggcuccuucaccgacuucuccaccauccccuccuccgccuucaaggccgccgccuucuucguccuccucuccaugguccucauccucggcugcaucaccugcuucucccucuucuucuucugcaacaccgccaccgucuacaagaucugcgccuggaugcagcuccucgccgcccucugccucguccucggcugcaugaucuuccccgacggcugggacgccgagaccauccgcgacaugugcggcgccaagaccggcaaguacucccucggcgacugcuccguccgcugggccuacauccucgccaucaucggcauccucaacgcccucauccucuccuuccucgccuucguccucggcaaccgccagaccgaccuccuccaggaggagcucaagcccgagaacaaggacuucgucggcuccaccgucuccuccguccuccgccccggcggcgacgucuccggcuggggcguccuccccugccccgucgcccacucccagggccccuga

SEQ ID NO: 45361 - RNA, 660 nt, Artificial Sequence
  derived and/or modified sequence opt2 from LHFPL5__Homo_sapiens__NP_872354
auggucaagcuccuccccgcccaggaggccgccaagaucuaccacaccaacuacguccgcaacucccgcgccgucggcgucauguggggcacccucaccaucugcuucuccguccucgucauggcccucuucauccagcccuacuggaucggcgacuccgucaacaccccccaggccggcuacuucggccucuucuccuacugcgucggcaacguccucuccuccgagcucaucugcaagggcggcccccucgacuucuccuccauccccucccgcgccuucaagaccgccauguucuucgucgcccucggcauguuccucaucaucggcuccaucaucugcuucucccucuucuucaucugcaacaccgccaccgucuacaagaucugcgccuggaugcagcucgccgccgccaccggccucaugaucggcugccucgucuaccccgacggcugggacuccuccgagguccgccgcaugugcggcgagcagaccggcaaguacacccucggccacugcaccauccgcugggccuucaugcucgccauccucuccaucggcgacgcccucauccucuccuuccucgccuucguccucggcuaccgccaggacaagcuccuccccgacgacuacaaggccgacggcaccgaggaggucuga

SEQ ID NO: 45362 - RNA, 633 nt, Artificial Sequence
  derived and/or modified sequence opt2 from LHPP__Homo_sapiens__NP_001161352
auggcccccuggggcaagcgccucgccggcguccgcggcguccuccucgacaucuccggcguccucuacgacuccggcgccggcggcggcaccgccaucgccggcuccgucgaggccgucgcccgccucaagcgcucccgccucaagguccgcuucugcaccaacgagucccagaagucccgcgccgagcucgucggccagcuccagcgccucggcuucgacaucuccgagcaggaggucaccgcccccgcccccgccgccugccagauccucaaggagcagggccuccgccccuaccuccucauccacgacggcguccgcuccgaguucgaccagaucgacaccuccaaccccaacugcgucgucaucgccgacgccggcgaguccuucuccuaccagaacaugaacaacgccuuccagguccucauggagcucgagaagcccguccucaucucccucggcaagggccgcuacuacaaggagaccuccggccucaugcucgacgucggccccuacaugaaggcccucgaguacgccugcggcaucaaggccgaggucgucggcaagcccucccccgaguucuucaaguccgcccuccaggccaucggcgucgaggcccaccaggcccaguga

SEQ ID NO: 45363 - RNA, 1221 nt, Artificial Sequence
  derived and/or modified sequence opt2 from LHX1__Homo_sapiens__XP_011545112
augguccacugcgccggcugcaagcgccccauccucgaccgcuuccuccucaacguccucgaccgcgccuggcacgucaagugcguccagugcugcgagugcaagugcaaccucaccgagaagugcuucucccgcgagggcaagcucuacugcaagaacgacuucuuccgcugcuucggcaccaagugcgccggcugcgcccagggcaucucccccuccgaccucguccgccgcgcccgcuccaaggucuuccaccucaacugcuucaccugcaugaugugcaacaagcagcucuccaccggcgaggagcucuacaucaucgacgagaacaaguucgucugcaaggaggacuaccucuccaacuccuccgucgccaaggagaacucccuccacuccgccaccaccggcuccgaccccucccucucccccgacucccaggaccccucccaggacgacgccaaggacuccgaguccgccaacgucuccgacaaggaggccggcuccaacgagaacgacgaccagaaccucggcgccaagcgccgcggcccccgcaccaccaucaaggccaagcagcucgagacccucaaggccgccuucgccgccacccccaagcccacccgccacauccgcgagcagcucgcccaggagaccggccucaacaugcgcgucauccaggucugguuccagaaccgccgcuccaaggagcgccgcaugaagcagcucuccgcccucggcgcccgccgccacgccuucuuccgcuccccccgccgcaugcgcccccucgucgaccgccucgagcccggcgagcucauccccaacggccccuucuccuucuacggcgacuaccaguccgaguacuacggccccggcggcaacuacgacuucuucccccagggcccccccuccucccaggcccagacccccgucgaccuccccuucguccccuccuccggccccuccggcaccccccucggcggccucgagcacccccuccccggccaccaccccuccuccgaggcccagcgcuucaccgacauccucgcccacccccccggcgacucccccucccccgagcccucccuccccggcccccuccacuccauguccgccgaggucuucggccccuccccccccuucuccucccucuccgucaacggcggcgccuccuacggcaaccaccucucccacccccccgagaugaacgaggccgccgucugguga

SEQ ID NO: 45364 - RNA, 1221 nt, Artificial Sequence
  derived and/or modified sequence opt2 from LHX2__Homo_sapiens__NP_004780
augcucuuccacucccucuccggccccgagguccacggcgucaucgacgagauggaccgccgcgccaaguccgaggcccccgccaucuccuccgccaucgaccgcggcgacaccgagaccaccaugcccuccaucuccuccgaccgcgccgcccucugcgccggcugcggcggcaagaucuccgaccgcuacuaccuccucgccgucgacaagcaguggcacaugcgcugccucaagugcugcgagugcaagcucaaccucgaguccgagcucaccugcuucuccaaggacggcuccaucuacugcaaggaggacuacuaccgccgcuucuccguccagcgcugcgcccgcugccaccucggcaucuccgccuccgagauggucaugcgcgcccgcgaccucgucuaccaccucaacugcuucaccugcaccaccugcaacaagaugcucaccaccggcgaccacuucggcaugaaggacucccucgucuacugccgccuccacuucgaggcccuccuccagggcgaguaccccgcccacuucaaccacgccgacgucgccgccgccgccgccgccgccgccgccgccaaguccgccggccucggcgccgccggcgccaacccccucggccuccccuacuacaacggcgucggcaccguccagaagggccgcccccgcaagcgcaagucccccggccccggcgccgaccucgccgccuacaacgccgcccucuccugcaacgagaacgacgccgagcaccucgaccgcgaccagcccuaccccuccucccagaagaccaagcgcaugcgcaccuccuucaagcaccaccagcuccgcaccaugaaguccuacuucgccaucaaccacaaccccgacgccaaggaccucaagcagcucgcccagaagaccggccucaccaagcgcguccuccaggucugguuccagaacgcccgcgccaaguuccgccgcaaccuccuccgccaggagaacaccggcgucgacaaguccaccgacgccgcccuccagaccggcacccccuccggccccgccuccgagcucuccaacgccucccucucccccuccuccacccccaccacccucaccgaccucaccucccccacccuccccaccgucaccuccguccucaccuccguccccggcaaccucgagggccacgagccccacucccccucccagaccacccucaccaaccucuucuga

SEQ ID NO: 45365 - RNA, 1209 nt, Artificial Sequence
  derived and/or modified sequence opt2 from LHX3__Homo_sapiens__NP_055379
auggaggcccgcggcgagcucggccccgcccgcgaguccgccggcggcgaccuccuccucgcccuccucgcccgccgcgccgaccuccgccgcgagaucccccucugcgccggcugcgaccagcacauccucgaccgcuucauccucaaggcccucgaccgccacuggcacuccaagugccucaagugcuccgacugccacaccccccucgccgagcgcugcuucucccgcggcgaguccgucuacugcaaggacgacuucuucaagcgcuucggcaccaagugcgccgccugccagcucggcaucccccccacccaggucguccgccgcgcccaggacuucgucuaccaccuccacugcuucgccugcgucgucugcaagcgccagcucgccaccggcgacgaguucuaccucauggaggacucccgccucgucugcaaggccgacuacgagaccgccaagcagcgcgaggccgaggccaccgccaagcgcccccgcaccaccaucaccgccaagcagcucgagacccucaaguccgccuacaacaccucccccaagcccgcccgccacguccgcgagcagcucuccuccgagaccggccucgacaugcgcgucguccaggucugguuccagaaccgccgcgccaaggagaagcgccucaagaaggacgccggccgccagcgcuggggccaguacuuccgcaacaugaagcgcucccgcggcggcuccaaguccgacaaggacuccguccaggagggccaggacuccgacgccgaggucuccuuccccgacgagcccucccucgccgagaugggccccgccaacggccucuacggcucccucggcgagcccacccaggcccucggccgccccuccggcgcccucggcaacuucucccucgagcacggcggccucgccggccccgagcaguaccgcgagcuccgccccggcucccccuacggcgucccccccucccccgccgccccccagucccuccccggcccccagccccuccucuccucccucgucuaccccgacaccucccucggccucguccccuccggcgcccccggcggccccccccccaugcgcguccucgccggcaacggccccuccuccgaccucuccaccggcuccuccggcggcuaccccgacuuccccgccucccccgccuccuggcucgacgaggucgaccacgcccaguucuga

SEQ ID NO: 45366 - RNA, 1173 nt, Artificial Sequence
  derived and/or modified sequence opt2 from LHX4__Homo_sapiens__NP_203129
augaugcaguccgccaccguccccgccgagggcgccgucaagggccuccccgagaugcucggcguccccaugcagcagaucccccagugcgccggcugcaaccagcacauccucgacaaguucauccucaagguccucgaccgccacuggcacuccuccugccucaagugcgccgacugccagaugcagcucgccgaccgcugcuucucccgcgccggcuccgucuacugcaaggaggacuucuucaagcgcuucggcaccaagugcaccgccugccagcagggcaucccccccacccaggucguccgcaaggcccaggacuucgucuaccaccuccacugcuucgccugcaucaucugcaaccgccagcucgccaccggcgacgaguucuaccucauggaggacggccgccucgucugcaaggaggacuacgagaccgccaagcagaacgacgacuccgaggccggcgccaagcgcccccgcaccaccaucaccgccaagcagcucgagacccucaagaacgccuacaagaacucccccaagcccgcccgccacguccgcgagcagcucuccuccgagaccggccucgacaugcgcgucguccaggucugguuccagaaccgccgcgccaaggagaagcgccucaagaaggacgccggccgccaccgcuggggccaguucuacaaguccgucaagcgcucccgcggcuccuccaagcaggagaaggaguccuccgccgaggacugcggcgucuccgacuccgagcucuccuuccgcgaggaccagauccucuccgagcucggccacaccaaccgcaucuacggcaacgucggcgacgucaccggcggccagcucaugaacggcuccuucuccauggacggcaccggccaguccuaccaggaccuccgcgacggcucccccuacggcaucccccagucccccuccuccaucuccucccuccccucccacgccccccuccucaacggccucgacuacaccgucgacuccaaccucggcaucaucgcccacgccggccagggcgucucccagacccuccgcgccauggccggcggccccaccuccgacaucuccaccggcuccuccgucggcuaccccgacuuccccaccucccccggcuccuggcucgacgagauggaccacccccccuucuga

SEQ ID NO: 45367 - RNA, 1209 nt, Artificial Sequence
  derived and/or modified sequence opt2 from LHX5__Homo_sapiens__NP_071758
augaugguccacugcgccggcugcgagcgccccauccucgaccgcuuccuccucaacguccucgaccgcgccuggcacaucaagugcguccagugcugcgagugcaagaccaaccucuccgagaagugcuucucccgcgagggcaagcucuacugcaagaacgacuucuuccgccgcuucggcaccaagugcgccggcugcgcccagggcaucucccccuccgaccucguccgcaaggcccgcuccaaggucuuccaccucaacugcuucaccugcauggucugcaacaagcagcucuccaccggcgaggagcucuacgucaucgacgagaacaaguucgucugcaaggacgacuaccucuccuccuccucccucaaggagggcucccucaacuccgucuccuccugcaccgaccgcucccucucccccgaccuccaggacgcccuccaggacgaccccaaggagaccgacaacuccaccuccuccgacaaggagaccgccaacaacgagaacgaggagcagaacuccggcaccaagcgccgcggcccccgcaccaccaucaaggccaagcagcucgagacccucaaggccgccuucgccgccacccccaagcccacccgccacauccgcgagcagcucgcccaggagaccggccucaacaugcgcgucauccaggucugguuccagaaccgccgcuccaaggagcgccgcaugaagcagcucuccgcccucggcgcccgccgccacgccuucuuccgcuccccccgccgcaugcgcccccucggcggccgccucgacgaguccgagaugcucggcuccacccccuacaccuacuacggcgacuaccagggcgacuacuacgcccccggcuccaacuacgacuucuucgcccacggcccccccucccaggcccagucccccgccgacuccuccuuccucgccgccuccggccccggcuccaccccccucggcgcccucgagcccccccucgccggcccccacgccgccgacaacccccgcuucaccgacaugaucucccaccccgacacccccucccccgagcccggccuccccggcacccuccaccccaugcccggcgaggucuucuccggcggccccuccccccccuuccccauguccggcaccuccggcuacuccggcccccucucccaccccaaccccgagcucaacgaggccgccgucugguga

SEQ ID NO: 45368 - RNA, 1101 nt, Artificial Sequence
  derived and/or modified sequence opt2 from LHX6__Homo_sapiens__NP_001229262
augcgccgcggccucugccgccgcuccgccgagaaccccgacgccggccccgucauggcccagcccggcuccggcugcaaggccaccacccgcugccucgagggcaccgccccccccgccauggcccaguccgacgccgaggcccucgccggcgcccucgacaaggacgagggccaggccucccccugcacccccuccacccccuccgucugcuccccccccuccgccgccuccuccguccccuccgccggcaagaacaucugcuccuccugcggccucgagauccucgaccgcuaccuccucaaggucaacaaccucaucuggcacguccgcugccucgagugcuccgucugccgcaccucccuccgccagcagaacuccugcuacaucaagaacaaggagaucuucugcaagauggacuacuucucccgcuucggcaccaagugcgcccgcugcggccgccagaucuacgccuccgacuggguccgccgcgcccgcggcaacgccuaccaccucgccugcuucgccugcuucuccugcaagcgccagcucuccaccggcgaggaguucggccucgucgaggagaagguccucugccgcauccacuacgacaccaugaucgagaaccucaagcgcgccgccgagaacggcaacggccucacccucgagggcgccguccccuccgagcaggacucccagcccaagcccgccaagcgcgcccgcaccuccuucaccgccgagcagcuccaggucaugcaggcccaguucgcccaggacaacaaccccgacgcccagacccuccagaagcucgccgacaugaccggccucucccgccgcgucauccaggucugguuccagaacugccgcgcccgccacaagaagcacaccccccagcaccccgucccccccuccggcgccccccccucccgccuccccuccgcccucuccgacgacauccacuacacccccuucuccucccccgagcgcgcccgcauggucacccuccacggcuacaucgagucccaccccuucuccguccucacccuccccgcccucccccaccuccccgucggcgccccccagcucccccucucccgcuga

SEQ ID NO: 45369 - RNA, 1167 nt, Artificial Sequence
  derived and/or modified sequence opt2 from LHX9__Homo_sapiens__NP_001014434
augcucaacggcaccacccucgaggccgccaugcucuuccacggcaucuccggcggccacauccagggcaucauggaggagauggagcgccgcuccaagaccgaggcccgccucgccaagggcgcccagcucaacggccgcgacgccggcaugcccccccucucccccgagaagcccgcccucugcgccggcugcggcggcaagaucuccgaccgcuacuaccuccucgccgucgacaagcaguggcaccuccgcugccucaagugcugcgagugcaagcucgcccucgaguccgagcucaccugcuucgccaaggacggcuccaucuacugcaaggaggacuacuaccgccgcuucuccguccagcgcugcgcccgcugccaccucggcaucuccgccuccgagauggucaugcgcgcccgcgacuccgucuaccaccucuccugcuucaccugcuccaccugcaacaagacccucaccaccggcgaccacuucggcaugaaggacucccucgucuacugccgcgcccacuucgagacccuccuccagggcgaguaccccccccagcucuccuacaccgagcucgccgccaaguccggcggccucgcccuccccuacuucaacggcaccggcaccguccagaagggccgcccccgcaagcgcaagucccccgcccucggcgucgacaucgucaacuacaacuccggcugcaacgagaacgaggccgaccaccucgaccgcgaccagcagcccuacccccccucccagaagaccaagcgcaugcgcaccuccuucaagcaccaccagcuccgcaccaugaaguccuacuucgccaucaaccacaaccccgacgccaaggaccucaagcagcucgcccagaagaccggccucaccaagcgcguccuccaggucugguuccagaacgcccgcgccaaguuccgccgcaaccuccuccgccaggagaacggcggcgucgacaaggccgacggcaccucccuccccgccccccccuccgccgacuccggcgcccucaccccccccggcaccgccaccacccucaccgaccucaccaaccccaccaucaccgucgucaccuccgucaccuccaacauggacucccacgaguccggcucccccucccagaccacccucaccaaccucuucuga

SEQ ID NO: 45370 - RNA, 1119 nt, Artificial Sequence
  derived and/or modified sequence opt2 from LIAS__Homo_sapiens__NP_006850
augucccuccgcugcggcgacgccgcccgcacccucggcccccgcgucuucggccgcuacuucugcucccccguccgcccccucuccucccuccccgacaagaagaaggagcuccuccagaacggccccgaccuccaggacuucgucuccggcgaccucgccgaccgcuccaccugggacgaguacaagggcaaccucaagcgccagaagggcgagcgccuccgccucccccccuggcucaagaccgagauccccaugggcaagaacuacaacaagcucaagaacacccuccgcaaccucaaccuccacaccgucugcgaggaggcccgcugccccaacaucggcgagugcuggggcggcggcgaguacgccaccgccaccgccaccaucaugcucaugggcgacaccugcacccgcggcugccgcuucugcuccgucaagaccgcccgcaacccccccccccucgacgccuccgagcccuacaacaccgccaaggccaucgccgaguggggccucgacuacgucguccucaccuccgucgaccgcgacgacaugcccgacggcggcgccgagcacaucgccaagaccgucuccuaccucaaggagcgcaaccccaagauccucgucgagugccucacccccgacuuccgcggcgaccucaaggccaucgagaaggucgcccucuccggccucgacgucuacgcccacaacgucgagaccguccccgagcuccaguccaagguccgcgacccccgcgccaacuucgaccagucccuccgcguccucaagcacgccaagaagguccagcccgacgucaucuccaagaccuccaucaugcucggccucggcgagaacgacgagcaggucuacgccaccaugaaggcccuccgcgaggccgacgucgacugccucacccucggccaguacaugcagcccacccgccgccaccucaaggucgaggaguacaucacccccgagaaguucaaguacugggagaaggucggcaacgagcucggcuuccacuacaccgccuccggcccccucguccgcuccuccuacaaggccggcgaguucuuccucaagaaccucgucgccaagcgcaagaccaaggaccucuga

SEQ ID NO: 45371 - RNA, 609 nt, Artificial Sequence
  derived and/or modified sequence opt2 from LIF__Homo_sapiens__XP_011528474
augaagguccucgccgccggcgucgucccccuccuccucguccuccacuggaagcacggcgccggcuccccccuccccaucacccccgucaacgccaccugcgccauccgccaccccugccacaacaaccucaugaaccagauccgcucccagcucgcccagcucaacggcuccgccaacgcccucuucauccucuacuacaccgcccagggcgagcccuuccccaacaaccucgacaagcucugcggccccaacgucaccgacuucccccccuuccacgccaacggcaccgagaaggccaagcucgucgagcucuaccgcaucgucgucuaccucggcaccucccucggcaacaucacccgcgaccagaagauccucaaccccuccgcccucucccuccacuccaagcucaacgccaccgccgacauccuccgcggccuccucuccaacguccucugccgccucugcuccaaguaccacgucggccacgucgacgucaccuacggccccgacaccuccggcaaggacgucuuccagaagaagaagcucggcugccagcuccucggcaaguacaagcagaucaucgccguccucgcccaggccuucuga

SEQ ID NO: 45372 - RNA, 3294 nt, Artificial Sequence
  derived and/or modified sequence opt2 from LIFR__Homo_sapiens__XP_011512344
augauggacaucuacgucugccucaagcgccccuccuggauggucgacaacaagcgcaugcgcaccgccuccaacuuccaguggcuccucuccaccuucauccuccucuaccucaugaaccaggucaacucccagaagaagggcgccccccacgaccucaagugcgucaccaacaaccuccaggucuggaacugcuccuggaaggcccccuccggcaccggccgcggcaccgacuacgaggucugcaucgagaaccgcucccgcuccugcuaccagcucgagaagaccuccaucaagauccccgcccucucccacggcgacuacgagaucaccaucaacucccuccacgacuucggcuccuccaccuccaaguucacccucaacgagcagaacgucucccucauccccgacacccccgagauccucaaccucuccgccgacuucuccaccuccacccucuaccucaaguggaacgaccgcggcuccgucuucccccaccgcuccaacgucaucugggagaucaagguccuccgcaaggaguccauggagcucgucaagcucgucacccacaacaccacccucaacggcaaggacacccuccaccacugguccugggccuccgacaugccccucgagugcgccauccacuucgucgagauccgcugcuacaucgacaaccuccacuucuccggccucgaggagugguccgacuggucccccgucaagaacaucuccuggauccccgacucccagaccaaggucuucccccaggacaaggucauccucgucggcuccgacaucaccuucugcugcgucucccaggagaagguccucuccgcccucaucggccacaccaacugcccccucauccaccucgacggcgagaacgucgccaucaagauccgcaacaucuccgucuccgccuccuccggcaccaacgucgucuucaccaccgaggacaacaucuucggcaccgucaucuucgccggcuacccccccgacaccccccagcagcucaacugcgagacccacgaccucaaggagaucaucugcuccuggaaccccggccgcgucaccgcccucgucggcccccgcgccaccuccuacacccucgucgaguccuucuccggcaaguacguccgccucaagcgcgccgaggcccccaccaacgaguccuaccagcuccucuuccagaugcuccccaaccaggagaucuacaacuucacccucaacgcccacaacccccucggccgcucccaguccaccauccucgucaacaucaccgagaaggucuacccccacacccccaccuccuucaaggucaaggacaucaacuccaccgccgucaagcucuccuggcaccuccccggcaacuucgccaagaucaacuuccucugcgagaucgagaucaagaaguccaacuccguccaggagcagcgcaacgucaccaucaagggcgucgagaacuccuccuaccucgucgcccucgacaagcucaaccccuacacccucuacaccuuccgcauccgcugcuccaccgagaccuucuggaagugguccaagugguccaacaagaagcagcaccucaccaccgaggccucccccuccaagggccccgacaccuggcgcgagugguccuccgacggcaagaaccucaucaucuacuggaagccccuccccaucaacgaggccaacggcaagauccucuccuacaacgucuccugcuccuccgacgaggagacccagucccucuccgagauccccgacccccagcacaaggccgagauccgccucgacaagaacgacuacaucaucuccgucgucgccaagaacuccgucggcuccuccccccccuccaagaucgccuccauggagauccccaacgacgaccucaagaucgagcaggucgucggcaugggcaagggcauccuccucaccuggcacuacgaccccaacaugaccugcgacuacgucaucaaguggugcaacuccucccgcuccgagcccugccucauggacuggcgcaagguccccuccaacuccaccgagaccgucaucgaguccgacgaguuccgccccggcauccgcuacaacuucuuccucuacggcugccgcaaccagggcuaccagcuccuccgcuccaugaucggcuacaucgaggagcucgcccccaucgucgcccccaacuucaccgucgaggacaccuccgccgacuccauccucgucaagugggaggacauccccgucgaggagcuccgcggcuuccuccgcggcuaccucuucuacuucggcaagggcgagcgcgacaccuccaagaugcgcguccucgaguccggccgcuccgacaucaaggucaagaacaucaccgacaucucccagaagacccuccgcaucgccgaccuccagggcaagaccuccuaccaccucguccuccgcgccuacaccgacggcggcgucggccccgagaaguccauguacgucgucaccaaggagaacuccgucggccucaucaucgccauccucauccccgucgccgucgccgucaucgucggcgucgucaccuccauccucugcuaccgcaagcgcgaguggaucaaggagaccuucuaccccgacauccccaaccccgagaacugcaaggcccuccaguuccagaaguccgucugcgagggcuccuccgcccucaagacccucgagaugaaccccugcacccccaacaacgucgagguccucgagacccgcuccgccuuccccaagaucgaggacaccgagaucaucucccccgucgccgagcgccccgaggaccgcuccgacgccgagcccgagaaccacgucgucgucuccuacugcccccccaucaucgaggaggagauccccaaccccgccgccgacgaggccggcggcaccgcccaggucaucuacaucgacguccaguccauguaccagccccaggccaagcccgaggaggagcaggagaacgaccccgucggcggcgccggcuacaagccccagaugcaccuccccaucaacuccaccgucgaggacaucgccgccgaggaggaccucgacaagaccgccggcuaccgcccccaggccaacgucaacaccuggaaccucgucucccccgacuccccccgcuccaucgacuccaacuccgagaucgucuccuucggcucccccugcuccaucaacucccgccaguuccucaucccccccaaggacgaggacucccccaaguccaacggcggcggcugguccuucaccaacuucuuccagaacaagcccaacgacuga

SEQ ID NO: 45373 - RNA, 2667 nt, Artificial Sequence
  derived and/or modified sequence opt2 from LIG1__Homo_sapiens__NP_001275992
augcagcgcuccaucauggccgcccucaaggaguggaacggcgucgucuccgaguccgacucccccgucaagcgccccggccgcaaggccgcccgcguccucggcuccgagggcgaggaggaggacgaggcccucucccccgccaagggccagaagcccgcccucgacugcucccaggucucccccccccgccccgccaccucccccgagaacaacgccucccucuccgacaccucccccauggacuccucccccuccggcauccccaagcgccgcaccgcccgcaagcagcuccccaagcgcaccauccaggagguccucgaggagcaguccgaggacgaggaccgcgaggccaagcgcaagaaggaggaggaggaggagacccccaaggagucccucaccgaggccgaggucgccaccgagaaggagggcgaggacggcgaccagcccaccaccccccccaagccccucaagaccuccaaggccgagacccccaccgaguccgucuccgagcccgaggucgccaccaagcaggagcuccaggaggaggaggagcagaccaagcccccccgccgcgcccccaagacccucuccuccuucuucaccccccgcaagcccgccgucaagaaggaggucaaggaggaggagcccggcgcccccggcaaggagggcgccgccgagggcccccucgaccccuccggcuacaaccccgccaagaacaacuaccaccccgucgaggacgccugcuggaagcccggccagaagguccccuaccucgccgucgcccgcaccuucgagaagaucgaggaggucuccgcccgccuccgcauggucgagacccucuccaaccuccuccgcuccgucgucgcccucuccccccccgaccuccuccccguccucuaccucucccucaaccaccucggccccccccagcagggccucgagcucggcgucggcgacggcguccuccucaaggccgucgcccaggccaccggccgccagcucgaguccguccgcgccgaggccgccgagaagggcgacgucggccucgucgccgagaacucccgcuccacccagcgccucaugcuccccccccccccccucaccgccuccggcgucuucuccaaguuccgcgacaucgcccgccucaccggcuccgccuccaccgccaagaagaucgacaucaucaagggccucuucgucgccugccgccacuccgaggcccgcuucaucgcccgcucccucuccggccgccuccgccucggccucgccgagcaguccguccucgccgcccucucccaggccgucucccucaccccccccggccaggaguucccccccgccauggucgacgccggcaagggcaagaccgccgaggcccgcaagaccuggcucgaggagcagggcaugauccucaagcagaccuucugcgagguccccgaccucgaccgcaucauccccguccuccucgagcacggccucgagcgccuccccgagcacugcaagcucucccccggcaucccccucaagcccaugcucgcccaccccacccgcggcaucuccgagguccucaagcgcuucgaggaggccgccuucaccugcgaguacaaguacgacggccagcgcgcccagauccacgcccucgagggcggcgaggucaagaucuucucccgcaaccaggaggacaacaccggcaaguaccccgacaucaucucccgcauccccaagaucaagcuccccuccgucaccuccuucauccucgacaccgaggccgucgccugggaccgcgagaagaagcagauccagcccuuccagguccucaccacccgcaagcgcaaggaggucgacgccuccgagauccagguccaggucugccucuacgccuucgaccucaucuaccucaacggcgagucccucguccgcgagccccucucccgccgccgccagcuccuccgcgagaacuucgucgagaccgagggcgaguucgucuucgccaccucccucgacaccaaggacaucgagcagaucgccgaguuccucgagcaguccgucaaggacuccugcgagggccucauggucaagacccucgacgucgacgccaccuacgagaucgccaagcgcucccacaacuggcucaagcucaagaaggacuaccucgacggcgucggcgacacccucgaccucgucgucaucggcgccuaccucggccgcggcaagcgcgccggccgcuacggcggcuuccuccucgccuccuacgacgaggacuccgaggagcuccaggccaucugcaagcucggcaccggcuucuccgacgaggagcucgaggagcaccaccagucccucaaggcccucguccuccccuccccccgccccuacguccgcaucgacggcgccgucauccccgaccacuggcucgaccccuccgccgucugggaggucaagugcgccgaccucucccucucccccaucuaccccgccgcccgcggccucgucgacuccgacaagggcaucucccuccgcuucccccgcuucauccgcguccgcgaggacaagcagcccgagcaggccaccaccuccgcccaggucgccugccucuaccgcaagcagucccagauccagaaccagcagggcgaggacuccggcuccgaccccgaggacaccuacuga

SEQ ID NO: 45374 - RNA, 3057 nt, Artificial Sequence
  derived and/or modified sequence opt2 from LIG3__Homo_sapiens__XP_005258027
auguccaaguuccgcggccuccgcuacaugucccucgccuucaagaucuucuucccccagacccuccgcgcccucucccgcaaggagcucugccucuuccgcaagcaccacuggcgcgacguccgccaguucucccagugguccgagaccgaccuccuccacggccacccccucuuccuccgccgcaagcccguccucuccuuccagggcucccaccuccgcucccgcgccaccuaccucgucuuccuccccggccuccacgucggccucugcuccggccccugcgagauggccgagcagcgcuucugcgucgacuacgccaagcgcggcaccgccggcugcaagaagugcaaggagaagaucgucaagggcgucugccgcaucggcaaggucguccccaaccccuucuccgaguccggcggcgacaugaaggagugguaccacaucaagugcauguucgagaagcucgagcgcgcccgcgccaccaccaagaagaucgaggaccucaccgagcucgagggcugggaggagcucgaggacaacgagaaggagcagaucacccagcacaucgccgaccucuccuccaaggccgccggcacccccaagaagaaggccgucguccaggccaagcucaccaccaccggccaggucaccucccccgucaagggcgccuccuucgucaccuccaccaacccccgcaaguucuccggcuucuccgccaagcccaacaacuccggcgaggcccccuccucccccacccccaagcgcucccucuccuccuccaagugcgacccccgccacaaggacugccuccuccgcgaguuccgcaagcucugcgccauggucgccgacaaccccuccuacaacaccaagacccagaucauccaggacuuccuccgcaagggcuccgccggcgacggcuuccacggcgacgucuaccucaccgucaagcuccuccuccccggcgucaucaagaccgucuacaaccucaacgacaagcagaucgucaagcucuucucccgcaucuucaacugcaaccccgacgacauggcccgcgaccucgagcagggcgacgucuccgagaccauccgcgucuucuucgagcaguccaaguccuucccccccgccgccaagucccuccucaccauccaggaggucgacgaguuccuccuccgccucuccaagcucaccaaggaggacgagcagcagcaggcccuccaggacaucgccucccgcugcaccgccaacgaccucaagugcaucauccgccucaucaagcacgaccucaagaugaacuccggcgccaagcacguccucgacgcccucgaccccaacgccuacgaggccuucaaggccucccgcaaccuccaggacgucgucgagcgcguccuccacaacgcccaggaggucgagaaggagcccggccagcgccgcgcccucuccguccaggccucccucaugacccccguccagcccaugcucgccgaggccugcaaguccgucgaguacgccaugaagaagugccccaacggcauguucuccgagaucaaguacgacggcgagcgcguccagguccacaagaacggcgaccacuucuccuacuucucccgcucccucaagcccguccucccccacaaggucgcccacuucaaggacuacaucccccaggccuuccccggcggccacuccaugauccucgacuccgagguccuccucaucgacaacaagaccggcaagccccuccccuucggcacccucggcguccacaagaaggccgccuuccaggacgccaacgucugccucuucgucuucgacugcaucuacuucaacgacgucucccucauggaccgcccccucugcgagcgccgcaaguuccuccacgacaacauggucgagauccccaaccgcaucauguucuccgagaugaagcgcgucaccaaggcccucgaccucgccgacaugaucacccgcgucauccaggagggccucgagggccucguccucaaggacgucaagggcaccuacgagcccggcaagcgccacuggcucaaggucaagaaggacuaccucaacgagggcgccauggccgacaccgccgaccucgucguccucggcgccuucuacggccagggcuccaagggcggcaugauguccaucuuccucaugggcugcuacgaccccggcucccagaaguggugcaccgucaccaagugcgccggcggccacgacgacgccacccucgcccgccuccagaacgagcucgacauggucaagaucuccaaggaccccuccaagauccccuccuggcucaaggucaacaagaucuacuaccccgacuucaucguccccgaccccaagaaggccgccgucugggagaucaccggcgccgaguucuccaaguccgaggcccacaccgccgacggcaucuccauccgcuucccccgcugcacccgcauccgcgacgacaaggacuggaaguccgccaccaaccucccccagcucaaggagcucuaccagcucuccaaggagaaggccgacuucaccgucgucgccggcgacgagggcuccuccaccaccggcggcuccuccgaggagaacaagggccccuccggcuccgccgucucccgcaaggcccccuccaagcccuccgccuccaccaagaaggccgagggcaagcucuccaacuccaacuccaaggacggcaacaugcagaccgccaagcccuccgccaugaaggucggcgagaagcucgccaccaaguccucccccgucaaggucggcgagaagcgcaaggccgccgacgagacccucugccagaccaagguccuccucgacaucuucaccggcguccgccucuaccucccccccuccacccccgacuucucccgccuccgccgcuacuucgucgccuucgacggcgaccucguccaggaguucgacaugaccuccgccacccacguccucggcucccgcgacaagaaccccgccgcccagcaggucucccccgaguggaucugggccugcauccgcaagcgccgccucgucgcccccugcuga

SEQ ID NO: 45375 - RNA, 2736 nt, Artificial Sequence
  derived and/or modified sequence opt2 from LIG4__Homo_sapiens__XP_005254115
auggccgccucccagaccucccagaccgucgccucccacguccccuucgccgaccucugcuccacccucgagcgcauccagaaguccaagggccgcgccgagaagauccgccacuuccgcgaguuccucgacuccuggcgcaaguuccacgacgcccuccacaagaaccacaaggacgucaccgacuccuucuaccccgccaugcgccucauccucccccagcucgagcgcgagcgcauggccuacggcaucaaggagaccaugcucgccaagcucuacaucgagcuccucaaccucccccgcgacggcaaggacgcccucaagcuccucaacuaccgcacccccaccggcacccacggcgacgccggcgacuucgccaugaucgccuacuucguccucaagccccgcugccuccagaagggcucccucaccauccagcaggucaacgaccuccucgacuccaucgccuccaacaacuccgccaagcgcaaggaccucaucaagaagucccuccuccagcucaucacccaguccuccgcccucgagcagaaguggcucauccgcaugaucaucaaggaccucaagcucggcgucucccagcagaccaucuucuccgucuuccacaacgacgccgccgagcuccacaacgucaccaccgaccucgagaaggucugccgccagcuccacgaccccuccgucggccucuccgacaucuccaucacccucuucuccgccuucaagcccaugcucgccgccaucgccgacaucgagcacaucgagaaggacaugaagcaccaguccuucuacaucgagaccaagcucgacggcgagcgcaugcagaugcacaaggacggcgacgucuacaaguacuucucccgcaacggcuacaacuacaccgaccaguucggcgccucccccaccgagggcucccucacccccuucauccacaacgccuucaaggccgacauccagaucugcauccucgacggcgagaugauggccuacaaccccaacacccagaccuucaugcagaagggcaccaaguucgacaucaagcgcauggucgaggacuccgaccuccagaccugcuacugcgucuucgacguccucauggucaacaacaagaagcucggccacgagacccuccgcaagcgcuacgagauccucuccuccaucuucacccccauccccggccgcaucgagaucguccagaagacccaggcccacaccaagaacgaggucaucgacgcccucaacgaggccaucgacaagcgcgaggagggcaucauggucaagcagccccucuccaucuacaagcccgacaagcgcggcgagggcuggcucaagaucaagcccgaguacgucuccggccucauggacgagcucgacauccucaucgucggcggcuacuggggcaagggcucccgcggcggcaugaugucccacuuccucugcgccgucgccgagaagcccccccccggcgagaagcccuccgucuuccacacccucucccgcgucggcuccggcugcaccaugaaggagcucuacgaccucggccucaagcucgccaaguacuggaagcccuuccaccgcaaggccccccccuccuccauccucugcggcaccgagaagcccgaggucuacaucgagcccugcaacuccgucaucguccagaucaaggccgccgagaucguccccuccgacauguacaagaccggcugcacccuccgcuucccccgcaucgagaagauccgcgacgacaaggaguggcacgagugcaugacccucgacgaccucgagcagcuccgcggcaaggccuccggcaagcucgccuccaagcaccucuacaucggcggcgacgacgagccccaggagaagaagcgcaaggccgcccccaagaugaagaaggucaucggcaucaucgagcaccucaaggcccccaaccucaccaacgucaacaagaucuccaacaucuucgaggacgucgaguucugcgucauguccggcaccgacucccagcccaagcccgaccucgagaaccgcaucgccgaguucggcggcuacaucguccagaaccccggccccgacaccuacugcgucaucgccggcuccgagaacauccgcgucaagaacaucauccucuccaacaagcacgacgucgucaagcccgccuggcuccucgagugcuucaagaccaaguccuucguccccuggcagccccgcuucaugauccacaugugccccuccaccaaggagcacuucgcccgcgaguacgacugcuacggcgacuccuacuucaucgacaccgaccucaaccagcucaaggaggucuucuccggcaucaagaacuccaacgagcagacccccgaggagauggccucccucaucgccgaccucgaguaccgcuacuccugggacugcuccccccucuccauguuccgccgccacaccgucuaccucgacuccuacgccgucaucaacgaccucuccaccaagaacgagggcacccgccucgccaucaaggcccucgagcuccgcuuccacggcgccaaggucgucuccugccucgccgagggcgucucccacgucaucaucggcgaggaccacucccgcgucgccgacuucaaggccuuccgccgcaccuucaagcgcaaguucaagauccucaaggaguccugggucaccgacuccaucgacaagugcgagcuccaggaggagaaccaguaccucaucuga

SEQ ID NO: 45376 - RNA, 1470 nt, Artificial Sequence
  derived and/or modified sequence opt2 from LILRA1__Homo_sapiens__NP_006854
augacccccaucgucaccguccucaucugccuccgccucucccucggcccccgcacccacguccaggccggcacccuccccaagcccacccucugggccgagcccggcuccgucaucacccagggcucccccgucacccucuggugccagggcauccucgagacccaggaguaccgccucuaccgcgagaagaagaccgcccccuggaucacccgcaucccccaggagaucgucaagaagggccaguuccccauccccuccaucaccugggagcacaccggccgcuaccgcugcuucuacggcucccacaccgccggcugguccgagcccuccgacccccucgagcucgucgucaccggcgccuacaucaagcccacccucuccgcccuccccucccccgucgucaccuccggcggcaacgucacccuccacugcgucucccaggucgccuucggcuccuucauccucugcaaggagggcgaggacgagcacccccagugccucaacucccagccccgcacccacggcuggucccgcgccaucuucuccgucggccccgucucccccucccgccgcugguccuaccgcugcuacgccuacgacuccaacuccccccacgucuggucccuccccuccgaccuccucgagcuccucguccucggcgucuccaagaagcccucccucuccguccagcccggccccaucgucgcccccggcgagucccucacccuccagugcgucuccgacgucuccuacgaccgcuucguccucuacaaggagggcgagcgcgacuuccuccagcuccccggcccccagccccaggccggccucucccaggccaacuucacccucggccccgucucccgcuccuacggcggccaguaccgcugcuccggcgccuacaaccucuccuccgagugguccgcccccuccgacccccucgacauccucaucgccggccaguuccgcggccgccccuucaucuccguccaccccggccccaccgucgccuccggcgagaacgucacccuccucugccaguccuggggccccuuccacaccuuccuccucaccaaggccggcgccgccgacgccccccuccgccuccgcuccauccacgaguaccccaaguaccaggccgaguuccccaugucccccgucaccuccgcccacuccggcaccuaccgcugcuacggcucccucuccuccaaccccuaccuccucucccaccccuccgacucccucgagcucauggucuccggcgccgccgagacccucucccccccccagaacaaguccgacuccaaggccggcgccgccaacacccucucccccucccagaacaagaccgccucccacccccaggacuacaccgucgagaaccucauccgcaugggcaucgccggccucguccucgucguccucggcauccuccucuucgaggcccagcacucccagcgcucccucuga

SEQ ID NO: 45377 - RNA, 1401 nt, Artificial Sequence
  derived and/or modified sequence opt2 from LILRA2__Homo_sapiens__NP_006857
augacccccauccucaccguccucaucugccucggccucucccucggcccccgcacccacguccaggccggccaccuccccaagcccacccucugggccgagcccggcuccgucaucauccagggcucccccgucacccuccgcugccagggcucccuccaggccgaggaguaccaccucuaccgcgagaacaaguccgccuccuggguccgccgcauccaggagcccggcaagaacggccaguuccccauccccuccaucaccugggagcacgccggccgcuaccacugccaguacuacucccacaaccacuccuccgaguacuccgacccccucgagcucgucgucaccggcgccuacuccaagcccacccucuccgcccuccccucccccgucgucaccuccggcggcaacgucacccuccagugcgucucccaggucgccuucgacggcuucauccucugcaaggagggcgaggacgagcacccccagcgccucaacucccacucccacgcccgcggcugguccugggccaucuucuccgucggccccgucucccccucccgccgcugguccuaccgcugcuacgccuacgacuccaacucccccuacgucuggucccuccccuccgaccuccucgagcuccucguccccggcgucuccaagaagcccucccucuccguccagcccggccccauggucgcccccggcgagucccucacccuccagugcgucuccgacgucggcuacgaccgcuucguccucuacaaggagggcgagcgcgacuuccuccagcgccccggcuggcagccccaggccggccucucccaggccaacuucacccucggccccgucucccccucccacggcggccaguaccgcugcuacuccgcccacaaccucuccuccgagugguccgcccccuccgacccccucgacauccucaucaccggccaguucuacgaccgccccucccucuccguccagcccguccccaccgucgcccccggcaagaacgucacccuccucugccagucccgcggccaguuccacaccuuccuccucaccaaggagggcgccggccaccccccccuccaccuccgcuccgagcaccaggcccagcagaaccaggccgaguuccgcaugggccccgucaccuccgcccacgucggcaccuaccgcugcuacuccucccucuccuccaaccccuaccuccucucccuccccuccgacccccucgagcucgucgucuccgccucccucggccagcacccccaggacuacaccgucgagaaccucauccgcaugggcgucgccggccucguccucgucguccucggcauccuccucuucgaggcccagcacucccagcgcucccuccaggacgccgccggccgcuga

SEQ ID NO: 45378 - RNA, 1128 nt, Artificial Sequence
  derived and/or modified sequence opt2 from LILRA3__Homo_sapiens__NP_001166125
augacccccauccucaccguccucaucugccucggccucucccucgacccccgcacccacguccaggccggcccccuccccaagcccacccucugggccgagcccggcuccgucaucacccagggcucccccgucacccuccgcugccagggcucccucgagacccaggaguaccaccucuaccgcgagaagaagaccgcccucuggaucacccgcaucccccaggagcucgucaagaagggccaguuccccauccucuccaucaccugggagcacgccggccgcuacugcugcaucuacggcucccacaccgccggccucuccgaguccuccgacccccucgagcucgucgucaccggcgccuacuccaagcccacccucuccgcccuccccucccccgucgucaccuccggcggcaacgucaccauccagugcgacucccaggucgccuucgacggcuucauccucugcgucuccaagaagcccucccucuccguccagcccggccccgucgucgcccccggcgagaagcucaccuuccagugcggcuccgacgccggcuacgaccgcuucguccucuacaaggaguggggccgcgacuuccuccagcgccccggccgccagccccaggccggccucucccaggccaacuucacccucggccccgucucccgcuccuacggcggccaguacaccugcuccggcgccuacaaccucuccuccgagugguccgcccccuccgacccccucgacauccucaucaccggccagauccgcgcccgccccuuccucuccguccgccccggccccaccgucgccuccggcgagaacgucacccuccucugccagucccagggcggcaugcacaccuuccuccucaccaaggagggcgccgccgacuccccccuccgccucaaguccaagcgccagucccacaaguaccaggccgaguuccccaugucccccgucaccuccgcccacgccggcaccuaccgcugcuacggcucccucuccuccaaccccuaccuccucacccaccccuccgacccccucgagcucgucgucuccggcgccgccgagacccucucccccccccagaacaaguccgacuccaaggccggcgaguga

SEQ ID NO: 45379 - RNA, 1500 nt, Artificial Sequence
  derived and/or modified sequence opt2 from LILRA4__Homo_sapiens__NP_036408
augacccucauccucaccucccuccucuucuucggccucucccucggcccccgcacccgcguccaggccgagaaccuccucaagcccauccucugggccgagcccggccccgucaucaccuggcacaaccccgucaccaucuggugccagggcacccucgaggcccagggcuaccgccucgacaaggagggcaacuccaugucccgccacauccucaagacccucgaguccgagaacaaggucaagcucuccauccccuccaugaugugggagcacgccggccgcuaccacugcuacuaccagucccccgccggcugguccgagcccuccgacccccucgagcucgucgucaccgccuacucccgccccacccucuccgcccuccccucccccgucgucaccuccggcgucaacgucacccuccgcugcgccucccgccucggccucggccgcuucacccucaucgaggagggcgaccaccgccucuccuggacccucaacucccaccagcacaaccacggcaaguuccaggcccucuuccccaugggcccccucaccuucuccaaccgcggcaccuuccgcugcuacggcuacgagaacaacacccccuacgucugguccgagcccuccgacccccuccagcuccucgucuccggcgucucccgcaagcccucccuccucacccuccagggccccgucgucacccccggcgagaaccucacccuccagugcggcuccgacgucggcuacauccgcuacacccucuacaaggagggcgccgacggccucccccagcgccccggccgccagccccaggccggccucucccaggccaacuucacccucucccccgucucccgcuccuacggcggccaguaccgcugcuacggcgcccacaacgucuccuccgagugguccgcccccuccgacccccucgacauccucaucgccggccagaucuccgaccgccccucccucuccguccagcccggccccaccgucaccuccggcgagaaggucacccuccucugccaguccugggaccccauguucaccuuccuccucaccaaggagggcgccgcccaccccccccuccgccuccgcuccauguacggcgcccacaaguaccaggccgaguuccccaugucccccgucaccuccgcccacgccggcaccuaccgcugcuacggcucccgcuccuccaaccccuaccuccucucccaccccuccgagccccucgagcucgucgucuccggcgccaccgagacccucaaccccgcccagaagaaguccgacuccaagaccgccccccaccuccaggacuacaccgucgagaaccucauccgcaugggcgucgccggccucguccuccucuuccucggcauccuccucuucgaggcccagcacucccagcgcucccccccccgcugcucccaggaggccaacucccgcaaggacaacgcccccuuccgcgucgucgagcccugggagcagaucuga

SEQ ID NO: 45380 - RNA, 900 nt, Artificial Sequence
  derived and/or modified sequence opt2 from LILRA5__Homo_sapiens__NP_067073
auggcccccuggucccaccccuccgcccagcuccagcccgucggcggcgacgccgucucccccgcccucaugguccuccucugccucggccucucccucggcccccgcacccacguccaggccggcaaccucuccaaggccacccucugggccgagcccggcuccgucaucucccgcggcaacuccgucaccauccgcugccagggcacccucgaggcccaggaguaccgccucgucaaggagggcucccccgagcccugggacacccagaacccccucgagcccaagaacaaggcccgcuucuccauccccuccaugaccgagcaccacgccggccgcuaccgcugcuacuacuacucccccgccggcugguccgagcccuccgacccccucgagcucgucgucaccggcuucuacaacaagcccacccucuccgcccuccccucccccgucgucaccuccggcgagaacgucacccuccagugcggcucccgccuccgcuucgaccgcuucauccucaccgaggagggcgaccacaagcucuccuggacccucgacucccagcucacccccuccggccaguuccaggcccucuuccccgucggccccgucacccccucccaccgcuggaugcuccgcugcuacggcucccgccgccacauccuccaggucugguccgagcccuccgaccuccucgagauccccgucuccggcgccgccgacaaccucucccccucccagaacaaguccgacuccggcaccgccucccaccuccaggacuacgccgucgagaaccucauccgcaugggcauggccggccucauccucgucguccucggcauccucaucuuccaggacuggcacucccagcgcuccccccaggccgccgccggccgcuga

SEQ ID NO: 45381 - RNA, 1956 nt, Artificial Sequence
  derived and/or modified sequence opt2 from LILRB1__Homo_sapiens__NP_001075107
augacccccauccucaccguccucaucugccucggccucucccucggcccccgcacccacguccaggccggccaccuccccaagcccacccucugggccgagcccggcuccgucaucacccagggcucccccgucacccuccgcugccagggcggccaggagacccaggaguaccgccucuaccgcgagaagaagaccgcccccuggaucacccgcaucccccaggagcucgucaagaagggccaguuccccauccccuccaucaccugggagcacaccggccgcuaccgcugcuacuacggcuccgacaccgccggccgcuccgaguccuccgacccccucgagcucgucgucaccggcgccuacaucaagcccacccucuccgcccagcccucccccgucgucaacuccggcggcaacgucacccuccagugcgacucccaggucgccuucgacggcuucauccucugcaaggagggcgaggacgagcacccccagugccucaacucccagccccacgcccgcggcuccucccgcgccaucuucuccgucggccccgucucccccucccgccgcuggugguaccgcugcuacgccuacgacuccaacucccccuacgaguggucccuccccuccgaccuccucgagcuccucguccucggcgucuccaagaagcccucccucuccguccagcccggccccaucgucgcccccgaggagacccucacccuccagugcggcuccgacgccggcuacaaccgcuucguccucuacaaggacggcgagcgcgacuuccuccagcucgccggcgcccagccccaggccggccucucccaggccaacuucacccucggccccgucucccgcuccuacggcggccaguaccgcugcuacggcgcccacaaccucuccuccgagugguccgcccccuccgacccccucgacauccucaucgccggccaguucuacgaccgcgucucccucuccguccagcccggccccaccgucgccuccggcgagaacgucacccuccucugccagucccagggcuggaugcagaccuuccuccucaccaaggagggcgccgccgacgaccccuggcgccuccgcuccaccuaccagucccagaaguaccaggccgaguuccccaugggccccgucaccuccgcccacgccggcaccuaccgcugcuacggcucccaguccuccaagcccuaccuccucacccaccccuccgacccccucgagcucgucgucuccggccccuccggcggccccuccucccccaccaccggccccaccuccaccuccgccggccccgaggaccagccccucacccccaccggcuccgacccccaguccggccucggccgccaccucggcgucgucaucggcauccucgucgccgucauccuccuccuccuccuccuccuccuccucuuccucauccuccgccaccgccgccagggcaagcacuggaccuccacccagcgcaaggccgacuuccagcaccccgccggcgccgucggccccgagcccaccgaccgcggccuccaguggcgcuccucccccgccgccgacgcccaggaggagaaccucuacgccgccgucaagcacacccagcccgaggacggcgucgagauggacacccgcuccccccacgacgaggacccccaggccgucaccuacgccgaggucaagcacucccgcccccgccgcgagauggccuccccccccuccccccucuccggcgaguuccucgacaccaaggaccgccaggccgaggaggaccgccagauggacaccgaggccgccgccuccgaggccccccaggacgucaccuacgcccagcuccacucccucacccuccgccgcgaggccaccgagcccccccccucccaggagggccccucccccgccguccccuccaucuacgccacccucgccauccacuga

SEQ ID NO: 45382 - RNA, 1449 nt, Artificial Sequence
  derived and/or modified sequence opt2 from LILRB2__Homo_sapiens__NP_001265333
augaccggcgccuaccccaagcccacccucuccgcccagcccucccccgucgucaccuccggcggccgcgucacccuccagugcgagucccaggucgccuucggcggcuucauccucugcaaggagggcgaggacgagcacccccagugccucaacucccagccccacgcccgcggcuccucccgcgccaucuucuccgucggccccgucucccccaaccgccgcuggucccaccgcugcuacggcuacgaccucaacucccccuacgucugguccucccccuccgaccuccucgagcuccucguccccggcgucuccaagaagcccucccucuccguccagcccggccccgucauggcccccggcgagucccucacccuccagugcgucuccgacgucggcuacgaccgcuucguccucuacaaggagggcgagcgcgaccuccgccagcuccccggccgccagccccaggccggccucucccaggccaacuucacccucggccccgucucccgcuccuacggcggccaguaccgcugcuacggcgcccacaaccucuccuccgagugcuccgcccccuccgacccccucgacauccucaucaccggccagauccgcggcacccccuucaucuccguccagcccggccccaccgucgccuccggcgagaacgucacccuccucugccaguccuggcgccaguuccacaccuuccuccucaccaaggccggcgccgccgacgccccccuccgccuccgcuccauccacgaguaccccaaguaccaggccgaguuccccaugucccccgucaccuccgcccacgccggcaccuaccgcugcuacggcucccucaacuccgaccccuaccuccucucccaccccuccgagccccucgagcucgucgucuccggccccuccaugggcuccucccccccccccaccggccccaucuccacccccgccggccccgaggaccagccccucacccccaccggcuccgacccccaguccggccucggccgccaccucggcgucgucaucggcauccucgucgccgucguccuccuccuccuccuccuccuccuccucuuccucauccuccgccaccgccgccagggcaagcacuggaccuccacccagcgcaaggccgacuuccagcaccccgccggcgccgucggccccgagcccaccgaccgcggccuccaguggcgcuccucccccgccgccgacgcccaggaggagaaccucuacgccgccgucaaggacacccagcccgaggacggcgucgagauggacacccgcgccgccgccuccgaggccccccaggacgucaccuacgcccagcuccacucccucacccuccgccgcaaggccaccgagcccccccccucccaggagcgcgagccccccgccgagcccuccaucuacgccacccucgccauccacuga

SEQ ID NO: 45383 - RNA, 1446 nt, Artificial Sequence
  derived and/or modified sequence opt2 from LILRB3__Homo_sapiens__XP_006726238
augacccccgcccucaccgcccuccucugccucggccucucccucggcccccgcacccgcguccaggccggccccuuccccaagcccacccucugggccgagcccggcuccgucaucuccuggggcucccccgucaccaucuggugccagggcucccucgaggcccaggaguaccagcucgacaaggagggcucccccgagccccucgaccgcaacaacccccucgagcccaagaacaaggcccgcuucuccauccccuccaugacccagcaccacgccggccgcuaccgcugccacuacuacuccuccgccggcugguccgagcccuccgacccccucgagcucgucaugaccggcuucuacaacaagcccacccucuccgcccuccccucccccgucgucgccuccggcggcaacaugacccuccgcugcggcucccagaagggcuaccaccacuucguccucaugaaggagggcgagcaccagcucccccgcacccucgacucccagcagcuccacuccggcggcuuccaggcccucuuccccgucggccccgucacccccucccaccgcuggcgcuucaccugcuacuacuacuacaccaacaccccccgcgucuggucccaccccuccgacccccucgagauccuccccuccggcgucucccgcaagcccucccuccucacccuccagggccccguccucgcccccggccagucccucacccuccagugcggcuccgacgucggcuacgaccgcuucguccucuacaaggagggcgagcgcgacuuccuccagcgccccggccagcagccccaggccggccucucccaggccaacuucacccucggccccgucucccccucccacggcggccaguaccgcugcuacggcgcccacaaccucuccuccgagugguccgcccccuccgacccccucaacauccucauggccggccagaucuacgacaccgucucccucuccgcccagcccggccccaccgucgccuccggcgagaacgucacccuccucugccagucccgcggcuacuucgacaccuuccuccucaccaaggagggcgccgcccaccccccccuccgccuccgcuccauguacggcgcccacaaguaccaggccgaguuccccaugucccccgucaccuccgcccacgccggcaccuaccgcugcuacggcuccuacuccuccaacccccaccuccucuccuuccccuccgagccccucgagcucauggucuccggccacuccggcggcuccucccucccccccaccggcccccccuccacccccgccucccacgccaaggacuacaccgucgagaaccucauccgcaugggcauggccggccucguccucgucuuccucggcauccuccucuucgaggcccagcacucccagcgcaacccccaggacgccgccggccgcuga

SEQ ID NO: 45384 - RNA, 1473 nt, Artificial Sequence
  derived and/or modified sequence opt2 from LILRB4__Homo_sapiens__XP_011546956
auggagcagccccacgacgagaaggaccccgccuccaagcgcccccaccccgucugccucuucguccuccccgcccuccgcacccaccccuccgcccagcucggcccccucggcggcgacgccaugauccccaccuucaccgcccuccucugccucggccucucccucggcccccgcacccacaugcaggccggcccccuccccaagcccacccucugggccgagcccggcuccgucaucuccuggggcaacuccgucaccaucuggugccagggcacccucgaggcccgcgaguaccgccucgacaaggaggagucccccgcccccugggaccgccagaacccccucgagcccaagaacaaggcccgcuucuccauccccuccaugaccgaggacuacgccggccgcuaccgcugcuacuaccgcucccccgucggcuggucccagcccuccgacccccucgagcucgucaugaccggcgccuacuccaagcccacccucuccgcccuccccuccccccucgucaccuccggcaaguccgucacccuccucugccagucccgcucccccauggacaccuuccuccucaucaaggagcgcgccgcccacccccuccuccaccuccgcuccgagcacggcgcccagcagcaccaggccgaguuccccaugucccccgucaccuccguccacggcggcaccuaccgcugcuucuccucccacggcuucucccacuaccuccucucccaccccuccgacccccucgagcucaucgucuccggcucccucgaggacccccgccccucccccacccgcuccgucuccaccgccgccggccccgaggaccagccccucaugcccaccggcuccgucccccacuccggccuccgccgccacugggagguccucaucggcguccucgucgucuccauccuccuccucucccuccuccucuuccuccuccuccagcacuggcgccagggcaagcaccgcacccucgcccagcgccaggccgacuuccagcgcccccccggcgccgccgagcccgagcccaaggacggcggccuccagcgccgcuccucccccgccgccgacguccagggcgagaacuucuccggcgccgccgucaagaacacccagcccgaggacggcgucgagauggacacccgccaguccccccacgacgaggacccccaggccgucaccuacgccaaggucaagcacucccgcccccgccgcgagauggccuccccccccuccccccucuccggcgaguuccucgacaccaaggaccgccaggccgaggaggaccgccagauggacaccgaggccgccgccuccgaggccccccaggacgucaccuacgcccagcuccacuccuucacccuccgccagaaggccaccgagcccccccccucccaggagggcgccucccccgccgagcccuccgucuacgccacccucgccauccacuga

SEQ ID NO: 45385 - RNA, 1776 nt, Artificial Sequence
  derived and/or modified sequence opt2 from LILRB5__Homo_sapiens__NP_001074911
augacccucacccucuccguccucaucugccucggccucuccgucggcccccgcaccugcguccaggccggcacccuccccaagcccacccucugggccgagcccgccuccgucaucgcccgcggcaagcccgucacccucuggugccagggcccccucgagaccgaggaguaccgccucgacaaggagggccuccccugggcccgcaagcgccagaacccccucgagcccggcgccaaggccaaguuccacauccccuccaccgucuacgacuccgccggccgcuaccgcugcuacuacgagacccccgccggcugguccgagcccuccgacccccucgagcucgucgccaccggcuucuacgccgagcccacccuccucgcccuccccucccccgucgucgccuccggcggcaacgucacccuccagugcgacacccucgacggccuccucaccuucguccucgucgaggaggagcagaagcucccccgcacccucuacucccagaagcuccccaagggccccucccaggcccucuuccccgucggccccgucacccccuccugccgcuggcgcuuccgcugcuacuacuacuaccgcaagaacccccaggucugguccaaccccuccgaccuccucgagauccucguccccggcgucucccgcaagcccucccuccucaucccccagggcuccgucgucgcccgcggcggcucccucacccuccagugccgcuccgacgucggcuacgacaucuucguccucuacaaggagggcgagcacgaccucguccagggcuccggccagcagccccaggccggccucucccaggccaacuucacccucggccccgucucccgcucccacggcggccaguaccgcugcuacggcgcccacaaccucuccccccgcugguccgcccccuccgacccccucgacauccucaucgccggccucauccccgacauccccgcccucuccguccagcccggccccaaggucgccuccggcgagaacgucacccuccucugccaguccuggcaccagaucgacaccuucuuccucaccaaggagggcgccgcccaccccccccucugccucaaguccaaguaccaguccuaccgccaccaggccgaguucuccaugucccccgucaccuccgcccagggcggcaccuaccgcugcuacuccgccauccgcuccuaccccuaccuccucuccucccccuccuacccccaggagcucgucgucuccggccccuccggcgaccccucccucucccccaccggcuccacccccacccccgccggccccgaggaccagccccucacccccaccggccucgacccccaguccggccucggccgccaccucggcgucgucaccggcgucuccgucgccuucguccuccuccucuuccuccuccucuuccuccuccuccgccaccgccaccaguccaagcaccgcaccuccgcccacuucuaccgccccgccggcgccgccggccccgagcccaaggaccagggccuccagaagcgcgccucccccgucgccgacauccaggaggagauccucaacgccgccgucaaggacacccagcccaaggacggcgucgagauggacgcccgcgccgccgccuccgaggccccccaggacgucaccuacgcccagcuccacucccucacccuccgccgcgaggccaccgagcccccccccucccaggagcgcgagccccccgccgagcccuccaucuacgccccccucgccauccacuga

SEQ ID NO: 45386 - RNA, 522 nt, Artificial Sequence
  derived and/or modified sequence opt2 from LIM2__Homo_sapiens__NP_001155220
auguacuccuucaugggcggcggccucuucugcgccugggucggcaccauccuccucgucgucgccauggccaccgaccacuggaugcaguaccgccucuccggcuccuucgcccaccagggccucuggcgcuacugccucggcaacaagugcuaccuccagaccgacuccaucgccuacuggaacgccacccgcgccuucaugauccucuccgcccucugcgccaucuccggcaucaucaugggcaucauggccuucgcccaccagcccaccuucucccgcaucucccgccccuucuccgccggcaucauguucuucuccuccacccucuucgucguccucgcccucgccaucuacaccggcgucaccgucuccuuccucggccgccgcuucggcgacuggcgcuucuccugguccuacauccucggcugggucgccguccucaugaccuucuucgccggcaucuucuacaugugcgccuaccgcguccacgagugccgccgccucuccaccccccgcuga

SEQ ID NO: 45387 - RNA, 1374 nt, Artificial Sequence
  derived and/or modified sequence opt2 from LIMA1__Homo_sapiens__NP_001230704
auggagcagaaggagaacgucccccccggccccgaggucugcaucacccaccaggagggcgagaagaucuccgccaacgagaacucccucgccguccgcuccacccccgccgaggacgacucccgcgacucccaggucaaguccgagguccagcagcccguccaccccaagccccucucccccgacucccgcgccuccucccucuccgaguccuccccccccaaggccaugaagaaguuccaggcccccgcccgcgagaccugcgucgagugccagaagaccgucuaccccauggagcgccuccucgccaaccagcaggucuuccacaucuccugcuuccgcugcuccuacugcaacaacaagcucucccucggcaccuacgccucccuccacggccgcaucuacugcaagccccacuucaaccagcucuucaaguccaagggcaacuacgacgagggcuucggccaccgcccccacaaggaccucugggccuccaagaacgagaacgaggagauccucgagcgccccgcccagcucgccaacgcccgcgagaccccccacucccccggcgucgaggacgcccccaucgccaaggucggcguccucgccgccuccauggaggccaaggccuccucccagcaggagaaggaggacaagcccgccgagaccaagaagcuccgcaucgccuggcccccccccaccgagcucggcuccuccggcuccgcccucgaggagggcaucaagauguccaagcccaaguggccccccgaggacgagaucuccaagcccgagguccccgaggacgucgaccucgaccucaagaagcuccgccgcuccuccucccucaaggagcgcucccgccccuucaccgucgccgccuccuuccaguccaccuccgucaagucccccaagaccgucuccccccccauccgcaagggcugguccauguccgagcaguccgaggaguccgucggcggccgcgucgccgagcgcaagcaggucgagaacgccaaggccuccaagaagaacggcaacgucggcaagaccaccuggcagaacaaggaguccaagggcgagaccggcaagcgcuccaaggagggccacucccucgagauggagaacgagaaccucgucgagaacggcgccgacuccgacgaggacgacaacuccuuccucaagcagcaguccccccaggagcccaagucccucaacugguccuccuucgucgacaacaccuucgccgaggaguucaccacccagaaccagaagucccaggacgucgagcucugggagggcgaggucgucaaggagcucuccgucgaggagcagaucaagcgcaaccgcuacuacgacgaggacgaggacgaggaguga

SEQ ID NO: 45388 - RNA, 3174 nt, Artificial Sequence
  derived and/or modified sequence opt2 from LIMCH1__Homo_sapiens__NP_001106188
auggccugccccgcccucggccucgaggcccuccagccccuccagcccgagcccccccccgagcccgccuucuccgaggcccagaaguggaucgagcaggucaccggccgcuccuucggcgacaaggacuuccgcaccggccucgagaacggcauccuccucugcgagcuccucaacgccaucaagcccggccucgucaagaagaucaaccgccuccccacccccaucgccggccucgacaacaucauccucuuccuccgcggcugcaaggagcucggccucaaggagucccagcucuucgaccccuccgaccuccaggacaccuccaaccgcgucaccgucaagucccucgacuacucccgcaagcucaagaacguccucgucaccaucuacuggcucggcaaggccgccaacuccugcaccuccuacuccggcaccacccucaaccucaaggaguucgagggccuccucgcccagaugcgcaaggacaccgacgacaucgagucccccaagcgcuccauccgcgacuccggcuacaucgacugcugggacuccgagcgcuccgacucccucucccccccccgccacggccgcgacgacuccuucgacucccucgacuccuucggcucccgcucccgccagacccccucccccgacgucguccuccgcggcuccuccgacggccgcggcuccgacuccgaguccgaccucccccaccgcaagcuccccgacgucaagaaggacgacauguccgcccgccgcaccucccacggcgagcccaaguccgccguccccuucaaccaguaccuccccaacaaguccaaccagaccgccuacguccccgccccccuccgcaagaagaaggccgagcgcgaggaguaccgcaaguccugguccaccgccaccuccccccucggcggcgagcgccccuuccgcuacggcccccgcacccccgucuccgacgacgccgaguccaccuccauguucgacaugcgcugcgaggaggaggccgccguccagccccacucccgcgcccgccaggagcagcuccagcucaucaacaaccagcuccgcgaggaggacgacaaguggcaggacgaccucgcccgcuggaagucccgccgccgcuccgucucccaggaccucaucaagaaggaggaggagcgcaagaagauggagaagcuccucgccggcgaggacggcaccuccgagcgccgcaaguccaucaagaccuaccgcgagaucguccaggagaaggagcgccgcgagcgcgagcuccacgaggccuacaagaacgcccgcucccaggaggaggccgagggcauccuccagcaguacaucgagcgcuucaccaucuccgaggccguccucgagcgccucgagaugcccaagauccucgagcgcucccacuccaccgagcccaaccucuccuccuuccucaacgaccccaaccccaugaaguaccuccgccagcagucccuccccccccccaaguucaccgccaccgucgagaccaccaucgcccgcgccuccguccucgacaccuccauguccgccggcuccggcucccccuccaagaccgucacccccaaggccguccccaugcucacccccaagcccuacucccagcccaagaacucccaggacguccucaagaccuucaaggucgacggcaaggucuccgucaacggcgagaccguccaccgcgaggaggagaaggagcgcgagugccccaccgucgcccccgcccacucccucaccaagucccagauguucgagggcgucgcccgcguccacggcuccccccucgagcucaagcaggacaacggcuccaucgagaucaacaucaagaagcccaacuccgucccccaggagcucgccgccaccaccgagaagaccgagcccaacucccaggaggacaagaacgacggcggcaagucccgcaagggcaacaucgagcucgccuccuccgagccccagcacuucaccaccaccgucacccgcugcucccccaccgucgccuucgucgaguuccccuccuccccccagcucaagaacgacgucuccgaggagaaggaccagaagaagcccgagaacgagauguccggcaaggucgagcucguccucucccagaaggucgucaagcccaagucccccgagcccgaggccacccucaccuuccccuuccucgacaagaugcccgaggccaaccagcuccaccuccccaaccucaacucccaggucgacucccccuccuccgagaagucccccgucaugaccccccaguucaaguucugggccugggaccccgaggaggagcgccgccgccaggagaaguggcagcaggagcaggagcgccuccuccaggagcgcuaccagaaggagcaggacaagcucaaggaggagugggagaaggcccagaaggaggucgaggaggaggagcgccgcuacuacgaggaggagcgcaagaucaucgaggacaccgucguccccuucaccgucuccuccuccuccgccgaccagcucuccaccuccuccuccaugaccgagggcuccggcaccaugaacaagaucgaccucggcaacugccaggacgagaagcaggaccgccgcuggaagaaguccuuccagggcgacgacuccgaccuccuccucaagacccgcgaguccgaccgccucgaggagaagggcucccucaccgagggcgcccucgcccacuccggcaaccccgucuccaagggcguccacgaggaccaccagcucgacaccgaggccggcgccccccacugcggcaccaacccccagcucgcccaggaccccucccagaaccagcagaccuccaaccccacccacuccuccgaggacgucaagcccaagacccucccccucgacaaguccaucaaccaccagaucgagucccccuccgagcgccgcaaguccaucuccggcaagaagcucugcuccuccugcggccucccccucggcaagggcgccgccaugaucaucgagacccucaaccucuacuuccacauccagugcuuccgcugcggcaucugcaagggccagcucggcgacgccgucuccggcaccgacguccgcauccgcaacggccuccucaacugcaacgacugcuacaugcgcucccgcuccgccggccagcccaccacccucuga

SEQ ID NO: 45389 - RNA, 2031 nt, Artificial Sequence
  derived and/or modified sequence opt2 from LIMD1__Homo_sapiens__NP_055055
auggacaaguacgacgaccucggccucgaggccuccaaguucaucgaggaccucaacauguacgaggccuccaaggacggccucuuccgcgucgacaagggcgccggcaacaaccccgaguucgaggagacccgccgcgucuucgccaccaagauggccaagauccaccuccagcagcagcagcagcagcuccuccaggaggagacccucccccgcggcucccgcggccccgucaacggcggcggccgccucggcccccaggcccgcugggaggucgucggcuccaagcucaccgucgacggcgccgccaagcccccccucgccgccuccaccggcgcccccggcgccgucaccacccucgccgccggccagccccccuaccccccccaggagcagcgcucccgccccuaccuccacggcacccgccacggcucccaggacugcggcucccgcgagucccucgccaccuccgagauguccgccuuccaccagcccggccccugcgaggaccccuccugccucacccacggcgacuacuacgacaaccucucccucgccucccccaaguggggcgacaagcccggcgucucccccuccaucggccucuccgucggcuccggcuggcccuccucccccggcuccgaccccccccuccccaagcccugcggcgaccacccccucaaccaccgccagcucucccucuccuccucccgcuccuccgagggcucccucggcggccagaacuccggcaucggcggccgcuccuccgagaagcccaccggccucugguccaccgccuccucccagcgcgucucccccggccuccccucccccaaccucgagaacggcgcccccgccgucggccccguccagccccgcacccccuccgucuccgccccccucgcccucuccugcccccgccagggcggccucccccgcuccaacuccggccucggcggcgaggucuccggcgucauguccaagcccaacgucgacccccagcccugguuccaggacggccccaaguccuaccucuccuccuccgcccccuccuccucccccgccggccucgacggcucccagcagggcgccguccccggccucggccccaagcccggcugcaccgaccucggcaccggccccaagcucucccccaccucccucguccaccccgucauguccacccuccccgagcucuccugcaaggagggcccccucggcugguccuccgacggcucccucggcuccguccuccucgacucccccuccuccccccgcguccgccuccccugccagccccucguccccggccccgagcuccgccccuccgccgccgagcucaagcucgaggcccucacccagcgccucgagcgcgagauggacgcccaccccaaggccgacuacuucggcgccugcgucaagugcuccaagggcgucuucggcgccggccaggccugccaggccaugggcaaccucuaccacgacaccugcuucaccugcgccgccugcucccgcaagcuccgcggcaaggccuucuacuucgucaacggcaaggucuucugcgaggaggacuuccucuacuccggcuuccagcaguccgccgaccgcugcuuccucugcggccaccucaucauggacaugauccuccaggcccucggcaaguccuaccaccccggcugcuuccgcugcgucaucugcaacgagugccucgacggcguccccuucaccgucgacuccgagaacaagaucuacugcguccgcgacuaccacaagguccucgcccccaagugcgccgccugcggccuccccauccucccccccgagggcuccgacgagaccauccgcgucgucuccauggaccgcgacuaccacgucgagugcuaccacugcgaggacugcggccucgagcucaacgacgaggacggccaccgcugcuacccccucgaggaccaccucuucugccacuccugccacgucaagcgccucgagaagcgccccuccuccaccgcccuccaccagcaccacuucuga

SEQ ID NO: 45390 - RNA, 384 nt, Artificial Sequence
  derived and/or modified sequence opt2 from LIMD2__Homo_sapiens__NP_085053
auguuccaggccgccggcgccgcccaggccacccccucccacgacgccaagggcggcggcuccuccaccguccagcgcuccaaguccuucucccuccgcgcccaggucaaggagaccugcgccgccugccagaagaccgucuaccccauggagcgccucgucgccgacaagcucaucuuccacaacuccugcuucugcugcaagcacugccacaccaagcucucccucggcuccuacgccgcccuccacggcgaguucuacugcaagccccacuuccagcagcucuucaaguccaagggcaacuacgacgagggcuucggccgcaagcagcacaaggagcucugggcccacaaggaggucgaccccggcaccaagaccgccuga

SEQ ID NO: 45391 - RNA, 1842 nt, Artificial Sequence
  derived and/or modified sequence opt2 from LIMK1__Homo_sapiens__NP_001191355
augcuccucgccuccgccccccgccgccgccgcuuccuccagcgcgccaagugcugcgacugcuccgccucccucucccaccaguacuacgagaaggacggccagcucuucugcaagaaggacuacugggcccgcuacggcgaguccugccacggcugcuccgagcagaucaccaagggccucgucauggucgccggcgagcucaaguaccaccccgagugcuucaucugccucaccugcggcaccuucaucggcgacggcgacaccuacacccucgucgagcacuccaagcucuacugcggccacugcuacuaccagaccgucgucacccccgucaucgagcagauccuccccgacucccccggcucccaccucccccacaccgucacccucgucuccauccccgccuccucccacggcaagcgcggccucuccgucuccaucgaccccccccacggcccccccggcugcggcaccgagcacucccacaccguccgcguccagggcgucgaccccggcugcaugucccccgacgucaagaacuccauccacgucggcgaccgcauccucgagaucaacggcacccccauccgcaacgucccccucgacgagaucgaccuccucauccaggagaccucccgccuccuccagcucacccucgagcacgacccccacgacacccucggccacggccucggccccgagaccuccccccucuccucccccgccuacacccccuccggcgaggccggcuccuccgcccgccagaagcccguccuccgcuccugcuccaucgaccgcucccccggcgccggcucccucggcucccccgccucccagcgcaaggaccucggccgcuccgagucccuccgcgucgucugccgcccccaccgcaucuuccgccccuccgaccucauccacggcgagguccucggcaagggcugcuucggccaggccaucaaggucacccaccgcgagaccggcgaggucauggucaugaaggagcucauccgcuucgacgaggagacccagcgcaccuuccucaaggaggucaaggucaugcgcugccucgagcaccccaacguccucaaguucaucggcguccucuacaaggacaagcgccucaacuucaucaccgaguacaucaagggcggcacccuccgcggcaucaucaaguccauggacucccaguaccccuggucccagcgcgucuccuucgccaaggacaucgccuccggcauggccuaccuccacuccaugaacaucauccaccgcgaccucaacucccacaacugccucguccgcgagaacaagaacgucgucgucgccgacuucggccucgcccgccucauggucgacgagaagacccagcccgagggccuccgcucccucaagaagcccgaccgcaagaagcgcuacaccgucgucggcaaccccuacuggauggcccccgagaugaucaacggccgcuccuacgacgagaaggucgacgucuucuccuucggcaucguccucugcgagaucaucggccgcgucaacgccgaccccgacuaccucccccgcaccauggacuucggccucaacguccgcggcuuccucgaccgcuacugcccccccaacugcccccccuccuucuuccccaucaccguccgcugcugcgaccucgaccccgagaagcgccccuccuucgucaagcucgagcacuggcucgagacccuccgcaugcaccucgccggccaccucccccucggcccccagcucgagcagcucgaccgcggcuucugggagaccuaccgccgcggcgaguccggccuccccgcccaccccgagguccccgacuga

SEQ ID NO: 45392 - RNA, 2061 nt, Artificial Sequence
  derived and/or modified sequence opt2 from LIMK2__Homo_sapiens__NP_001026971
augggcuccuaccucuccguccccgccuacuucaccucccgcgaccucuuccgcugcuccgagugccaggacucccucaccaacugguacuacgagaaggacggcaagcucuacugccccaaggacuacuggggcaaguucggcgaguucugccacggcugcucccuccucaugaccggccccuucauggucgccggcgaguucaaguaccaccccgagugcuucgccugcauguccugcaaggucaucaucgaggacggcgacgccuacgcccucguccagcacgccacccucuacugcggcaagugccacaacgaggucguccucgcccccauguucgagcgccucuccaccgaguccguccaggagcagcuccccuacuccgucacccucaucuccaugcccgccaccaccgagggccgccgcggcuucuccgucuccgucgaguccgccugcuccaacuacgccaccaccguccaggucaaggaggucaaccgcaugcacaucucccccaacaaccgcaacgccauccaccccggcgaccgcauccucgagaucaacggcacccccguccgcacccuccgcgucgaggaggucgaggacgccaucucccagaccucccagacccuccagcuccucaucgagcacgaccccgucucccagcgccucgaccagcuccgccucgaggcccgccucgccccccacaugcagaacgccggccacccccacgcccucuccacccucgacaccaaggagaaccucgagggcacccuccgccgccgcucccuccgccgcuccaacuccaucuccaagucccccggccccuccucccccaaggagccccuccucuucucccgcgacaucucccgcuccgagucccuccgcugcuccuccuccuacucccagcagaucuuccgccccugcgaccucauccacggcgagguccucggcaagggcuucuucggccaggccaucaaggucacccacaaggccaccggcaaggucauggucaugaaggagcucauccgcugcgacgaggagacccagaagaccuuccucaccgaggucaaggucaugcgcucccucgaccaccccaacguccucaaguucaucggcguccucuacaaggacaagaagcucaaccuccucaccgaguacaucgagggcggcacccucaaggacuuccuccgcuccauggaccccuuccccuggcagcagaagguccgcuucgccaagggcaucgccuccggcauggccuaccuccacuccaugugcaucauccaccgcgaccucaacucccacaacugccucaucaagcucgacaagaccgucgucgucgccgacuucggccucucccgccucaucgucgaggagcgcaagcgcgcccccauggagaaggccaccaccaagaagcgcacccuccgcaagaacgaccgcaagaagcgcuacaccgucgucggcaaccccuacuggauggcccccgagaugcucaacggcaaguccuacgacgagaccgucgacaucuucuccuucggcaucguccucugcgagaucaucggccaggucuacgccgaccccgacugccucccccgcacccucgacuucggccucaacgucaagcucuucugggagaaguucguccccaccgacugcccccccgccuucuucccccucgccgccaucugcugccgccucgagcccgagucccgcgccccccccggcgccgccggcgagggccccggcugcgccgacgacgagggccccguccgccgccagggcaaggucaccaucaaguacgaccccaaggagcuccgcaagcaccucaaccucgaggaguggauccucgagcagcucacccgccucuacgacugccaggaggaggagaucuccgagcucgagaucgacgucgacgagcuccucgacauggaguccgacgacgccugggccucccgcgucaaggagcuccucgucgacugcuacaagcccaccgaggccuucaucuccggccuccucgacaagauccgcgccaugcagaagcucuccaccccccagaagaaguga

SEQ ID NO: 45393 - RNA, 990 nt, Artificial Sequence
  derived and/or modified sequence opt2 from LIMS1__Homo_sapiens__NP_001180411
augaccugcaacauggccaacgcccucgccuccgccaccugcgagcgcugcaagggcggcuucgcccccgccgagaagaucgucaacuccaacggcgagcucuaccacgagcagugcuucgucugcgcccagugcuuccagcaguuccccgagggccucuucuacgaguucgagggccgcaaguacugcgagcacgacuuccagaugcucuucgcccccugcugccaccagugcggcgaguucaucaucggccgcgucaucaaggccaugaacaacuccuggcaccccgagugcuuccgcugcgaccucugccaggagguccucgccgacaucggcuucgucaagaacgccggccgccaccucugccgccccugccacaaccgcgagaaggcccgcggccucggcaaguacaucugccagaagugccacgccaucaucgacgagcagccccucaucuucaagaacgaccccuaccaccccgaccacuucaacugcgccaacugcggcaaggagcucaccgccgacgcccgcgagcucaagggcgagcucuacugccuccccugccacgacaagaugggcguccccaucugcggcgccugccgccgccccaucgagggccgcgucgucaacgccaugggcaagcaguggcacgucgagcacuucgucugcgccaagugcgagaagcccuuccucggccaccgccacuacgagcgcaagggccucgccuacugcgagacccacuacaaccagcucuucggcgacgucugcuuccacugcaaccgcgucaucgagggcgacgucgucuccgcccucaacaaggccuggugcgucaacugcuucgccugcuccaccugcaacaccaagcucacccucaagaacaaguucgucgaguucgacaugaagcccgucugcaagaagugcuacgagaaguucccccucgagcucaagaagcgccucaagaagcucgccgagacccucggccgcaaguga

SEQ ID NO: 45394 - RNA, 1092 nt, Artificial Sequence
  derived and/or modified sequence opt2 from LIMS2__Homo_sapiens__NP_001129509
augaccggccgcaagcgcaaguggggcgagaccggcaccggcuccggcgccgcccccgccgccgcccuccgcugguccaacauguccgacgcccucgccaacgccgucugccagcgcugccaggcccgcuucucccccgccgagcgcaucgucaacuccaacggcgagcucuaccacgagcacugcuucgucugcgcccagugcuuccgccccuuccccgagggccucuucuacgaguucgagggccgcaaguacugcgagcacgacuuccagaugcucuucgcccccugcugcggcuccugcggcgaguucaucaucggccgcgucaucaaggccaugaacaacaacuggcaccccggcugcuuccgcugcgagcucugcgacgucgagcucgccgaccucggcuucgucaagaacgccggccgccaccucugccgccccugccacaaccgcgagaaggccaagggccucggcaaguacaucugccagcgcugccaccucgucaucgacgagcagccccucauguuccgcuccgacgccuaccaccccgaccacuucaacugcacccacugcggcaaggagcucaccgccgaggcccgcgagcucaagggcgagcucuacugccuccccugccacgacaagaugggcguccccaucugcggcgccugccgccgccccaucgagggccgcgucgucaacgcccucggcaagcaguggcacgucgagcacuucgucugcgccaagugcgagaagcccuuccucggccaccgccacuacgagaagaagggccucgccuacugcgagacccacuacaaccagcucuucggcgacgucugcuacaacugcucccacgucaucgagggcgacgucgucuccgcccucaacaaggccuggugcgucuccugcuucuccugcuccaccugcaacuccaagcucacccucaagaacaaguucgucgaguucgacaugaagcccgucugcaagcgcugcuacgagaaguucccccucgagcucaagaagcgccucaagaagcucuccgagcucaccucccgcaaggcccagcccaaggccaccgaccucaacuccgccuga

SEQ ID NO: 45395 - RNA, 753 nt, Artificial Sequence
  derived and/or modified sequence opt2 from LIN28B__Homo_sapiens__NP_001004317
auggccgagggcggcgccuccaagggcggcggcgaggagcccggcaagcuccccgagcccgccgaggaggagucccagguccuccgcggcaccggccacugcaagugguucaacguccgcaugggcuucggcuucaucuccaugaucaaccgcgagggcuccccccucgacauccccgucgacgucuucguccaccaguccaagcucuucauggagggcuuccgcucccucaaggagggcgagcccgucgaguucaccuucaagaaguccuccaagggccucgaguccauccgcgucaccggccccggcggcucccccugccucggcuccgagcgccgccccaagggcaagacccuccagaagcgcaagcccaagggcgaccgcugcuacaacugcggcggccucgaccaccacgccaaggagugcucccuccccccccagcccaagaagugccacuacugccaguccaucaugcacauggucgccaacugcccccacaagaacgucgcccagccccccgccuccucccagggccgccaggaggccgagucccagcccugcaccuccacccucccccgcgaggucggcggcggccacggcugcaccuccccccccuucccccaggaggcccgcgccgagaucuccgagcgcuccggccgcuccccccaggaggccuccuccaccaaguccuccaucgcccccgaggagcaguccaagaagggccccuccguccagaagcgcaagaagaccuga

SEQ ID NO: 45396 - RNA, 351 nt, Artificial Sequence
  derived and/or modified sequence opt2 from LIN52__Homo_sapiens__NP_001019845
augggcuggaagauggccucccccaccgacggcaccgaccucgaggccucccuccucuccuucgagaagcucgaccgcgccucccccgaccucuggcccgagcagcuccccggcgucgccgaguucgccgccuccuucaagucccccaucaccuccuccccccccaaguggauggccgagaucgagcgcgacgacaucgacaugcucaaggagcucggcucccucaccaccgccaaccucauggagaagguccgcggccuccagaaccucgccuaccagcucggccucgacgagucccgcgagaugacccgcggcaaguuccucaacauccucgagaagcccaagaaguga

SEQ ID NO: 45397 - RNA, 702 nt, Artificial Sequence
  derived and/or modified sequence opt2 from LIN7A__Homo_sapiens__NP_004655
augcucaagcccuccgucaccuccgcccccaccgccgacauggccacccucaccgucguccagccccucacccucgaccgcgacgucgcccgcgccaucgagcuccucgagaagcuccaggaguccggcgagguccccguccacaagcuccagucccucaagaagguccuccaguccgaguucugcaccgccauccgcgaggucuaccaguacaugcacgagaccaucaccgucaacggcugccccgaguuccgcgcccgcgccaccgccaaggccaccgucgccgccuucgccgccuccgagggccacucccacccccgcgucgucgagcuccccaagaccgacgagggccucggcuucaacgucaugggcggcaaggagcagaacucccccaucuacaucucccgcaucauccccggcggcgucgccgagcgccacggcggccucaagcgcggcgaccagcuccucuccgucaacggcgucuccgucgagggcgagcaccacgagaaggccgucgagcuccucaaggccgccaaggacuccgucaagcucgucguccgcuacacccccaagguccucgaggagauggaggcccgcuucgagaagcuccgcaccgcccgccgccgccagcagcagcagcuccucauccagcagcagcagcagcagcagcagcagcagacccagcagaaccacauguccuga

SEQ ID NO: 45398 - RNA, 624 nt, Artificial Sequence
  derived and/or modified sequence opt2 from LIN7B__Homo_sapiens__NP_071448
auggccgcccucgucgagccccucggccucgagcgcgacgucucccgcgccgucgagcuccucgagcgccuccagcgcuccggcgagcuccccccccagaagcuccaggcccuccagcgcguccuccagucccgcuucugcuccgccauccgcgaggucuacgagcagcucuacgacacccucgacaucaccggcuccgccgagauccgcgcccacgccaccgccaaggccaccgucgccgccuucaccgccuccgagggccacgcccacccccgcgucgucgagcuccccaagaccgacgagggccucggcuucaacaucaugggcggcaaggagcagaacucccccaucuacaucucccgcgucauccccggcggcgucgccgaccgccacggcggccucaagcgcggcgaccagcuccucuccgucaacggcgucuccgucgagggcgagcagcacgagaaggccgucgagcuccucaaggccgcccagggcuccgucaagcucgucguccgcuacaccccccgcguccucgaggagauggaggcccgcuucgagaagaugcgcuccgcccgccgccgccagcagcaccaguccuacuccucccucgagucccgcggcuga

SEQ ID NO: 45399 - RNA, 594 nt, Artificial Sequence
  derived and/or modified sequence opt2 from LIN7C__Homo_sapiens__NP_060832
auggccgcccucggcgagcccguccgccucgagcgcgacaucugccgcgccaucgagcuccucgagaagcuccagcgcuccggcgagguccccccccagaagcuccaggcccuccagcgcguccuccaguccgaguucugcaacgccguccgcgaggucuacgagcacgucuacgagaccgucgacaucuccuccucccccgagguccgcgccaacgccaccgccaaggccaccgucgccgccuucgccgccuccgagggccacucccacccccgcgucgucgagcuccccaagaccgaggagggccucggcuucaacaucaugggcggcaaggagcagaacucccccaucuacaucucccgcaucauccccggcggcaucgccgaccgccacggcggccucaagcgcggcgaccagcuccucuccgucaacggcgucuccgucgagggcgagcaccacgagaaggccgucgagcuccucaaggccgcccagggcaaggucaagcucgucguccgcuacacccccaagguccucgaggagauggagucccgcuucgagaagaugcgcuccgccaagcgccgccagcagaccuga

SEQ ID NO: 45400 - RNA, 1572 nt, Artificial Sequence
  derived and/or modified sequence opt2 from LIN9__Homo_sapiens__NP_001257338
augcaccgcggcggccagccccucaagaagcgccgcggcuccuucaagauggccgagcucgaccagcuccccgacgaguccuccuccgccaaggcccucgucucccucaaggagggcucccucuccaacaccuggaacgagaaguacuccucccuccagaagacccccgucuggaagggccgcaacaccuccuccgccgucgagaugaaguucaccgccaccauguccacccccgacaagaaggccucccagaagaucggcuuccgccuccgcaaccuccucaagcuccccaaggcccacaaguggugcaucuacgagugguucuacuccaacaucgacaagccccucuucgagggcgacaacgacuucugcgucugccucaaggaguccuuccccaaccucaagacccgcaagcucacccgcgucgaguggggcaagauccgccgccucaugggcaagccccgccgcugcuccuccgccuucuucgaggaggagcgcuccgcccucaagcagaagcgccagaagauccgccuccuccagcagcgcaaggucgccgacgucucccaguucaaggaccuccccgacgagaucccccucccccucgucaucggcaccaaggucaccgcccgccuccgcggcguccacgacggccucuucaccggccagaucgacgccgucgacacccucaacgccaccuaccgcgucaccuucgaccgcaccggccucggcacccacaccauccccgacuacgagguccucuccaacgagccccacgagaccaugcccaucgccgccuucggccagaagcagcgccccucccgcuucuucaugacccccccccgccuccacuacacccccccccuccagucccccaucaucgacaacgacccccuccucggccagucccccuggcgcuccaagaucuccggcuccgacaccgagacccucggcggcuuccccgucgaguuccucauccaggucacccgccucuccaagauccucaugaucaagaaggagcacaucaagaagcuccgcgagaugaacaccgaggccgagaagcucaaguccuacuccaugcccaucuccaucgaguuccagcgccgcuacgccaccaucguccucgagcucgagcagcucaacaaggaccucaacaagguccuccacaagguccagcaguacugcuacgagcucgcccccgaccagggccuccagcccgccgaccagcccaccgacaugcgccgccgcugcgaggaggaggcccaggagaucguccgccacgccaacuccuccaccggccagcccugcgucgagaacgagaaccucaccgaccucaucucccgccucaccgccauccuccuccagaucaagugccucgccgagggcggcgaccucaacuccuucgaguucaagucccucaccgacucccucaacgacaucaaguccaccaucgacgccuccaacaucuccugcuuccagaacaacgucgagauccacgucgcccacauccaguccggccucucccagaugggcaaccuccacgccuucgccgccaacaacaccaaccgcgacuga

SEQ ID NO: 45401 - RNA, 1845 nt, Artificial Sequence
  derived and/or modified sequence opt2 from LINGO1__Homo_sapiens__NP_001288126
augcucgccggcggcguccgcuccaugcccuccccccuccucgccugcuggcagcccauccuccuccucguccucggcuccguccucuccggcuccgccaccggcugccccccccgcugcgagugcuccgcccaggaccgcgccguccucugccaccgcaagcgcuucgucgccguccccgagggcauccccaccgagacccgccuccucgaccucggcaagaaccgcaucaagacccucaaccaggacgaguucgccuccuucccccaccucgaggagcucgagcucaacgagaacaucgucuccgccgucgagcccggcgccuucaacaaccucuucaaccuccgcacccucggccuccgcuccaaccgccucaagcucaucccccucggcgucuucaccggccucuccaaccucaccaagcucgacaucuccgagaacaagaucgucauccuccucgacuacauguuccaggaccucuacaaccucaagucccucgaggucggcgacaacgaccucgucuacaucucccaccgcgccuucuccggccucaacucccucgagcagcucacccucgagaagugcaaccucaccuccauccccaccgaggcccucucccaccuccacggccucaucguccuccgccuccgccaccucaacaucaacgccauccgcgacuacuccuucaagcgccucuaccgccucaagguccucgagaucucccacuggcccuaccucgacaccaugacccccaacugccucuacggccucaaccucaccucccucuccaucacccacugcaaccucaccgccguccccuaccucgccguccgccaccucgucuaccuccgcuuccucaaccucuccuacaaccccaucuccaccaucgagggcuccaugcuccacgagcuccuccgccuccaggagauccagcucgucggcggccagcucgccgucgucgagcccuacgccuuccgcggccucaacuaccuccgcguccucaacgucuccggcaaccagcucaccacccucgaggaguccgucuuccacuccgucggcaaccucgagacccucauccucgacuccaacccccucgccugcgacugccgccuccucugggucuuccgccgccgcuggcgccucaacuucaaccgccagcagcccaccugcgccacccccgaguucguccagggcaaggaguucaaggacuuccccgacguccuccuccccaacuacuucaccugccgccgcgcccgcauccgcgaccgcaaggcccagcaggucuucgucgacgagggccacaccguccaguucgucugccgcgccgacggcgaccccccccccgccauccucuggcucuccccccgcaagcaccucgucuccgccaaguccaacggccgccucaccgucuuccccgacggcacccucgagguccgcuacgcccagguccaggacaacggcaccuaccucugcaucgccgccaacgccggcggcaacgacuccaugcccgcccaccuccacguccgcuccuacucccccgacuggccccaccagcccaacaagaccuucgccuucaucuccaaccagcccggcgagggcgaggccaacuccacccgcgccaccguccccuuccccuucgacaucaagacccucaucaucgccaccaccaugggcuucaucuccuuccucggcgucguccucuucugccucguccuccucuuccucuggucccgcggcaagggcaacaccaagcacaacaucgagaucgaguacgucccccgcaaguccgacgccggcaucuccuccgccgacgccccccgcaaguucaacaugaagaugaucuga

SEQ ID NO: 45402 - RNA, 1821 nt, Artificial Sequence
  derived and/or modified sequence opt2 from LINGO2__Homo_sapiens__XP_011516032
augcuccacaccgccaucuccugcuggcagcccuuccucggccucgccgucguccucaucuucaugggcuccaccaucggcugccccgcccgcugcgagugcuccgcccagaacaaguccgucuccugccaccgccgccgccucaucgccauccccgagggcauccccaucgagaccaagauccucgaccucuccaagaaccgccucaaguccgucaaccccgaggaguucaucuccuacccccuccucgaggagaucgaccucuccgacaacaucaucgccaacgucgagcccggcgccuucaacaaccucuucaaccuccgcucccuccgccucaagggcaaccgccucaagcucgucccccucggcgucuucaccggccucuccaaccucaccaagcucgacaucuccgagaacaagaucgucauccuccucgacuacauguuccaggaccuccacaaccucaagucccucgaggucggcgacaacgaccucgucuacaucucccaccgcgccuucuccggccuccucucccucgagcagcucacccucgagaagugcaaccucaccgccguccccaccgaggcccucucccaccuccgcucccucaucucccuccaccucaagcaccucaacaucaacaacaugcccgucuacgccuucaagcgccucuuccaccucaagcaccucgagaucgacuacuggccccuccucgacaugaugcccgccaacucccucuacggccucaaccucaccucccucuccgucaccaacaccaaccucuccaccguccccuuccucgccuucaagcaccucgucuaccucacccaccucaaccucuccuacaaccccaucuccaccaucgaggccggcauguucuccgaccucauccgccuccaggagcuccacaucgucggcgcccagcuccgcaccaucgagccccacuccuuccagggccuccgcuuccuccgcguccucaacgucucccagaaccuccucgagacccucgaggagaacgucuucuccuccccccgcgcccucgagguccucuccaucaacaacaacccccucgccugcgacugccgccuccucuggauccuccagcgccagcccacccuccaguucggcggccagcagcccaugugcgccggccccgacaccauccgcgagcgcuccuucaaggacuuccacuccaccgcccucuccuucuacuucaccugcaagaagcccaagauccgcgagaagaagcuccagcaccuccucgucgacgagggccagaccguccagcucgagugcuccgccgacggcgacccccagcccgucaucuccugggucaccccccgccgccgcuucaucaccaccaaguccaacggccgcgccaccguccucggcgacggcacccucgagauccgcuucgcccaggaccaggacuccggcauguacgucugcaucgccuccaacgccgccggcaacgacaccuucaccgccucccucaccgucaagggcuucgccuccgaccgcuuccucuacgccaaccgcacccccauguacaugaccgacuccaacgacaccaucuccaacggcaccaacgccaacaccuucucccucgaccucaagaccauccucgucuccaccgccaugggcugcuucaccuuccucggcgucguccucuucugcuuccuccuccucuucgucuggucccgcggcaagggcaagcacaagaacuccaucgaccucgaguacgucccccgcaagaacaacggcgccgucgucgagggcgaggucgccggcccccgccgcuucaacaugaagaugaucuga

SEQ ID NO: 45403 - RNA, 1782 nt, Artificial Sequence
  derived and/or modified sequence opt2 from LINGO4__Homo_sapiens__NP_001004432
auggacgccgccaccgcccccaagcaggccuggccccccuggcccccccuccucuuccuccuccuccuccccggcggcuccggcggcuccugccccgccgucugcgacugcaccucccagccccaggccguccucugcggccaccgccagcucgaggccguccccggcggccucccccucgacaccgagcuccucgaccucuccggcaaccgccucuggggccuccagcagggcaugcucucccgccucucccuccuccaggagcucgaccucuccuacaaccagcucuccacccucgagcccggcgccuuccacggccuccagucccuccucacccuccgccuccagggcaaccgccuccgcaucaugggccccggcgucuucuccggccucuccgcccucacccuccucgaccuccgccucaaccagaucguccucuuccucgacggcgccuucggcgagcucggcucccuccagaagcucgaggucggcgacaaccaccucgucuucgucgcccccggcgccuucgccggccucgccaagcucuccacccucacccucgagcgcugcaaccucuccaccguccccggccucgcccucgcccgccuccccgcccucgucgcccuccgccuccgcgagcucgacaucggccgccuccccgccggcgcccuccgcggccucggccagcucaaggagcucgagauccaccucuggcccucccucgaggcccucgaccccggcucccucgucggccucaaccucuccucccucgccaucacccgcugcaaccucuccuccguccccuuccaggcccucuaccaccucuccuuccuccgcguccucgaccucucccagaaccccaucuccgccauccccgcccgccgccucuccccccucguccgccuccaggagcuccgccucuccggcgccugccucaccuccaucgccgcccacgccuuccacggccucaccgccuuccaccuccucgacgucgccgacaacgcccuccagacccucgaggagaccgccuuccccucccccgacaagcucgucacccuccgccucuccggcaacccccucaccugcgacugccgccuccucuggcuccuccgccuccgccgccaccucgacuucggcauguccccccccgccugcgccggcccccaccacguccagggcaagucccucaaggaguucuccgacauccucccccccggccacuucaccugcaagcccgcccucauccgcaaguccggcccccgcugggucaucgccgaggagggcggccacgccgucuucuccugcuccggcgacggcgaccccgcccccaccgucuccuggaugcgcccccacggcgccuggcucggccgcgccggccgcguccgcguccucgaggacggcacccucgagauccgcuccguccagcuccgcgaccgcggcgccuacgucugcgucgucuccaacgucgccggcaacgacucccuccgcaccuggcucgaggucauccaggucgagccccccaacggcacccucuccgaccccaacaucaccguccccggcauccccggccccuucuuccucgacucccgcggcgucgccaugguccucgccgucggcuuccuccccuuccucaccuccgucacccucugcuucggccucaucgcccucugguccaagggcaagggccgcgucaagcaccacaugaccuucgacuucgucgccccccgccccuccggcgacaagaacuccggcggcaaccgcgucaccgccaagcucuucuga

SEQ ID NO: 45404 - RNA, 2274 nt, Artificial Sequence
  derived and/or modified sequence opt2 from LINS__Homo_sapiens__NP_001035706
augaaggucuucugcgagguccucgaggagcucuacaagaagguccuccucggcgccacccucgagaacgacucccacgacuacaucuucuaccucaaccccgccgucuccgaccaggacugcuccaccgccaccucccucgagugggccaacaccugcggcauccagggccgccaccagcccaucuccgucggcgucgcccccaucgccgucgcccccgucugccucaagaccaacucccagauguccggcucccgcgaggucaugcuccuccagcucaccgucaucaaggucaugaccacccgcauccucuccgucaagaccgaguuccacgccaaggagcaguaccgcgacgucaucaagauccuccucgaguccgccaaggucgacuccaagcucaucugcauguuccagaacuccgacaagcuccucucccacauggccgcccagugccucgcccuccuccucuacuuccagcuccgcgagaagaucacccucuccaacuccuggaucgccuucugccagaagaaccucuccgaguacuccgaguccaacaaggccaucuacugccucuggacccucaccgccaucaucaaggagaucuucaaggacuccugcucccagaagaccgagauccucaagcaguuccucacccacuucgacaccaucuucgaggucuucuacaacucccucuucucccagcacuucgagaacugccgcgacaccuccaagaucgucaacauccucaugugcuuccucgaccuccucgagcuccucaucgccucccgcauccaccucaagcuccacuucaccugccagcgcauccucuuccucaagcccuccugcaugcucgaggucaucaccuggcccauccaggccuucgucaagcgcaaggucaucaucuuccucaagaagugccuccucugcaaggucggcgaggaccucugccgcggcuccguccccgcccucaugccccccgaccaccacgucgccgucgacaugcucgcccucgccaacgccguccuccaggccgucaacuccggccuccucaagacccucuccgucuacgagaagcacuccuucuucggcggcgacgagguccagcccgagugcgagcucaucaccucccccgaccacgucauccuccgcgccgccucccucgucaucaugaagucccucgagaucaaguuccagaacuacuccuccgccuccgagaugaaggucgaccuccagcgcuucauguccgagcuccucaccuuccucaagccccaccuccagcccucccuccagcuccacaaccccugcaaguggcucucccgcgucuucaucgagcaggacgacgacaugcucgaggccgccaaggccucccucggcaucuaccucacccucacccgcggcugcgaggccaccgagucccucacccagggcaaggagaugugggaccaccacacccacgagaacggcuacaacccccacugcaucuuccucuucuuccucaagaacaucggcuucgacuccaccguccuccucgacuuccucaucuccuccgagaccugcuuccucgaguacuucguccgcuaccucaagcuccuccagaaggacugggacaacuucuucaccaucugcaacaacuucgacgccaccgaguccaaguacgacaucuccaucugcggcugcguccccucccucguccaggaccaguccuccaaccagaccaucccccaccgccucaccgccccccacucccaccgcgacgucugcgcccgccacuccugggccuccgacgcccccuccgagccccucaaggccgucauguccaagggcgcccacaccaugugcgccuccucccucuccuccccccgcgccucccagucccucgucgacuacgacuccuccgacgacuccgacgucgaguccaccgagcagugccucgccaacuccaagcagaccucccuccaccagcaggccaccaaggagauccaggacgccgccggcaccucccgcgacaagaaggaguucucccucgagccccccucccgcccccucguccucaaggaguucgacaccgccuucuccuucgacugcgaggucgcccccaacgacgucgucuccgaggucggcaucuucuaccgcaucgucaagugcuuccaggagcuccaggacgccaucugccgccuccagaagaagaaccucuuccccuacaaccccaccgcccuccucaagcuccucaaguacaucgaggucaucuccaacaagaccaugaacacccucuga

SEQ ID NO: 45405 - RNA, 1200 nt, Artificial Sequence
  derived and/or modified sequence opt2 from LIPA__Homo_sapiens__NP_000226
augaagaugcgcuuccucggccucgucgucugccucguccucuggacccuccacuccgagggcuccggcggcaagcucaccgccgucgaccccgagaccaacaugaacgucuccgagaucaucuccuacuggggcuuccccuccgaggaguaccucgucgagaccgaggacggcuacauccucugccucaaccgcaucccccacggccgcaagaaccacuccgacaagggccccaagcccgucgucuuccuccagcacggccuccucgccgacuccuccaacugggucaccaaccucgccaacuccucccucggcuucauccucgccgacgccggcuucgacgucuggaugggcaacucccgcggcaacaccuggucccgcaagcacaagacccucuccgucucccaggacgaguucugggccuucuccuacgacgagauggccaaguacgaccuccccgccuccaucaacuucauccucaacaagaccggccaggagcaggucuacuacgucggccacucccagggcaccaccaucggcuucaucgccuucucccagauccccgagcucgccaagcgcaucaagauguucuucgcccucggccccgucgccuccgucgccuucugcaccucccccauggccaagcucggccgccuccccgaccaccucaucaaggaccucuucggcgacaaggaguuccucccccaguccgccuuccucaaguggcucggcacccacgucugcacccacgucauccucaaggagcucugcggcaaccucugcuuccuccucugcggcuucaacgagcgcaaccucaacaugucccgcgucgacgucuacaccacccacucccccgccggcaccuccguccagaacaugcuccacuggucccaggccgucaaguuccagaaguuccaggccuucgacuggggcuccuccgccaagaacuacuuccacuacaaccaguccuacccccccaccuacaacgucaaggacaugcucguccccaccgccgucugguccggcggccacgacuggcucgccgacgucuacgacgucaacauccuccucacccagaucaccaaccucgucuuccacgaguccauccccgagugggagcaccucgacuucaucuggggccucgacgcccccuggcgccucuacaacaagaucaucaaccucaugcgcaaguaccaguga

SEQ ID NO: 45406 - RNA, 1500 nt, Artificial Sequence
  derived and/or modified sequence opt2 from LIPC__Homo_sapiens__XP_005254429
auggacaccuccccccucugcuucuccauccuccucguccucugcaucuucauccaguccuccgcccucggccagucccucaagcccgagcccuucggccgccgcgcccaggccgucgagaccaacaagacccuccacgagaugaagacccgcuuccuccucuucggcgagaccaaccagggcugccagauccgcaucaaccaccccgacacccuccaggagugcggcuucaacuccucccucccccucgucaugaucauccacggcugguccgucgacggcguccucgagaacuggaucuggcagauggucgccgcccucaagucccagcccgcccagcccgucaacgucggccucgucgacuggaucacccucgcccacgaccacuacaccaucgccguccgcaacacccgccucgucggcaaggaggucgccgcccuccuccgcuggcucgaggaguccguccagcucucccgcucccacguccaccucaucggcuacucccucggcgcccacgucuccggcuucgccggcuccuccaucggcggcacccacaagaucggccgcaucaccggccucgacgccgccggcccccucuucgagggcuccgcccccuccaaccgccucucccccgacgacgccaacuucgucgacgccauccacaccuucacccgcgagcacaugggccucuccgucggcaucaagcagcccaucggccacuacgacuucuaccccaacggcggcuccuuccagcccggcugccacuuccucgagcucuaccgccacaucgcccagcacggcuucaacgccaucacccagaccaucaagugcucccacgagcgcuccguccaccucuucaucgacucccuccuccacgccggcacccaguccauggccuaccccugcggcgacaugaacuccuucucccagggccucugccucuccugcaagaagggccgcugcaacacccucggcuaccacguccgccaggagccccgcuccaaguccaagcgccucuuccucgucacccgcgcccagucccccuucaaggucuaccacuaccaguucaagauccaguucaucaaccagaccgagacccccauccagaccaccuucaccaugucccuccucggcaccaaggagaagaugcagaagauccccaucacccucggcaagggcaucgccuccaacaagaccuacuccuuccucaucacccucgacgucgacaucggcgagcucaucaugaucaaguucaagugggagaacuccgccgucugggccaacgucugggacaccguccagaccaucauccccugguccaccggcccccgccacuccggccucguccucaagaccauccgcgucaaggccggcgagacccagcagcgcaugaccuucugcuccgagaacaccgacgaccuccuccuccgccccacccaggagaagaucuucgucaagugcgagaucaaguccaagaccuccaagcgcaagauccgcuga

SEQ ID NO: 45407 - RNA, 3231 nt, Artificial Sequence
  derived and/or modified sequence opt2 from LIPE__Homo_sapiens__NP_005348
auggagcccggcuccaaguccgucucccgcuccgacuggcagcccgagccccaccagcgccccaucaccccccucgagcccggccccgagaagacccccaucgcccagcccgaguccaagacccuccagggcuccaacacccagcagaagcccgccuccaaccagcgcccccucacccagcaggagacccccgcccagcacgacgccgagucccagaaggagccccgcgcccagcagaaguccgccucccaggaggaguuccucgccccccagaagcccgccccccagcagucccccuacauccagcgcguccuccucacccagcaggaggccgccucccagcagggccccggccucggcaaggaguccaucacccagcaggagcccgcccuccgccagcgccacgucgcccagcccggccccggccccggcgagcccccccccgcccagcaggaggccgaguccacccccgccgcccaggccaagcccggcgccaagcgcgagcccuccgcccccaccgaguccaccucccaggagacccccgagcaguccgacaagcagaccacccccguccagggcgccaaguccaagcagggcucccucaccgagcucggcuuccucaccaagcuccaggagcucuccauccagcgcuccgcccucgaguggaaggcccucuccgagugggucaccgacuccgaguccgaguccgacgucggcuccuccuccgacaccgacucccccgccaccaugggcggcauggucgcccagggcgucaagcucggcuucaagggcaaguccggcuacaaggucauguccggcuacuccggcaccuccccccacgagaagaccuccgcccgcaaccaccgccacuaccaggacaccgccucccgccucauccacaacauggaccuccgcaccaugacccagucccucgucacccucgccgaggacaacaucgccuucuucuccucccagggccccggcgagaccgcccagcgccucuccggcgucuucgccggcguccgcgagcaggcccucggccucgagcccgcccucggccgccuccucggcgucgcccaccucuucgaccucgaccccgagacccccgccaacggcuaccgcucccucguccacaccgcccgcugcugccucgcccaccuccuccacaagucccgcuacgucgccuccaaccgccgcuccaucuucuuccgcaccucccacaaccucgccgagcucgaggccuaccucgccgcccucacccagcuccgcgcccucgucuacuacgcccagcgccuccucgucaccaaccgccccggcguccucuucuucgagggcgacgagggccucaccgccgacuuccuccgcgaguacgucacccuccacaagggcugcuucuacggccgcugccucggcuuccaguucacccccgccauccgccccuuccuccagaccaucuccaucggccucgucuccuucggcgagcacuacaagcgcaacgagaccggccucuccgucgccgccuccucccucuucaccuccggccgcuucgccaucgaccccgagcuccgcggcgccgaguucgagcgcaucacccagaaccucgacguccacuucuggaaggccuucuggaacaucaccgagauggagguccucuccucccucgccaacauggccuccgccaccguccgcgucucccgccuccucucccucccccccgaggccuucgagaugccccucaccgccgaccccacccucaccgucaccaucucccccccccucgcccacaccggccccggccccguccucguccgccucaucuccuacgaccuccgcgagggccaggacuccgaggagcucuccucccucaucaaguccaacggccagcgcucccucgagcucuggccccgcccccagcaggccccccgcucccgcucccucaucguccacuuccacggcggcggcuucgucgcccagaccucccgcucccacgagcccuaccucaaguccugggcccaggagcucggcgcccccaucaucuccaucgacuacucccucgcccccgaggcccccuucccccgcgcccucgaggagugcuucuucgccuacugcugggccaucaagcacugcgcccuccucggcuccaccggcgagcgcaucugccucgccggcgacuccgccggcggcaaccucugcuucaccgucgcccuccgcgccgccgccuacggcguccgcguccccgacggcaucauggccgccuaccccgccaccaugcuccagcccgccgccucccccucccgccuccucucccucauggacccccuccucccccucuccguccucuccaagugcgucuccgccuacgccggcgccaagaccgaggaccacuccaacuccgaccagaaggcccucggcaugaugggccucguccgccgcgacaccgcccuccuccuccgcgacuuccgccucggcgccuccuccuggcucaacuccuuccucgagcucuccggccgcaagucccagaagauguccgagcccaucgccgagcccaugcgccgcuccgucuccgaggccgcccucgcccagccccagggcccccucggcaccgacucccucaagaaccucacccuccgcgaccucucccuccgcggcaacuccgagaccuccuccgacacccccgagaugucccucuccgccgagacccucucccccuccacccccuccgacgucaacuuccuccucccccccgaggacgccggcgaggaggccgaggccaagaacgagcucucccccauggaccgcggccucggcguccgcgccgccuuccccgagggcuuccacccccgccgcuccucccagggcgccacccagaugccccucuacuccucccccaucgucaagaaccccuucauguccccccuccucgcccccgacuccaugcucaagucccucccccccguccacaucgucgccugcgcccucgaccccaugcucgacgacuccgucaugcucgcccgccgccuccgcaaccucggccagcccgucacccuccgcgucgucgaggaccucccccacggcuuccucacccucgccgcccucugccgcgagacccgccaggccgccgagcucugcgucgagcgcauccgccucguccucaccccccccgccggcgccggccccuccggcgagaccggcgccgccggcgucgacggcggcugcggcggccgccacuga

SEQ ID NO: 45408 - RNA, 1098 nt, Artificial Sequence
  derived and/or modified sequence opt2 from LIPF__Homo_sapiens__NP_001185757
auguggcuccuccucaccauggccucccucaucuccguccucggcaccacccacggccucuucggcaagcuccaccccggcucccccgaggucaccaugaacaucucccagaugaucaccuacuggggcuaccccaacgaggaguacgaggucgucaccgaggacggcuacauccucgaggucaaccgcauccccuacggcaagaagaacuccggcaacaccgacgccggcuacgacgucuggcucggcaacucccgcggcaacaccugggcccgccgcaaccucuacuacucccccgacuccgucgaguucugggccuucuccuucgacgagauggccaaguacgaccuccccgccaccaucgacuucaucgucaagaagaccggccagaagcagcuccacuacgucggccacucccagggcaccaccaucggcuucaucgccuucuccaccaaccccucccucgccaagcgcaucaagaccuucuacgcccucgcccccgucgccaccgucaaguacaccaagucccucaucaacaagcuccgcuucgucccccagucccucuucaaguucaucuucggcgacaagaucuucuacccccacaacuucuucgaccaguuccucgccaccgaggucugcucccgcgagaugcucaaccuccucugcuccaacgcccucuucaucaucugcggcuucgacuccaagaacuucaacaccucccgccucgacgucuaccucucccacaaccccgccggcaccuccguccagaacauguuccacuggacccaggccgucaaguccggcaaguuccaggccuacgacuggggcucccccguccagaaccgcaugcacuacgaccagucccagccccccuacuacaacgucaccgccaugaacguccccaucgccgucuggaacggcggcaaggaccuccucgccgacccccaggacgucggccuccuccuccccaagcuccccaaccucaucuaccacaaggagauccccuucuacaaccaccucgacuucaucugggccauggacgccccccaggaggucuacaacgacaucgucuccaugaucuccgaggacaagaaguga

SEQ ID NO: 45409 - RNA, 1503 nt, Artificial Sequence
  derived and/or modified sequence opt2 from LIPG__Homo_sapiens__NP_006024
auguccaacuccgucccccuccucugcuucuggucccucugcuacugcuucgccgccggcucccccguccccuucggccccgagggccgccucgaggacaagcuccacaagcccaaggccacccagaccgaggucaagcccuccguccgcuucaaccuccgcaccuccaaggaccccgagcacgagggcugcuaccucuccgucggccacucccagccccucgaggacugcuccuucaacaugaccgccaagaccuucuucaucauccacggcuggaccauguccggcaucuucgagaacuggcuccacaagcucgucuccgcccuccacacccgcgagaaggacgccaacgucgucgucgucgacuggcucccccucgcccaccagcucuacaccgacgccgucaacaacacccgcgucgucggccacuccaucgcccgcaugcucgacuggcuccaggagaaggacgacuucucccucggcaacguccaccucaucggcuacucccucggcgcccacgucgccggcuacgccggcaacuucgucaagggcaccgucggccgcaucaccggccucgaccccgccggccccauguucgagggcgccgacauccacaagcgccucucccccgacgacgccgacuucgucgacguccuccacaccuacacccgcuccuucggccucuccaucggcauccagaugcccgucggccacaucgacaucuaccccaacggcggcgacuuccagcccggcugcggccucaacgacguccucggcuccaucgccuacggcaccaucaccgaggucgucaagugcgagcacgagcgcgccguccaccucuucgucgacucccucgucaaccaggacaagcccuccuucgccuuccagugcaccgacuccaaccgcuucaagaagggcaucugccucuccugccgcaagaaccgcugcaacuccaucggcuacaacgccaagaagaugcgcaacaagcgcaacuccaagauguaccucaagacccgcgccggcaugcccuuccgcgucuaccacuaccagaugaagauccacgucuucuccuacaagaacaugggcgagaucgagcccaccuucuacgucacccucuacggcaccaacgccgacucccagacccucccccucgagaucgucgagcgcaucgagcagaacgccaccaacaccuuccucgucuacaccgaggaggaccucggcgaccuccucaagauccagcucaccugggagggcgccucccaguccugguacaaccucuggaaggaguuccgcuccuaccucucccagccccgcaaccccggccgcgagcucaacauccgccgcauccgcgucaaguccggcgagacccagcgcaagcucaccuucugcaccgaggaccccgagaacaccuccaucucccccggccgcgagcucugguuccgcaagugccgcgacggcuggcgcaugaagaacgagaccucccccaccgucgagcuccccuga

SEQ ID NO: 45410 - RNA, 1356 nt, Artificial Sequence
  derived and/or modified sequence opt2 from LIPH__Homo_sapiens__NP_640341
augcuccgcuucuaccucuucaucucccuccucugccucucccgcuccgacgccgaggagaccugccccuccuucacccgccucuccuuccacuccgccgucgucggcaccggccucaacguccgccucaugcucuacacccgcaagaaccucaccugcgcccagaccaucaacuccuccgccuucggcaaccucaacgucaccaagaagaccaccuucaucguccacggcuuccgccccaccggcuccccccccgucuggauggacgaccucgucaagggccuccucuccgucgaggacaugaacgucgucgucgucgacuggaaccgcggcgccaccacccucaucuacacccacgccuccuccaagacccgcaaggucgccaugguccucaaggaguucaucgaccagaugcucgccgagggcgccucccucgacgacaucuacaugaucggcgucucccucggcgcccacaucuccggcuucgucggcgagauguacgacggcuggcucggccgcaucaccggccucgaccccgccggcccccucuucaacggcaagccccaccaggaccgccucgaccccuccgacgcccaguucgucgacgucauccacuccgacaccgacgcccucggcuacaaggagccccucggcaacaucgacuucuaccccaacggcggccucgaccagcccggcugccccaagaccauccucggcggcuuccaguacuucaagugcgaccaccagcgcuccgucuaccucuaccucuccucccuccgcgaguccugcaccaucaccgccuaccccugcgacuccuaccaggacuaccgcaacggcaagugcgucuccugcggcaccucccagaaggaguccugcccccuccucggcuacuacgccgacaacuggaaggaccaccuccgcggcaaggacccccccaugaccaaggccuucuucgacaccgccgaggagucccccuucugcauguaccacuacuucgucgacaucaucaccuggaacaagaacguccgccgcggcgacaucaccaucaagcuccgcgacaaggccggcaacaccaccgaguccaagaucaaccacgagcccaccaccuuccagaaguaccaccaggucucccuccucgcccgcuucaaccaggaccucgacaaggucgccgccaucucccucauguucuccaccggcucccucaucggcccccgcuacaagcuccgcauccuccgcaugaagcuccgcucccucgcccaccccgagcgcccccagcucugccgcuacgaccucguccucauggagaacgucgagaccgucuuccagcccauccucugccccgagcuccagcucuga

SEQ ID NO: 45411 - RNA, 1383 nt, Artificial Sequence
  derived and/or modified sequence opt2 from LIPI__Homo_sapiens__NP_001289927
augcgcgucuacaucuuccucugccucaugugcuggguccgcuccgacaacaagcgccccugccucgaguucucccagcucuccgucaaggacuccuuccgcgaccucuucaucccccgcaucgagaccauccucaugauguacacccgcaacaaccucaacugcgccgagccccucuucgagcagaacaacucccucaacgucaacuucaacacccagaagaagaccgucuggcucauccacggcuaccgccccgucggcuccaucccccucuggcuccagaacuucguccgcauccuccucaacgaggaggacaugaacgucaucgucgucgacuggucccgcggcgccaccaccuucaucuacaaccgcgccgucaagaacacccgcaaggucgccgucucccucuccguccacaucaagaaccuccucaagcacggcgccucccucgacaacuuccacuucaucggcgucucccucggcgcccacaucuccggcuucgucggcaagaucuuccacggccagcucggccgcaucaccggccucgaccccgccggcccccgcuucucccgcaagccccccuacucccgccucgacuacaccgacgccaaguucgucgacgucauccacuccgacuccaacggccucggcauccaggagccccucggccacaucgacuucuaccccaacggcggcaacaagcagcccggcugccccaaguccaucuucuccggcauccaguucaucaagugcaaccaccagcgcgccguccaccucuucauggccucccucgagaccaacugcaacuucaucuccuuccccugccgcuccuacaaggacuacaagaccucccucugcgucgacugcgacugcuucaaggagaaguccugcccccgccucggcuaccaggccaagcucuucaagggcguccucaaggagcgcauggagggccgcccccuccgcaccaccgucuuccucgacaccuccggcaccuaccccuucugcaccuacuacuucguccucuccaucaucguccccgacaagaccaugauggacggcuccuucuccuucaagcuccucaaccagcucggcaugaucgaggagccccgccucuacgagaagaacaagcccuucuacaagcuccaggaggucaagauccucgcccaguucuacaacgacuucgucaacaucuccuccaucggccucaccuacuuccaguccuccaaccuccagugcuccaccugcaccuacaagauccagucccucaugcucaagucccucaccuaccccgagcgccccccccucugccgcuacaacaucguccucaaggaccgcgaggaggucuuccucaaccccaacaccugcacccccaagaacaccuga

SEQ ID NO: 45412 - RNA, 1197 nt, Artificial Sequence
  derived and/or modified sequence opt2 from LIPN__Homo_sapiens__NP_001095939
augauguggcuccuccucaccaccaccugccucaucugcggcacccucaacgccggcggcuuccucgaccucgagaacgaggucaaccccgaggucuggaugaacaccuccgagaucaucaucuacaacggcuaccccuccgaggaguacgaggucaccaccgaggacggcuacauccuccucgucaaccgcauccccuacggccgcacccacgcccgcuccaccggcccccgccccgucgucuacaugcagcacgcccucuucgccgacaacgccuacuggcucgagaacuacgccaacggcucccucggcuuccuccucgccgacgccggcuacgacgucuggaugggcaacucccgcggcaacaccuggucccgccgccacaagacccucuccgagaccgacgagaaguucugggccuucuccuucgacgagauggccaaguacgaccuccccggcgucaucgacuucaucgucaacaagaccggccaggagaagcucuacuucaucggccacucccucggcaccaccaucggcuucgucgccuucuccaccaugcccgagcucgcccagcgcaucaagaugaacuucgcccucggccccaccaucuccuucaaguaccccaccggcaucuucacccgcuucuuccuccuccccaacuccaucaucaaggccgucuucggcaccaagggcuucuuccucgaggacaagaagaccaagaucgccuccaccaagaucugcaacaacaagauccucuggcucaucugcuccgaguucaugucccucugggccggcuccaacaagaagaacaugaaccagucccgcauggacgucuacaugucccacgcccccaccggcuccuccguccacaacauccuccacaucaagcagcucuaccacuccgacgaguuccgcgccuacgacuggggcaacgacgccgacaacaugaagcacuacaaccagucccacccccccaucuacgaccucaccgccaugaagguccccaccgccaucugggccggcggccacgacguccucgucaccccccaggacgucgcccgcauccucccccagaucaagucccuccacuacuucaagcuccuccccgacuggaaccacuucgacuucgucuggggccucgacgccccccagcgcauguacuccgagaucaucgcccucaugaaggccuacuccuga

SEQ ID NO: 45413 - RNA, 1122 nt, Artificial Sequence
  derived and/or modified sequence opt2 from LIPT1__Homo_sapiens__NP_057013
augcucauccccuucuccaugaagaacugcuuccagcuccucugcaacugccagguccccgccgccggcuucaagaagaccgucaagaacggccucauccuccaguccaucuccaacgacgucuaccagaaccucgccgucgaggacuggauccacgaccacaugaaccucgagggcaagcccauccucuucuucuggcagaacucccccuccgucgucaucggccgccaccagaaccccuggcaggagugcaaccucaaccucaugcgcgaggagggcaucaagcucgcccgccgccgcuccggcggcggcaccgucuaccacgacaugggcaacaucaaccucaccuucuucaccaccaagaagaaguacgaccgcauggagaaccucaagcucaucguccgcgcccucaacgccguccagccccagcucgacguccaggccaccaagcgcuucgaccuccuccucgacggccaguucaagaucuccggcaccgccuccaagaucggccgcaccaccgccuaccaccacugcacccuccucugcuccaccgacggcaccuuccucuccucccuccucaagucccccuaccagggcauccgcuccaacgccaccgccuccauccccucccucgucaagaaccuccucgagaaggaccccacccucaccugcgagguccucaugaacgccgucgccaccgaguacgccgccuaccaccagaucgacaaccacauccaccucaucaaccccaccgacgagacccucuuccccggcaucaacuccaaggccaaggagcuccagaccugggaguggaucuacggcaagacccccaaguucuccaucaacaccuccuuccacguccucuacgagcagucccaccucgagaucaaggucuucaucgacaucaagaacggccgcaucgagaucugcaacaucgaggcccccgaccacuggcucccccucgagauccgcgacaagcucaacuccucccucaucggcuccaaguucugccccaccgagaccaccaugcucaccaacauccuccuccgcaccugcccccaggaccacaagcucaacuccaaguggaacauccucugcgagaagaucaagggcaucauguga

SEQ ID NO: 45414 - RNA, 696 nt, Artificial Sequence
  derived and/or modified sequence opt2 from LIPT2__Homo_sapiens__NP_001138341
augcgccagcccgccguccgccucguccgccucggccgcguccccuacgccgagcuccucggccuccaggaccgcuggcuccgccgccuccaggccgagcccggcaucgaggcccccuccggcaccgaggccggcgcccuccuccucugcgagcccgccggccccgucuacaccgccggccuccgcggcggccucacccccgaggagaccgcccgccuccgcgcccucggcgccgagguccgcgucaccggccgcggcggccucgccaccuuccacggccccggccagcuccucugccaccccguccucgaccuccgccgccucggccuccgccuccgcaugcacgucgccucccucgaggccugcgccguccgccucugcgagcuccagggccuccaggacgcccgcgcccgccccccccccuacaccggcgucuggcucgacgaccgcaagaucugcgccaucggcguccgcugcggccgccacaucaccucccacggccucgcccucaacugcuccaccgaccucaccugguucgagcacaucguccccugcggccucgucggcaccggcgucaccucccucuccaaggagcuccagcgccacgucaccgucgaggaggucaugccccccuuccucgucgccuucaaggagaucuacaagugcacccucaucuccgaggacucccccaacuga

SEQ ID NO: 45415 - RNA, 459 nt, Artificial Sequence
  derived and/or modified sequence opt2 from LITAF__Homo_sapiens__NP_001129945
auguccguccccggccccuaccaggccgccaccggccccuccuccgcccccuccgccccccccuccuacgaggagaccgucgccgucaacuccuacuaccccaccccccccgcccccaugcccggccccaccaccggccucgucaccggccccgacggcaagggcaugaacccccccuccuacuacacccagcccgcccccauccccaacaacaaccccaucaccguccagaccgucuacguccagcaccccaucaccuuccucgaccgccccauccagaugugcugccccuccugcaacaagaugaucgucucccagcucuccuacaacgccggcgcccucaccuggcucuccugcggcucccucugccuccucggccaggagugcuccggcaccaucgucgcccuccgcuccuucgaccuccucggcuccugcaacccccccuccuccgccuccuga

SEQ ID NO: 45416 - RNA, 849 nt, Artificial Sequence
  derived and/or modified sequence opt2 from LIX1__Homo_sapiens__NP_694966
auggaccgcacccucgagucccuccgccacaucaucgcccagguccucccccaccgcgaccccgcccucgucuucaaggaccucaacgucgucuccaugcuccaggaguucugggaguccaagcagcagcagaaggccgccuuccccuccgagggcgucgucgucuacgagucccuccccgcccccggcccccccuucgucuccuacgucacccuccccggcggcuccugcuucggcaacuuccagugcugccucucccgcgccgaggcccgccgcgacgccgccaaggucgcccucaucaacucccucuucaacgagcuccccucccgccgcaucaccaaggaguucaucauggaguccguccaggaggccgucgccuccaccuccggcacccucgacgacgccgacgaccccuccaccuccgucggcgccuaccacuacaugcucgaguccaacaugggcaagaccaugcucgaguuccaggagcucaugaccaucuuccagcuccuccacuggaacggcucccucaaggcccuccgcgagaccaagugcucccgccaggaggucaucuccuacuacucccaguacucccucgacgagaagaugcgcucccacauggcccucgacuggaucaugaaggagcgcgacucccccggcaucgucucccaggagcuccgcauggcccuccgccagcucgaggaggcccgcaaggccggccaggagcuccgcuucuacaaggagaagaaggagauccucucccucgcccucacccagaucugcuccgaccccgacaccuccucccccuccgacgaccagcucucccucaccgcccucugcggcuaccacuga

SEQ ID NO: 45417 - RNA, 3195 nt, Artificial Sequence
  derived and/or modified sequence opt2 from LLGL1__Homo_sapiens__NP_004131
augaugaaguuccgcuuccgccgccagggcgccgacccccagcgcgagaagcucaagcaggagcucuucgccuucaacaagaccgucgagcacggcuuccccaaccagcccuccgcccucgccuucgaccccgagcuccgcaucauggccaucggcacccgcuccggcgccgucaagaucuacggcgcccccggcgucgaguucaccggccuccaccgcgacgccgccaccgucacccagaugcacuuccucaccggccagggccgccuccucucccuccucgacgacuccucccuccaccucugggagaucguccaccacaacggcugcgcccaccucgaggaggcccucuccuuccagcuccccucccgccccggcuucgacggcgccuccgccccccucucccucacccgcgucaccgucguccuccucgucgccgccggcgacaucgccgcccucggcaccgagggcuccuccgucuucuuccucgacgucaccacccucacccuccucgagggccagacccucgcccccggcgagguccuccgcuccguccccgacgacuaccgcugcggcaaggcccucggccccgucgagucccuccagggccaccuccgcgaccccaccaagauccucaucggcuacucccgcggccuccucgucaucuggaaccaggccucccagugcgucgaccacaucuuccucggcaaccagcagcucgagucccucugcuggggccgcgacuccuccaccgucgucuccucccacuccgacggcuccuacgccgucugguccgucgacgccggcuccuuccccacccuccagcccaccgucgccaccacccccuacggccccuuccccugcaaggccaucaacaagauccucuggcgcaacugcgaguccggcggccacuucaucaucuucuccggcggcaugccccgcgccuccuacggcgaccgccacugcgucuccguccuccgcgccgagacccucgucacccucgacuucaccucccgcaucaucgacuucuucaccguccacuccacccgccccgaggacgaguucgacgacccccaggcccucgccguccuccucgaggaggagcucgucguccucgaccuccagacccccggcuggcccgccguccccgcccccuaccucgccccccuccacuccuccgccaucaccugcuccgcccacgucgccuccguccccgccaagcucugggcccgcaucgucuccgccggcgagcagcaguccccccagcccgucuccuccgcccucuccuggcccaucaccggcggccgcaaccucgcccaggagcccucccagcgcggccuccuccucaccggccacgaggacggcaccguccgcuucugggacgccuccggcgucgcccuccgcccccucuacaagcucuccaccgccggccucuuccagaccgacugcgagcacgccgacucccucgcccaggccgccgaggacgacuggccccccuuccgcaaggucggcugcuucgaccccuacuccgacgacccccgccucggcguccagaaggucgcccucugcaaguacaccgcccagauggucgucgccggcaccgccggccagguccucguccucgagcucuccgacguccccgucgagcaggccgucuccgucgccaucaucgaccuccuccaggaccgcgagggcuucaccuggaagggccacgagcgccucuccccccgcaccggcccccuccccuggcccgccggcuuccagccccgcguccucguccagugccucccccccgccgccgucaccgccgucacccuccacaccgaguggucccucgucgccuucggcaccucccacggcuucggccucuucgacuaccagcgcaagucccccguccucgcccgcugcacccuccaccccaacgacucccucgccauggagggcccccucucccgcgucaagucccucaagaagucccuccgccaguccuuccgccgcauccgcaagucccgcgucuccggcaagaagcgcgccgccaacgccuccuccaagcuccaggaggccaacgcccagcucgccgagcaggccugcccccacgacgucgagaugacccccguccagcgccgcaucgagccccgcuccgccgacgacucccucuccggcgucguccgcugccucuacuucgccgacaccuuccuccgcgacggcgcccaccacggccccaccaugugggccggcaccaacuccggcuccgucuucgccuacgcccucgagguccccgccgccgccgucggcggcgagaagcgccccgagcaggccgucgaggccguccucggcaaggagguccagcucaugcaccgcgcccccgucgucgccaucgccguccucgacggccgcggccgcccccuccccgagcccuacgaggccucccgcgaccucgcccaggcccccgacaugcagggcggccacgccguccucaucgccuccgaggagcaguucaaggucuucacccuccccaaggucuccgccaagaccaaguucaagcucaccgcccacgagggcugccgcguccgcaaggucgcccucgccaccuucgccuccgucgccugcgaggacuacgccgagaccugccucgccugccucaccaaccucggcgacguccacgucuucuccguccccggccuccgcccccagguccacuacuccugcauccgcaaggaggacaucuccggcaucgccuccugcgucuucacccgccacggccagggcuucuaccucaucucccccuccgaguucgagcgcuucucccucuccgcccgcaacaucaccgagccccucugcucccucgacaucaacuggccccgcgacgccacccaggccuccuaccgcauccgcgagucccccaagcucucccaggccaacggcacccccuccauccuccucgccccccagucccucgacggcucccccgaccccgcccacuccaugggccccgacacccccgagccccccgaggccgcccucucccccauguccaucgacuccgccaccuccgccgacaccacccucgacaccaccggcgacgucaccgucgaggacgucaaggacuuccucggcuccuccgaggaguccgagaagaaccuccgcaaccucgccgaggacgaggcccacgccugcgccauccucaucaaguga

SEQ ID NO: 45418 - RNA, 1071 nt, Artificial Sequence
  derived and/or modified sequence opt2 from LLGL2__Homo_sapiens__NP_001015002
augcgccgcuuccuccgccccggccacgaccccguccgcgagcgccucaagcgcgaccucuuccaguucaacaagaccgucgagcacggcuucccccaccagcccuccgcccucggcuacucccccucccuccgcauccucgccaucggcacccgcuccggcgccaucaagcucuacggcgcccccggcgucgaguucaugggccuccaccaggagaacaacgccgucacccagauccaccuccuccccggccagugccagcucgucacccuccucgacgacaacucccuccaccucuggucccucaaggucaagggcggcgccuccgagcuccaggaggacgaguccuucacccuccgcggcccccccggcgccgcccccuccgccacccagaucaccgucguccucccccacuccuccugcgagcuccucuaccucggcaccgaguccggcaacgucuucgucguccagcuccccgccuuccgcgcccucgaggaccgcaccaucuccuccgacgccguccuccagcgccuccccgaggaggcccgccaccgccgcgucuucgagauggucgaggcccuccaggagcacccccgcgaccccaaccagauccucaucggcuacucccgcggccucgucgucaucugggaccuccagggcucccgcguccucuaccacuuccucuccucccagcagcucgagaacaucugguggcagcgcgacggccgccuccucgucuccugccacuccgacggcuccuacugccaguggcccgucuccuccgaggcccagcagcccgagccccuccgcucccucguccccuacggccccuuccccugcaaggccaucacccgcauccucuggcucaccacccgccagggccuccccuucaccaucuuccagggcggcaugccccgcgccuccuacggcgaccgccacugcaucuccgucauccacgacggccagcagaccgccuucgacuucaccucccgcgucaucggcuucaccguccucaccgaggccgaccccgccgccucccgccgcgccuccggcgucggcgcccagggcuga

SEQ ID NO: 45419 - RNA, 1533 nt, Artificial Sequence
  derived and/or modified sequence opt2 from LMAN1__Homo_sapiens__NP_005561
auggccggcucccgccagcgcggccuccgcgcccgcguccgcccccucuucugcgcccuccuccucucccucggccgcuucguccgcggcgacggcgucggcggcgaccccgccgucgcccucccccaccgccgcuucgaguacaaguacuccuucaagggcccccaccucguccaguccgacggcaccguccccuucugggcccacgccggcaacgccauccccuccuccgaccagauccgcgucgcccccucccucaagucccagcgcggcuccgucuggaccaagaccaaggccgccuucgagaacugggaggucgaggucaccuuccgcgucaccggccgcggccgcaucggcgccgacggccucgccaucugguacgccgagaaccagggccucgagggccccgucuucggcuccgccgaccucuggaacggcgucggcaucuucuucgacuccuucgacaacgacggcaagaagaacaaccccgccaucgucaucaucggcaacaacggccagauccacuacgaccaccagaacgacggcgccucccaggcccucgccuccugccagcgcgacuuccgcaacaagcccuaccccguccgcgccaagaucaccuacuaccagaacacccucaccgucaugaucaacaacggcuucacccccgacaagaacgacuacgaguucugcgccaaggucgagaacaugaucauccccgcccagggccacuucggcaucuccgccgccaccggcggccucgccgacgaccacgacguccucuccuuccucaccuuccagcucaccgagcccggcaaggagccccccacccccgacaaggagaucuccgagaaggagaaggagaaguaccaggaggaguucgagcacuuccagcaggagcucgacaagaagaaggaggaguuccagaagggccaccccgaccuccagggccagcccgccgaggagaucuucgaguccgucggcgaccgcgagcuccgccaggucuucgagggccagaaccgcauccaccucgagaucaagcagcucaaccgccagcucgacaugauccucgacgagcagcgccgcuacgucuccucccucaccgaggagaucuccaagcgcggcgccggcaugcccggccagcacggccagaucacccagcaggagcucgacaccgucgucaagacccagcacgagauccuccgccaggucaacgagaugaagaacuccauguccgagaccguccgccucgucuccggcaugcagcaccccggcuccgccggcggcgucuacgagaccacccagcacuucaucgacaucaaggagcaccuccacaucgucaagcgcgacaucgacaaccucguccagcgcaacaugcccuccaacgagaagcccaagugccccgagcucccccccuuccccuccugccucuccaccguccacuucaucaucuucgucgucguccagaccguccucuucaucggcuacaucauguaccgcucccagcaggaggccgccgccaagaaguucuucuga

SEQ ID NO: 45420 - RNA, 1581 nt, Artificial Sequence
  derived and/or modified sequence opt2 from LMAN1L__Homo_sapiens__NP_068591
augcccgccgucuccggccccggcccccucuucugccuccuccuccuccuccucgacccccacucccccgagaccggcugccccccccuccgccgcuucgaguacaagcucuccuucaagggcccccgccucgcccuccccggcgccggcauccccuucuggucccaccacggcgacgccauccucggccucgaggagguccgccucacccccuccaugcgcaaccgcuccggcgccgucuggucccgcgccuccguccccuucuccgccugggaggucgagguccagaugcgcgucaccggccucggccgccgcggcgcccagggcauggccgucugguacacccgcggccgcggccacgucggcuccguccucggcggccucgccuccugggacggcaucggcaucuucuucgacucccccgccgaggacacccaggacucccccgccauccgcguccucgccuccgacggccacauccccuccgagcagcccggcgacggcgccucccagggccucggcuccugccacugggacuuccgcaaccgcccccaccccuuccgcgcccgcaucaccuacuggggccagcgccuccgcaugucccucaacuccggccucacccccuccgaccccggcgaguucugcgucgacgucggcccccuccuccucguccccggcggcuucuucggcgucuccgccgccaccggcacccucgccgacgaccacgacguccucuccuuccucaccuucucccucuccgagcccucccccgagguccccccccagcccuuccucgagaugcagcagcuccgccucgcccgccagcucgagggccucugggcccgccucggccucggcacccgcgaggacgucacccccaaguccgacuccgaggcccagggcgagggcgagcgccucuucgaccucgaggagacccucggccgccaccgccgcauccuccaggcccuccgcggccucuccaagcagcucgcccaggccgagcgccaguggaagaagcagcucggcccccccggccaggcccgccccgacggcggcugggcccucgacgccuccugccagauccccuccacccccggccgcggcggccaccucuccaugucccucaacaaggacuccgccaaggucggcgcccuccuccacggccaguggacccuccuccaggcccuccaggagaugcgcgacgccgccguccgcauggccgccgaggcccaggucuccuaccuccccgucggcaucgagcaccacuuccucgagcucgaccacauccucggccuccuccaggaggagcuccgcggccccgccaaggccgccgccaaggccccccgcccccccggccagcccccccgcgccuccuccugccuccagcccggcaucuuccucuucuaccuccucauccagaccgucggcuucuucggcuacguccacuuccgccaggagcucaacaagucccuccaggagugccucuccaccggcucccucccccucggccccgccccccacaccccccgcgcccucggcauccuccgccgccagccccuccccgccuccaugcccgccuga

SEQ ID NO: 45421 - RNA, 1080 nt, Artificial Sequence
  derived and/or modified sequence opt2 from LMAN2L__Homo_sapiens__NP_001135764
auggccgccacccucggcccccucggcuccuggcagcaguggcgccgcugccucuccgcccgcgacggcucccgcaugcuccuccuccuccuccuccucggcuccggccagggcccccagcaggucggcgccggccagaccuucgaguaccucaagcgcgagcacucccucuccaagcccuaccagggcgucggcaccggcuccuccucccucuggaaccucaugggcaacgccauggucaugacccaguacauccgccucacccccgacaugcaguccaagcagggcgcccucuggaaccgcguccccugcuuccuccgcgacugggagcuccagguccacuucaagauccacggccagggcaagaagaaccuccacggcgacggccucgccaucugguacaccaaggaccgcaugcagcccggccccgucuucggcaacauggacaaguucgucggccucggcgucuucgucgacaccuaccccaacgaggagaagcagcaggaggcccagaagcgccgcuacucccccggcguccagcgcgucuuccccuacaucuccgccauggucaacaacggcucccucuccuacgaccacgagcgcgacggccgccccaccgagcucggcggcugcaccgccaucguccgcaaccuccacuacgacaccuuccucgucauccgcuacgucaagcgccaccucaccaucaugauggacaucgacggcaagcacgaguggcgcgacugcaucgagguccccggcguccgccucccccgcggcuacuacuucggcaccuccuccaucaccggcgaccucuccgacaaccacgacgucaucucccucaagcucuucgagcucaccgucgagcgcacccccgaggaggagaagcuccaccgcgacgucuuccuccccuccgucgacaacaugaagcuccccgagaugaccgccccccuccccccccucuccggccucgcccucuuccucaucgucuucuucucccucgucuucuccgucuucgccaucgucaucggcaucauccucuacaacaaguggcaggagcagucccgcaagcgcuucuacuga

SEQ ID NO: 45422 - RNA, 1473 nt, Artificial Sequence
  derived and/or modified sequence opt2 from LMBR1__Homo_sapiens__NP_071903
auggagggccaggacgaggucuccgcccgcgagcagcacuuccacucccagguccgcgaguccaccaucugcuuccuccucuucgccauccucuacgucgucuccuacuucaucaucacccgcuacaagcgcaaguccgacgagcaggaggacgaggacgccaucgucaaccgcaucucccucuuccucuccaccuucacccucgccgucuccgccggcgccguccuccuccuccccuucuccaucaucuccaacgagauccuccucuccuucccccagaacuacuacauccaguggcucaacggcucccucauccacggccucuggaaccucgccucccucuucuccaaccucugccucuucguccucaugcccuucgccuucuucuuccucgaguccgagggcuucgccggccucaagaagggcauccgcgcccgcauccucgagacccucgucaugcuccuccuccucgcccuccucauccucggcaucgucugggucgccuccgcccucaucgacaacgacgccgccuccauggagucccucuacgaccucugggaguucuaccuccccuaccucuacuccugcaucucccucaugggcugccuccuccuccuccucugcacccccgucggccucucccgcauguucaccgucaugggccagcuccucgucaagcccaccauccucgaggaccucgacgagcagaucuacaucaucacccucgaggaggaggcccuccagcgccgccucaacggccucuccuccuccgucgaguacaacaucauggagcucgagcaggagcucgagaacgucaagacccucaagaccaagcucgagcgccgcaagaaggccuccgccugggagcgcaaccucgucuaccccgccgucaugguccuccuccucaucgagaccuccaucuccguccuccucgucgccugcaacauccucugccuccucgucgacgagaccgccaugcccaagggcacccgcggccccggcaucggcaacgccucccucuccaccuucggcuucgucggcgccgcccucgagaucauccucaucuucuaccucauggucuccuccgucgucggcuucuacucccuccgcuucuucggcaacuucacccccaagaaggacgacaccaccaugaccaagaucaucggcaacugcgucuccauccucguccucuccuccgcccuccccgucaugucccgcacccucggcaucacccgcuucgaccuccucggcgacuucggccgcuucaacuggcucggcaacuucuacaucguccucuccuacaaccuccucuucgccaucgucaccacccucugccucguccgcaaguucaccuccgccguccgcgaggagcucuucaaggcccucggccuccacaagcuccaccuccccaacaccucccgcgacuccgagaccgccaagcccuccgucaacggccaccagaaggcccucuga

SEQ ID NO: 45423 - RNA, 1623 nt, Artificial Sequence
  derived and/or modified sequence opt2 from LMBRD1__Homo_sapiens__NP_060838
auggccaccuccggcgccgccuccgccgagcucgucaucggcuggugcaucuucggccuccuccuccucgccauccucgccuucugcuggaucuacguccgcaaguaccagucccgccgcgaguccgaggucgucuccaccaucaccgccaucuucucccucgccaucgcccucaucaccuccgcccuccuccccgucgacaucuuccucgucuccuacaugaagaaccagaacggcaccuucaaggacugggccaacgccaacgucucccgccagaucgaggacaccguccucuacggcuacuacacccucuacuccgucauccucuucugcgucuucuucuggauccccuucgucuacuucuacuacgaggagaaggacgacgacgacaccuccaagugcacccagaucaagaccgcccucaaguacacccucggcuucgucgucaucugcgcccuccuccuccucgucggcgccuucgucccccucaacguccccaacaacaagaacuccaccgagugggagaaggucaagucccucuucgaggagcucggcuccucccacggccucgccgcccucuccuucuccaucuccucccucacccucaucggcaugcucgccgccaucaccuacaccgccuacggcauguccgcccucccccucaaccucaucaagggcacccgcuccgccgccuacgagcgccucgagaacaccgaggacaucgaggaggucgagcagcacauccagaccaucaaguccaaguccaaggacggccgcccccuccccgcccgcgacaagcgcgcccucaagcaguucgaggagcgccuccgcacccucaagaagcgcgagcgccaccucgaguucaucgagaacuccugguggaccaaguucugcggcgcccuccgcccccucaagaucgucuggggcaucuucuucauccucgucgcccuccucuucgucaucucccucuuccucuccaaccucgacaaggcccuccacuccgccggcaucgacuccggcuucaucaucuucggcgccaaccucuccaacccccucaacaugcuccucccccuccuccagaccgucuucccccucgacuacauccucaucaccaucaucaucauguacuucaucuucaccuccauggccggcauccgcaacaucggcaucugguucuucuggauccgccucuacaagauccgccgcggccgcacccgcccccaggcccuccucuuccucugcaugauccuccuccucaucguccuccacaccuccuacaugaucuacucccucgccccccaguacgucauguacggcucccagaacuaccucaucgagaccaacaucaccuccgacaaccacaagggcaacuccacccucuccguccccaagcgcugcgacgccgacgcccccgaggaccagugcaccgucacccgcaccuaccucuuccuccacaaguucugguucuucuccgccgccuacuacuucggcaacugggccuuccucggcgucuuccucaucggccucaucgucuccugcugcaagggcaagaaguccgucaucgagggcgucgacgaggacuccgacaucuccgacgacgagcccuccgucuacuccgccuga

SEQ ID NO: 45424 - RNA, 2088 nt, Artificial Sequence
  derived and/or modified sequence opt2 from LMBRD2__Homo_sapiens__NP_001007528
auguccggcgccgcccucggccucgagaucgucuucgucuucuuccucgcccucuuccuccuccaccgcuacggcgacuucaagaagcagcaccgccucgucaucaucggcacccuccucgccugguaccucugcuuccucaucgucuucauccucccccucgacgucuccaccaccaucuacaaccgcugcaagcacgccgccgccaacuccuccccccccgagaacuccaacaucaccggccucuacgccaccgccaaccccguccccucccagcaccccugcuucaagcccugguccuacauccccgacggcaucaugcccaucuucuggcgcgucgucuacuggaccucccaguuccucaccuggauccuccuccccuucaugcaguccuacgcccgcuccggcggcuucuccaucaccggcaagaucaagaccgcccucaucgagaacgccaucuacuacggcaccuaccuccucaucuucggcgccuuccucaucuacgucgccgucaacccccaccuccaccucgaguggaaccagcuccagaccaucggcaucgccgccgccaacaccuggggccucuuccuccucguccuccuccucggcuacggccucgucgagaucccccgcuccuacuggaacggcgccaagcgcggcuaccuccucaugaagaccuacuucaaggccgccaagcucaugaccgagaaggccgacgccgaggagaaccucgaggacgccauggaggagguccgcaaggucaacgaguccaucaaguacaaccacccccuccgcaagugcgucgacaccauccucaagaagugccccaccgaguaccaggagaagaugggccgcaacauggacgacuacgaggacuucgacgagaagcacuccaucuaccccuccgagaagucccucgucaagcuccacaagcaggucaucuacuccguccagcgccaccgccgcacccagguccaguggcagauccuccucgagcaggccuucuaccucgaggacgucgccaagaacgagaccuccgccacccaccaguucguccacaccuuccagucccccgagcccgagaaccgcuucauccaguacuucuacaaccccaccuucgagugguacugggagugccuccuccgccccugguucuacaagauccucgccgucguccucuccaucuucuccgucaucgucgucugguccgagugcaccuucuucuccaccacccccguccucucccucuucgccgucuucauccagcucgccgagaagaccuacaacuacaucuacaucgagaucgccugcuuccucuccaucuucuuccucuccaucugcgucuacuccaccgucuuccgcauccgcgucuucaacuacuacuaccucgccucccaccaccagaccgacgccuacucccuccucuucuccggcaugcucuucugccgccucacccccccccucugccucaacuuccucggccucacccacauggacuccuccaucucccacaagaacacccagcccaccgccuacaccuccaucaugggcuccaugaagguccucuccuucaucgccgacggcuucuacaucuacuaccccaugcucgucgucauccucugcaucgccaccuacuucucccucggcacccgcugccucaaccuccucggcuuccagcaguucaugggcgacgacgacaugaccuccgaccucgucaacgagggcaaggagcucauccgcaaggagaagcgcaagcgccagcgccaggaggagggcgagaaccgccgccgcgaguggaaggagcgcuacggccacaaccgcgaggacuccacccgcaaccgcaacauccacaccgaccccaaggaguccaacuucuccgacgucaacaccaaccgcuccgccuucaaguacacccgcgccaacaaccgcaccgagcgcgaccgcaucgagcuccuccaggacgccgagccccucgacuucaacgccgagaccuucaccgacgacccccucgaguccgaguccggccgcuaccagcccggcggccgcuaccucuccaugucccgcuccgacaucuucaacgacgucuga

SEQ ID NO: 45425 - RNA, 879 nt, Artificial Sequence
  derived and/or modified sequence opt2 from LMCD1__Homo_sapiens__NP_001265162
auggacuccaaguacuccacccucaccgcccgcgucaagggcggcgacggcauccgcaucuacaagcgcaaccgcaugaucaugaccaaccccaucgccaccggcaaggaccccaccuucgacaccaucaccuacgagugggccccccccggcgucacccagaagcucggccuccaguacauggagcucauccccaaggagaagcagcccgucaccggcaccgagggcgccuucuaccgccgccgccagcucaugcaccagcuccccaucuacgaccaggaccccucccgcugccgcggccuccucgagaacgagcucaagcucauggaggaguucgucaagcaguacaaguccgaggcccucggcgucggcgaggucgcccuccccggccagggcggccuccccaaggaggagggcaagcagcaggagaagcccgagggcgccgagaccaccgccgccaccaccaacggcucccucuccgaccccuccaaggaggucgaguacgucugcgagcucugcaagggcgccgccccccccgacucccccgucgucuacuccgaccgcgccggcuacaacaagcaguggcaccccaccugcuucgucugcgccaagugcuccgagccccucgucgaccucaucuacuucuggaaggacggcgcccccuggugcggccgccacuacugcgagucccuccgcccccgcugcuccggcugcgacgagaucaucuucgccgaggacuaccagcgcgucgaggaccucgccuggcaccgcaagcacuucgucugcgagggcugcgagcagcuccucuccggccgcgccuacaucgucaccaagggccagcuccucugccccaccugcuccaaguccaagcgcuccuga

SEQ ID NO: 45426 - RNA, 1704 nt, Artificial Sequence
  derived and/or modified sequence opt2 from LMF1__Homo_sapiens__NP_073610
augcgccccgacucccccaccauggccgcccccgccgagucccuccgccgccgcaagaccggcuacuccgaccccgagcccgaguccccccccgcccccggccgcggccccgccggcucccccgcccaccuccacaccggcaccuucuggcucacccgcaucguccuccucaaggcccucgccuucgucuacuucgucgccuuccucgucgccuuccaccagaacaagcagcucaucggcgaccgcggccuccuccccugccgcgucuuccucaagaacuuccagcaguacuuccaggaccgcaccuccugggaggucuucuccuacaugcccaccauccucuggcucauggacugguccgacaugaacuccaaccucgaccuccucgcccuccucggccucggcaucuccuccuucguccucaucaccggcugcgccaacaugcuccucauggccgcccucuggggccucuacaugucccucgucaacgucggccacgucugguacuccuucggcugggagucccagcuccucgagaccggcuuccucggcaucuuccucugcccccucuggacccucucccgccucccccagcacacccccaccucccgcaucguccucuggggcuuccgcuggcucaucuuccgcaucaugcucggcgccggccucaucaagauccgcggcgaccgcugcuggcgcgaccucaccugcauggacuuccacuacgagacccagcccaugcccaaccccgucgccuacuaccuccaccacucccccuggugguuccaccgcuucgagacccucuccaaccacuucaucgagcuccucguccccuucuuccucuuccucggccgccgcgccugcaucauccacggcguccuccagauccucuuccaggccguccucaucgucuccggcaaccucuccuuccucaacuggcucaccaugguccccucccucgccugcuucgacgacgccacccucggcuuccucuuccccuccggccccggcucccucaaggaccgcguccuccagaugcagcgcgacauccgcggcgcccgccccgagccccgcuucggcuccgucguccgccgcgccgccaacgucucccucggcguccuccucgccuggcucuccguccccgucguccucaaccuccucuccucccgccaggucaugaacacccacuucaacucccuccacaucgucaacaccuacggcgccuucggcuccaucaccaaggagcgcgccgaggucauccuccagggcaccgccuccuccaacgccuccgcccccgacgccaugugggaggacuacgaguucaagugcaagcccggcgaccccucccgccgccccugccucaucucccccuaccacuaccgccucgacuggcucaugugguucgccgccuuccagaccuacgagcacaacgacuggaucauccaccucgccggcaagcuccucgccuccgacgccgaggcccucucccuccucgcccacaaccccuucgccggccgcccccccccccgcuggguccgcggcgagcacuaccgcuacaaguucucccgccccggcggccgccacgccgccgagggcaagugguggguccgcaagcgcaucggcgccuacuuccccccccucucccucgaggagcuccgccccuacuuccgcgaccgcggcuggccccuccccggcccccucuga

SEQ ID NO: 45427 - RNA, 2079 nt, Artificial Sequence
  derived and/or modified sequence opt2 from LMLN__Homo_sapiens__NP_001129521
auggucaccacccucggccccaagauggccgccgaguggggcggcggcgucggcuacuccggcuccggccccggccgcucccgcuggcgcugguccggcuccgucuggguccgcuccguccuccuccuccucggcggccuccgcgccuccgccaccuccacccccgucucccucggcuccuccccccccugccgccaccacguccccuccgacaccgaggucaucaacaagguccaccucaaggccaaccacgucgucaagcgcgacgucgacgagcaccuccgcaucaagaccgucuacgacaaguccgucgaggagcuccuccccgagaagaagaaccucgucaagaacaagcucuucccccaggccaucuccuaccucgagaagaccuuccagguccgccgccccgccggcaccauccuccucucccgccagugcgccaccaaccaguaccuccgcaaggagaacgacccccaccgcuacugcaccggcgagugcgccgcccacaccaagugcggccccgucaucguccccgaggagcaccuccagcagugccgcgucuaccgcggcggcaaguggccccacggcgccgucggcguccccgaccaggagggcaucuccgacgccgacuucguccucuacgucggcgcccucgccaccgagcgcugcucccacgagaacaucaucuccuacgccgccuacugccagcaggaggccaacauggaccgccccaucgccggcuacgccaaccucugccccaacaugaucuccacccagccccaggaguucgucggcaugcucuccaccgucaagcacgaggucauccacgcccucggcuucuccgccggccucuucgccuucuaccacgacaaggacggcaacccccucaccucccgcuucgccgacggccucccccccuucaacuacucccucggccucuaccagugguccgacaaggucguccgcaaggucgagcgccucugggacguccgcgacaacaagaucguccgccacaccgucuaccuccucgucaccccccgcgucgucgaggaggcccgcaagcacuucgacugccccguccucgagggcauggagcucgagaaccagggcggcgucggcaccgagcucaaccacugggagaagcgccuccucgagaacgaggccaugaccggcucccacacccagaaccgcguccucucccgcaucacccucgcccucauggaggacaccggcugguacaaggccaacuacuccauggccgagaagcucgacuggggccgcggcaugggcugcgacuucguccgcaaguccugcaaguucuggaucgaccagcagcgccagaagcgccagaugcucucccccuacugcgacacccuccgcuccaacccccuccagcucaccugccgccaggaccagcgcgccgucgccgucugcaaccuccagaaguuccccaagccccucccccaggaguaccaguacuucgacgagcucuccggcauccccgccgaggaccuccccuacuacggcggcuccgucgagaucgccgacuacugccccuucucccaggaguucuccuggcaccucuccggcgaguaccagcgcuccuccgacugccgcauccucgagaaccagcccgagaucuucaagaacuacggcgccgagaaguacggcccccacuccgucugccucauccagaaguccgccuucgucauggagaagugcgagcgcaagcucuccuaccccgacuggggcuccggcugcuaccaggucuccugcuccccccagggccucaaggucuggguccaggacaccuccuaccucugcucccgcgccggccagguccuccccgucuccauccagaugaacggcuggauccacgacggcaaccuccucugccccuccugcugggacuucugcgagcucugcccccccgagaccgacccccccgccaccaaccucacccgcgcccucccccucgaccucugcuccugcuccuccucccucgucgucacccucuggcuccuccucggcaaccucuucccccuccucgccggcuuccuccucugcaucuggcacuga

SEQ ID NO: 45428 - RNA, 1725 nt, Artificial Sequence
  derived and/or modified sequence opt2 from LMNA__Homo_sapiens__NP_001244303
augggcaacuccgagggcugcaacaccaagaaggagggcgaccucaucgccgcccaggcccgccucaaggaccucgaggcccuccucaacuccaaggaggccgcccucuccaccgcccucuccgagaagcgcacccucgagggcgagcuccacgaccuccgcggccaggucgccaagcucgaggccgcccucggcgaggccaagaagcagcuccaggacgagaugcuccgccgcgucgacgccgagaaccgccuccagaccaugaaggaggagcucgacuuccagaagaacaucuacuccgaggagcuccgcgagaccaagcgccgccacgagacccgccucgucgagaucgacaacggcaagcagcgcgaguucgagucccgccucgccgacgcccuccaggagcuccgcgcccagcacgaggaccaggucgagcaguacaagaaggagcucgagaagaccuacuccgccaagcucgacaacgcccgccaguccgccgagcgcaacuccaaccucgucggcgccgcccacgaggagcuccagcagucccgcauccgcaucgacucccucuccgcccagcucucccagcuccagaagcagcucgccgccaaggaggccaagcuccgcgaccucgaggacucccucgcccgcgagcgcgacaccucccgccgccuccucgccgagaaggagcgcgagauggccgagaugcgcgcccgcaugcagcagcagcucgacgaguaccaggagcuccucgacaucaagcucgcccucgacauggagauccacgccuaccgcaagcuccucgagggcgaggaggagcgccuccgccucucccccucccccaccucccagcgcucccgcggccgcgccuccucccacuccucccagacccagggcggcggcuccgucaccaagaagcgcaagcucgaguccaccgagucccgcuccuccuucucccagcacgcccgcaccuccggccgcgucgccgucgaggaggucgacgaggagggcaaguucguccgccuccgcaacaaguccaacgaggaccaguccaugggcaacuggcagaucaagcgccagaacggcgacgacccccuccucaccuaccgcuucccccccaaguucacccucaaggccggccaggucgucaccaucugggccgccggcgccggcgccacccacuccccccccaccgaccucgucuggaaggcccagaacaccuggggcugcggcaacucccuccgcaccgcccucaucaacuccaccggcgaggaggucgccaugcgcaagcucguccgcuccgucaccgucgucgaggacgacgaggacgaggacggcgacgaccuccuccaccaccaccacggcucccacugcuccuccuccggcgaccccgccgaguacaaccuccgcucccgcaccguccucugcggcaccugcggccagcccgccgacaaggccuccgccuccggcuccggcgcccaggucggcggccccaucuccuccggcuccuccgccuccuccgucaccgucacccgcuccuaccgcuccgucggcggcuccggcggcggcuccuucggcgacaaccucgucacccgcuccuaccuccucggcaacuccuccccccgcacccaguccccccagaacugcuccaucauccaggagaugggcaugcgcugggaggucgaggagggccgccgcaaggucucccucuccugccuccccuga

SEQ ID NO: 45429 - RNA, 1761 nt, Artificial Sequence
  derived and/or modified sequence opt2 from LMNB1__Homo_sapiens__NP_005564
auggccaccgccacccccguccccccccgcaugggcucccgcgccggcggccccaccaccccccucucccccacccgccucucccgccuccaggagaaggaggagcuccgcgagcucaacgaccgccucgccgucuacaucgacaagguccgcucccucgagaccgagaacuccgcccuccagcuccaggucaccgagcgcgaggagguccgcggccgcgagcucaccggccucaaggcccucuacgagaccgagcucgccgacgcccgccgcgcccucgacgacaccgcccgcgagcgcgccaagcuccagaucgagcucggcaagugcaaggccgagcacgaccagcuccuccucaacuacgccaagaaggaguccgaccucaacggcgcccagaucaagcuccgcgaguacgaggccgcccucaacuccaaggacgccgcccucgccaccgcccucggcgacaagaagucccucgagggcgaccucgaggaccucaaggaccagaucgcccagcucgaggccucccucgccgccgccaagaagcagcucgccgacgagacccuccucaaggucgaccucgagaaccgcugccagucccucaccgaggaccucgaguuccgcaaguccauguacgaggaggagaucaacgagacccgccgcaagcacgagacccgccucgucgaggucgacuccggccgccagaucgaguacgaguacaagcucgcccaggcccuccacgagaugcgcgagcagcacgacgcccagguccgccucuacaaggaggagcucgagcagaccuaccacgccaagcucgagaacgcccgccucuccuccgagaugaacaccuccaccgucaacuccgcccgcgaggagcucauggagucccgcaugcgcaucgagucccucuccucccagcucuccaaccuccagaaggagucccgcgccugccucgagcgcauccaggagcucgaggaccuccucgccaaggagaaggacaacucccgccgcaugcucaccgacaaggagcgcgagauggccgagauccgcgaccagaugcagcagcagcucaacgacuacgagcagcuccucgacgucaagcucgcccucgacauggagaucuccgccuaccgcaagcuccucgagggcgaggaggagcgccucaagcucucccccucccccuccucccgcgucaccgucucccgcgccuccuccucccgcuccguccgcaccacccgcggcaagcgcaagcgcgucgacgucgaggaguccgaggccuccuccuccgucuccaucucccacuccgccuccgccaccggcaacgucugcaucgaggagaucgacgucgacggcaaguucauccgccucaagaacaccuccgagcaggaccagcccaugggcggcugggagaugauccgcaagaucggcgacaccuccgucuccuacaaguacaccucccgcuacguccucaaggccggccagaccgucaccaucugggccgccaacgccggcgucaccgccuccccccccaccgaccucaucuggaagaaccagaacuccuggggcaccggcgaggacgucaaggucauccucaagaacucccagggcgaggaggucgcccagcgcuccaccgucuucaagaccaccauccccgaggaggaggaggaggaggaggaggccgccggcgucgucgucgaggaggagcucuuccaccagcagggcaccccccgcgccuccaaccgcuccugcgccaucauguga

SEQ ID NO: 45430 - RNA, 1863 nt, Artificial Sequence
  derived and/or modified sequence opt2 from LMNB2__Homo_sapiens__NP_116126
auguccccccccucccccggccgccgccgcgagcagcgccgcccccgcgccgccgccaccauggccaccccccuccccggccgcgccggcggccccgccaccccccucucccccacccgccucucccgccuccaggagaaggaggagcuccgcgagcucaacgaccgccucgcccacuacaucgaccgcguccgcgcccucgagcucgagaacgaccgccuccuccucaagaucuccgagaaggaggaggucaccacccgcgaggucuccggcaucaaggcccucuacgaguccgagcucgccgacgcccgccgcguccucgacgagaccgcccgcgagcgcgcccgccuccagaucgagaucggcaagcuccgcgccgagcucgacgaggucaacaaguccgccaagaagcgcgagggcgagcucaccgucgcccagggccgcgucaaggaccucgagucccucuuccaccgcuccgaggucgagcucgccgccgcccucuccgacaagcgcggccucgaguccgacgucgccgagcuccgcgcccagcucgccaaggccgaggacggccacgccgucgccaagaagcagcucgagaaggagacccucaugcgcgucgaccucgagaaccgcugccagucccuccaggaggagcucgacuuccgcaaguccgucuucgaggaggagguccgcgagacccgccgccgccacgagcgccgccucgucgaggucgacuccucccgccagcaggaguacgacuucaagauggcccaggcccucgaggagcuccgcucccagcacgacgagcagguccgccucuacaagcucgagcucgagcagaccuaccaggccaagcucgacuccgccaagcucuccuccgaccagaacgacaaggccgccuccgccgcccgcgaggagcucaaggaggcccgcaugcgccucgagucccucuccuaccagcucuccggccuccagaagcaggccuccgccgccgaggaccgcauccgcgagcucgaggaggccauggccggcgagcgcgacaaguuccgcaagaugcucgacgccaaggagcaggagaugaccgagaugcgcgacgucaugcagcagcagcucgccgaguaccaggagcuccucgacgucaagcucgcccucgacauggagaucaacgccuaccgcaagcuccucgagggcgaggaggagcgccucaagcucucccccucccccuccucccgcgucaccgucucccgcgccaccuccuccuccuccggcucccucuccgccaccggccgccucggccgcuccaagcgcaagcgccucgaggucgaggagccccucggcuccggccccuccguccucggcaccggcaccggcggcuccggcggcuuccaccucgcccagcaggccuccgccuccggcuccgucuccaucgaggagaucgaccucgagggcaaguucguccagcucaagaacaacuccgacaaggaccagucccucggcaacuggcgcaucaagcgccagguccucgagggcgaggagaucgccuacaaguucacccccaaguacauccuccgcgccggccagauggucaccgucugggccgccggcgccggcgucgcccacuccccccccuccacccucgucuggaagggccaguccuccuggggcaccggcgaguccuuccgcaccguccucgucaacgccgacggcgaggaggucgccaugcgcaccgucaagaaguccuccgucaugcgcgagaacgagaacggcgaggaggaggaggaggaggccgaguucggcgaggaggaccucuuccaccagcagggcgacccccgcaccaccucccgcggcugcuacgucauguga

SEQ ID NO: 45431 - RNA, 978 nt, Artificial Sequence
  derived and/or modified sequence opt2 from LMNTD1__Homo_sapiens__NP_001139199
augcagcagcccguccgcgccggcgacaucggcgucucccgcguccagacccaccacaacgccucccccuucuccguccccaagaagcaggacgagucccccaugaucggcgacggcgaggacuacuuccucucccucuucggcgacuccaagaagcucaccgcccacuccaacuacacccagaagacccucaaguacuucuccaugauccucgaggaggucggccaguucaccuccuccucccucggcgacgucgagaucgccgaggucaacgucaagggccucuucgucaagcucaucaacuccucccucgacaaggagauggccaucggcgaccacauccuccagcagaacgucaacggccagaccaucucccucuaccgcuuccuccccaacaucgucaugcaggccaacuccaccgucaccgucugggccgccgccuccgaggccaagcaccagccccccuccgacuuccucuggaaggagcaggacaaguuccgcgccucccccgacugcaucaccauccucugcaagcccaacggccaggccaucgccugguacacccccauccacuggaagcaggccugggagaagcucgacgccgacgucgaguucaaccgcugcuccgucgucucccccaccuuccgcaagcgcgucuuccaguggaccgccuccaccgccaccaucaccaaggagaagcaggaccagcccaagaaggacaucuccaacuaccaggucgagcaggcccagguccuccucaagcgcgagaaggagaucccccccaccgucuuccccaaccgcucccccuggugccagaaccccuacgucuccgcccaccccuacugcccccucaucgagccccacaacaccuccaccgccggcggccgccucgaccgccagccccgcacccgcuccacccgccccaaccgcgccuccggcuccaagaagaagaagaccuccgagucccagaagcaguga

SEQ ID NO: 45432 - RNA, 468 nt, Artificial Sequence
  derived and/or modified sequence opt2 from LMO1__Homo_sapiens__NP_001257357
augguccucgaccaggaggacggcguccccaugcucuccguccagcccaagggcaagcagaagggcugcgccggcugcaaccgcaagaucaaggaccgcuaccuccucaaggcccucgacaaguacuggcacgaggacugccucaagugcgccugcugcgacugccgccucggcgaggucggcuccacccucuacaccaaggccaaccucauccucugccgccgcgacuaccuccgccucuucggcaccaccggcaacugcgccgccugcuccaagcucauccccgccuucgagauggucaugcgcgcccgcgacaacgucuaccaccucgacugcuucgccugccagcucugcaaccagcgcuucugcgucggcgacaaguucuuccucaagaacaacaugauccucugccagauggacuacgaggagggccagcucaacggcaccuucgagucccagguccaguga

SEQ ID NO: 45433 - RNA, 477 nt, Artificial Sequence
  derived and/or modified sequence opt2 from LMO2__Homo_sapiens__NP_001135787
auguccuccgccaucgagcgcaagucccucgaccccuccgaggagcccgucgacgagguccuccagaucccccccucccuccucaccugcggcggcugccagcagaacaucggcgaccgcuacuuccucaaggccaucgaccaguacuggcacgaggacugccucuccugcgaccucugcggcugccgccucggcgaggucggccgccgccucuacuacaagcucggccgcaagcucugccgccgcgacuaccuccgccucuucggccaggacggccucugcgccuccugcgacaagcgcauccgcgccuacgagaugaccaugcgcgucaaggacaaggucuaccaccucgagugcuucaagugcgccgccugccagaagcacuucugcgucggcgaccgcuaccuccucaucaacuccgacaucgucugcgagcaggacaucuacgaguggaccaagaucaacggcaugaucuga

SEQ ID NO: 45434 - RNA, 438 nt, Artificial Sequence
  derived and/or modified sequence opt2 from LMO3__Homo_sapiens__NP_001001395
augcucuccguccagcccgacaccaagcccaagggcugcgccggcugcaaccgcaagaucaaggaccgcuaccuccucaaggcccucgacaaguacuggcacgaggacugccucaagugcgccugcugcgacugccgccucggcgaggucggcuccacccucuacaccaaggccaaccucauccucugccgccgcgacuaccuccgccucuucggcgucaccggcaacugcgccgccugcuccaagcucauccccgccuucgagauggucaugcgcgccaaggacaacgucuaccaccucgacugcuucgccugccagcucugcaaccagcgcuucugcgucggcgacaaguucuuccucaagaacaacaugauccucugccagaccgacuacgaggagggccucaugaaggagggcuacgccccccagguccgcuga

SEQ ID NO: 45435 - RNA, 4050 nt, Artificial Sequence
  derived and/or modified sequence opt2 from LMO7__Homo_sapiens__NP_005349
augaagaagauccgcaucugccacaucuucaccuucuacuccuggauguccuacgacguccucuuccagcgcaccgagcucggcgcccucgagaucuggcgccagcucaucugcgcccacgucugcaucugcgucggcuggcucuaccuccgcgaccgcgucugcuccaagaaggacaucauccuccgcaccgagcagaacuccggccgcaccauccucaucaaggccgucaccgagaagaacuucgagaccaaggacuuccgcgccucccucgagaacggcguccuccucugcgaccucaucaacaagcucaagcccggcgucaucaagaagaucaaccgccucuccacccccaucgccggccucgacaacaucaacgucuuccucaaggccugcgagcagaucggccucaaggaggcccagcucuuccaccccggcgaccuccaggaccucuccaaccgcgucaccgucaagcaggaggagaccgaccgccgcgucaagaacguccucaucacccucuacuggcucggccgcaaggcccaguccaaccccuacuacaacggcccccaccucaaccucaaggccuucgagaaccuccucggccaggcccucaccaaggcccucgaggacuccuccuuccucaagcgcuccggccgcgacuccggcuacggcgacaucuggugccccgagcgcggcgaguuccucgcccccccccgccaccacaagcgcgaggacuccuucgagucccucgacucccucggcucccgcucccucaccuccugcuccuccgacaucacccuccgcggcggccgcgagggcuucgaguccgacaccgacuccgaguucaccuucaagaugcaggacuacaacaaggacgacauguccuaccgccgcaucuccgccgucgagcccaagaccgcccuccccuucaaccgcuuccuccccaacaagucccgccagcccuccuacguccccgccccccuccgcaagaagaagcccgacaagcacgaggacaaccgccgcuccugggccucccccgucuacaccgaggccgacggcaccuucucccgccucuuccagaagaucuacggcgagaacggcuccaaguccauguccgacgucuccgccgaggacguccagaaccuccgccagcuccgcuacgaggagaugcagaagaucaagucccagcucaaggagcaggaccagaaguggcaggacgaccucgccaaguggaaggaccgccgcaaguccuacaccuccgaccuccagaagaagaaggaggagcgcgaggagaucgagaagcaggcccucgagaaguccaagcgcuccuccaagaccuucaaggagaugcuccaggaccgcgagucccagaaccagaaguccaccguccccucccgccgccgcauguacuccuucgacgacguccucgaggagggcaagcgcccccccaccaugaccgucuccgaggccuccuaccaguccgagcgcgucgaggagaagggcgccaccuaccccuccgagauccccaaggaggacuccaccaccuucgccaagcgcgaggaccgcgucaccaccgagauccagcuccccucccagucccccgucgaggagcagucccccgccucccucuccucccuccgcucccgcuccacccagauggaguccacccgcgucuccgccucccucccccgcuccuaccgcaagaccgacaccguccgccucaccuccgucgucaccccccgccccuucggcucccagacccgcggcaucuccucccucccccgcuccuacaccauggacgacgccuggaaguacaacggcgacgucgaggacaucaagcgcacccccaacaacgucgucuccacccccgcccccucccccgacgccucccagcucgccuccucccucuccucccagaaggaggucgccgccaccgaggaggacgucacccgccuccccucccccaccucccccuucuccucccucucccaggaccaggccgccaccuccaaggccacccucuccuccaccuccggccucgaccucauguccgaguccggcgagggcgagaucuccccccagcgcgaggucucccgcucccaggaccaguucuccgacaugcgcaucuccaucaaccagacccccggcaagucccucgacuucggcuucaccaucaagugggacauccccggcaucuucgucgccuccgucgaggccggcucccccgccgaguucucccagcuccaggucgacgacgagaucaucgccaucaacaacaccaaguucuccuacaacgacuccaaggagugggaggaggccauggccaaggcccaggagaccggccaccucgucauggacguccgccgcuacggcaaggccggcucccccgagaccaaguggaucgacgccaccuccggcaucuacaacuccgagaaguccuccaaccucuccgucaccaccgacuucuccgagucccuccaguccuccaacaucgaguccaaggagaucaacggcauccacgacgaguccaacgccuucgaguccaaggccuccgaguccaucucccucaagaaccucaagcgccgcucccaguucuucgagcagggcuccuccgacuccgucguccccgaccuccccguccccaccaucuccgcccccucccgcugggucugggaccaggaggaggagcgcaagcgccaggagcgcuggcagaaggagcaggaccgccuccuccaggagaaguaccagcgcgagcaggagaagcuccgcgaggaguggcagcgcgccaagcaggaggccgagcgcgagaacuccaaguaccucgacgaggagcucaugguccucuccuccaacuccaugucccucaccacccgcgagcccucccucgccaccugggaggccaccugguccgagggcuccaaguccuccgaccgcgagggcacccgcgccggcgaggaggagcgccgccagccccaggaggaggucguccacgaggaccagggcaagaagccccaggaccagcucgucaucgagcgcgagcgcaagugggagcagcagcuccaggaggagcaggagcagaagcgccuccaggccgaggccgaggagcagaagcgccccgccgaggagcagaagcgccaggccgagaucgagcgcgagaccuccguccgcaucuaccaguaccgccgccccgucgacuccuacgacauccccaagaccgaggaggccuccuccggcuuccuccccggcgaccgcaacaagucccgcuccaccaccgagcucgacgacuacuccaccaacaagaacggcaacaacaaguaccucgaccagaucggcaacaugaccuccucccagcgccgcuccaagaaggagcagguccccuccggcgccgagcucgagcgccagcagauccuccaggagaugcgcaagcgcaccccccuccacaacgacaacuccuggauccgccagcgcuccgccuccgucaacaaggagcccgucucccuccccggcaucaugcgccgcggcgagucccucgacaaccucgacuccccccgcuccaacuccuggcgccagccccccuggcucaaccagcccaccggcuucuacgccuccuccuccguccaggacuucucccgcccccccccccagcucgucuccaccuccaaccgcgccuacaugcgcaaccccuccuccuccguccccccccccuccgccggcuccgucaagaccuccaccaccggcgucgccaccacccagucccccaccccccgcucccacucccccuccgccucccaguccggcucccagcuccgcaaccgcuccgucuccggcaagcgcaucugcuccuacugcaacaacauccucggcaagggcgccgccaugaucaucgagucccucggccucugcuaccaccuccacugcuucaagugcgucgccugcgagugcgaccucggcggcuccuccuccggcgccgagguccgcauccgcaaccaccagcucuacugcaacgacugcuaccuccgcuucaaguccggccgccccaccgccauguga

SEQ ID NO: 45436 - RNA, 1803 nt, Artificial Sequence
  derived and/or modified sequence opt2 from LMOD1__Homo_sapiens__NP_036266
augucccgcgucgccaaguaccgccgccaggucuccgaggaccccgacaucgacucccuccucgagacccucucccccgaggagauggaggagcucgagaaggagcucgacgucgucgaccccgacggcuccguccccgucggccuccgccagcgcaaccagaccgagaagcaguccaccggcgucuacaaccgcgaggccaugcucaacuucugcgagaaggagaccaagaagcucaugcagcgcgagauguccauggacgaguccaagcaggucgagaccaagaccgacgccaagaacggcgaggagcgcggccgcgacgccuccaagaaggcccucggcccccgccgcgacuccgaccucggcaaggagcccaagcgcggcggccucaagaaguccuucucccgcgaccgcgacgaggccggcggcaaguccggcgagaagcccaaggaggagaagaucauccgcggcaucgacaagggccgcguccgcgccgccgucgacaagaaggaggccggcaaggacggccgcggcgaggagcgcgccgucgccaccaagaaggaggaggagaagaagggcuccgaccgcaacaccggccucucccgcgacaaggacaagaagcgcgaggagaugaaggaggucgccaagaaggaggacgacgagaaggucaagggcgagcgccgcaacaccgacacccgcaaggagggcgagaagaugaagcgcgccggcggcaacaccgacaugaagaaggaggacgagaaggucaagcgcggcaccggcaacaccgacaccaagaaggacgacgagaaggucaagaagaacgagccccuccacgagaaggaggccaaggacgacuccaagaccaagacccccgagaagcagacccccuccggccccaccaagcccuccgagggccccgccaaggucgaggaggaggccgcccccuccaucuucgacgagccccucgagcgcgucaagaacaacgaccccgagaugaccgaggucaacgucaacaacuccgacugcaucaccaacgagauccucguccgcuucaccgaggcccucgaguucaacaccgucgucaagcucuucgcccucgccaacacccgcgccgacgaccacgucgccuucgccaucgccaucaugcucaaggccaacaagaccaucaccucccucaaccucgacuccaaccacaucaccggcaagggcauccucgccaucuuccgcgcccuccuccagaacaacacccucaccgagcuccgcuuccacaaccagcgccacaucugcggcggcaagaccgagauggagaucgccaagcuccucaaggagaacaccacccuccucaagcucggcuaccacuucgagcucgccggcccccgcaugaccgucaccaaccuccucucccgcaacauggacaagcagcgccagaagcgccuccaggagcagcgccaggcccaggaggccaagggcgagaagaaggaccuccucgagguccccaaggccggcgccgucgccaagggcucccccaagcccuccccccagcccucccccaagcccucccccaagaacucccccaagaagggcggcgcccccgccgccccccccccccccccccccccccucgcccccccccucaucauggagaaccucaagaacucccucucccccgccacccagcgcaagaugggcgacaagguccuccccgcccaggagaagaacucccgcgaccagcuccucgccgccauccgcuccuccaaccucaagcagcucaagaaggucgagguccccaagcuccuccaguga

SEQ ID NO: 45437 - RNA, 1683 nt, Artificial Sequence
  derived and/or modified sequence opt2 from LMOD3__Homo_sapiens__NP_001291347
auguccgagcacucccgcaacuccgaccaggaggagcuccucgacgaggagaucaacgaggacgagauccucgccaaccucuccgccgaggagcucaaggagcuccaguccgagauggaggucauggcccccgaccccucccuccccgucggcaugauccagaaggaccagaccgacaagccccccaccggcaacuucaaccacaagucccucgucgacuacauguacugggagaaggccucccgccgcaugcucgaggaggagcgcguccccgucaccuucgucaaguccgaggagaagacccaggaggagcacgaggagaucgagaagcgcaacaagaacauggcccaguaccucaaggagaagcucaacaacgagaucgucgccaacaagcgcgaguccaagggcuccuccaacauccaggagaccgacgaggaggacgaggaggaggaggacgacgacgacgacgacgagggcgaggacgacggcgaggaguccgaggagaccaaccgcgaggaggagggcaaggccaaggagcagauccgcaacugcgagaacaacugccagcaggucaccgacaaggccuucaaggagcagcgcgaccgccccgaggcccaggagcaguccgagaagaagaucuccaagcucgaccccaagaagcucgcccucgacaccuccuuccucaaggucuccacccgccccuccggcaaccagaccgaccucgacggcucccuccgccgcguccgcaagaacgaccccgacaugaaggagcucaaccucaacaacaucgagaacauccccaaggagaugcuccucgacuucgucaacgccaugaagaagaacaagcacaucaagaccuucucccucgccaacgucggcgccgacgagaacgucgccuucgcccucgccaacaugcuccgcgagaaccgcuccaucaccacccucaacaucgaguccaacuucaucaccggcaagggcaucgucgccaucaugcgcugccuccaguucaacgagacccucaccgagcuccgcuuccacaaccagcgccacaugcucggccaccacgccgagauggagaucgcccgccuccucaaggccaacaacacccuccucaagaugggcuaccacuucgagcuccccggcccccgcauggucgucaccaaccuccucacccgcaaccaggacaagcagcgccagaagcgccaggaggagcagaagcagcagcagcucaaggagcagaagaagcucaucgccaugcucgagaacggccucggccucccccccggcaugugggagcuccucggcggccccaagcccgacucccgcaugcaggaguucuuccagcccccccccccccgcccccccaacccccagaacguccccuucucccagcgcuccgagaugaugaagaagcccucccaggcccccaaguaccgcaccgaccccgacuccuuccgcgucgucaagcucaagcgcauccagcgcaagucccgcaugcccgaggcccgcgagccccccgagaagaccaaccucaaggacgucaucaagacccucaagcccgucccccgcaaccgcccccccccccucgucgagaucaccccccgcgaccagcuccucaacgacauccgccacuccuccgucgccuaccucaagcccguccagcuccccaaggagcucgccuga

SEQ ID NO: 45438 - RNA, 4512 nt, Artificial Sequence
  derived and/or modified sequence opt2 from LMTK2__Homo_sapiens__NP_055731
augcccggcccccccgcccuccgccgccgccuccuccuccuccuccucguccuccucaucgccggcuccgccggcgccgccccccucccccagaccggcgccggcgaggccccccccgccgccgaggucuccuccuccuucgucauccucugcgucugcucccucaucauccucaucguccucaucgccaacugcgucuccugcugcaaggaccccgagaucgacuucaaggaguucgaggacaacuucgacgacgagaucgacuucaccccccccgccgaggacacccccuccguccagucccccgccgaggucuucacccucuccguccccaacaucucccuccccgcccccucccaguuccagcccuccgucgagggccucaagucccaggucgcccgccacucccucaacuacauccaggagaucggcaacggcugguucggcaagguccuccucggcgagaucuacaccggcaccuccgucgcccgcgucaucgucaaggagcucaaggccuccgccaaccccaaggagcaggacaccuuccucaagaacggcgagcccuacuacauccuccagcaccccaacauccuccagugcgucggccagugcgucgaggccauccccuaccuccucgucuucgaguucugcgaccucggcgaccucaaggccuaccuccgcuccgagcaggagcacaugcgcggcgacucccagaccaugcuccuccagcgcauggccugcgaggucgccgccggccucgccgccaugcacaagcuccacuuccuccacuccgaccucgcccuccgcaacugcuuccucaccuccgaccucaacgucaaggucggcgacuacggcaucggcuucucccgcuacaaggaggacuacaucgagaccgacgacaagaaggucuucccccuccgcuggaccgcccccgagcucgucaccuccuuccaggaccgccuccucaccgccgaccagaccaaguacuccaacaucuggucccucggcgucacccucugggagcucuucgacaacgccgcccagcccuacuccaaccucuccaaccucgacguccucaaccaggucauccgcgagcgcgacaccaagcuccccaagccccagcucgagcagcccuacuccgaccgcugguacgagguccuccaguucugcuggcucucccccgagaagcgccccgccgccgaggacguccaccgccuccucaccuaccuccgccuccagucccagcgcgacuccgaggucgacuucgagcagcaguggaacgcccucaagcccaacaccaacucccgcgacuccuccaacaacgccgccuuccccauccucgaccacuucgcccgcgaccgccucggccgcgagauggaggagguccucaccgucaccgagaccucccagggccucuccuucgaguacgucugggaggccgccaagcacgaccacuucgacgagcgcucccgcggccaccucgacgagggccucuccuacaccuccaucuucuaccccgucgaggucuucgaguccucccucuccgaccccggccccggcaagcaggacgacuccggccaggacgucccccuccgcguccccggcgucguccccgucuucgacgcccacaaccucuccgucggcuccgacuacuacauccagcucgaggagaaguccggcuccaaccucgagcucgacuacccccccgcccuccucaccaccgacauggacaaccccgagcgcaccggccccgagcucucccagcucaccgcccuccgcuccgucgagcucgaggaguccuccaccgacgaggacuucuuccaguccuccaccgaccccaaggacuccucccuccccggcgaccuccacgucaccuccggccccgagucccccuucaacaacaucuucaacgacgucgacaaguccgaggaccuccccucccaccagaagaucuucgaccucauggagcucaacggcguccaggccgacuucaagcccgccacccucuccuccucccucgacaaccccaaggaguccgucaucaccggccacuucgagaaggagaagccccgcaagaucuucgacuccgagccccucugccucuccgacaaccucaugcaccaggacaacuucgacccccucaacguccaggagcucuccgagaacuuccucuuccuccaggagaagaaccuccucaagggcucccucuccuccaaggagcacaucaacgaccuccagaccgagcucaagaacgccggcuucaccgaggccaugcucgagaccuccugccgcaacucccucgacaccgagcuccaguucgccgagaacaagcccggccucucccuccuccaggagaacgucuccaccaagggcgacgacaccgacgucaugcucaccggcgacacccucuccaccucccuccaguccucccccgagguccaggucccccccaccuccuucgagaccgaggagaccccccgccgcgucccccccgacucccuccccacccagggcgagacccagcccaccugccucgacgucaucguccccgaggacugccuccaccaggacaucucccccgacgccgucaccguccccgucgagauccucuccaccgacgcccgcacccacucccucgacaaccgcucccaggacucccccggcgaguccgaggagacccuccgccucaccgaguccgacuccguccucgccgacgacauccucgccucccgcgucuccgucggcuccucccuccccgagcucggccaggagcuccacaacaagcccuucuccgaggaccaccacucccaccgccgccucgagaagaaccucgaggccgucgagacccucaaccagcucaacuccaaggacgccgccaaggaggccggccucgucuccgcccucuccuccgacuccaccucccaggacucccuccucgaggacucccucuccgcccccuuccccgccuccgagcccucccucgagacccccgacucccucgaguccgucgacguccacgaggcccuccucgacucccucggcucccacaccccccagaagcucgucccccccgacaagcccgccgacuccggcuacgagaccgagaaccucgagucccccgaguggacccuccaccccgcccccgagggcaccgccgacuccgagcccgccaccaccggcgacggcggccacuccggccucccccccaaccccgucaucgucaucuccgacgccggcgacggccaccgcggcaccgaggucacccccgagaccuucaccgccggcucccagggcuccuaccgcgacuccgccuacuucuccgacaacgacuccgagcccgagaagcgcuccgaggagguccccggcaccucccccuccgcccucguccucguccaggagcagccccuccccgagcccguccuccccgagcagucccccgccgcccaggacuccugccucgaggcccgcaagucccagcccgacgaguccugccucuccgcccuccacaacuccuccgaccucgagcuccgcgccacccccgagcccgcccagaccggcgucccccagcagguccaccccaccgaggacgaggccuccucccccugguccguccucaacgccgagcucuccuccggcgacgacuucgagacccaggacgaccgccccugcacccucgccuccaccggcaccaacaccaacgagcuccucgccuacaccaacuccgcccucgacaagucccucuccucccacuccgagggccccaagcucaaggagcccgacaucgagggcaaguaccucggcaagcucggcgucuccggcaugcucgaccucuccgaggacggcauggacgccgacgaggaggacgagaacuccgacgacuccgacgaggaccuccgcgccuucaaccuccacucccucuccuccgaguccgaggacgagaccgagcaccccguccccaucauccucuccaacgaggacggccgccaccuccgcucccuccucaagcccaccgccgccaacgcccccgacccccuccccgaggacuggaagaaggagaagaaggccgucaccuucuucgacgacgucaccgucuaccucuucgaccaggagacccccaccaaggagcucggccccugcggcggcgaggccugcggccccgaccucuccggccccgcccccgccuccggcucccccuaccucucccgcugcaucaacuccgaguccuccaccgacgaggagggcggcggcuucgagugggacgacgacuucucccccgaccccuucauguccaagaccaccuccaaccuccucuccuccaagcccucccuccagaccuccaaguacuucuccccccccccccccgcccgcuccaccgagcaguccuggccccacuccgcccccuacucccgcuucuccaucucccccgccaacaucgccuccuucucccucacccaccucaccgacuccgacaucgagcagggcggcuccuccgaggacggcgagaaggacuga

SEQ ID NO: 45439 - RNA, 4470 nt, Artificial Sequence
  derived and/or modified sequence opt2 from LMTK3__Homo_sapiens__NP_001073903
augcgccagguccucuggcucugcaacgucugcgucaccgcccgcgagacccgccaccaccuccaccuccccgccauccucgacaagaugcccgcccccggcgcccucauccuccucgccgccgucuccgccuccggcugccucgccucccccgcccaccccgacggcuucgcccucggccgcgccccccucgccccccccuacgccgucguccucaucuccugcuccggccuccucgccuucaucuuccuccuccucaccugccucugcugcaagcgcggcgacgucggcuucaaggaguucgagaaccccgagggcgaggacugcuccggcgaguacaccccccccgccgaggagaccuccuccucccagucccuccccgacgucuacauccucccccucgccgaggucucccuccccaugcccgccccccagcccucccacuccgacaugaccaccccccucggccucucccgccagcaccucuccuaccuccaggagaucggcuccggcugguucggcaaggucauccucggcgagaucuucuccgacuacacccccgcccaggucgucgucaaggagcuccgcgccuccgccggcccccucgagcagcgcaaguucaucuccgaggcccagcccuaccgcucccuccagcaccccaacguccuccagugccucggccucugcgucgagacccuccccuuccuccucaucauggaguucugccagcucggcgaccucaagcgcuaccuccgcgcccagcgcccccccgagggccucucccccgagcuccccccccgcgaccuccgcacccuccagcgcaugggccucgagaucgcccgcggccucgcccaccuccacucccacaacuacguccacuccgaccucgcccuccgcaacugccuccucaccuccgaccucaccguccgcaucggcgacuacggccucgcccacuccaacuacaaggaggacuacuaccucacccccgagcgccucuggaucccccuccgcugggccgcccccgagcuccucggcgagcuccacggcaccuucauggucgucgaccagucccgcgaguccaacaucuggucccucggcgucacccucugggagcucuucgaguucggcgcccagcccuaccgccaccucuccgacgaggagguccucgccuucgucguccgccagcagcacgucaagcucgcccgcccccgccucaagcuccccuacgccgacuacugguacgacauccuccaguccugcuggcgcccccccgcccagcgccccuccgccuccgaccuccagcuccagcucaccuaccuccucuccgagcgccccccccgccccccccccccccccccccccccccgcgacggccccuuccccuggcccuggccccccgcccacuccgccccccgccccggcacccucuccucccccuucccccuccucgacggcuuccccggcgccgaccccgacgacguccucaccgucaccgaguccucccgcggccucaaccucgagugccucugggagaaggcccgccgcggcgccggccgcggcggcggcgcccccgccuggcagcccgccuccgccccccccgccccccacgccaaccccuccaaccccuucuacgaggcccucuccacccccuccguccuccccgucaucuccgcccgcucccccuccgucuccuccgaguacuacauccgccucgaggagcacggcuccccccccgagccccucuuccccaacgacugggacccccucgaccccggcguccccgccccccaggccccccaggcccccuccgaggucccccagcucgucuccgagaccugggccuccccccucuuccccgccccccgccccuuccccgcccaguccuccgccuccggcuccuuccuccucuccggcugggaccccgagggccgcggcgccggcgagacccucgccggcgaccccgccgagguccucggcgagcgcggcaccgcccccugggucgaggaggaggaggaggaggaggagggcuccucccccggcgaggacuccuccucccucggcggcggccccucccgccgcggcccccuccccugcccccucugcucccgcgagggcgccugcuccugccucccccucgagcgcggcgacgccgucgccggcuggggcggccaccccgcccucggcugcccccacccccccgaggacgacuccucccuccgcgccgagcgcggcucccucgccgaccuccccauggccccccccgccuccgccccccccgaguuccucgacccccucaugggcgccgccgccccccaguaccccggccgcggccccccccccgcccccccccccccccccccccccccccgcgcccccgccgaccccgccgccucccccgacccccccuccgccgucgccucccccggcuccggccucuccucccccggccccaagcccggcgacuccggcuacgagaccgagacccccuucucccccgagggcgccuuccccggcggcggcgccgccgaggaggagggcgucccccgcccccgcgccccccccgagccccccgaccccggcgccccccgccccccccccgaccccggcccccucccccuccccggcccccgcgagaagcccaccuucgucguccaggucuccaccgagcagcuccucaugucccuccgcgaggacgucacccgcaaccuccucggcgagaagggcgccaccgcccgcgagaccggcccccgcaaggccggccgcggccccggcaaccgcgagaagguccccggccucaaccgcgaccccaccguccucggcaacggcaagcaggcccccucccucucccuccccgucaacggcgucaccguccucgagaacggcgaccagcgcgcccccggcaucgaggagaaggccgccgagaacggcgcccucggcucccccgagcgcgaggagaagguccucgagaacggcgagcucacccccccccgccgcgaggagaaggcccucgagaacggcgagcuccgcucccccgaggccggcgagaagguccucgucaacggcggccucaccccccccaaguccgaggacaaggucuccgagaacggcggccuccgcuucccccgcaacaccgagcgcccccccgagaccggccccuggcgcgcccccggccccugggagaagacccccgaguccuggggccccgcccccaccaucggcgagcccgcccccgagaccucccucgagcgcgcccccgcccccuccgccgucgucuccucccgcaacggcggcgagaccgcccccggcccccucggccccgcccccaagaacggcacccucgagcccggcaccgagcgccgcgcccccgagaccggcggcgccccccgcgcccccggcgccggccgccucgaccucggcuccggcggccgcgcccccgucggcaccggcaccgcccccggcggcggccccggcuccggcgucgacgccaaggccggcugggucgacaacacccgcccccagccccccccccccccccucccccccccccccgaggcccagccccgccgccucgagcccgcccccccccgcgcccgccccgaggucgcccccgagggcgagcccggcgcccccgacucccgcgccggcggcgacaccgcccucuccggcgacggcgacccccccaagcccgagcgcaagggccccgagaugccccgccucuuccucgaccucggccccccccagggcaacuccgagcagaucaaggcccgccucucccgccucucccucgcccuccccccccucacccucacccccuuccccggccccggcccccgccgcccccccugggagggcgccgacgccggcgccgccggcggcgaggccggcggcgccggcgcccccggccccgccgaggaggacggcgaggacgaggacgaggacgaggaggaggacgaggaggccgccgcccccggcgccgccgccggcccccgcggccccggccgcgcccgcgccgcccccguccccgucgucgucuccuccgccgacgccgacgccgcccgcccccuccgcggccuccucaaguccccccgcggcgccgacgagcccgaggacuccgagcucgagcgcaagcgcaagauggucuccuuccacggcgacgucaccgucuaccucuucgaccaggagacccccaccaacgagcucuccguccaggccccccccgagggcgacaccgaccccuccaccccccccgccccccccacccccccccaccccgccacccccggcgacggcuuccccuccaacgacuccggcuucggcggcuccuucgagugggccgaggacuucccccuccuccccccccccggccccccccucugcuucucccgcuucuccgucucccccgcccucgagacccccggcccccccgcccgcgcccccgacgcccgccccgccggccccgucgagaacuga

SEQ ID NO: 45440 - RNA, 1149 nt, Artificial Sequence
  derived and/or modified sequence opt2 from LMX1A__Homo_sapiens__NP_001167540
augcucgacggccucaagauggaggagaacuuccaguccgccaucgacaccuccgccuccuucuccucccuccucggccgcgccgucucccccaaguccgucugcgagggcugccagcgcgucauccucgaccgcuuccuccuccgccucaacgacuccuucuggcacgagcagugcguccagugcgccuccugcaaggagccccucgagaccaccugcuucuaccgcgacaagaagcucuacugcaaguacgacuacgagaagcucuucgccgucaagugcggcggcugcuucgaggccaucgcccccaacgaguucgucaugcgcgcccagaaguccgucuaccaccucuccugcuucugcugcugcgucugcgagcgccagcuccagaagggcgacgaguucguccucaaggagggccagcuccucugcaagggcgacuacgagaaggagcgcgagcuccucucccucgucucccccgccgccuccgacuccggcaaguccgacgacgaggagucccucugcaaguccgcccacggcgccggcaagggcaccgccgaggagggcaaggaccacaagcgccccaagcgcccccgcaccauccucaccacccagcagcgccgcgccuucaaggccuccuucgaggucuccuccaagcccugccgcaagguccgcgagacccucgccgccgagaccggccucuccguccgcgucguccaggucugguuccagaaccagcgcgccaagaugaagaagcucgcccgccgccagcagcagcagcagcaggaccagcagaacacccagcgccucuccuccgcccagaccaacggcggcggcuccgccggcauggagggcaucaugaaccccuacaccgcccuccccaccccccagcagcuccucgccaucgagcaguccgucuacuccuccgaccccuuccgccagggccucacccccccccagaugcccggcgaccacaugcaccccuacggcgccgagccccucuuccacgaccucgacuccgacgacaccucccucuccaaccucggcgacugcuuccucgccaccuccgaggccggcccccuccagucccgcgucggcaaccccaucgaccaccucuacuccaugcagaacuccuacuucaccuccuga

SEQ ID NO: 45441 - RNA, 1221 nt, Artificial Sequence
  derived and/or modified sequence opt2 from LMX1B__Homo_sapiens__NP_001167617
auggacaucgccaccggccccgagucccucgagcgcugcuucccccgcggccagaccgacugcgccaagaugcucgacggcaucaagauggaggagcacgcccuccgccccggccccgccacccucggcguccuccucggcuccgacugcccccaccccgccgucugcgagggcugccagcgccccaucuccgaccgcuuccucaugcgcgucaacgaguccuccuggcacgaggagugccuccagugcgccgccugccagcaggcccucaccaccuccugcuacuuccgcgaccgcaagcucuacugcaagcaggacuaccagcagcucuucgccgccaagugcuccggcugcauggagaagaucgcccccaccgaguucgucaugcgcgcccucgagugcgucuaccaccucggcugcuucugcugcugcgucugcgagcgccagcuccgcaagggcgacgaguucguccucaaggagggccagcuccucugcaagggcgacuacgagaaggagaaggaccuccucuccuccgucucccccgacgaguccgacuccgucaaguccgaggacgaggacggcgacaugaagcccgccaagggccagggcucccaguccaagggcuccggcgacgacggcaaggacccccgccgccccaagcgcccccgcaccauccucaccacccagcagcgccgcgccuucaaggccuccuucgaggucuccuccaagcccugccgcaagguccgcgagacccucgccgccgagaccggccucuccguccgcgucguccaggucugguuccagaaccagcgcgccaagaugaagaagcucgcccgccgccaccagcagcagcaggagcagcagaacucccagcgccucggccagggcgagcccggccccggccagggccucggccaggagguccucuccucccgcauggagggcaugauggccuccuacaccccccucgcccccccccagcagcagaucgucgccauggagcagucccccuacggcuccuccgaccccuuccagcagggccucacccccccccagaugcccggcaacgacuccaucuuccacgacaucgacuccgacaccucccucaccucccucuccgacugcuuccucggcuccuccgacgucggcucccuccaggcccgcgucggcaaccccaucgaccgccucuacuccaugcaguccuccuacuucgccuccuga

SEQ ID NO: 45442 - RNA, 3078 nt, Artificial Sequence
  derived and/or modified sequence opt2 from LNPEP__Homo_sapiens__NP_005566
auggagcccuucaccaacgaccgccuccagcucccccgcaacaugaucgagaacuccauguucgaggaggagcccgacgucgucgaccucgccaaggagcccugccuccacccccucgagcccgacgaggucgaguacgagccccgcggcucccgccuccucguccgcggccucggcgagcacgagauggaggaggacgaggaggacuacgaguccuccgccaagcuccucggcauguccuucaugaaccgcuccuccggccuccgcaacuccgccaccggcuaccgccagucccccgacggcgccugcuccguccccuccgcccgcaccauggucgucugcgccuucgucaucgucgucgccgucuccgucaucauggucaucuaccuccucccccgcugcaccuucaccaaggagggcugccacaagaagaaccaguccaucggccucauccagcccuucgccaccaacggcaagcucuuccccugggcccagauccgccuccccaccgccgucgucccccuccgcuacgagcucucccuccaccccaaccucaccuccaugaccuuccgcggcuccgucaccaucuccguccaggcccuccaggucaccuggaacaucauccuccacuccaccggccacaacaucucccgcgucaccuucauguccgccgucuccucccaggagaagcaggccgagauccucgaguacgccuaccacggccagaucgccaucgucgcccccgaggcccuccucgccggccacaacuacacccucaagaucgaguacuccgccaacaucuccuccuccuacuacggcuucuacggcuucuccuacaccgacgaguccaacgagaagaaguacuucgccgccacccaguucgagccccucgccgcccgcuccgccuuccccugcuucgacgagcccgccuucaaggccaccuucaucaucaagaucauccgcgacgagcaguacaccgcccucuccaacaugcccaagaaguccuccgucguccucgacgacggccucguccaggacgaguucuccgaguccgucaagauguccaccuaccucgucgccuucaucgucggcgagaugaagaaccucucccaggacgucaacggcacccucgucuccaucuacgccguccccgagaagaucggccagguccacuacgcccucgagaccaccgucaagcuccucgaguucuuccagaacuacuucgagauccaguacccccucaagaagcucgaccucgucgccauccccgacuucgaggccggcgccauggagaacuggggccuccucaccuuccgcgaggagacccuccucuacgacuccaacaccuccuccauggccgaccgcaagcucgucaccaagaucaucgcccacgagcucgcccaccagugguucggcaaccucgucaccaugaagugguggaacgaccucuggcucaacgagggcuucgccaccuucauggaguacuucucccucgagaagaucuucaaggagcucuccuccuacgaggacuuccucgacgcccgcuucaagaccaugaagaaggacucccucaacuccucccaccccaucuccuccuccguccaguccuccgagcagaucgaggagauguucgacucccucuccuacuucaagggcuccucccuccuccucaugcucaagaccuaccucuccgaggacgucuuccagcacgccgucguccucuaccuccacaaccacuccuacgccuccauccaguccgacgaccucugggacuccuucaacgaggucaccaaccagacccucgacgucaagcgcaugaugaagaccuggacccuccagaagggcuucccccucgucaccguccagaagaagggcaaggagcucuucauccagcaggagcgcuucuuccucaacaugaagcccgagauccagcccuccgacaccuccuaccucuggcacaucccccucuccuacgucaccgagggccgcaacuacuccaaguaccaguccgucucccuccucgacaagaaguccggcgucaucaaccucaccgaggagguccucugggucaaggucaacaucaacaugaacggcuacuacaucguccacuacgccgacgacgacugggaggcccucauccaccagcucaagaucaaccccuacguccucuccgacaaggaccgcgccaaccucaucaacaacaucuucgagcucgccggccucggcaaggucccccucaagcgcgccuucgaccucaucaacuaccucggcaacgagaaccacaccgcccccaucaccgaggcccucuuccagaccgaccucaucuacaaccuccucgagaagcucggcuacauggaccucgccucccgccucgucacccgcgucuucaagcuccuccagaaccagauccagcagcagaccuggaccgacgagggcacccccuccaugcgcgagcuccgcuccgcccuccucgaguucgccugcacccacaaccucggcaacugcuccaccaccgccaugaagcucuucgacgacuggauggccuccaacggcacccagucccuccccaccgacgucaugaccaccgucuucaaggucggcgccaagaccgacaagggcugguccuuccuccucggcaaguacaucuccaucggcuccgaggccgagaagaacaagauccucgaggcccucgccuccuccgaggacguccgcaagcucuacuggcucaugaaguccucccucaacggcgacaacuuccgcacccagaagcucuccuucaucauccgcaccgucggccgccacuuccccggccaccuccucgccugggacuucgucaaggagaacuggaacaagcucguccagaaguucccccucggcuccuacaccauccagaacaucgucgccggcuccaccuaccucuucuccaccaagacccaccucuccgagguccaggccuucuucgagaaccaguccgaggccaccuuccgccuccgcugcguccaggaggcccucgaggucauccagcucaacauccaguggauggagaagaaccucaagucccucaccugguggcucuga

SEQ ID NO: 45443 - RNA, 1899 nt, Artificial Sequence
  derived and/or modified sequence opt2 from LNX1__Homo_sapiens__NP_116011
augaaggcccuccuccuccucguccuccccuggcucucccccgccaacuacaucgacaacgucggcaaccuccacuuccucuacuccgagcucugcaagggcgccucccacuacggccucaccaaggaccgcaagcgccgcucccaggacggcugccccgacggcugcgccucccucaccgccaccgcccccucccccgaggucuccgccgccgccaccaucucccucaugaccgacgagcccggccucgacaaccccgccuacgucuccuccgccgaggacggccagcccgccaucucccccgucgacuccggccgcuccaaccgcacccgcgcccgccccuucgagcgcuccaccauccgcucccgcuccuucaagaagaucaaccgcgcccucuccguccuccgccgcaccaaguccggcuccgccgucgccaaccacgccgaccagggccgcgagaacuccgagaacaccaccgcccccgaggucuucccccgccucuaccaccucauccccgacggcgagaucaccuccaucaagaucaaccgcgucgaccccuccgagucccucuccauccgccucgucggcggcuccgagaccccccucguccacaucaucauccagcacaucuaccgcgacggcgucaucgcccgcgacggccgccuccuccccggcgacaucauccucaaggucaacggcauggacaucuccaacgucccccacaacuacgccguccgccuccuccgccagcccugccagguccucuggcucaccgucaugcgcgagcagaaguuccgcucccgcaacaacggccaggcccccgacgccuaccgcccccgcgacgacuccuuccacgucauccucaacaaguccucccccgaggagcagcucggcaucaagcucguccgcaaggucgacgagcccggcgucuucaucuucaacguccucgacggcggcgucgccuaccgccacggccagcucgaggagaacgaccgcguccucgccaucaacggccacgaccuccgcuacggcucccccgaguccgccgcccaccucauccaggccuccgagcgccgcguccaccucgucgucucccgccagguccgccagcgcucccccgacaucuuccaggaggccggcuggaacuccaacggcuccuggucccccggccccggcgagcgcuccaacacccccaagccccuccaccccaccaucaccugccacgagaaggucgucaacauccagaaggaccccggcgagucccucggcaugaccgucgccggcggcgccucccaccgcgagugggaccuccccaucuacgucaucuccgucgagcccggcggcgucaucucccgcgacggccgcaucaagaccggcgacauccuccucaacgucgacggcgucgagcucaccgaggucucccgcuccgaggccgucgcccuccucaagcgcaccuccuccuccaucguccucaaggcccucgaggucaaggaguacgagccccaggaggacugcuccucccccgccgcccucgacuccaaccacaacauggccccccccuccgacuggucccccuccugggucauguggcucgagcucccccgcugccucuacaacugcaaggacaucguccuccgccgcaacaccgccggcucccucggcuucugcaucgucggcggcuacgaggaguacaacggcaacaagcccuucuucaucaaguccaucgucgagggcacccccgccuacaacgacggccgcauccgcugcggcgacauccuccucgccgucaacggccgcuccaccuccggcaugauccacgccugccucgcccgccuccucaaggagcucaagggccgcaucacccucaccaucgucuccuggcccggcaccuuccucuga

SEQ ID NO: 45444 - RNA, 2073 nt, Artificial Sequence
  derived and/or modified sequence opt2 from LNX2__Homo_sapiens__NP_699202
augggcaccaccuccgacgagauggucuccgucgagcagaccuccuccuccucccucaacccccucugcuucgagugcggccagcagcacuggacccgcgagaaccaccucuacaacuaccagaacgaggucgacgacgaccucgucugccacaucugccuccagccccuccuccagccccucgacacccccugcggccacaccuucugcuacaagugccuccgcaacuuccuccaggagaaggacuucugcccccucgaccgcaagcgccuccacuucaagcucugcaagaaguccuccauccucguccacaagcuccucgacaagcuccucguccucugccccuucuccuccgucugcaaggacgucaugcagcgcugcgaccucgaggcccaccucaagaaccgcugccccggcgccucccaccgccgcgucgcccucgagcgccgcaagaccucccgcacccaggccgagaucgagaacgagaacggccccacccuccucgaccccgccggcacccucucccccgaggccgacugccucggcaccggcgccguccccgucgagcgccaccucaccuccgccucccucuccaccugguccgaggagcccggccucgacaaccccgccuucgaggaguccgccggcgccgacaccacccagcagccccucucccuccccgagggcgagaucaccaccaucgagauccaccgcuccaaccccuacauccagcucggcaucuccaucgucggcggcaacgagaccccccucaucaacaucgucauccaggaggucuaccgcgacggcgucaucgcccgcgacggccgccuccucgccggcgaccagauccuccaggucaacaacuacaacaucuccaacgucucccacaacuacgcccgcgccguccucucccagcccugcaacacccuccaccucaccguccuccgcgagcgccgcuucggcaaccgcgcccacaaccacuccgacuccaacuccccccgcgaggagaucuuccaggucgcccuccacaagcgcgacuccggcgagcagcucggcaucaagcucguccgccgcaccgacgagcccggcgucuucauccucgaccuccucgagggcggccucgccgcccaggacggccgccucuccuccaacgaccgcguccucgccaucaacggccacgaccucaaguacggcacccccgagcucgccgcccagaucauccaggccuccggcgagcgcgucaaccucaccaucgcccgccccggcaagccccagcccggcaacaccauccgcgaggccggcaaccacuccuccuccucccagcaccacacccccccccccuacuacucccgccccuccucccacaaggaccucacccagugcgucaccugccaggagaagcacaucaccgucaagaaggagccccacgagucccucggcaugaccgucgccggcggccgcggcuccaaguccggcgagcuccccaucuucgucaccuccguccccccccacggcugccucgcccgcgacggccgcaucaagcgcggcgacguccuccucaacaucaacggcaucgaccucaccaaccucucccacuccgaggccgucgccaugcucaaggccuccgccgccucccccgccgucgcccucaaggcccucgagguccagaucgucgaggaggccacccagaacgccgaggagcagcccuccaccuucuccgagaacgaguacgacgccuccuggucccccuccugggucauguggcucggccuccccuccacccuccacuccugccacgacaucguccuccgccgcuccuaccucggcuccuggggcuucuccaucgucggcggcuacgaggagaaccacaccaaccagcccuucuucaucaagaccaucguccucggcacccccgccuacuacgacggccgccucaagugcggcgacaugaucgucgccgucaacggccucuccaccgucggcaugucccacuccgcccucguccccaugcucaaggagcagcgcaacaaggucacccucaccgucaucugcuggcccggcucccucgucuga

SEQ ID NO: 45445 - RNA, 1755 nt, Artificial Sequence
  derived and/or modified sequence opt2 from LOC100288966__Homo_sapiens__NP_001244291
auggucgccgaggucugcuccaugcccaccgccuccaccgucaagaagcccuucgaccuccgcuccaagaugggcaaguggugccaccaccgcuuccccugcugccgcggcuccggcaaguccaacaugggcaccuccggcgaccacgacgacuccuucaugaagaugcuccgcuccaagaugggcaagugcugccgccacugcuuccccugcugccgcggcuccggcaccuccaacgucggcaccuccggcgaccacgagaacuccuucaugaagaugcuccgcuccaagaugggcaaguggugcugccacugcuuccccugcugccgcggcuccuccaaguccaacgucggcgccuggggcgacuacgaccacuccgccuucauggagccccgcuaccacguccgccgcgaggaccucgacaagcuccaccgcgccgccugguggggcaaggucccccgcaaggaccucaucgucaugcuccgcgacaccgacaugaacaagcgcgacaaggagaagcgcaccgcccuccaccucgccuccgccaacggcaacuccgaggucguccagcuccuccucgaccgccgcugccagcucaacguccucgacaacaagaagcgcaccgcccucaucaaggccauccagugccaggaggacgagugcguccucaugcuccucgagcacggcgccgaccgcaacauccccgacgaguacggcaacaccgcccuccacuacgccaucuacaacgaggacaagcucauggccaaggcccuccuccucuacggcgccgacaucgaguccaagaacaagugcggccucaccccccuccuccucggcguccacgagcagaagcagcaggucgucaaguuccucaucaagaagaaggccaaccucaacguccucgaccgcuacggccgcaccgcccucauccucgccgucugcugcggcuccgccuccaucgucaaccuccuccucgagcagaacgucgacgucuccucccaggaccucuccggccagaccgcccgcgaguacgccgucuccucccaccaccacgucaucugcgagcuccucuccgacuacaaggagaagcagaugcucaagaucuccuccgagaacuccaaccccgagcaggaccucaagcucaccuccgaggaggagucccagcgccucaaggucuccgagaacucccagcccgagaagaugucccaggagcccgagaucaacaaggacugcgaccgcgaggucgaggaggagaucaagaagcacggcuccaaccccgucggccuccccgagaaccucaccaacggcgccuccgccggcaacggcgacgacggccucaucccccagcgccgcucccgcaagcccgagaaccagcaguuccccgacaccgagaacgaggaguaccacuccgacgagcagaacgacacccgcaagcagcucuccgaggagcagaacaccggcaucucccaggacgagauccucaccaacaagcagaagcagaucgaggucgccgagcagaagaugaacuccgagcucucccucucccacaagaaggaggaggaccuccuccgcgagaacuccguccuccaggaggagaucgccguccuccgccucgagcucgacgagaccaagcaccagaaccagcuccgcgagaacaagauccucgaggagaucgaguccgucaaggagaagaccgacaagcuccuccgcgccaugcagcucaacgaggaggcccucaccaagaccaacaucuga

SEQ ID NO: 45446 - RNA, 1650 nt, Artificial Sequence
  derived and/or modified sequence opt2 from LOC101060321__Homo_sapiens__NP_001278391
auggacgucgucgaggucgccggcuccuggugggcccaggagcgcgaggacaucaucaugaaguacgagaagggccaccgcgccggccuccccgaggacaagggccccaagcccuuccgcuccuacaacaacaacgucgaccaccucggcaucguccacgagaccgagcuccccccccucaccgcccgcgaggccaagcagauccgccgcgagaucucccgcaaguccaagugggucgacaugcucggcgacugggagaaguacaaguccucccgcaagcucaucgaccgcgccuacaagggcaugcccaugaacauccgcggccccaugugguccguccuccucaacaucgaggagaugaagcucaagaaccccggccgcuaccagaucaugaaggagaagggcaagcgcuccuccgagcacauccagcgcaucgaccgcgacaucuccggcacccuccgcaagcacauguucuuccgcgaccgcuacggcaccaagcagcgcgagcuccuccacauccuccucgccuacgaggaguacaaccccgaggucggcuacugccgcgaccucucccacaucgccgcccucuuccuccucuaccuccccgaggaggacgccuucugggcccucguccagcuccucgccuccgagcgccacucccuccagggcuuccacucccccaacggcggcaccguccagggccuccaggaccagcaggagcacgucgucgccaccucccagcccaagaccaugggccaccaggacaagaaggaccucugcggccagugcuccccccucggcugccucauccgcauccucaucgacggcaucucccucggccucacccuccgccucugggacgucuaccucgucgagggcgagcaggcccucaugcccaucacccgcaucgccuucaagguccagcagaagcgccucaccaagaccucccgcugcggccccugggcccgcuucugcaaccgcuucgucgacaccugggcccgcgacgaggacaccguccucaagcaccuccgcgccuccaugaagaagcucacccgcaagcagggcgaccuccccccccccgccaagcccgagcagggcuccuccgccucccgccccguccccgccucccgcggcggcaagacccucugcaagggcgaccgccaggccccccccggcccccccgcccgcuucccccgccccaucugguccgccucccccccccgcgccccccgcuccuccacccccugccccggcggcgccguccgcgaggacaccuaccccgucggcacccagggcguccccucccccgcccucgcccagggcggcccccagggcuccuggcgcuuccuccaguggaacuccaugccccgccuccccaccgaccucgacgucgagggccccugguuccgccacuacgacuuccgccaguccugcuggguccgcgccaucucccaggaggaccagcucgcccccugcuggcaggccgagcaccccgccgagcgcguccgcuccgccuucgccgcccccuccaccgacuccgaccagggcacccccuuccgcgcccgcgacgagcagcagugcgcccccaccuccggccccugccucugcggccuccaccucgaguccucccaguucccccccggcuucuga

SEQ ID NO: 45447 - RNA, 453 nt, Artificial Sequence
  derived and/or modified sequence opt2 from LOC102723475__Homo_sapiens__XP_006724009
auggccuaccucgaggucugccucggcucccucuccugcuccuccggcacccucaugccccgcaugauccucuccaacaccaccgccgucacccccuuccucaccaagcucuggcaggagaccguccagcagggcggcaacauguccggccucgcccgccgcuccccccgcuccggcgacggcaagcucgaggcccucuacguccucaugguccucggcuucuucggcuucuucacccucggcaucaugcucuccuacauccgcuccaagaagcucgagcacuccaacgaccccuucaacgucuacaucgaguccaacgccuggcaggagaaggacaaggccuacguccaggcccgcguccucgaguccuaccgcuccugcuacgucgucgagaaccaccucgccaucgagcagcccaacacccaccuccccgagaccaagcccucccccuga

SEQ ID NO: 45448 - RNA, 1551 nt, Artificial Sequence
  derived and/or modified sequence opt2 from LOC102723996__Homo_sapiens__XP_006723962
augcgccucggcucccccggccuccucuuccuccucuucuccucccuccgcgccgacacccaggagaaggagguccgcgccauggucggcuccgacgucgagcucuccugcgccugccccgagggcucccgcuucgaccucaacgacgucuacgucuacuggcagaccuccgaguccaagaccgucgucaccuaccacaucccccagaacuccucccucgagaacgucgacucccgcuaccgcaaccgcgcccucaugucccccgccggcaugcuccgcggcgacuucucccuccgccucuucaacgucaccccccaggacgagcagaaguuccacugccucguccucucccagucccucggcuuccaggagguccucuccgucgaggucacccuccacgucgccgccaacuucuccguccccgucgucuccgccccccacucccccucccaggacgagcucaccuucaccugcaccuccaucaacggcuacccccgccccaacgucuacuggaucaacaagaccgacaacucccuccucgaccaggcccuccagaacgacaccgucuuccucaacaugcgcggccucuacgacgucgucuccguccuccgcaucgcccgcacccccuccgucaacaucggcugcugcaucgagaacguccuccuccagcagaaccucaccgucggcucccagaccggcaacgacaucggcgagcgcgacaagaucaccgagaaccccgucuccaccggcgagaagaacgccgccaccugguccauccucgccguccucugccuccucgucgucgucgccgucgccaucggcugggucugccgcgaccgcugccuccagcacuccuacgccggcgccugggccgucucccccgagaccgagcucaccggcgaguucgccgucggcuccucccgcuucuggggcgcccagggccgccucggcugccagcucuccuuccgcgucuccaagaacuuccagaaggccgagguccccugccucgagcagcuccucuuccucgagacccagcgcuccccccgcuggugcgcccgccacuuccuccagcccccccucggcaugggcuggcaccccggcguccacuucgucacccuccgcugggacuuccccaacaugcaccgcucccgcgagaccuccgcccgccucccccgcucccccguccccucccccgaccagggcguccagggcggcucccgccaccgccgccccgcccccaugggcugccccgaguggguccaggcccccgcccccuccccccgcggcgucucccgcgccggccccggcaccggcgcccagccccccuggggcguccagggcggcucccgccaccgccgccccgcccccaugggcugccccgaguggguccaggcccccgcccccuccccccgcggcgucugccgcgccggccccggcaccggcgcccagccccucuggggcguccgcuccggcuccggccaccgccagcuccucuccgucgccgccacccccgccgcccucgucugccccuccguccccggcgccaccuga

SEQ ID NO: 45449 - RNA, 399 nt, Artificial Sequence
  derived and/or modified sequence opt2 from LOC102724127__Homo_sapiens__XP_011544335
augcgcgccucccccugcaucucccagcccgccgccuccuggcacccccgccccuccgcccuccgccccaccgccggcuccggccccgacacccgcacccccggcaccgucgaggacggcuccgcccccugccccgccuuccgcucccccgccgucucccccugcggcgaggagcccugcugcuuccagaucucccccgccgaggagacccucgagcucggccgccucgucucccccggcaacugcgacacccucuccccccgcgccgccggcuucuacgccugccacguccgcucccucauccccugccgcuccaccaagggccgcuggccccucaccgccuccgccgccggccucucccgccacgcccagugcggccccucccucggccucggcuga

SEQ ID NO: 45450 - RNA, 1656 nt, Artificial Sequence
  derived and/or modified sequence opt2 from LOC102724560__Homo_sapiens__XP_011544402
augcccuccgagaccccccaggccgaggucggccccaccggcugcccccaccgcuccggcccccacuccgccaagggcucccucgagaagggcucccccgaggacaaggaggccaaggagccccucuggauccgccccgacgcccccucccgcugcaccuggcagcucggccgccccgccuccgaguccccccaccaccacaccgcccccgccaagucccccaagauccuccccgacauccucaagaagaucggcgacacccccaugguccgcaucaacaagaucggcaagaaguucggccucaagugcgagcuccucgccaagugcgaguucuucaacgccggcggcuccgucaaggaccgcaucucccuccgcaugaucgaggacgccgagcgcgacggcacccucaagcccggcgacaccaucaucgagcccaccuccggcaacaccggcaucggccucgcccucgccgccgccguccgcggcuaccgcugcaucaucgucaugcccgagaagauguccuccgagaaggucgacguccuccgcgcccucggcgccgagaucguccgcacccccaccaacgcccgcuucgacucccccgagucccacgucggcgucgccuggcgccucaagaacgagauccccaacucccacauccucgaccaguaccgcaacgccuccaacccccucgcccacuacgacaccaccgccgacgagauccuccagcagugcgacggcaagcucgacaugcucgucgccuccgucggcaccggcggcaccaucaccggcaucgcccgcaagcucaaggagaagugccccggcugccgcaucaucggcgucgaccccgagggcuccauccucgccgagcccgaggagcucaaccagaccgagcagaccaccuacgaggucgagggcaucggcuacgacuucauccccaccguccucgaccgcaccgucgucgacaagugguucaaguccaacgacgaggaggccuucaccuucgcccgcaugcucaucgcccaggagggccuccucugcggcggcuccgccggcuccaccgucgccgucgccgucaaggccgcccaggagcuccaggagggccagcgcugcgucgucauccuccccgacuccguccgcaacuacaugaccaaguuccucuccgaccgcuggaugcuccagaagggcuuccucaaggaggaggaccucaccgagaagaagcccuggugguggcaccuccgcguccaggagcucggccucuccgccccccucaccguccuccccaccaucaccugcggccacaccaucgagauccuccgcgagaagggcuucgaccaggcccccgucgucgacgaggccggcgucauccucggcauggucacccucggcaacaugcucuccucccuccucgccggcaagguccagcccuccgaccaggucggcaaggucaucuacaagcaguucaagcagauccgccucaccgacacccucggccgccucucccacauccucgagauggaccacuucgcccucgucguccacgagcagauccaguaccacuccaccggcaaguccucccagcgccagauggucuucggcgucgucaccgccaucgaccuccucaacuucgucgccgcccaggagcgcgaccagaaguga

SEQ ID NO: 45451 - RNA, 663 nt, Artificial Sequence
  derived and/or modified sequence opt2 from LOC102724770__Homo_sapiens__XP_006724997
auggagcgcuacgccggcgcccucgaggaggucgccgacggcgcccgccagcaggagcgccacuaccagcuccucuccgcccuccagucccucgucaaggagcuccccuccuccuuccagcagcgccucuccuacaccacccucuccgaccucgcccucgcccuccucgacggcaccgucuucgagaucguccagggccuccucgagauccagcaccucaccgagaagucccucuacaaccagcgccuccgccuccagaacgagcaccgcguccuccgccaggcccuccgccagaagcaccaggaggcccagcaggccugccgcccccacaaccuccccguccuccaggccgcccagcagcgcgagcucgaggccgucgagcaccgcauccgcgaggagcagcgcgccauggaccagaagaucguccucgagcucgaccgcaaggucgccgaccagcaguccacccucgagaaggccggcgucgccggcuucuacgucaccaccaacccccaggagcucaugcuccagaugaaccuccucgagcucauccgcaagcuccagcagcgcggcugcugggccggcaaggccgcccucggccucggcggccccuggcagcuccccgccgcccagugcgaccagaagggcucccccgucccccccuga

SEQ ID NO: 45452 - RNA, 2292 nt, Artificial Sequence
  derived and/or modified sequence opt2 from LOC102725016__Homo_sapiens__XP_006725712
augcacggcgccugcuccaugcgccgcuuccacccccuccucgcccucgccggcacccacugcgccugcucccacuuccgcuccucccgcaccgccaccccccccugggccgccccccucaagauccucaacgccgagcgcgcccgcgccguccgccccccccagccccucccccgcccccaccgcucccgcuccgccccccccaagccccccgccaaggccccccgcgccgccggccgcgccuggcucgccgccgccuccccccgcgacgacaucgucgccaugacccgccgcuccgacgucaacgccggcgcccucgucugggagcgcggccgccgcgcccgcuucgaggccgcccucuccuccgccggccgcaccgccccccccccccgcuccccccgccccgccuccccccgcuccucccgcggcgccggccccguccccugcgccgcccccccccagcgcgccguccucgccuccccccgcuccguccgcggcggccccaagccccccggccgcggcggcgcccgcgccuccggcggcgccgccggccccgcccccgccaugccccccggcaagguccuccagcccguccucaagaugaaggucgacgagcucuuccucuacuggcucuccgaggccuccacccagcgcaugcuccaggacugccuccgccgcaucaaggcccccggccgcgaccagcccacccccggcgacggcgagcagcccggcgccuggcccaccgccccccucgccgccccccgccccuccggccucgagccccccggcacccccggccccggccccgcccucccccucggcgccgccuccuccccccgcaacgccccccacguccgcggcacccgccgcuccgccggcacccgcgucguccagacccgcaaggaggagccccucccccccgccaccucccaguccauccccaccuucuacuucccccgcggccgcccccaggacuccgucaacgucgacgccgucaucuccaagaucgaguccaccuucgcccgcuucccccacgagcgcgccaccauggacgacaugggccucgucgccaaggccugcggcugcccccucuacuggaagggcccccucuucuacggcgccggcggcgagcgcaccggcuccgucuccguccacaaguucgucgccauguggcgcaagauccuccagaacugccacgacgacgccgccaaguucguccaccuccucaugucccccggcugcaacuaccucguccaggaggacuucguccccuuccuccaggacgucgucaacacccaccccggccucuccuuccucaaggaggccuccgaguuccacucccgcuacaucaccaccgucauccagcgcaucuucuacgccgucaaccgcuccugguccggccgcaucaccugcgccgagcuccgccgcuccuccuuccuccagaacgucgcccuccucgaggaggaggccgacaucaaccagcucaccgaguucuucuccuacgagcacuucuacgucaucuacugcaaguucugggagcucgacaccgaccacgaccuccucaucgacgccgacgaccucgcccgccacaacgaccacgcccucuccaccaagaugaucgaccgcaucuucuccggcgccgucacccgcggccgcaagguccagaaggagggcaagaucuccuacgccgacuucgucugguuccucaucuccgaggaggacaagaagacccccaccuccaucgaguacugguuccgcugcauggaccucgacggcgacggcgcccucuccauguucgagcucgaguacuucuacgaggagcagugccgccgccucgacuccauggccaucgaggcccuccccuuccaggacugccucugccagaugcucgaccucgucaagccccgcaccgagggcaagaucacccuccaggaccucaagcgcugcaagcucgccaacgucuucuucgacaccuucuucaacaucgagaaguaccucgaccacgagcagaaggagcagaucucccuccuccgcgacggcgacuccggcggccccgagcucuccgacugggagaaguacgccgccgaggaguacgacauccucgucgccgaggagaccgucggcgagcccugggaggacggcuucgaggccgagcucucccccgucgagcagaagcucuccgcccuccgcuccccccucgcccagcgccccuucuucgaggcccccuccccccucggcgccgucgaccucuacgaguacgccugcggcgacgaggaccucgagccccucuga

SEQ ID NO: 45453 - RNA, 1899 nt, Artificial Sequence
  derived and/or modified sequence opt2 from LOC102725035__Homo_sapiens__XP_006726376
augacccccgcccucaccgcccuccucugccucggccucucccucggcccccgcacccgcguccaggccggccccuuccccaagcccacccucugggccgagcccggcuccgucaucuccuggggcucccccgucaccaucuggugccagggcucccucgaggcccaggaguaccgccucgacaaggagggcucccccgagccccucgaccgcaacaacccccucgagcccaagaacaaggcccgcuucuccauccccuccaugaccgagcaccacgccggccgcuaccgcugccacuacuacuccuccgccggcugguccgagcccuccgacccccucgagcucgucaugaccggcuucuacaacaagcccacccucuccgcccuccccucccccgucgucgccuccggcggcaacaugacccuccgcugcggcucccagaagggcuaccaccacuucguccucaugaaggagggcgagcaccagcucccccgcacccucgacucccagcagcuccacuccggcggcuuccaggcccucuuccccgucggccccgucaaccccucccaccgcuggcgcuucaccugcuacuacuacuacaugaacaccccccaggucuggucccaccccuccgacccccucgagauccuccccuccggcgucucccgcaagcccucccuccucacccuccagggccccguccucgcccccggccagucccucacccuccagugcggcuccgacgucggcuacgaccgcuucguccucuacaaggagggcgagcgcgacuuccuccagcgccccggccagcagccccaggccggccucucccaggccaacuucacccucggccccgucucccccucccacggcggccaguaccgcugcuacggcgcccacaaccucuccuccgagugguccgcccccuccgacccccucaacauccucauggccggccagaucuacgacaccgucucccucuccgcccagcccggccccaccgucgccuccggcgagaacgucacccuccucugccaguccugguggcaguucgacaccuuccuccucaccaaggagggcgccgcccaccccccccuccgccuccgcuccauguacggcgcccacaaguaccaggccgaguuccccaugucccccgucaccuccgcccacgccggcaccuaccgcugcuacggcuccuacuccuccaacccccaccuccucuccuuccccuccgagccccucgagcucauggucuccggccacuccggcggcuccucccucccccccaccggcccccccuccacccccggccucggccgcuaccucgagguccucaucggcgucuccgucgccuucguccuccuccucuuccuccuccucuuccuccuccuccgccgccagcgccacuccaagcaccgcaccuccgaccagcgcaagaccgacuuccagcgccccgccggcgccgccgagaccgagcccaaggaccgcggccuccuccgccgcuccucccccgccgccgacguccaggaggagaaccucuacgccgccgucaaggacacccaguccgaggaccgcgucgagcucgacucccagcaguccccccacgacgaggacccccaggccgucaccuacgcccccgucaagcacuccuccccccgccgcgagauggccuccccccccuccucccucuccggcgaguuccucgacaccaaggaccgccaggucgaggaggaccgccagauggacaccgaggccgccgccuccgaggccucccaggacgucaccuacgcccagcuccacucccucacccuccgccgcaaggccaccgagcccccccccucccaggagggcgagccccccgccgagcccuccaucuacgccacccucgccauccacuga

SEQ ID NO: 45454 - RNA, 9861 nt, Artificial Sequence
  derived and/or modified sequence opt2 from LOC400499__Homo_sapiens__XP_006721060
augaccgccugcaccggcuccgccggcccccaccuccccgucggcacccgcuacaccuaccacuucuccaccaacaccuccaccucccuccaggacguccucgucgagggcuccggccucggccuccagggccucgccguccucgacguccucggccucugccagauggcccucuggcuccaggacuuccaggucaccuccauccucggcgccaaggucgagcuccucaaggaguccgagucccucuccgccacccucggccgcaacccccuccgcuucauccuccacuccggccgcgucgcccaccucugcccccaccccaccgagccccgcuggguccucaacgucaagcgcgccguccucucccuccuccagggccaccccggcgcccacucccccaagaccuucgacgaggucgacauccucggccgcugccccaccaccuaccagcaccacggcgacuggcuccacaagaccaaggaccucgcccgcugcucccuccgccgcggccgcuccucccuccacucccaggcccuccccggcgucgcccccggccucaccucccgccucaccugcguccaguccuuccgcgccggcguccuccgcgaggccuccugcaccgagcucgacuccgccggcccccuccccgccaaggccuccgccguccagaugcgcacccucuccucccucucccuccuccacgagaugccccaggaccccgccggcaccgaccccgacgaccgcgacgacgaggacaugacccccuccucccuccucuacgagugggaggagacccccucccaggccauggucgccaccgccgccacccucguccgccgccucugccucgcccagaccaccucccucgaggccauggaccucuuccucacccucgucucccagcuccagggccucuccggcggcgagcucauggagcucuggcaguacuccuccuucaagugccgcgacaacggccagccccuccucgacgcccuccccuccugcggcaccgagcacugcgucggccucaugaaggagcucaucgccuccgccgccgucgaggccgacgaggucgaggccuggcucuccucccucgccuuccucccccagcccaccgacgccaugguccacaugcuccucccccuccuccagaccccccgcgccucccccggcgccuuccucggcaucuccgcccucguccacaaccucugcgccucccucgacggccccugcggccagcuccccggcgucggcucccucguccgcauccucggcgacgcccucggcgagaacugcaccauccaggagcccuccgacgacgacaagcuccagcucguccucaaggccgucggcaacgccggccucgccgccauggcccucacccccacccucuccgccugcgccucccuccgcuccuccacccccgagauccgccucggcgccauccaggccuuccgccgcguccccugcuccgccgaccgcuccguccucucccgccucuaccagucccucgaggaggacgccgagauccgcaucaacgccuaccucgcccucaugcgcugccccuccgaggaggucuucgcccagguccgccgcacccaggccggcgagcucuccacccaggucggcuccuucgucuggucccacauccuccagcuccucgagacccacgacccccucaagcgcgcccuccgcgacacccuccccgaggacauccucucccaggaguuccaccccgagauguggaagcacuccuccuacuccgacgucaccuuccgcuccgucuccggcucccucggcgccaaccucgagggcacccuccucuucucccccgccuccuuccucccccgcuccgccaccgucaaccucaccauccacaccaugggccgcgccuucaaccuccucgagcucggccuccgccucgagaacgccgaggagaucgcccaccgccucuucggccgcaaguccuucuggggccaggaggacggccgcgagcccgagcccgaggagccccccggccccgagcccggccccgccccccagcccgccucccccgagugccccggcgaccgcgaccgccgcaugcgcuaccuccagcagaaggucacccgccgccgcggcgcccgccaggcccuccgcugcgagcucuccgucaagcuccucggccaggagcucuccuucgucaacugcggcgccaccggcucccacgucaaccacuggccccucaaccucgccgagcucgccaucaagcucaugaagggccaggagguccagaugaaccgccgccucucccucgccgcccaggagcucgucuuccccaccgucuccggccuccccgcccgccucacccucaacgccuccgccgccaucuccauccgcguccgcggcaccaccgacuuccagcagcgcuccgacuucuccgucaacggcuacgucaagcccuccgcccuccuccagaucuccgcccagaugggcaccgccggcauccucggccaggccggccuccgcugggucaccuccguccgcuccgccgccucccucgacggcggcauccagguccagaagggccgcguccucaagguccaccucaacacccccgaggaggccgucgagcuccucuccuucuccucccagcucuaccucaucacccgcgacggcguccgcucccuccgccacguccccggccccuccgagguccaguccugcaccggcgaggaggucuccuacaccuggggcuggcgccucugcaccggcgucaccuggcccguccccggccagcccuaccuccucucccuccccgucuucgccgccgucacccuccagaagcgcgaccccggccuccgccaguaccuccucgaggccgccuacacccuccagccccagaagggcuccugguucccccaggaggccaccgcccacgucuucaugggcacccccggcuccgagguccuccgcgacgucggcgucgacauguccuacucccucccccagaacaaguuccgccucaagcuccuccaccccaagaagaagaucgagcucgacggcaagauggaggcccucggcuccgcccacaccggccaccucgagcucguccucgacgaccgcgacgucuacuacaucaagggcugguccgaccuccagcccgccaugggcggcgaggccgagcgcuuccaggcccagcucgaggucaagcucgucaccggcggcucccccgucgucuucaccggcaaccucacccgccaggucggcuccaagcucgccuucuccgccucccucucccaccuccucuccgaccaggccaacgucaccgcccuccucgagcgcaaggaggagaacggccgccgcgucgccgcccucggcgccgagcucuucguccccggccucgucggccuccgcgcccucggccuccuccagcagcgcggccagcucuggaccaacucccuccgcauccaguacucccuccucggccaggccaagcaggccgcccacgagugcuccaccucccagaagcuccgcgccgacuccggcuccgacggcgccuaccgccucgagcuccgccacgagcuccacugcacccagauccucgccuucucccacaagguccagcucuggcacgaggaggacuccggccaccuccacucccagcucgaggucuccuacggcaagcacugggacaagaacuccaacaagcgccaccuccgcgucucccagaccuucaagaacgacuccggccccgcccucuccaaccacuucauggaguucguccuccagguccccgagcgccaggucgacugccgcguccagcucuaccaccucucccuccgccuccccuacgucgaguccuccucccaccucaagguccaguacaacggccgcccccucuucgucgccggcggccaguggaaggacaccucccgcgccacccucuggaagugggagggcgcccucaaccucgacucccccuggcucauggucuccgccgcccaccgccucuacuggccccaccgcgccgucuuccaggccguccucgagcucacccucggcaaggccuggacccucaaggaccucgucgucuccgucggcugccgcucccagggccccaaccgcgagggcaagauccaggucuacaccgccgccaccaccuaccuccgcgucuccaccgucaccguccucgcccagucccucuuccacuccugguccgagcucgaguccgccuggaacgccgccguccagggcgagauccacgccgagaacucccgcgaccgcaagauccucaacugcuggcucaagggcccccagcaggagcucaaccucaccgccgccuaccgccaccucgaguggccccgcaagacccaggucucccucaccgccguccgcaucggcgcccagggccagccccgcggccuccagcucgagggcgagcucgaggagcuccgccaggaccgcacccucuaccgcaagcgcggcgcccuccuccuccgccacccccuccaccuccccaucccccagucccuccuccuccaggagaccuucaccgccgaccgccgccaccagcgcuacucccucgagacccgcgucguccucaacggccgcgaggagacccuccagaccaugguccucggcugccaggccggccaccccuacgucugcgccggccucaugcaccccuacgacggcaaggucaucccccgcaacaccgagggcugccucgucaccuggaaccagcacaccgccaagaaccgcgaggucgaggccacccucaagguccaccgcaaggucguccuccaccucaagggccuccaccacgaccgcucccagcacggcgagauccgccacucccucgcccucgaccucgcccacuccuaccagcucuccuucccccaggcccucucccucgacggcggcaucaucuuccgccaguccccccagggcaccuucaacuucggcauggacgcccgcgccgccgucaaccacaacgucaccucccaggccuccguccagcucaacggcuccgacuccgacuucgccuucuucuuccagcuccgccacccccacggccccaccuucccccccaacuuccagguccaggccgccgccggccgcuaccgcguccgcucccucaacggcucccucuccguccagauguccggccgcgagcucguccuccucgaggucgacgccucccaggacacccgccgcuccucccgcggcuggggcgucuccguccuccuccaccaggccguccucuccgccccccgcgccguccgccuccagcucuccgccaagaucacccccgcccgcaucuggcucuucuccaaggcccuccucgaccagaacaccgcccagcuccuccucaaggccuccgaggaguggcgcggcggccgcauccucaccuuccagucccagacccgccacaccgucgccggcugggccgccaugccccgccuccucacccucaccggccgccucaagcagaaggagacccuccaggagggcacccucuccgucaccgccgacuccgccguccucggcuuccuccuccgcgaccagcacgagaaggccggcaacggcaccuccguccgcuccgucaccugcguccucgcccagaacuccucccaggcccuccccggcgagcuccagcucaagggccgccuccaggcccagacccgcaaccuccgcgcccaggccuccauccgcgcccacgccgccucccucgcccucggcggcgccugcuccuggggcccccgccacggccagcucgccggcggccccacccacaacaucuccacccucuccgacgccggccuccccuccgaggccggcaugcuccucucccucacccacgucgccuccaacugcuccgcccgccucgcccucuggaacgccggcgcccagcucgacggcgccaucggccucgaggacgucacccccgaguccuccggccuccagcuccacgccucccuccgccacacccacaccaugcccucccucaagcacuggggccuccccuucucccucgacggccacggccacuuccaguccgucggccgcucccucgccgccggccucaccgucauccucgacggcgagcagcuccgcgccgcccucgagcgcaaggccgagggcggccgccagggccucguccucggccuccaccacggccucuccggccuccagggcacccuccccucccagcucgaggucaacugcuccggcgacgccucccccacccagcuccucggcuggugccgcggcgacaucgccggccagccccucgaggucuccgucgacauccacaacggcuccuccggcuucgagcacuccggccgcauccucaugggccccaccuuccucaacuacuccgucuccugcuacuaccacgacggccaccucgagcucuccggccgcuccuggcacaacuccgaggcccuccucugggccggcuuccccggcgaggccugccucuccgccgagcuccagauccacgagacccagacccaggcccgcgucgcccuccacggcggcgacuccggcgucuccauggaccucgccgcccucgucgcccgcccccgccgcggcccccuccagcucgucgccuccgccucccacaccguccccgcccuccagcgccucggccuccccuucaccaaccagcucgucuuccagggccucugggaggccgaggagauguccuccucccuccagcucaccugcgacucccaggccacccucguccucgacguccgcggccagaaccaggccgucuccaaggagcuccucuucuccggccgccaccgccuccccuuccuccucggccucugccccuccuccgccuccgccuccgccaagcuccacuacuccaagggcgagguccaguccauguucgcccucggcgucgaggagcgccacuuccacaucuccacccgccaggucgccgccaaggccggccucaacaacuucaucaagcucgagcagaccuuccuccagcucuccgcccucccccgcgagcucuuccuccagaccgccuacgagcgcgcccacggcacccgcguccuccgccaggucguccucugggacggccaggaggucgcccucaccggcucccucuccggccccuuccccaagcccacccgcaaccucucccuccaggucgagcucacccacccccucccccucccccucccccgccacugcucccuccgccucuccuccgagcaccucggcggcucccaccgcgacggccucgucgucggcugggacggccgcgaccagguccucgucuccuccucccucuggcucggcaaguccgagcucgccgcccgccucgcccucgcccaccccuucaaccuccccuggcgccaggccgaggccuccggccucgccgagucccgcggcggccgccagucccgccagguccagcucaccuggaaccgcggccagcccgccacccuccagcucaccugggccgacggcucccucgcccacuccaccgccugggacggcugccucgccgccucccccggccagcuccaggagaccuggggccucaacucccuccaggccugcggcgccuucacccagacccccgccgucuucgucgagcagcucaacgucuccuggggccagcaccgcaugcgccagaaccucaccuacgagcgccacuggcccucccagcccgacaagaucaucauggaggccacccucgagcacguccucggcgccuccugcacccgccaguccuucuggggcgagguccagaccgacuacgcccgcuggcuccgccacucccuccaccucggccucugcgaccucccccgcgcccuccucgucgucggcgagcacacccucggccagggcggccuccuccuccgcucccgcugccaccucggccucgcccccgaccccgaccacggccuccaccucucccucacccuccagaaccacucccgcccccgcuccgccgacuucuccggcgcccucgagcuccgcggcuccaaggcccagcgcgucggccuccucggccgcgucuccaccuccaccucccagucccucguccgccucgagggcuccgucgacaaccgcgaggagaagguccgccucuccgucuuccgcgcccccuccugccuccaggccuccgucgcccacgaggagggcggccgcgaggaguccgucguccuccgcgccugcgcccacggccgcaccgccgaggccgagguccucuuccgcgacggccgccagcccucccagccccucggccgccucacccuccaggccgccaaccagucccuccuccucgccgcccgcggcugccagggcggccuccucggccacgucgagucccgcaucgccgccgucggcucccagguccaggcccgccucgaggagaagguccagggccucggcgccuccguccgccgcuuccagcagcucguccagcccgccggcacccucgacggcgucgccggccuccuccuccagcucucccaggccggccgcgaggccaugcaggccuccggcugggccgucgccacccucugggcccgcucccaggcccucacccagcaccucccccucuaccucgaguggcuccaggucggccucgagcagcuccgcgaggagcucgaguggccccucgccacccucaaggacgccuaccucgaggucacccuccgcccccucgaggaggucuggcgcgagcgcgccgaggaggccaugcgccgccuccaggccuggguccccggcaugcccggcaagggcggcccccgccccauccgcgccgcccucggcgccaugaagggcgcccucgagcucgccgcccagcagaugcucuccugggccgaggccaccuucucccgcgcccucaagcgccucugcaagccccuccucgaccucuacucccucuccgcccgcaaccgcuccgucgucgucaugcucccccuccuccccgccggcgacgagccccucgacgucgcccgcgucaccuccuaccucauggaggagaagcuccuccgcccccuccgcgagcucuccggcgccaacguccucgccgaguacuacuggcuccgccgccgccuccucgccggccccugggaguaccacgcccucgucgccggcgcccagcacgucgucaccuucgacggccgcgucugggaccucuccacccagugcggcuccauccuccucgcccaggacuucgcccacaacaccuucucccucacccucucccgcaccggcuccggccucaccgcccucuucgucgagcucaaccacaagacccucauccucuaccccucccuccaggccuaccgccucuacaacuccucccuccccggcgacuccugccccgaccucaagcuccaccccgccaccacccgcaaggacgucucccgcaucgagcucgccuccgaggacggcgucuccgucuccugcgacguccccaccggccucugcucccucacccucggccucuggcagcacggcaucuccgccggccuccucggcaccaacgacaacgaggccggcaacgagcucaugcuccccgacggcuccauggcccgcucccucgaggagcucucccucgccuggcaggucggcggcgacugccgcgccaccgagaagccccagcaggagcaggccugccccggccagcuccccgccugcugggccuucuucgagggcccccacuccucccuccgcgacugcuuccgcgucgucgaccccacccccuuccucucccucugcguccagguccccugcggcacccaggagcuccagcccgccugcaaccucgccgccgccuacauccaccucugcgcccgcggcuucgucccccucgccccccccccccagugcgcccccuga

SEQ ID NO: 45455 - RNA, 1251 nt, Artificial Sequence
  derived and/or modified sequence opt2 from LOC400927-CSNK1E__Homo_sapiens__NP_001276841
auggagcuccgcgucggcaacaaguaccgccucggccgcaagaucggcuccggcuccuucggcgacaucuaccucggcgccaacaucgccuccggcgaggaggucgccaucaagcucgagugcgucaagaccaagcacccccagcuccacaucgaguccaaguucuacaagaugaugcagggcggcgucggcauccccuccaucaaguggugcggcgccgagggcgacuacaacgucauggucauggagcuccucggccccucccucgaggaccucuucaacuucugcucccgcaaguucucccucaagaccguccuccuccucgccgaccagaugaucucccgcaucgaguacauccacuccaagaacuucauccaccgcgacgucaagcccgacaacuuccucaugggccucggcaagaagggcaaccucgucuacaucaucgacuucggccucgccaagaaguaccgcgacgcccgcacccaccagcacauccccuaccgcgagaacaagaaccucaccggcaccgcccgcuacgccuccaucaacacccaccucggcaucgagcagucccgccgcgacgaccucgagucccucggcuacguccucauguacuucaaccucggcucccuccccuggcagggccucaaggccgccaccaagcgccagaaguacgagcgcaucuccgagaagaagauguccacccccaucgagguccucugcaagggcuaccccuccgaguucuccaccuaccucaacuucugccgcucccuccgcuucgacgacaagcccgacuacuccuaccuccgccagcucuuccgcaaccucuuccaccgccagggcuucuccuacgacuacgucuucgacuggaacaugcucaaguucggcgccgcccgcaaccccgaggacgucgaccgcgagcgccgcgagcacgagcgcgaggagcgcaugggccagcuccgcggcuccgccacccgcgcccucccccccggcccccccaccggcgccaccgccaaccgccuccgcuccgccgccgagcccgucgccuccacccccgccucccgcauccagcccgccggcaacaccuccccccgcgccaucucccgcgucgaccgcgagcgcaaggucuccaugcgccuccaccgcggcgcccccgccaacgucuccuccuccgaccucaccggccgccaggaggucucccgcauccccgccucccagaccuccguccccuucgaccaccucggcaaguga

SEQ ID NO: 45456 - RNA, 2583 nt, Artificial Sequence
  derived and/or modified sequence opt2 from LOC645177__Homo_sapiens__XP_011519208
auggccuccccccgcaaggucaccgagaagcgccacaaccccgucgaguccaucugccgcaagauccgcgccauccacaagcgcgaggccaucuccaaccccauccagcagaucaucaaguaccaguccuccuccuucgacuccccccagaccaacaccaagaaguacuucgaggagguccuccgcaagaugaccgccgccugcguccccacccccggcucccacugguccuccuccgaggaggucgacgccuucaucuccuccccccagaucaucuccccccgcacccccuccaccucccaccucuccucccccgagaccgccaccuacuccgucauccucaccuccuccgagaacgucuccaagcccaagucccaguccaacaagaacuacaccucccucaugucccagauccgcaaggccgaguucuucuccaacaaggaccucaacaacuacugcuccgagaacaacuucuccacccucacccucgacuucgacuccaccuucguccagucccucaagugcuucgacccccaggacuccgucgucaagaagcucucccucaacgaggacggcuggaagcaggaggccgacgacggcaaggaggacgucaucuacuccaucaaccgcgccugcaaggaggaggcccucaccuccaucuucaacgccugcgacaucaagcgcaagggcuccgucggcgucgccaagaucaucaacuuccuccgccagaccaccucccagaacuccgaggacuccggccucgagcagcucuggaacaugcucgaccccgagaagcgcgacccccacgucgaccucgagaccuuccaggccaugaugaaggacuggauggccuacugcggcaacaccugggagggcgucaaccaccgccucuccuccaucaucgacgacuccgucugcgagcaggacggcaucaaguccgacggcaccaugaagauguccaccgacaucaccgacuccacccucggcuccuucgaggcccucggcggcgagaccuccaagggcguccucgaggucuccgaccucaucgccuacgucgccgaccuccacuucaacaagcgcaagcucgaggaggagaacaacaaguucaagcucgcccucgagacccucgaggagaccaacucccagcucuccgaggacugcaccgagcuccgccuccaggucaaguccgcccaccaggccaucaugcgcaccaaccuccucaaggaggagcucgaggagcucaagcucuccaugaacgccuccgaggagcagaaguccaugaucgucgcccaguccaagcagcucgagaccgagaaccgcgcccucauccucaagauccgcauccuccaggaggagaacuucaagaacaucauggacaucgaccgccucgagaagaagaucgaggaccucuccaagaccgagaccgagcaccaggucuccaccucccagauccucaugcagcuccacaccuacgagaacacccuccucaacaaggacaccucccuccagaagaagggccucuacaucgaggagcucaaguccaccaucaucgaguacggcuccaucaucgagaaccuccgcggcgagaaguccaagcucgcccacgagcuccagcaccuccagcaggcccucaucaccaacggcauccagcucaacgucaacggcgagugcaacuccaucaucuccgagggcgagaagucccuccacuacgagcucacccucgcccaguccgccgagaacaccgagaccgagcgccagcacaacgucaucaaccucuccucccucgacgccaugauggaccaggagaugcuccuccuccuccgcgagcccgcccagaaggccgucgaguucaccgccacccuccagaagcuccacgaggagaucuccaagaucgccacccucaucgagaacucccgccgcugggucaccaaccccgagaucaccgucaaggagaagugggaggagcagcucaccgaguucaacaacaucauggaggagaagcucgaccucugcauccucaugcucaacauccucggcaaccacaaggagucccucgacaaggaguucgccaagcucaucgagauccucaagcgcuuccgccaggaguacuucuacuuccgcaaggaguuccucgcccgcaaccccaccuccggccagaagcagcucgaggccaucaagcagcuccaggaggacgccgucaaccaggagggcauccuccgcaagcgccuccaggagaccucccagcgccucgaggacgucgaggagcagggcaaggaccgcgaccgcgaggcccacaccgccuccgagaaggccaccucccuccuccacaagcucgaggaggccaucuccgagcagcgcaaccuccagaccaucaacaccgagcucuccaacaccugccaggcccuccagcagaagacccgcaagcucaagaacgcccucucccucgacuccuucaccgccguccccacccucgaguccacccccuucuccggcgucgccaaccagauccacacccucugcgagcgccccaccuacggcgaggucaaggacggcgcccucgacgucaagcgccagcacaaguga

SEQ ID NO: 45457 - RNA, 2688 nt, Artificial Sequence
  derived and/or modified sequence opt2 from LONP1__Homo_sapiens__NP_001263408
auggccgccuccaccggcuacguccgccucuggggcgccgcccgcugcuggguccuccgccgccccaugcucgccgccgccggcggccgcguccccaccgccgccggcgccuggcuccuccgcggccccgucaucaccgcccucacccccaugaccauccccgacgucuucccccaccucccccucaucgccaucacccgcaaccccgucuucccccgcuucaucaagaucaucgaggucaagaacaagaagcucgucgagcuccuccgccgcaagguccgccucgcccagcccuacgucggcgucuuccucaagcgcgacgacuccaacgaguccgacgucgucgagucccucgacgagaucuaccacaccggcaccuucgcccagauccacgagaugcaggaccucggcgacaagcuccgcaugaucgucaugggccaccgccgcguccacaucucccgccagcucgaggucgagcccgaggagcccgaggccgagaacaagcacaagccccgccgcaaguccaagcgcggcaagaaggaggccgaggacgagcucuccgcccgccaccccgccgagcucgccauggagcccacccccgagcuccccgccgagguccucauggucgaggucgagaacgucguccacgaggacuuccaggucaccgaggaggucaaggcccucaccgccgagaucgucaagaccauccgcgacaucaucgcccucaacccccucuaccgcgaguccguccuccagaugaugcaggccggccagcgcgucgucgacaaccccaucuaccucuccgacaugggcgccgcccucaccggcgccgagucccacgagcuccaggacguccucgaggagaccaacauccccaagcgccucuacaaggcccucucccuccucaagaaggaguucgagcucuccaagcuccagcagcgccucggccgcgaggucgaggagaagaucaagcagacccaccgcaaguaccuccuccaggagcagcucaagaucaucaagaaggagcucggccucgagaaggacgacaaggacgccaucgaggagaaguuccgcgagcgccucaaggagcucgucguccccaagcacgucauggacgucgucgacgaggagcucuccaagcucggccuccucgacaaccacuccuccgaguucaacgucacccgcaacuaccucgacuggcucaccuccauccccuggggcaaguacuccaacgagaaccucgaccucgcccgcgcccaggccguccucgaggaggaccacuacggcauggaggacgucaagaagcgcauccucgaguucaucgccgucucccagcuccgcggcuccacccagggcaagauccucugcuucuacggcccccccggcgucggcaagaccuccaucgcccgcuccaucgcccgcgcccucaaccgcgaguacuuccgcuucuccgucggcggcaugaccgacgucgccgagaucaagggccaccgccgcaccuacgucggcgccaugcccggcaagaucauccagugccucaagaagaccaagaccgagaacccccucauccucaucgacgaggucgacaagaucggccgcggcuaccagggcgaccccuccuccgcccuccucgagcuccucgaccccgagcagaacgccaacuuccucgaccacuaccucgacguccccgucgaccucuccaagguccucuucaucugcaccgccaacgucaccgacaccauccccgagccccuccgcgaccgcauggagaugaucaacgucuccggcuacgucgcccaggagaagcucgccaucgccgagcgcuaccucgucccccaggcccgcgcccucugcggccucgacgaguccaaggccaagcucuccuccgacguccucacccuccucaucaagcaguacugccgcgaguccggcguccgcaaccuccagaagcaggucgagaagguccuccgcaaguccgccuacaagaucgucuccggcgaggccgaguccgucgaggucacccccgagaaccuccaggacuucgucggcaagcccgucuucaccgucgagcgcauguacgacgucaccccccccggcgucgucaugggccucgccuggaccgccaugggcggcuccacccucuucgucgagaccucccuccgccgcccccaggacaaggacgccaagggcgacaaggacggcucccucgaggucaccggccagcucggcgaggucaugaaggaguccgcccgcaucgccuacaccuucgcccgcgccuuccucaugcagcacgcccccgccaacgacuaccucgucaccucccacauccaccuccacguccccgagggcgccacccccaaggacggccccuccgccggcugcaccaucgucaccgcccuccucucccucgccaugggccgccccguccgccagaaccucgccaugaccggcgaggucucccucaccggcaagauccuccccgucggcggcaucaaggagaagaccaucgccgccaagcgcgccggcgucaccugcaucguccuccccgccgagaacaagaaggacuucuacgaccucgccgccuucaucaccgagggccucgagguccacuucgucgagcacuaccgcgagaucuucgacaucgccuuccccgacgagcaggccgaggcccucgccgucgagcgcuga

SEQ ID NO: 45458 - RNA, 2322 nt, Artificial Sequence
  derived and/or modified sequence opt2 from LONRF1__Homo_sapiens__NP_689484
auguccucccccgccgucgcccgcaccucccccggcggcucccgcgagauggcccccgccccccagggccgcggccgcuucugggaggucggcggcggcuccggccaccgccucgagcgcgccgccgccgaguccgagcgcugggagcuccuccuccgccgcggcgagcuccucgcccucggcggccaccucaagggcgcccucgaggccuucgccgccgcccuccgccgcggcgcccccgcccgccccgagugccucggcgcccucgucgacugccucgucuucaacuaccgccuccgccacggccucggcugguccgccgcccccgucgccggcgccgacggcggcgccggcggccuccuccgcugccucggcugccgcggcuuccucuccgagcccgucaccguccccugcggccacuccuacugccgccgcugccuccgccgcgagcuccgcgcccgcugccgccucugccgcgaccgccucccccccgccaccgccuccgccaccgacgccgagggcaccgccccccgcccccccccccucgccgccgccaucgccgccuccgacuuccgcaccuccgucguccucaaccaccucgccgagaagugguuccccggccagcgcgagcgcgcccgcgccgccggccgccucggcgagcuccuccaccagggccgcuaccgcgaggcccucgccgccgccugcgaggcccuccgcgccgagcccuccgaccucaucgucaagaucuaccgcgccgaguccuacgccggccuccaggaguucaaggccgccaucgaggaccucaacgccguccucuuccagcuccccgacuggcccgaggucuacuuccgcaagggcaagguccucugcgacgccggcuuccucggcgacgcccuccagcucuuccuccagugccucgcccucgacgaggacuucgcccccgccaagcuccagguccagaagauccucugcgaccuccuccuccccgagaaccucaaggagggccucaaggaguccuccugguccucccuccccugcaccaagaaccgccccuucgacuuccacuccgucauggaggagucccagucccucaacgagcccucccccaagcaguccgaggagauccccgaggucaccuccgagcccgucaagggcucccucaaccgcgcccaguccgcccaguccaucaacuccaccgagaugcccgcccgcgaggacugccucaagcgcgucuccuccgagcccguccucuccguccaggagaagggcguccuccucaagcgcaagcucucccuccucgagcaggacgucaucgucaacgaggacggccgcaacaagcucaagaagcagggcgagacccccaacgaggucugcauguucucccucgccuacggcgacauccccgaggagcucaucgacgucuccgacuucgagugcucccucugcaugcgccucuucuucgagcccgucaccacccccugcggccacuccuucugcaagaacugccucgagcgcugccucgaccacgcccccuacugcccccucugcaaggagucccucaaggaguaccucgccgaccgccgcuacugcgucacccagcuccucgaggagcucaucgucaaguaccuccccgacgagcucuccgagcgcaagaagaucuacgacgaggagaccgccgagcucucccaccucaccaagaacguccccaucuucgucugcaccauggccuaccccaccguccccugcccccuccacgucuucgagccccgcuaccgccucaugauccgccgcuccauccagaccggcaccaagcaguucggcaugugcgucuccgacacccagaacuccuucgccgacuacggcugcaugcuccagauccgcaacguccacuuccuccccgacggccgcuccgucgucgacaccgucggcggcaagcgcuuccgcguccucaagcgcggcaugaaggacggcuacugcaccgccgacaucgaguaccucgaggacgucaaggucgagaacgaggacgagaucaagaaccuccgcgagcuccacgaccucgucuacucccaggccugcuccugguuccagaaccuccgcgaccgcuuccgcucccagauccuccagcacuucggcuccaugcccgagcgcgaggagaaccuccaggccgcccccaacggccccgccuggugcugguggcuccucgccguccuccccgucgacccccgcuaccagcucuccguccucuccaugaagucccucaaggagcgccucaccaagauccagcacauccucaccuacuucucccgcgaccaguccaaguga

SEQ ID NO: 45459 - RNA, 939 nt, Artificial Sequence
  derived and/or modified sequence opt2 from LOR__Homo_sapiens__NP_000418
auguccuaccagaagaagcagcccaccccccagccccccgucgacugcgucaagaccuccggcggcggcggcggcggcggcggcuccggcggcggcggcugcggcuucuucggcggcggcggcuccggcggcggcuccuccggcuccggcugcggcuacuccggcggcggcggcuacuccggcggcggcugcggcggcggcuccuccggcggcggcggcggcggcggcaucggcggcugcggcggcggcuccggcggcuccgucaaguacuccggcggcggcggcuccuccggcggcggcuccggcugcuucuccuccggcggcggcggcuccggcugcuucuccuccggcggcggcggcuccuccggcggcggcuccggcugcuucuccuccggcggcggcggcuccuccggcggcggcuccggcugcuucuccuccggcggcggcggcuucuccggccaggccguccagugccaguccuacggcggcgucuccuccggcggcuccuccggcggcggcuccggcugcuucuccuccggcggcggcggcggcuccgucugcggcuacuccggcggcggcuccggcugcggcggcggcuccuccggcggcuccggcuccggcuacgucuccucccagcaggucacccagaccuccugcgccccccagcccuccuacggcggcggcuccuccggcggcggcggcuccggcggcuccggcugcuucuccuccggcggcggcggcggcuccuccggcugcggcggcggcuccuccggcaucggcuccggcugcaucaucuccggcggcggcuccgucugcggcggcggcuccuccggcggcggcggcggcggcuccuccgucggcggcuccggcuccggcaagggcguccccaucugccaccagacccagcagaagcaggcccccaccuggcccuccaaguga

SEQ ID NO: 45460 - RNA, 3345 nt, Artificial Sequence
  derived and/or modified sequence opt2 from LOXHD1__Homo_sapiens__NP_001138944
augaacaacgagaucaccuacuacuuccccugccagcgcuggcucgccgucgaggaggacgacggccagcucucccgcgagcuccuccccgucgacgaguccuacguccucccccaguccgaggagggccgcggcggcggcgacaacaacccccucgacaaccucgcccucgagcagaaggacaaguccaccaccuucuccgucaccaucaagaccggcgucaagaagaacgccggcaccgacgccaacgucuucaucacccucuucggcacccaggacgacaccggcaugacccuccucaaguccuccaagaccaacuccgacaaguucgagcgcgacuccaucgagaucuucaccgucgagacccucgaccucggcgaccucuggaagguccgccucggccacgacaacaccggcaaggcccccggcugguucgucgacugggucgaggucgacgcccccucccucggcaagugcaugaccuuccccugcggccgcuggcucgccaagaacgaggacgacggcuccaucauccgcgaccucuuccacgccgagcuccagacccgccucuacacccccuucguccccuacgagaucacccucuacaccuccgacgucuucgccgccggcaccgacgccaacaucuucaucaucaucuacggcugcgacgccgucugcacccagcagaaguaccucugcaccaacaagcgcgagcagaagcaguucuucgagcgcaaguccgccucccgcuucaucgucgagcucgaggacgucggcgagaucaucgagaagauccgcaucggccacaacaacaccggcaugaaccccggcuggcacugcucccacgucgacauccgccgccuccuccccgacaaggacggcgccgagacccucaccuuccccugcgaccgcuggcucgccaccuccgaggacgacaagaagaccauccgcgagcucguccccuacgacaucuucaccgagaaguacaugaaggacggcucccuccgccaggucuacaaggaggucgaggagccccucgacaucguccucuacuccguccagaucuucaccggcaacauccccggcgccggcaccgacgccaaggucuacaucaccaucuacggcgaccucggcgacaccggcgagcgcuaccucggcaaguccgagaaccgcaccaacaaguucgagcgcggcaccgccgacaccuucaucaucgaggccgccgaccucggcgucaucuacaagaucaagcuccgccacgacaacuccaaguggugcgccgacugguacgucgagaaggucgagaucuggaacgacaccaacgaggacgaguuccucuuccucugcggccgcuggcucucccucaagaaggaggacggccgccucgagcgccucuucuacgagaaggaguacaccggcgaccgcuccuccaacugcuccucccccgccgacuucugggagaucgcccucuccuccaagauggccgacgucgacaucuccaccgucaccggccccauggccgacuacguccaggagggccccaucauccccuacuacgucuccgucaccaccggcaagcacaaggacgccgccaccgacucccgcgccuucaucuuccucaucggcgaggacgacgagcgcuccaagcgcaucuggcucgacuacccccgcggcaagcgcggcuucucccgcggcuccgucgaggaguucuacgucgccggccucgacgucggcaucaucaagaagaucgagcucggccacgacggcgccucccccgaguccugcuggcucgucgaggagcucugccucgccguccccacccagggcaccaaguacaugcucaacugcaacugcuggcucgccaaggaccgcggcgacggcaucaccucccgcgucuucgaccuccucgacgccauggucgucaacaucggcgucaagguccucuacgagaugaccgucuggaccggcgacgucgucggcggcggcaccgacuccaacaucuucaugacccucuacggcaucaacggcuccaccgaggagaugcagcucgacaagaagaaggcccgcuucgagcgcgagcagaacgacaccuucaucauggagauccucgacaucgcccccuucaccaagaugcgcauccgcaucgacggccucggcucccgccccgagugguuccucgagcgcauccuccucaagaacaugaacaccggcgaccucaccauguucuacuacggcgacuggcucucccagcgcaagggcaagaagacccucgucugcgagaugugcgccgucaucgacgaggaggagaugauggaguggaccuccuacaccgucgccgucaagaccuccgacauccucggcgccggcaccgacgccaacgucuucaucaucaucuucggcgagaacggcgacuccggcacccucgcccucaagcaguccgccaacuggaacaaguucgagcgcaacaacaccgacaccuucaacuuccccgacaugcucucccucggccaccucugcaagcuccgcgucuggcacgacaacaagggcaucuuccccggcuggcaccucuccuacgucgacgucaaggacaacucccgcgacgagaccuuccacuuccagugcgacugcuggcucuccaaguccgagggcgacggccagaccguccgcgacuucgccugcgccaacaacaagaucugcgacgagcucgaggagaccaccuacgagaucgucaucgagaccggcaacggcggcgagacccgcgagaacgucuggcucauccucgagggccgcaagaaccgcuccaaggaguuccucauggagaacuccucccgccagcgcgccuuccgcaagggcaccaccgacaccuucgaguucgacuccaucuaccucggcgacaucgccucccucugcgucggccaccucgcccgcgaggaccgcuucauccccaagcgcgagcucgccuggcacgucaagaccaucaccaucaccgagauggaguacggcaacgucuacuucuucaacugcgacugccucaucccccucaagcgcaagcgcaaguacuucaaggucuucgaggucaccaagaccaccgaguccuucgccuccaagguccagucccucguccccgucaaguacgaggucaucgucaccaccggcuacgagcccggcgccggcaccgacgccaacgucuucgucaccaucuucggcgccaacggcgacaccggcaagcgcgagcucaagcagaagaugcgcaaccucuucgagcgcggcuccaccgaccgcuucuuccucgagacccucgagcucgucgucacccgccucggccucgccgccgagugcggcuga

SEQ ID NO: 45461 - RNA, 1254 nt, Artificial Sequence
  derived and/or modified sequence opt2 from LOX__Homo_sapiens__NP_002308
augcgcuucgccuggaccguccuccuccucggcccccuccagcucugcgcccucguccacugcgccccccccgccgccggccagcagcagcccccccgcgagccccccgccgcccccggcgccuggcgccagcagauccagugggagaacaacggccaggucuucucccuccucucccucggcucccaguaccagccccagcgccgccgcgaccccggcgccgccguccccggcgccgccaacgccuccgcccagcagccccgcacccccauccuccucauccgcgacaaccgcaccgccgccgcccgcacccgcaccgccggcuccuccggcgucaccgccggccgcccccgccccaccgcccgccacugguuccaggccggcuacuccaccucccgcgcccgcgaggccggcgccucccgcgccgagaaccagaccgcccccggcgagguccccgcccucuccaaccuccgcccccccucccgcgucgacggcauggucggcgacgaccccuacaaccccuacaaguacuccgacgacaaccccuacuacaacuacuacgacaccuacgagcgcccccgccccggcggccgcuaccgccccggcuacggcaccggcuacuuccaguacggccuccccgaccucgucgccgaccccuacuacauccaggccuccaccuacguccagaagauguccauguacaaccuccgcugcgccgccgaggagaacugccucgccuccaccgccuaccgcgccgacguccgcgacuacgaccaccgcguccuccuccgcuucccccagcgcgucaagaaccagggcaccuccgacuuccuccccucccgcccccgcuacuccugggaguggcacuccugccaccagcacuaccacuccauggacgaguucucccacuacgaccuccucgacgccaacacccagcgccgcgucgccgagggccacaaggccuccuucugccucgaggacaccuccugcgacuacggcuaccaccgccgcuucgccugcaccgcccacacccagggccucucccccggcugcuacgacaccuacggcgccgacaucgacugccaguggaucgacaucaccgacgucaagcccggcaacuacauccucaaggucuccgucaaccccuccuaccucguccccgaguccgacuacaccaacaacgucguccgcugcgacauccgcuacaccggccaccacgccuacgccuccggcugcaccaucucccccuacuga

SEQ ID NO: 45462 - RNA, 1725 nt, Artificial Sequence
  derived and/or modified sequence opt2 from LOXL1__Homo_sapiens__NP_005567
auggcccucgcccgcggcucccgccagcucggcgcccucgucuggggcgccugccucugcguccucguccacggccagcaggcccagcccggccagggcuccgaccccgcccgcuggcgccagcucauccagugggagaacaacggccaggucuacucccuccucaacuccggcuccgaguacguccccgccggcccccagcgcuccgaguccuccucccgcguccuccucgccggcgccccccaggcccagcagcgccgcucccacggcuccccccgccgccgccaggcccccucccucccccuccccggccgcgucggcuccgacaccguccgcggccaggcccgccaccccuucggcuucggccagguccccgacaacuggcgcgaggucgccgucggcgacuccaccggcauggcccgcgcccgcaccuccgucucccagcagcgccacggcggcuccgccuccuccgucuccgccuccgccuucgccuccaccuaccgccagcagcccuccuacccccagcaguuccccuacccccaggcccccuucgucucccaguacgagaacuacgaccccgccucccgcaccuacgaccagggcuucgucuacuaccgccccgccggcggcggcgucggcgccggcgccgccgccgucgccuccgccggcgucaucuaccccuaccagccccgcgcccgcuacgaggaguacggcggcggcgaggagcuccccgaguaccccccccagggcuucuaccccgcccccgagcgccccuacguccccccccccccccccccccccgacggccucgaccgccgcuacucccacucccucuacuccgagggcacccccggcuucgagcaggccuaccccgaccccggccccgaggccgcccaggcccacggcggcgacccccgccucggcugguacccccccuacgccaaccccccccccgaggccuacggccccccccgcgcccucgagccccccuaccuccccguccgcuccuccgacacccccccccccggcggcgagcgcaacggcgcccagcagggccgccucuccgucggcuccgucuaccgccccaaccagaacggccgcggccuccccgaccucguccccgaccccaacuacguccaggccuccaccuacguccagcgcgcccaccucuacucccuccgcugcgccgccgaggagaagugccucgccuccaccgccuacgcccccgaggccaccgacuacgacguccgcguccuccuccgcuucccccagcgcgucaagaaccagggcaccgccgacuuccuccccaaccgcccccgccacaccugggaguggcacuccugccaccagcacuaccacuccauggacgaguucucccacuacgaccuccucgacgccgccaccggcaagaaggucgccgagggccacaaggccuccuucugccucgaggacuccaccugcgacuucggcaaccucaagcgcuacgccugcaccucccacacccagggccucucccccggcugcuacgacaccuacaacgccgacaucgacugccaguggaucgacaucaccgacguccagcccggcaacuacauccucaagguccacgucaaccccaaguacaucguccucgaguccgacuucaccaacaacgucguccgcugcaacauccacuacaccggccgcuacgucuccgccaccaacugcaagaucguccaguccuga

SEQ ID NO: 45463 - RNA, 2325 nt, Artificial Sequence
  derived and/or modified sequence opt2 from LOXL2__Homo_sapiens__NP_002309
auggagcgcccccucugcucccaccucugcuccugccucgccaugcucgcccuccucuccccccucucccucgcccaguacgacuccuggccccacuaccccgaguacuuccagcagcccgcccccgaguaccaccagccccaggcccccgccaacgucgccaagauccagcuccgccucgccggccagaagcgcaagcacuccgagggccgcgucgaggucuacuacgacggccaguggggcaccgucugcgacgacgacuucuccauccacgccgcccacgucgucugccgcgagcucggcuacgucgaggccaaguccuggaccgccuccuccuccuacggcaagggcgagggccccaucuggcucgacaaccuccacugcaccggcaacgaggccacccucgccgccugcaccuccaacggcuggggcgucaccgacugcaagcacaccgaggacgucggcgucgucugcuccgacaagcgcauccccggcuucaaguucgacaacucccucaucaaccagaucgagaaccucaacauccaggucgaggacauccgcauccgcgccauccucuccaccuaccgcaagcgcacccccgucauggagggcuacgucgaggucaaggagggcaagaccuggaagcagaucugcgacaagcacuggaccgccaagaacucccgcgucgucugcggcauguucggcuuccccggcgagcgcaccuacaacaccaaggucuacaagauguucgccucccgccgcaagcagcgcuacuggcccuucuccauggacugcaccggcaccgaggcccacaucuccuccugcaagcucggcccccaggucucccucgaccccaugaagaacgucaccugcgagaacggccuccccgccgucgucuccugcguccccggccaggucuucucccccgacggccccucccgcuuccgcaaggccuacaagcccgagcagccccucguccgccuccgcggcggcgccuacaucggcgagggccgcgucgagguccucaagaacggcgaguggggcaccgucugcgacgacaagugggaccucgucuccgccuccgucgucugccgcgagcucggcuucggcuccgccaaggaggccgucaccggcucccgccucggccagggcaucggccccauccaccucaacgagauccagugcaccggcaacgagaaguccaucaucgacugcaaguucaacgccgagucccagggcugcaaccacgaggaggacgccggcguccgcugcaacacccccgccaugggccuccagaagaagcuccgccucaacggcggccgcaaccccuacgagggccgcgucgagguccucgucgagcgcaacggcucccucgucuggggcauggucugcggccagaacuggggcaucgucgaggccauggucgucugccgccagcucggccucggcuucgccuccaacgccuuccaggagaccugguacuggcacggcgacgucaacuccaacaaggucgucauguccggcgucaagugcuccggcaccgagcucucccucgcccacugccgccacgacggcgaggacgucgccugcccccagggcggcguccaguacggcgccggcgucgccugcuccgagaccgcccccgaccucguccucaacgccgagaugguccagcagaccaccuaccucgaggaccgccccauguucaugcuccagugcgccauggaggagaacugccucuccgccuccgccgcccagaccgaccccaccaccggcuaccgccgccuccuccgcuucuccucccagauccacaacaacggccaguccgacuuccgccccaagaacggccgccacgccuggaucuggcacgacugccaccgccacuaccacuccauggaggucuucacccacuacgaccuccucaaccucaacggcaccaaggucgccgagggccacaaggccuccuucugccucgaggacaccgagugcgagggcgacauccagaagaacuacgagugcgccaacuucggcgaccagggcaucaccaugggcugcugggacauguaccgccacgacaucgacugccagugggucgacaucaccgacgucccccccggcgacuaccucuuccaggucgucaucaaccccaacuucgaggucgccgaguccgacuacuccaacaacaucaugaagugccgcucccgcuacgacggccaccgcaucuggauguacaacugccacaucggcggcuccuucuccgaggagaccgagaagaaguucgagcacuucuccggccuccucaacaaccagcucuccccccaguga

SEQ ID NO: 45464 - RNA, 1827 nt, Artificial Sequence
  derived and/or modified sequence opt2 from LOXL3__Homo_sapiens__NP_001276093
augcgccccgucuccgucuggcaguggucccccuggggccuccuccucugccuccucugcuccuccugccucggcucccccucccccuccaccggccccgagaagaaggccggcucccagggccuccgcuuccgccucgccggcuucccccgcaagcccuacgagggccgcgucgagauccagcgcgccggcgaguggggcaccaucugcgacgacgacuucacccuccaggccgcccacauccucugccgcgagcucggcuucaccgaggccaccggcuggacccacuccgccaaguacggccccggcaccggccgcaucuggcucgacaaccucuccugcuccggcaccgagcaguccgucaccgagugcgccucccgcggcuggggcaacuccgacugcacccacgacgaggacgccggcgucaucugcaaggaccagcgccuccccggcuucuccgacuccaacgucaucgaggcccgcguccgccucaagggcggcgcccaccccggcgagggccgcgucgagguccucaaggccuccaccuggggcaccgucugcgaccgcaagugggaccuccacgccgccuccgucgucugccgcgagcucggcuucggcuccgcccgcgaggcccucuccggcgcccgcaugggccagggcaugggcgccauccaccucuccgagguccgcugcuccggccaggagcucucccucuggaagugcccccacaagaacaucaccgccgaggacugcucccacucccaggacgccggcguccgcugcaaccuccccuacaccggcgccgagacccgcauccgccucuccggcggccgcucccagcacgagggccgcgucgagguccagaucggcggccccggcccccuccgcuggggccucaucugcggcgacgacuggggcacccucgaggccauggucgccugccgccagcucggccucggcuacgccaaccacggccuccaggagaccugguacugggacuccggcaacaucaccgaggucgucauguccggcguccgcugcaccggcaccgagcucucccucgaccagugcgcccaccacggcacccacaucaccugcaagcgcaccggcacccgcuucaccgccggcgucaucugcuccgagaccgccuccgaccuccuccuccacuccgcccucguccaggagaccgccuacaucgaggaccgcccccuccacaugcucuacugcgccgccgaggagaacugccucgccuccuccgcccgcuccgccaacuggcccuacggccaccgccgccuccuccgcuucuccucccagauccacaaccucggccgcgccgacuuccgccccaaggccggccgccacuccugggucuggcacgagugccacggccacuaccacuccauggacaucuucacccacuacgacauccucacccccaacggcaccaaggucgccgagggccacaaggccuccuucugccucgaggacaccgagugccaggaggacgucuccaagcgcuacgagugcgccaacuucggcgagcagggcaucaccgucggcugcugggaccucuaccgccacgacaucgacugccaguggaucgacaucaccgacgucaagcccggcaacuacauccuccaggucgucaucaaccccaacuucgaggucgccgaguccgacuucaccaacaacgccaugaagugcaacugcaaguacgacggccaccgcaucuggguccacaacugccacaucggcgacgccuucuccgaggaggccaaccgccgcuucgagcgcuaccccggccagaccuccaaccagaucaucuga

SEQ ID NO: 45465 - RNA, 2271 nt, Artificial Sequence
  derived and/or modified sequence opt2 from LOXL4__Homo_sapiens__NP_115587
auggccugguccccccccgccacccucuuccucuuccuccuccuccucggccagcccccccccucccgcccccagucccucggcaccaccaagcuccgccucgucggccccgaguccaagcccgaggagggccgccucgagguccuccaccagggccaguggggcaccgucugcgacgacaacuucgccauccaggaggccaccgucgccugccgccagcucggcuucgaggccgcccucaccugggcccacuccgccaaguacggccagggcgagggccccaucuggcucgacaacguccgcugcgucggcaccgaguccucccucgaccagugcggcuccaacggcuggggcgucuccgacugcucccacuccgaggacgucggcgucaucugccacccccgccgccaccgcggcuaccucuccgagaccgucuccaacgcccucggcccccagggccgccgccucgaggagguccgccucaagcccauccucgccuccgccaagcagcacucccccgucaccgagggcgccgucgaggucaaguacgagggccacuggcgccaggucugcgaccagggcuggaccaugaacaacucccgcgucgucugcggcaugcucggcuuccccuccgagguccccgucgacucccacuacuaccgcaaggucugggaccucaagaugcgcgaccccaagucccgccucaagucccucaccaacaagaacuccuucuggauccaccaggucaccugccucggcaccgagccccacauggccaacugccagguccaggucgcccccgcccgcggcaagcuccgccccgccugccccggcggcaugcacgccgucgucuccugcgucgccggcccccacuuccgcccccccaagaccaagccccagcgcaagggcuccugggccgaggagccccgcguccgccuccgcuccggcgcccaggucggcgagggccgcgucgagguccucaugaaccgccaguggggcaccgucugcgaccaccgcuggaaccucaucuccgccuccgucgucugccgccagcucggcuucggcuccgcccgcgaggcccucuucggcgcccgccucggccagggccucggccccauccaccucuccgagguccgcugccgcggcuacgagcgcacccucuccgacugccccgcccucgagggcucccagaacggcugccagcacgagaacgacgccgccguccgcugcaacguccccaacaugggcuuccagaaccagguccgccucgccggcggccgcauccccgaggagggccuccucgagguccaggucgaggucaacggcgucccccgcuggggcuccgucugcuccgagaacuggggccucaccgaggccauggucgccugccgccagcucggccucggcuucgccauccacgccuacaaggagaccugguucugguccggcaccccccgcgcccaggaggucgucauguccggcguccgcugcuccggcaccgagcucgcccuccagcagugccagcgccacggccccguccacugcucccacggcggcggccgcuuccucgccggcgucuccugcauggacuccgcccccgaccucgucaugaacgcccagcucguccaggagaccgccuaccucgaggaccgcccccucucccagcucuacugcgcccacgaggagaacugccucuccaaguccgccgaccacauggacuggcccuacggcuaccgccgccuccuccgcuucuccacccagaucuacaaccucggccgcaccgacuuccgccccaagaccggccgcgacuccugggucuggcaccagugccaccgccacuaccacuccaucgaggucuucacccacuacgaccuccucacccucaacggcuccaaggucgccgagggccacaaggccuccuucugccucgaggacaccaacugccccaccggccuccagcgccgcuacgccugcgccaacuucggcgagcagggcgucaccgucggcugcugggacaccuaccgccacgacaucgacugccagugggucgacaucaccgacgucggccccggcaacuacaucuuccaggucaucgucaacccccacuacgaggucgccgaguccgacuucuccaacaacaugcuccagugccgcugcaaguacgacggccaccgcgucuggcuccacaacugccacaccggcaacuccuaccccgccaacgccgagcucucccucgagcaggagcagcgccuccgcaacaaccucaucuga

SEQ ID NO: 45466 - RNA, 6123 nt, Artificial Sequence
  derived and/or modified sequence opt2 from LPA__Homo_sapiens__NP_005568
auggagcacaaggaggucguccuccuccuccuccucuuccucaaguccgccgcccccgagcagucccacgucguccaggacugcuaccacggcgacggccaguccuaccgcggcaccuacuccaccaccgucaccggccgcaccugccaggccugguccuccaugaccccccaccagcacaaccgcaccaccgagaacuaccccaacgccggccucaucaugaacuacugccgcaaccccgacgccgucgccgcccccuacugcuacacccgcgaccccggcguccgcugggaguacugcaaccucacccagugcuccgacgccgagggcaccgccgucgccccccccaccgucacccccguccccucccucgaggcccccuccgagcaggcccccaccgagcagcgccccggcguccaggagugcuaccacggcaacggccaguccuaccgcggcaccuacuccaccaccgucaccggccgcaccugccaggccugguccuccaugaccccccacucccacucccgcacccccgaguacuaccccaacgccggccucaucaugaacuacugccgcaaccccgacgccgucgccgcccccuacugcuacacccgcgaccccggcguccgcugggaguacugcaaccucacccagugcuccgacgccgagggcaccgccgucgccccccccaccgucacccccguccccucccucgaggcccccuccgagcaggcccccaccgagcagcgccccggcguccaggagugcuaccacggcaacggccaguccuaccgcggcaccuacuccaccaccgucaccggccgcaccugccaggccugguccuccaugaccccccacucccacucccgcacccccgaguacuaccccaacgccggccucaucaugaacuacugccgcaaccccgacgccgucgccgcccccuacugcuacacccgcgaccccggcguccgcugggaguacugcaaccucacccagugcuccgacgccgagggcaccgccgucgccccccccaccgucacccccguccccucccucgaggcccccuccgagcaggcccccaccgagcagcgccccggcguccaggagugcuaccacggcaacggccaguccuaccgcggcaccuacuccaccaccgucaccggccgcaccugccaggccugguccuccaugaccccccacucccacucccgcacccccgaguacuaccccaacgccggccucaucaugaacuacugccgcaaccccgacgccgucgccgcccccuacugcuacacccgcgaccccggcguccgcugggaguacugcaaccucacccagugcuccgacgccgagggcaccgccgucgccccccccaccgucacccccguccccucccucgaggcccccuccgagcaggcccccaccgagcagcgccccggcguccaggagugcuaccacggcaacggccaguccuaccgcggcaccuacuccaccaccgucaccggccgcaccugccaggccugguccuccaugaccccccacucccacucccgcacccccgaguacuaccccaacgccggccucaucaugaacuacugccgcaaccccgacgccgucgccgcccccuacugcuacacccgcgaccccggcguccgcugggaguacugcaaccucacccagugcuccgacgccgagggcaccgccgucgccccccccaccgucacccccguccccucccucgaggcccccuccgagcaggcccccaccgagcagcgccccggcguccaggagugcuaccacggcaacggccaguccuaccgcggcaccuacuccaccaccgucaccggccgcaccugccaggccugguccuccaugaccccccacucccacucccgcacccccgaguacuaccccaacgccggccucaucaugaacuacugccgcaaccccgacgccgucgccgcccccuacugcuacacccgcgaccccggcguccgcugggaguacugcaaccucacccagugcuccgacgccgagggcaccgccgucgccccccccaccgucacccccguccccucccucgaggcccccuccgagcaggcccccaccgagcagcgccccggcguccaggagugcuaccacggcaacggccaguccuaccgcggcaccuacuccaccaccgucaccggccgcaccugccaggccugguccuccaugaccccccacucccacucccgcacccccgaguacuaccccaacgccggccucaucaugaacuacugccgcaaccccgacgccgucgccgcccccuacugcuacacccgcgaccccggcguccgcugggaguacugcaaccucacccagugcuccgacgccgagggcaccgccgucgccccccccaccgucacccccguccccucccucgaggcccccuccgagcaggcccccaccgagcagcgccccggcguccaggagugcuaccacggcaacggccaguccuaccgcggcaccuacuccaccaccgucaccggccgcaccugccaggccugguccuccaugaccccccacucccacucccgcacccccgaguacuaccccaacgccggccucaucaugaacuacugccgcaaccccgaccccgucgccgcccccuacugcuacacccgcgaccccuccguccgcugggaguacugcaaccucacccagugcuccgacgccgagggcaccgccgucgccccccccaccaucacccccauccccucccucgaggcccccuccgagcaggcccccaccgagcagcgccccggcguccaggagugcuaccacggcaacggccaguccuaccagggcaccuacuucaucaccgucaccggccgcaccugccaggccugguccuccaugaccccccacucccacucccgcacccccgccuacuaccccaacgccggccucaucaagaacuacugccgcaaccccgaccccgucgccgcccccuggugcuacaccaccgaccccuccguccgcugggaguacugcaaccucacccgcugcuccgacgccgaguggaccgccuucgucccccccaacgucauccucgcccccucccucgaggccuucuucgagcaggcccucaccgaggagacccccggcguccaggacugcuacuaccacuacggccaguccuaccgcggcaccuacuccaccaccgucaccggccgcaccugccaggccugguccuccaugaccccccaccagcacucccgcacccccgagaacuaccccaacgccggccucacccgcaacuacugccgcaaccccgacgccgagauccgccccuggugcuacaccauggaccccuccguccgcugggaguacugcaaccucacccagugccucgucaccgaguccuccguccucgccacccucaccgucguccccgaccccuccaccgaggccuccuccgaggaggcccccaccgagcagucccccggcguccaggacugcuaccacggcgacggccaguccuaccgcggcuccuucuccaccaccgucaccggccgcaccugccaguccugguccuccaugaccccccacuggcaccagcgcaccaccgaguacuaccccaacggcggccucacccgcaacuacugccgcaaccccgacgccgagaucucccccuggugcuacaccauggaccccaacguccgcugggaguacugcaaccucacccagugccccgucaccgaguccuccguccucgccaccuccaccgccgucuccgagcaggcccccaccgagcagucccccaccguccaggacugcuaccacggcgacggccaguccuaccgcggcuccuucuccaccaccgucaccggccgcaccugccaguccugguccuccaugaccccccacuggcaccagcgcaccaccgaguacuaccccaacggcggccucacccgcaacuacugccgcaaccccgacgccgagauccgccccuggugcuacaccauggaccccuccguccgcugggaguacugcaaccucacccagugccccgucauggaguccacccuccucaccacccccaccgucguccccguccccuccaccgagcuccccuccgaggaggcccccaccgagaacuccaccggcguccaggacugcuaccgcggcgacggccaguccuaccgcggcacccucuccaccaccaucaccggccgcaccugccaguccugguccuccaugaccccccacuggcaccgccgcaucccccucuacuaccccaacgccggccucacccgcaacuacugccgcaaccccgacgccgagauccgccccuggugcuacaccauggaccccuccguccgcugggaguacugcaaccucacccgcugccccgucaccgaguccuccguccucaccacccccaccgucgcccccguccccuccaccgaggcccccuccgagcaggccccccccgagaagucccccgucguccaggacugcuaccacggcgacggccgcuccuaccgcggcaucuccuccaccaccgucaccggccgcaccugccaguccugguccuccaugaucccccacuggcaccagcgcacccccgagaacuaccccaacgccggccucaccgagaacuacugccgcaaccccgacuccggcaagcagcccuggugcuacaccaccgaccccugcguccgcugggaguacugcaaccucacccagugcuccgagaccgaguccggcguccucgagacccccaccgucguccccguccccuccauggaggcccacuccgaggccgcccccaccgagcagacccccgucguccgccagugcuaccacggcaacggccaguccuaccgcggcaccuucuccaccaccgucaccggccgcaccugccaguccugguccuccaugaccccccaccgccaccagcgcacccccgagaacuaccccaacgacggccucaccaugaacuacugccgcaaccccgacgccgacaccggccccuggugcuucaccauggaccccuccauccgcugggaguacugcaaccucacccgcugcuccgacaccgagggcaccgucgucgccccccccaccgucauccagguccccucccucggcccccccuccgagcaggacugcauguucggcaacggcaagggcuaccgcggcaagaaggccaccaccgucaccggcacccccugccaggagugggccgcccaggagccccaccgccacuccaccuucauccccggcaccaacaagugggccggccucgagaagaacuacugccgcaaccccgacggcgacaucaacggccccuggugcuacaccaugaacccccgcaagcucuucgacuacugcgacaucccccucugcgccuccuccuccuucgacugcggcaagccccaggucgagcccaagaagugccccggcuccaucgucggcggcugcgucgcccacccccacuccuggcccuggcaggucucccuccgcacccgcuucggcaagcacuucugcggcggcacccucaucucccccgaguggguccucaccgccgcccacugccucaagaaguccucccgccccuccuccuacaaggucauccucggcgcccaccaggaggucaaccucgagucccacguccaggagaucgaggucucccgccucuuccucgagcccacccaggccgacaucgcccuccucaagcucucccgccccgccgucaucaccgacaaggucaugcccgccugccuccccucccccgacuacauggucaccgcccgcaccgagugcuacaucaccggcuggggcgagacccagggcaccuucggcaccggccuccucaaggaggcccagcuccucgucaucgagaacgaggucugcaaccacuacaaguacaucugcgccgagcaccucgcccgcggcaccgacuccugccagggcgacuccggcggcccccucgucugcuucgagaaggacaaguacauccuccagggcgucaccuccuggggccucggcugcgcccgccccaacaagcccggcgucuacgcccgcgucucccgcuucgucaccuggaucgagggcaugaugcgcaacaacuga

SEQ ID NO: 45467 - RNA, 1095 nt, Artificial Sequence
  derived and/or modified sequence opt2 from LPAR1__Homo_sapiens__XP_005251839
auggccgccaucuccaccuccauccccgucaucucccagccccaguucaccgccaugaacgagccccagugcuucuacaacgaguccaucgccuucuucuacaaccgcuccggcaagcaccucgccaccgaguggaacaccgucuccaagcucgucaugggccucggcaucaccgucugcaucuucaucaugcucgccaaccuccucgucauggucgccaucuacgucaaccgccgcuuccacuuccccaucuacuaccucauggccaaccucgccgccgccgacuucuucgccggccucgccuacuucuaccucauguucaacaccggccccaacacccgccgccucaccgucuccaccuggcuccuccgccagggccucaucgacaccucccucaccgccuccgucgccaaccuccucgccaucgccaucgagcgccacaucaccgucuuccgcaugcagcuccacacccgcauguccaaccgccgcgucgucgucgucaucgucgucaucuggaccauggccaucgucaugggcgccauccccuccgucggcuggaacugcaucugcgacaucgagaacugcuccaacauggccccccucuacuccgacuccuaccucgucuucugggccaucuucaaccucgucaccuucgucgucauggucguccucuacgcccacaucuucggcuacguccgccagcgcaccaugcgcaugucccgccacuccuccggcccccgccgcaaccgcgacaccaugaugucccuccucaagaccgucgucaucguccucggcgccuucaucaucugcuggacccccggccucguccuccuccuccucgacgucugcugcccccagugcgacguccucgccuacgagaaguucuuccuccuccucgccgaguucaacuccgccaugaaccccaucaucuacuccuaccgcgacaaggagauguccgccaccuuccgccagauccucugcugccagcgcuccgagaaccccaccggccccaccgagggcuccgaccgcuccgccuccucccucaaccacaccauccucgccggcguccacuccaacgaccacuccgucgucuga

SEQ ID NO: 45468 - RNA, 1056 nt, Artificial Sequence
  derived and/or modified sequence opt2 from LPAR2__Homo_sapiens__XP_011526723
auggucaucaugggccagugcuacuacaacgagaccaucggcuucuucuacaacaacuccggcaaggagcucuccucccacuggcgccccaaggacgucgucgucgucgcccucggccucaccgucuccguccucguccuccucaccaaccuccucgucaucgccgccaucgccuccaaccgccgcuuccaccagcccaucuacuaccuccucggcaaccucgccgccgccgaccucuucgccggcgucgccuaccucuuccucauguuccacaccggcccccgcaccgcccgccucucccucgagggcugguuccuccgccagggccuccucgacaccucccucaccgccuccgucgccacccuccucgccaucgccgucgagcgccaccgcuccgucauggccguccagcuccacucccgccucccccgcggccgcgucgucaugcucaucgucggcgucugggucgccgcccucggccucggccuccuccccgcccacuccuggcacugccucugcgcccucgaccgcugcucccgcauggccccccuccucucccgcuccuaccucgccgucugggcccucuccucccuccucgucuuccuccucauggucgccgucuacacccgcaucuucuucuacguccgccgccgcguccagcgcauggccgagcacgucuccugccacccccgcuaccgcgagaccacccucucccucgucaagaccgucgucaucauccucggcgccuucgucgucugcuggacccccggccaggucguccuccuccucgacggccucggcugcgaguccugcaacguccucgccgucgagaaguacuuccuccuccucgccgaggccaacucccucgucaacgccgccgucuacuccugccgcgacgccgagaugcgccgcaccuuccgccgccuccucugcugcgccugccuccgccaguccacccgcgaguccguccacuacaccuccuccgcccagggcggcgccuccacccgcaucaugcuccccgagaacggccacccccucauggacuccacccucuga

SEQ ID NO: 45469 - RNA, 1062 nt, Artificial Sequence
  derived and/or modified sequence opt2 from LPAR3__Homo_sapiens__XP_011539451
augaacgagugccacuacgacaagcacauggacuucuucuacaaccgcuccaacaccgacaccgucgacgacuggaccggcaccaagcucgucaucguccucugcgucggcaccuucuucugccucuucaucuucuucuccaacucccucgucaucgccgccgucaucaagaaccgcaaguuccacuuccccuucuacuaccuccucgccaaccucgccgccgccgacuucuucgccggcaucgccuacgucuuccucauguucaacaccggccccgucuccaagacccucaccgucaaccgcugguuccuccgccagggccuccucgacuccucccucaccgccucccucaccaaccuccucgucaucgccgucgagcgccacauguccaucaugcgcaugcgcguccacuccaaccucaccaagaagcgcgucacccuccucauccuccucgucugggccaucgccaucuucaugggcgccguccccacccucggcuggaacugccucugcaacaucuccgccugcuccucccucgcccccaucuacucccgcuccuaccucgucuucuggaccgucuccaaccucauggccuuccucaucauggucgucgucuaccuccgcaucuacgucuacgucaagcgcaagaccaacguccucuccccccacaccuccggcuccaucucccgccgccgcacccccaugaagcucaugaagaccgucaugaccguccucggcgccuucgucgucugcuggacccccggccucgucguccuccuccucgacggccucaacugccgccagugcggcguccagcacgucaagcgcugguuccuccuccucgcccuccucaacuccgucgucaaccccaucaucuacuccuacaaggacgaggacauguacggcaccaugaagaagaugaucugcugcuucucccaggagaaccccgagcgccgccccucccgcauccccuccaccguccucucccgcuccgacaccggcucccaguacaucgaggacuccaucucccagggcgccgucugcaacaaguccaccuccuga

SEQ ID NO: 45470 - RNA, 1035 nt, Artificial Sequence
  derived and/or modified sequence opt2 from LPAR6__Homo_sapiens__NP_001155970
auggucuccgucaacuccucccacugcuucuacaacgacuccuucaaguacacccucuacggcugcauguucuccauggucuucguccucggccucaucuccaacugcgucgccaucuacaucuucaucugcguccucaagguccgcaacgagaccaccaccuacaugaucaaccucgccauguccgaccuccucuucgucuucacccuccccuuccgcaucuucuacuucaccacccgcaacuggcccuucggcgaccuccucugcaagaucuccgucaugcucuucuacaccaacauguacggcuccauccucuuccucaccugcaucuccgucgaccgcuuccucgccaucgucuaccccuucaaguccaagacccuccgcaccaagcgcaacgccaagaucgucugcaccggcgucuggcucaccgucaucggcggcuccgcccccgccgucuucguccaguccacccacucccagggcaacaacgccuccgaggccugcuucgagaacuuccccgaggccaccuggaagaccuaccucucccgcaucgucaucuucaucgagaucgucggcuucuucaucccccucauccucaacgucaccugcuccuccaugguccucaagacccucaccaagcccgucacccucucccgcuccaagaucaacaagaccaagguccucaagaugaucuucguccaccucaucaucuucugcuucugcuucguccccuacaacaucaaccucauccucuacucccucguccgcacccagaccuucgucaacugcuccgucgucgccgccguccgcaccauguaccccaucacccucugcaucgccgucuccaacugcugcuucgaccccaucgucuacuacuucaccuccgacaccauccagaacuccaucaagaugaagaacugguccguccgccgcuccgacuuccgcuucuccgagguccacggcgccgagaacuucauccagcacaaccuccagacccucaaguccaagaucuucgacaacgaguccgccgccuga

SEQ ID NO: 45471 - RNA, 1605 nt, Artificial Sequence
  derived and/or modified sequence opt2 from LPCAT1__Homo_sapiens__NP_079106
augcgccuccgcggcugcggcccccgcgccgcccccgccuccuccgccggcgccuccgacgcccgccuccucgccccccccggccgcaaccccuucguccacgagcuccgccucuccgcccuccagaaggcccaggucgcccucaugacccucacccucuuccccguccgccuccucgucgccgccgccaugaugcuccucgccuggccccucgcccucgucgccucccucggcuccgccgagaaggagcccgagcagccccccgcccucuggcgcaaggucgucgacuuccuccucaaggccaucaugcgcaccaugugguucgccggcggcuuccaccgcgucgccgucaagggccgccaggcccuccccaccgaggccgccauccucacccucgccccccacuccuccuacuucgacgccauccccgucaccaugaccauguccuccaucgucaugaaggccgagucccgcgacauccccaucuggggcacccucauccaguacauccgccccgucuucgucucccgcuccgaccaggacucccgccgcaagaccgucgaggagaucaagcgccgcgcccaguccaacggcaaguggccccagaucaugaucuuccccgagggcaccugcaccaaccgcaccugccucaucaccuucaagcccggcgccuucauccccggcgcccccguccagcccgucguccuccgcuaccccaacaagcucgacaccaucaccuggaccuggcagggccccggcgcccucgagauccucuggcucacccucugccaguuccacaaccaggucgagaucgaguuccuccccgucuacucccccuccgaggaggagaagcgcaaccccgcccucuacgccuccaacguccgccgcgucauggccgaggcccucggcgucuccgucaccgacuacaccuucgaggacugccagcucgcccucgccgagggccagcuccgccuccccgccgacaccugccuccucgaguucgcccgccucguccgcggccucggccucaagcccgagaagcucgagaaggaccucgaccgcuacuccgagcgcgcccgcaugaagggcggcgagaagaucggcaucgccgaguucgccgccucccucgagguccccgucuccgaccuccucgaggacauguucucccucuucgacgaguccggcuccggcgaggucgaccuccgcgagugcgucgucgcccucuccgucgucugccgccccgcccgcacccucgacaccauccagcucgccuucaagauguacggcgcccaggaggacggcuccgucggcgagggcgaccucuccugcauccucaagaccgcccucggcgucgccgagcucaccgucaccgaccucuuccgcgccaucgaccaggaggagaagggcaagaucaccuucgccgacuuccaccgcuucgccgagauguaccccgccuucgccgaggaguaccucuaccccgaccagacccacuucgaguccugcgccgagaccucccccgcccccauccccaacggcuucugcgccgacuucucccccgagaacuccgacgccggccgcaagcccguccgcaagaagcucgacuga

SEQ ID NO: 45472 - RNA, 1635 nt, Artificial Sequence
  derived and/or modified sequence opt2 from LPCAT2__Homo_sapiens__NP_060309
augucccgcugcgcccaggccgccgaggucgccgccaccguccccggcgccggcgucggcaacgucggccuccgcccccccauggucccccgccaggccuccuucuuccccccccccguccccaaccccuucguccagcagacccagaucggcuccgcccgccgcguccagaucguccuccucggcaucauccuccuccccauccgcguccuccucgucgcccucauccuccuccucgccuggcccuucgccgccaucuccaccgucugcugccccgagaagcucacccaccccaucaccggcuggcgccgcaagaucacccagaccgcccucaaguuccucggccgcgccauguucuucuccaugggcuucaucgucgccgucaagggcaagaucgccuccccccucgaggcccccgucuucgucgccgccccccacuccaccuucuucgacggcaucgccugcgucgucgccggccuccccuccauggucucccgcaacgagaacgcccaggucccccucaucggccgccuccuccgcgccguccagcccguccucgucucccgcgucgaccccgacucccgcaagaacaccaucaacgagaucaucaagcgcaccaccuccggcggcgaguggccccagauccucgucuuccccgagggcaccugcaccaaccgcuccugccucaucaccuucaagcccggcgccuucauccccggcguccccguccagcccguccuccuccgcuaccccaacaagcucgacaccgucaccuggaccuggcagggcuacaccuucauccagcucugcaugcucaccuucugccagcucuucaccaaggucgaggucgaguucaugcccguccagguccccaacgacgaggagaagaacgaccccguccucuucgccaacaagguccgcaaccucauggccgaggcccucggcauccccgucaccgaccacaccuacgaggacugccgccucaugaucuccgccggccagcucacccuccccauggaggccggccucgucgaguucaccaagaucucccgcaagcucaagcucgacugggacggcguccgcaagcaccucgacgaguacgccuccaucgccuccuccuccaagggcggccgcaucggcaucgaggaguucgccaaguaccucaagcuccccgucuccgacguccuccgccagcucuucgcccucuucgaccgcaaccacgacggcuccaucgacuuccgcgaguacgucaucggccucgccguccucugcaaccccuccaacaccgaggagaucauccaggucgccuucaagcucuucgacgucgacgaggacggcuacaucaccgaggaggaguucuccaccauccuccaggccucccucggcguccccgaccucgacgucuccggccucuucaaggagaucgcccagggcgacuccaucuccuacgaggaguucaaguccuucgcccucaagcaccccgaguacgccaagaucuucaccaccuaccucgaccuccagaccugccacgucuucucccuccccaaggagguccagaccacccccuccaccgccuccaacaaggucucccccgagaagcacgaggaguccaccuccgacaagaaggacgacuga

SEQ ID NO: 45473 - RNA, 1464 nt, Artificial Sequence
  derived and/or modified sequence opt2 from LPCAT3__Homo_sapiens__NP_005759
auggccuccuccgccgagggcgacgagggcaccgucgucgcccucgccggcguccuccaguccggcuuccaggagcucucccucaacaagcucgccaccucccucggcgccuccgagcaggcccuccgccucaucaucuccaucuuccucggcuaccccuucgcccucuucuaccgccacuaccucuucuacaaggagaccuaccucauccaccucuuccacaccuucaccggccucuccaucgccuacuucaacuucggcaaccagcucuaccacucccuccucugcaucguccuccaguuccucauccuccgccucaugggccgcaccaucaccgccguccucaccaccuucugcuuccagauggccuaccuccucgccggcuacuacuacaccgccaccggcaacuacgacaucaaguggaccaugccccacugcguccucacccucaagcucaucggccucgccgucgacuacuucgacggcggcaaggaccagaacucccucuccuccgagcagcagaaguacgccauccgcggcguccccucccuccucgaggucgccggcuucuccuacuucuacggcgccuuccucgucggcccccaguucuccaugaaccacuacaugaagcucguccagggcgagcucaucgacauccccggcaagauccccaacuccaucauccccgcccucaagcgccucucccucggccucuucuaccucgucggcuacacccuccucuccccccacaucaccgaggacuaccuccucaccgaggacuacgacaaccaccccuucugguuccgcugcauguacaugcucaucuggggcaaguucguccucuacaaguacgucaccugcuggcucgucaccgagggcgucugcauccucaccggccucggcuucaacggcuucgaggagaagggcaaggccaagugggacgccugcgccaacaugaaggucuggcucuucgagaccaacccccgcuucaccggcaccaucgccuccuucaacaucaacaccaacgccugggucgcccgcuacaucuucaagcgccucaaguuccucggcaacaaggagcucucccagggccucucccuccucuuccucgcccucuggcacggccuccacuccggcuaccucgucugcuuccagauggaguuccucaucgucaucgucgagcgccaggccgcccgccucauccaggagucccccacccucuccaagcucgccgccaucaccguccuccagcccuucuacuaccucguccagcagaccauccacuggcucuucaugggcuacuccaugaccgccuucugccucuucaccugggacaaguggcucaaggucuacaaguccaucuacuuccucggccacaucuucuuccucucccuccucuucauccuccccuacauccacaaggccauggucccccgcaaggagaagcucaagaagauggaguga

SEQ ID NO: 45474 - RNA, 1575 nt, Artificial Sequence
  derived and/or modified sequence opt2 from LPCAT4__Homo_sapiens__NP_705841
augucccagggcucccccggcgacugggccccccucgaccccacccccggcccccccgccucccccaaccccuucguccacgagcuccaccucucccgccuccagcgcgucaaguucugccuccucggcgcccuccucgcccccauccgcguccuccucgccuucaucguccucuuccuccucuggcccuucgccuggcuccaggucgccggccucuccgaggagcagcuccaggagcccaucaccggcuggcgcaagaccgucugccacaacggcguccucggccucucccgccuccucuucuuccuccucggcuuccuccgcauccgcguccgcggccagcgcgccucccgccuccaggcccccguccucgucgccgccccccacuccaccuucuucgaccccaucguccuccuccccugcgaccuccccaaggucgucucccgcgccgagaaccucuccguccccgucaucggcgcccuccuccgcuucaaccaggccauccucgucucccgccacgaccccgccucccgccgccgcgucgucgaggagguccgccgccgcgccaccuccggcggcaaguggccccagguccucuucuuccccgagggcaccugcuccaacaagaaggcccuccucaaguucaagcccggcgccuucaucgccggcguccccguccagcccguccucauccgcuaccccaacucccucgacaccaccuccugggccuggcgcggccccggcguccucaagguccucuggcucaccgccucccagcccugcuccaucgucgacgucgaguuccuccccgucuaccaccccucccccgaggagucccgcgaccccacccucuacgccaacaacguccagcgcgucauggcccaggcccucggcauccccgccaccgagugcgaguucgucggcucccuccccgucaucgucgucggccgccucaaggucgcccucgagccccagcucugggagcucggcaagguccuccgcaaggccggccucuccgccggcuacgucgacgccggcgccgagcccggccgcucccgcaugaucucccaggaggaguucgcccgccagcuccagcucuccgacccccagaccgucgccggcgccuucggcuacuuccagcaggacaccaagggccucgucgacuuccgcgacgucgcccucgcccucgccgcccucgacggcggccgcucccucgaggagcucacccgccucgccuucgagcucuucgccgaggagcaggccgagggccccaaccgccuccucuacaaggacggcuucuccaccauccuccaccuccuccucggcuccccccaccccgccgccaccgcccuccacgccgagcucugccaggccggcuccucccagggccucucccucugccaguuccagaacuucucccuccacgacccccucuacggcaagcucuucuccaccuaccuccgccccccccacaccucccgcggcaccucccagacccccaacgccuccucccccggcaaccccaccgcccucgccaacggcaccguccaggcccccaagcagaagggcgacuga

SEQ ID NO: 45475 - RNA, 1113 nt, Artificial Sequence
  derived and/or modified sequence opt2 from LPGAT1__Homo_sapiens__NP_055688
auggccaucacccucgaggaggcccccuggcucggcuggcuccucgucaaggcccucaugcgcuucgccuucauggucgucaacaaccucgucgccauccccuccuacaucugcuacgucaucauccuccagccccuccgcguccucgacuccaagcgcuucugguacaucgagggcaucauguacaaguggcuccucggcauggucgccuccuggggcugguacgccggcuacaccgucauggaguggggcgaggacaucaaggccgucuccaaggacgaggccgucaugcucgucaaccaccaggccaccggcgacgucugcacccucaugaugugccuccaggacaagggccucgucgucgcccagaugauguggcucauggaccacaucuucaaguacaccaacuucggcaucgucucccucguccacggcgacuucuucauccgccagggccgcuccuaccgcgaccagcagcuccuccuccucaagaagcaccucgagaacaacuaccgcucccgcgaccgcaaguggaucguccucuuccccgagggcggcuuccuccgcaagcgccgcgagaccucccaggccuucgccaagaagaacaaccuccccuuccucaccaacgucacccucccccgcuccggcgccaccaagaucauccucaacgcccucgucgcccagcagaagaacggcucccccgccggcggcgacgccaaggagcucgacuccaaguccaagggccuccaguggaucaucgacaccaccaucgccuaccccaaggccgagcccaucgacauccagaccuggauccucggcuaccgcaagcccaccgucacccacguccacuaccgcaucuuccccaucaaggacgucccccucgagaccgacgaccucaccaccuggcucuaccagcgcuucgucgagaaggaggaccuccucucccacuucuacgagaccggcgccuucccccccuccaagggccacaaggaggccgucucccgcgagaugacccucuccaaccucuggaucuuccucauccaguccuucgccuuccucuccggcuacaugugguacaacaucauccaguacuucuaccacugccucuucuga

SEQ ID NO: 45476 - RNA, 2691 nt, Artificial Sequence
  derived and/or modified sequence opt2 from LPIN1__Homo_sapiens__NP_001248356
augucccgcguccagaccaugaacuacgucggccagcucgccggccaggucuucgucaccgucaaggagcucuacaagggccucaaccccgccacccucuccggcugcaucgacaucaucgucauccgccagcccaacggcaaccuccagugcucccccuuccacguccgcuucggcaagaugggcguccuccgcucccgcgagaaggucgucgacaucgagaucaacggcgaguccgucgaccuccacaugaagcucggcgacaacggcgaggccuucuucguccaggagaccgacaacgaccaggaggucauccccaugcaccucgccaccucccccauccucuccgagggcgccucccgcauggagugccagcucaagcgcggcuccgucgaccgcaugcgcggccucgaccccuccacccccgcccaggucaucgcccccuccgagacccccuccuccuccuccgucgucaagaagcgccgcaagcgccgccgcaagucccagcucgacucccucaagcgcgacgacaacaugaacaccuccgaggacgaggacauguuccccaucgagauguccuccgacgaggccauggagcuccucgaguccucccgcacccuccccaacgacaucccccccuuccaggacgacauccccgaggagaaccucucccucgccgucaucuacccccaguccgccuccuaccccaacuccgaccgcgaguggucccccacccccucccccuccggcucccgccccuccacccccaaguccgacuccgagcucgucuccaaguccaccgagcgcaccggccagaagaaccccgagaugcucuggcucuggggcgagcucccccaggccgccaaguccuccuccccccacaagaugaaggaguccuccccccucuccucccgcaagaucugcgacaagucccacuuccaggccauccacuccgaguccuccgacaccuucuccgaccagucccccacccucgucggcggcgcccuccucgaccagaacaagccccagaccgagaugcaguucgucaacgaggaggaccucgagacccucggcgccgccgccccccuccuccccaugaucgaggagcucaagccccccuccgccuccgucguccagaccgccaacaagaccgacucccccucccgcaagcgcgacaagcgcucccgccaccucggcgccgacggcgucuaccucgacgaccucaccgacauggaccccgaggucgccgcccucuacuuccccaagaacggcgaccccuccggccucgccaagcacgccuccgacaacggcgcccgcuccgccaaccaguccccccaguccgucggcuccuccggcgucgacuccggcgucgaguccaccuccgacggccuccgcgaccuccccuccaucgccaucucccucugcggcggccucuccgaccaccgcgagaucaccaaggacgccuuccucgagcaggccgucuccuaccagcaguucgucgacaaccccgccaucaucgacgaccccaaccucgucgucaagaucggcuccaaguacuacaacuggaccaccgccgccccccuccuccucgccaugcaggccuuccagaagccccuccccaaggccaccgucgaguccaucaugcgcgacaagaugcccaagaagggcggccgcuggugguucuccuggcgcggccgcaacaccaccaucaaggaggaguccaagcccgagcagugccucgccggcaaggcccacuccaccggcgagcagcccccccagcucucccucgccacccgcgucaagcacgaguccuccuccuccgacgaggagcgcgccgccgccaagcccuccaacgccggccaccucccccuccuccccaacgucuccuacaagaagacccuccgccucaccuccgagcagcucaagucccucaagcucaagaacggccccaacgacgucgucuucuccgucaccacccaguaccagggcaccugccgcugcgagggcaccaucuaccucuggaacugggacgacaaggucaucaucuccgacaucgacggcaccaucacccgcuccgacacccucggccacauccuccccacccucggcaaggacuggacccaccagggcaucgccaagcucuaccacaaggucucccagaacggcuacaaguuccucuacugcuccgcccgcgccaucggcauggccgacaugacccgcggcuaccuccacugggucaacgagcgcggcaccguccucccccagggcccccuccuccucucccccuccucccucuucuccgcccuccaccgcgaggucaucgagaagaagcccgagaaguucaagguccagugccucaccgacaucaagaaccucuucuuccccaacaccgagcccuucuacgccgccuucggcaaccgccccgccgacgucuacuccuacaagcaggucggcgucucccucaaccgcaucuucaccgucaaccccaagggcgagcucguccaggagcacgccaagaccaacaucuccuccuacguccgccucugcgaggucgucgaccacgucuucccccuccucaagcgcucccacuccuccgacuuccccugcuccgacaccuucuccaacuucaccuucuggcgcgagccccucccccccuucgagaaccaggacauccacuccgccuccgccuga

SEQ ID NO: 45477 - RNA, 2691 nt, Artificial Sequence
  derived and/or modified sequence opt2 from LPIN2__Homo_sapiens__NP_055461
augaacuacgucggccagcucgccggccaggucaucgucaccgucaaggagcucuacaagggcaucaaccaggccacccucuccggcugcaucgacgucaucgucguccagcagcaggacggcuccuaccagugcucccccuuccacguccgcuucggcaagcucggcguccuccgcuccaaggagaaggucaucgacaucgagaucaacggcuccgccgucgaccuccacaugaagcucggcgacaacggcgaggccuucuucgucgaggagaccgaggaggaguacgagaagcuccccgccuaccucgccaccucccccauccccaccgaggaccaguucuucaaggacaucgacaccccccucgucaaguccggcggcgacgagacccccucccaguccuccgacaucucccacguccucgagaccgagaccaucuucacccccuccuccgucaagaagaagaagcgccgccgcaagaaguacaagcaggacuccaagaaggaggagcaggccgccuccgccgccgccgaggacaccugcgacgucggcgucuccuccgacgacgacaagggcgcccaggccgcccgcggcuccuccaacgccucccucaaggaggaggagugcaaggagccccuccucuuccacuccggcgaccacuacccccucuccgacggcgacugguccccccucgagaccaccuacccccagaccgccugccccaaguccgacuccgagcucgaggucaagcccgccgagucccuccuccgcuccgagucccacauggaguggaccuggggcggcuuccccgaguccaccaaggucuccaagcgcgagcgcuccgaccaccacccccgcaccgccaccaucacccccuccgagaacacccacuuccgcgucauccccuccgaggacaaccucaucuccgaggucgagaaggacgccuccauggaggacaccgucugcaccaucgucaagcccaagccccgcgcccucggcacccagauguccgaccccaccuccgucgccgagcuccucgagcccccccucgaguccacccagaucuccuccaugcucgacgccgaccaccuccccaacgccgcccucgccgaggcccccuccgaguccaagcccgccgccaaggucgacucccccuccaagaagaagggcguccacaagcgcucccagcaccagggccccgacgacaucuaccucgacgaccucaagggccucgagcccgaggucgccgcccucuacuuccccaaguccgaguccgagcccggcucccgccaguggcccgaguccgacacccucuccggcucccaguccccccaguccgucggcuccgccgccgccgacuccggcaccgagugccucuccgacuccgccauggaccuccccgacgucacccucucccucugcggcggccucuccgagaacggcgagaucuccaaggagaaguucauggagcacaucaucaccuaccacgaguucgccgagaaccccggccucaucgacaaccccaaccucgucauccgcaucuacaaccgcuacuacaacugggcccucgccgcccccaugauccucucccuccaggucuuccagaagucccuccccaaggccaccgucgaguccugggucaaggacaagaugcccaagaaguccggccgcuggugguucuggcgcaagcgcgaguccaugaccaagcagcuccccgaguccaaggagggcaaguccgaggccccccccgccuccgaccuccccuccuccuccaaggagcccgccggcgcccgccccgccgagaacgacuccuccuccgacgagggcucccaggagcucgaggaguccaucaccgucgaccccauccccaccgagccccucucccacggcuccaccaccuccuacaagaagucccuccgccucuccuccgaccagaucgccaagcucaagcuccacgacggccccaacgacgucgucuucuccaucaccacccaguaccagggcaccugccgcugcgccggcaccaucuaccucuggaacuggaacgacaagaucaucaucuccgacaucgacggcaccaucaccaaguccgacgcccucggccagauccucccccagcucggcaaggacuggacccaccagggcaucgccaagcucuaccacuccaucaacgagaacggcuacaaguuccucuacugcuccgcccgcgccaucggcauggccgacaugacccgcggcuaccuccacugggucaacgacaagggcaccauccucccccgcggcccccucaugcucucccccuccucccucuucuccgccuuccaccgcgaggucaucgagaagaagcccgagaaguucaagaucgagugccucaacgacaucaagaaccucuucgcccccuccaagcagcccuucuacgccgccuucggcaaccgccccaacgacgucuacgccuacacccaggucggcguccccgacugccgcaucuucaccgucaaccccaagggcgagcucauccaggagcgcaccaagggcaacaaguccuccuaccaccgccucuccgagcucgucgagcacgucuucccccuccucuccaaggagcagaacuccgccuuccccugccccgaguucuccuccuucugcuacuggcgcgaccccauccccgaggucgaccucgacgaccucuccuga

SEQ ID NO: 45478 - RNA, 1428 nt, Artificial Sequence
  derived and/or modified sequence opt2 from LPL__Homo_sapiens__NP_000228
auggaguccaaggcccuccucguccucacccucgccgucuggcuccagucccucaccgccucccgcggcggcgucgccgccgccgaccagcgccgcgacuucaucgacaucgaguccaaguucgcccuccgcacccccgaggacaccgccgaggacaccugccaccucauccccggcgucgccgaguccgucgccaccugccacuucaaccacuccuccaagaccuucauggucauccacggcuggaccgucaccggcauguacgaguccuggguccccaagcucgucgccgcccucuacaagcgcgagcccgacuccaacgucaucgucgucgacuggcucucccgcgcccaggagcacuaccccgucuccgccggcuacaccaagcucgucggccaggacgucgcccgcuucaucaacuggauggaggaggaguucaacuacccccucgacaacguccaccuccucggcuacucccucggcgcccacgccgccggcaucgccggcucccucaccaacaagaaggucaaccgcaucaccggccucgaccccgccggccccaacuucgaguacgccgaggcccccucccgccucucccccgacgacgccgacuucgucgacguccuccacaccuucacccgcggcucccccggccgcuccaucggcauccagaagcccgucggccacgucgacaucuaccccaacggcggcaccuuccagcccggcugcaacaucggcgaggccauccgcgucaucgccgagcgcggccucggcgacgucgaccagcucgucaagugcucccacgagcgcuccauccaccucuucaucgacucccuccucaacgaggagaaccccuccaaggccuaccgcugcuccuccaaggaggccuucgagaagggccucugccucuccugccgcaagaaccgcugcaacaaccucggcuacgagaucaacaagguccgcgccaagcgcuccuccaagauguaccucaagacccgcucccagaugcccuacaaggucuuccacuaccaggucaagauccacuucuccggcaccgaguccgagacccacaccaaccaggccuucgagaucucccucuacggcaccgucgccgaguccgagaacauccccuucacccuccccgaggucuccaccaacaagaccuacuccuuccucaucuacaccgaggucgacaucggcgagcuccucaugcucaagcucaaguggaaguccgacuccuacuucuccugguccgacuggugguccucccccggcuucgccauccagaagauccgcgucaaggccggcgagacccagaagaaggucaucuucugcucccgcgagaaggucucccaccuccagaagggcaaggcccccgccgucuucgucaagugccacgacaagucccucaacaagaaguccggcuga

SEQ ID NO: 45479 - RNA, 1890 nt, Artificial Sequence
  derived and/or modified sequence opt2 from LPO__Homo_sapiens__NP_001153574
augcgcguccuccuccaccuccccgcccuccucgccucccucauccuccuccaggccgccgccuccaccacccgcgaccccucccucgaccucaccucccucucccucgaggucggcugcggcgcccccgcccccgucguccgcugcgaccccugcucccccuaccgcaccaucaccggcgacugcaacaaccgccgcaagcccgcccucggcgccgccaaccgcgcccucgcccgcuggcuccccgccgaguacgaggacggccucucccuccccuucggcuggacccccggcaagacccgcaacggcuucccccucccccucgcccgcgaggucuccaacaagaucgucggcuaccucaacgaggagggcguccucgaccagaaccgcucccuccucuucaugcaguggggccagaucgucgaccacgaccucgacuucgcccccgacaccgagcucggcuccuccgaguacuccaaggcccagugcgacgaguacugcauccagggcgacaacugcuuccccaucauguucccccccaacgaccccaaggccggcacccagggcaagugcaugcccuucuuccgcgccggcuucgucugccccaccccccccuacaagucccucgcccgcgagcagaucaacgcccucaccuccuuccucgacgccuccuucgucuacuccuccgagcccucccucgccucccgccuccgcaaccucuccuccccccucggccucauggccgucaaccaggaggucuccgaccacggccuccccuaccuccccuacgacuccaagaagcccucccccugcgaguucaucaacaccaccgcccgcguccccugcuuccucgccggcgacucccgcgccuccgagcacauccuccucgccaccucccacacccucuuccuccgcgagcacaaccgccucgcccgcgagcucaagcgccucaacccccagugggacggcgagaagcucuaccaggaggcccgcaagauccucggcgccuucguccagaucaucaccuuccgcgacuaccuccccauccuccucggcgaccacaugcagaaguggaucccccccuaccagggcuacuccgaguccgucgacccccgcaucuccaacgucuucaccuucgccuuccgcuucggccaccucgagguccccuccuccauguuccgccucgacgagaacuaccagcccuggggccccgagcccgagcucccccuccacacccucuucuucaacaccuggcgcauggucaaggacggcggcaucgacccccucguccgcggccuccucgccaagaaguccaagcucaugaagcagaacaagaugaugaccggcgagcuccgcaacaagcucuuccagcccacccaccgcauccacggcuucgaccucgccgccaucaacacccagcgcugccgcgaccacggccagcccggcuacaacuccuggcgcgccuucugcgaccucucccagccccagacccucgaggagcucaacaccguccucaaguccaagaugcucgccaagaagcuccucggccucuacggcacccccgacaacaucgacaucuggaucggcgccaucgccgagccccucgucgagcgcggccgcgucggcccccuccucgccugccuccucggcaagcaguuccagcagauccgcgacggcgaccgcuucuggugggagaaccccggcgucuucaccaacgagcagaaggacucccuccagaagauguccuucucccgccucgucugcgacaacacccgcaucaccaaggucccccgcgaccccuucugggccaacuccuaccccuacgacuucgucgacugcuccgccaucgacaagcucgaccucucccccugggccuccgucaagaacuga

SEQ ID NO: 45480 - RNA, 1839 nt, Artificial Sequence
  derived and/or modified sequence opt2 from LPP__Homo_sapiens__NP_001161143
augucccaccccuccuggcucccccccaaguccaccggcgagccccucggccacguccccgcccgcauggagaccacccacuccuucggcaaccccuccaucuccgucuccacccagcagccccccaagaaguucgcccccgucgucgcccccaagcccaaguacaaccccuacaagcagcccggcggcgagggcgacuuccuccccccccccccccccccccucgacgacuccuccgcccuccccuccaucuccggcaacuucccccccccccccccccucgacgaggaggccuucaagguccagggcaaccccggcggcaagacccucgaggagcgccgcuccucccucgacgccgagaucgacucccucaccuccauccucgccgaccucgagugcuccucccccuacaagccccgccccccccaguccuccaccggcuccaccgccuccccccccgucuccacccccgucaccggccacaagcgcauggucauccccaaccagcccccccucaccgccaccaagaaguccacccucaagccccagcccgccccccaggccggccccauccccgucgcccccaucggcacccucaagccccagccccagcccguccccgccuccuacaccaccgccuccaccuccucccgccccaccuucaacguccaggucaaguccgcccagcccuccccccacuacauggccgcccccuccuccggccagaucuacggcuccggcccccagggcuacaacacccagcccguccccgucuccggccagugccccccccccuccacccgcggcggcauggacuacgccuacauccccccccccggccuccagcccgagcccggcuacggcuacgcccccaaccagggccgcuacuacgagggcuacuacgccgccggccccggcuacggcggccgcaacgacuccgaccccaccuacggccagcagggccaccccaacaccuggaagcgcgagcccggcuacaccccccccggcgccggcaaccagaacccccccggcauguaccccgucaccggccccaagaagaccuacaucaccgaccccgucuccgcccccugcgcccccccccuccagcccaagggcggccacuccggccagcucggccccuccuccgucgcccccuccuuccgccccgaggacgagcucgagcaccucaccaagaagaugcucuacgacauggagaacccccccgccgacgaguacuucggccgcugcgcccgcugcggcgagaacgucgucggcgagggcaccggcugcaccgccauggaccaggucuuccacgucgacugcuucaccugcaucaucugcaacaacaagcuccgcggccagcccuucuacgccgucgagaagaaggccuacugcgagcccugcuacaucaacacccucgagcagugcaacgucugcuccaagcccaucauggagcgcauccuccgcgccaccggcaaggccuaccacccccacugcuucaccugcgucaugugccaccgcucccucgacggcauccccuucaccgucgacgccggcggccucauccacugcaucgaggacuuccacaagaaguucgccccccgcugcuccgucugcaaggagcccaucaugcccgcccccggccaggaggagaccguccgcaucgucgcccucgaccgcgacuuccacguccacugcuaccgcugcgaggacugcggcggccuccucuccgagggcgacaaccagggcugcuacccccucgacggccacauccucugcaagaccugcaacuccgcccgcauccgcguccucaccgccaaggccuccaccgaccucuga

SEQ ID NO: 45481 - RNA, 1284 nt, Artificial Sequence
  derived and/or modified sequence opt2 from LPPR2__Homo_sapiens__NP_001164106
auggccggcggccgcccccaccucaagcgcuccuucuccaucauccccugcuucgucuucgucgagggcuucuucugcuacgacuccaccuacgccaagcccuaccccggccccgaggccgccucccgcgucccccccgcccucgucuacgcccucgucaccgccggccccacccucaccauccuccucggcgagcucgcccgcgccuucuuccccgccccccccuccgccguccccgucaucggcgaguccaccaucgucuccggcgccugcugccgcuucuccccccccguccgccgccucguccgcuuccucggcgucuacuccuucggccucuucaccaccaccaucuucgccaacgccggccaggucgucaccggcaaccccaccccccacuuccucuccgucugccgccccaacuacaccgcccucggcugccucccccccucccccgaccgccccggccccgaccgcuucgucaccgaccagggcgccugcgccggcucccccucccucgucgccgccgcccgccgcgccuuccccugcaaggacgccgcccucugcgccuacgccgucaccuacaccgccauguacgucacccucgucuuccgcgucaagggcucccgccucgucaagcccucccucugccucgcccuccucugccccgccuuccucgucggcgucguccgcgucgccgaguaccgcaaccacugguccgacguccucgccggcuuccucaccggcgccgccaucgccaccuuccucgucaccugcgucguccacaacuuccagucccgcccccccuccggccgccgccucucccccugggaggaccucggccaggcccccaccauggacuccccccucgagaagcucuccgucgcccaggagcccgaggucugccgcccccacuccacccccgcccgccucacccccuccaagucccagaacugcgcccgccgcggccaccucauccccuccugcgucuccucccgcgcccccgccaugugcuccuccccccgcgucccccgcccccgccuccgcuccgagcccaccccccucccccucccccucccccuccccgcccccacccccucccagggccccucccccuccucccccggccccggcggccccggcggcggcggcggccgcggccgcaagcuccuccuccccaccccccuccuccgcgaccucuacacccucuccggccucuaccccucccccuuccaccgcgacaacuucucccccuaccucuucgccucccgcgaccaccuccucuga

SEQ ID NO: 45482 - RNA, 1965 nt, Artificial Sequence
  derived and/or modified sequence opt2 from LPPR4__Homo_sapiens__XP_011540800
augcccuacaucgagcccacccaggaggccauccccuuccucaugcuccucucccucgccuucgccggccccgccaucaccaucauggucggcgagggcauccucuacugcugccucuccaagcgccgcaacggcgucggccucgagcccaacaucaacgccggcggcugcaacuucaacuccuuccuccgccgcgccguccgcuucgucggcguccacgucuucggccucugcuccaccgcccucaucaccgacaucauccagcucuccaccggcuaccaggcccccuacuuccucaccgucugcaagcccaacuacaccucccucaacgucuccugcaaggagaacuccuacaucgucgaggacaucugcuccggcuccgaccucaccgucaucaacuccggccgcaaguccuuccccucccagcacgccacccucgccgccuucgccgccgucuacgucuccauguacuucaacuccacccucaccgacuccuccaagcuccucaagccccuccucgucuucaccuucaucaucugcggcaucaucugcggccucacccgcaucacccaguacaagaaccaccccgucgacgucuacugcggcuuccucaucggcggcggcaucgcccucuaccucggccucuacgccgucggcaacuuccuccccuccgacgaguccauguuccagcaccgcgacgcccuccgcucccucaccgaccucaaccaggaccccaaccgccuccucuccgccaagaacggcuccuccuccgacggcaucgcccacaccgagggcauccucaaccgcaaccaccgcgacgccuccucccucaccaaccucaagcgcgccaacgccgacgucgagaucaucaccccccgcucccccaugggcaaggagaacauggucaccuucuccaacacccucccccgcgccaacacccccuccgucgaggaccccguccgccgcaacgccuccauccacgccuccauggacuccgcccgcuccaagcagcuccucacccaguggaagaacaagaacgagucccgcaagcucucccuccaggucaucgagcccgagcccggccagucccccccccgcuccaucgagaugcgcuccuccuccgagcccucccgcgucggcgucaacggcgaccaccacggccccggcaaccaguaccucaagauccagcccggcgccguccccggcugcaacaacuccaugcccggcggcccccgcgucuccauccagucccgccccggcuccucccagcucguccacauccccgaggagacccaggagaacaucuccaccucccccaaguccuccuccgcccgcgccaaguggcucaaggccgccgagaagaccgucgccugcaaccgcuccaacucccagccccgcaucaugcaggucaucgccauguccaagcagcagggcguccuccaguccucccccaagaacaccgagggcuccaccgucuccugcaccggcuccauccgcuacaagacccucaccgaccacgagcccuccggcaucguccgcgucgaggcccaccccgagaacaaccgccccaucauccagauccccuccaccgagggcgagggcuccggcuccuggaaguggaaggcccccgagaagggcucccuccgccagaccuacgagcucaacgaccucaaccgcgacuccgaguccugcgagucccucaaggacuccuucggcuccggcgaccgcaagcgcuccaacaucgacuccaacgagcaccaccaccacggcaucaccaccauccgcgucacccccgucgagggcuccgagaucggcuccgagacccucuccaucuccuccucccgcgacuccacccuccgccgcaagggcaacaucauccucauccccgagcgcuccaacucccccgagaacacccgcaacaucuucuacaagggcaccucccccacccgcgccuacaaggacuga

SEQ ID NO: 45483 - RNA, 1176 nt, Artificial Sequence
  derived and/or modified sequence opt2 from LPXN__Homo_sapiens__NP_001137467
auguccacccuccucaucuccuccuccgacgcccuccucgaggagcucgagcgcuccacccuccaggacuccgacgaguacuccaaccccgccccccucccccucgaccagcacucccgcaaggagaccaaccucgacgagaccuccgagauccucuccauccaggacaacaccuccccccuccccgcccagcucgucuacaccaccaacauccaggagcucaacgucuacuccgaggcccaggagcccaaggagucccccccccccuccaagaccuccgccgccgcccagcucgacgagcucauggcccaccucaccgagaugcaggccaaggucgccguccgcgccgacgccggcaagaagcaccuccccgacaagcaggaccacaaggccucccucgacuccaugcucggcggccucgagcaggagcuccaggaccucggcaucgccaccguccccaagggccacugcgccuccugccagaagcccaucgccggcaaggucauccacgcccucggccaguccuggcaccccgagcacuucgucugcacccacugcaaggaggagaucggcuccucccccuucuucgagcgcuccggccucgccuacugccccaacgacuaccaccagcucuucuccccccgcugcgccuacugcgccgcccccauccucgacaagguccucaccgccaugaaccagaccuggcaccccgagcacuucuucugcucccacugcggcgaggucuucggcgccgagggcuuccacgagaaggacaagaagcccuacugccgcaaggacuuccucgccauguucucccccaagugcggcggcugcaaccgccccguccucgagaacuaccucuccgccauggacaccgucuggcaccccgagugcuucgucugcggcgacugcuucaccuccuucuccaccggcuccuucuucgagcucgacggccgccccuucugcgagcuccacuaccaccaccgccgcggcacccucugccacggcugcggccagcccaucaccggccgcugcaucuccgccaugggcuacaaguuccaccccgagcacuucgucugcgccuucugccucacccagcucuccaagggcaucuuccgcgagcagaacgacaagaccuacugccagcccugcuucaacaagcucuucccccucuga

SEQ ID NO: 45484 - RNA, 693 nt, Artificial Sequence
  derived and/or modified sequence opt2 from LRAT__Homo_sapiens__NP_001288574
augaagaaccccaugcucgaggucgucucccuccuccucgagaagcuccuccucaucuccaacuucacccucuucuccuccggcgccgccggcgaggacaagggccgcaacuccuucuacgagaccuccuccuuccaccgcggcgacguccucgaggucccccgcacccaccucacccacuacggcaucuaccucggcgacaaccgcgucgcccacaugaugcccgacauccuccucgcccucaccgacgacaugggccgcacccagaaggucgucuccaacaagcgccucauccucggcgucaucgucaaggucgccuccauccgcgucgacaccgucgaggacuucgccuacggcgccaacauccucgucaaccaccucgacgagucccuccagaagaaggcccuccucaacgaggaggucgcccgccgcgccgagaagcuccucggcuucacccccuacucccuccucuggaacaacugcgagcacuucgucaccuacugccgcuacggcacccccaucuccccccaguccgacaaguucugcgagaccgucaagaucaucauccgcgaccagcgcuccguccucgccuccgccguccucggccucgccuccaucgucugcaccggccucgucuccuacaccacccuccccgccaucuucauccccuucuuccucuggauggccggcuga

SEQ ID NO: 45485 - RNA, 8592 nt, Artificial Sequence
  derived and/or modified sequence opt2 from LRBA__Homo_sapiens__NP_006717
auggccuccgaggacaaccgcguccccucccccccccccaccggcgacgacggcggcggcggcggccgcgaggagacccccaccgagggcggcgcccucucccucaagcccggccuccccauccgcggcauccgcaugaaguucgccguccucaccggccucgucgaggucggcgaggucuccaaccgcgacaucgucgagaccgucuucaaccuccucgucggcggccaguucgaccucgagaugaacuucaucauccaggagggcgaguccaucaacugcauggucgaccuccucgagaagugcgacaucaccugccaggccgaggucugguccauguucaccgccauccucaagaaguccauccgcaaccuccaggucugcaccgaggucggccucgucgagaagguccucggcaagaucgagaaggucgacaacaugaucgccgaccuccucgucgacaugcucggcguccucgccuccuacaaccucaccguccgcgagcucaagcucuucuucuccaagcuccagggcgacaagggccgcuggcccccccacgccggcaagcuccucuccguccucaagcacaugccccagaaguacggccccgacgccuucuucaacuuccccggcaaguccgccgccgccaucgcccucccccccaucgccaaguggcccuaccagaacggcuucaccuuccacaccuggcuccgcauggaccccgucaacaacaucaacgucgacaaggacaagcccuaccucuacugcuuccgcaccuccaagggccucggcuacuccgcccacuucgucggcggcugccucaucgucaccuccaucaaguccaagggcaagggcuuccagcacugcgucaaguucgacuucaagccccagaagugguacauggucaccaucguccacaucuacaaccgcuggaagaacuccgagcuccgcugcuacgucaacggcgagcucgccuccuacggcgagaucaccugguucgucaacaccuccgacaccuucgacaagugcuuccucggcuccuccgagaccgccgacgccaaccgcgucuucugcggccagaugaccgccgucuaccucuucuccgaggcccucaacgccgcccagaucuucgccaucuaccagcucggccucggcuacaagggcaccuucaaguucaaggccgaguccgaccucuuccucgccgagcaccacaagcuccuccucuacgacggcaagcucuccuccgccaucgccuucaccuacaacccccgcgccaccgacgcccagcucugccucgaguccucccccaaggacaaccccuccaucuucguccacuccccccacgcccucaugcuccaggacgucaaggccguccucacccacuccauccaguccgccaugcacuccaucggcggcguccagguccucuucccccucuucgcccagcucgacuaccgccaguaccucuccgacgagaucgaccucaccaucugcuccacccuccucgccuucaucauggagcuccucaagaacuccaucgccaugcaggagcagaugcucgccugcaagggcuuccucgucaucggcuacucccucgagaaguccuccaagucccacgucucccgcgccguccucgagcucugccucgccuucuccaaguaccucuccaaccuccagaacggcaugccccuccucaagcagcucugcgaccacguccuccucaaccccgccaucuggauccacacccccgccaagguccagcucaugcucuacaccuaccucuccaccgaguucaucggcaccgucaacaucuacaacaccauccgccgcgucggcaccguccuccucaucaugcacacccucaaguacuacuacugggccgucaacccccaggaccgcuccggcaucacccccaagggccucgacggcccccgccccaaccagaaggagaugcucucccuccgcgccuuccuccucauguucaucaagcagcucgucaugaaggacuccggcgucaaggaggacgagcuccaggccauccucaacuaccuccucaccaugcacgaggacgacaaccucauggacguccuccagcuccucgucgcccucauguccgagcaccccaacuccaugauccccgccuucgaccagcgcaacggccuccgcgucaucuacaagcuccucgccuccaaguccgagggcauccgcguccaggcccucaaggccaugggcuacuuccucaagcaccucgcccccaagcgcaaggccgaggucaugcucggccacggccucuucucccuccucgccgagcgccucaugcuccagaccaaccucaucaccaugaccaccuacaacguccucuucgagauccucaucgagcagaucggcacccaggucauccacaagcagcaccccgaccccgacuccuccgucaagauccagaacccccagauccucaaggucaucgccacccuccuccgcaacuccccccagugccccgaguccauggagguccgccgcgccuuccucuccgacaugaucaagcucuucaacaacucccgcgagaaccgccgcucccuccuccagugcuccgucuggcaggaguggaugcucucccucugcuacuucaaccccaagaacuccgacgagcagaagaucaccgagauggucuacgccaucuuccgcauccuccucuaccacgccgucaaguacgaguggggcggcuggcgcgucugggucgacacccucuccaucacccacuccaaggucaccuucgagauccacaaggagaaccucgccaacaucuuccgcgagcagcagggcaaggucgacgaggagaucggccucugcuccuccaccuccguccaggccgccuccggcauccgccgcgacaucaacgucuccgucggcucccagcagcccgacaccaaggacucccccgucugcccccacuucaccaccaacggcaacgagaacuccuccaucgagaagaccuccucccucgaguccgccuccaacaucgagcuccagaccaccaacaccuccuacgaggagaugaaggccgagcaggagaaccaggagcuccccgacgagggcacccucgaggagacccucaccaacgagacccgcaacgccgacgaccucgaggucuccuccgacaucaucgaggccgucgccaucuccuccaacuccuucaucaccaccggcaaggacuccaugaccgucuccgaggucaccgccuccaucuccucccccuccgaggaggacgccuccgagaugcccgaguuccucgacaaguccaucgucgaggaggaggaggacgacgacuacgucgagcucaaggucgagggcucccccaccgaggaggccaaccuccccaccgagcuccaggacaacucccucucccccgccgccuccgaggccggcgagaagcucgacauguucggcaacgacgacaagcucaucuuccaggagggcaagcccgucaccgagaagcagaccgacaccgagacccaggacuccaaggacuccggcauccagaccaugaccgccuccggcuccuccgccaugucccccgagaccaccgucucccagaucgccgucgaguccgaccucggccagaugcucgaggagggcaagaaggccaccaaccucacccgcgagaccaagcucaucaacgacugccacggcuccgucuccgaggccuccuccgagcagaagaucgccaagcucgacgucuccaacgucgccaccgacaccgagcgccucgagcucaaggccucccccaacgucgaggccccccagccccaccgccacguccucgagaucucccgccagcacgagcagcccggccagggcaucgcccccgacgccgucaacggccagcgccgcgacucccgcuccaccgucuuccgcauccccgaguucaacuggucccagaugcaccagcgccuccucaccgaccuccucuucuccaucgagaccgacauccagauguggcgcucccacuccaccaagaccgucauggacuucgucaacuccuccgacaacgucaucuucguccacaacaccauccaccucaucucccaggucauggacaacauggucauggccugcggcggcauccucccccuccucuccgccgccaccuccgccacccacgagcucgagaacaucgagcccacccagggccucuccaucgaggccuccgucaccuuccuccagcgccucaucucccucgucgacguccucaucuucgccuccucccucggcuucaccgagaucgaggccgagaaguccauguccuccggcggcauccuccgccagugccuccgccucgucugcgccgucgccguccgcaacugccucgagugccagcagcacucccagcucaagacccgcggcgacaaggcccucaagcccaugcacucccucaucccccucggcaaguccgccgccaagucccccgucgacaucgucaccggcggcaucucccccguccgcgaccucgaccgccuccuccaggacauggacaucaaccgccuccgcgccgucgucuuccgcgacaucgaggacuccaagcaggcccaguuccucgcccucgccgucgucuacuucaucuccguccucauggucuccaaguaccgcgacauccucgagccccagaacgagcgccacucccaguccugcaccgagaccggcuccgagaacgagaacgucucccucuccgagaucacccccgccgccuucuccacccucaccaccgccuccgucgaggaguccgaguccaccuccuccgcccgccgccgcgacuccggcaucggcgaggagaccgccaccggccucggcucccacgucgaggucaccccccacaccgccccccccggcgucuccgccggccccgacgccaucuccgagguccucuccacccucucccucgaggucaacaagucccccgagaccaagaacgaccgcggcaacgaccucgacaccaaggccacccccuccgucuccgucuccaagaacgucaacgucaaggacauccuccgcucccucgucaacauccccgccgacggcgucaccgucgaccccgcccuccucccccccgccugccucggcgcccucggcgaccucuccgucgagcagcccguccaguuccgcuccuucgaccgcuccgucaucgucgccgccaagaaguccgccgucucccccuccaccuucaacaccuccauccccaccaacgccgucuccgucgucuccuccgucgacuccgcccaggccuccgacaugggcggcgagucccccggcucccgcuccuccaacgccaagcuccccuccguccccaccgucgacuccgucucccaggaccccgucuccaacauguccaucaccgagcgccucgagcacgcccucgagaaggccgccccccuccuccgcgagaucuucgucgacuucgcccccuuccucucccgcacccuccucggcucccacggccaggagcuccucaucgagggcaccucccucgucugcaugaaguccuccuccuccgucgucgagcucgucaugcuccucugcucccaggaguggcagaacuccauccagaagaacgccggccucgccuucaucgagcucgucaacgagggccgccuccucucccagaccaugaaggaccaccucguccgcgucgccaacgaggccgaguucauccucucccgccagcgcgccgaggacauccaccgccacgccgaguucgagucccucugcgcccaguacuccgccgacaagcgcgaggacgagaagaugugcgaccaccucauccgcgccgccaaguaccgcgaccacgucaccgccacccagcucauccagaagaucaucaacauccucaccgacaagcacggcgccuggggcaacuccgccgucucccgcccccucgaguucuggcgccucgacuacugggaggacgaccuccgccgccgccgccgcuucguccgcaacccccucggcuccacccaccccgaggccacccucaagaccgccgucgagcacgucugcaucuucaagcuccgcgagaacuccaaggccaccgacgaggacauccucgccaagggcaagcaguccauccgcucccaggcccucggcaaccagaacuccgagaacgagauccuccucgagggcgacgacgacacccucuccuccgucgacgagaaggaccucgagaaccucgccggccccgucucccucuccacccccgcccagcucgucgcccccuccgucgucgucaagggcacccucuccgucaccuccuccgagcucuacuucgaggucgacgaggaggaccccaacuucaagaagaucgaccccaagauccucgccuacaccgagggccuccacggcaaguggcucuucaccgagauccgcuccaucuucucccgccgcuaccuccuccagaacaccgcccucgagaucuucauggccaaccgcgucgccgucauguucaacuuccccgaccccgccaccgucaagaaggucgucaacuaccucccccgcgucggcgucggcaccuccuucggccucccccagacccgccgcaucucccucgccuccccccgccagcucuucaaggccuccaacaugacccagcgcuggcagcaccgcgagaucuccaacuucgaguaccucauguuccucaacaccaucgccggccgcuccuacaacgaccucaaccaguaccccgucuuccccugggucaucaccaacuacgaguccgaggagcucgaccucacccuccccaccaacuuccgcgaccucuccaagcccaucggcgcccucaaccccaagcgcgccgccuucuucgccgagcgcuacgaguccugggaggacgaccagguccccaaguuccacuacggcacccacuacuccaccgccuccuucguccucgccuggcuccuccgcaucgagcccuucaccaccuacuuccucaaccuccagggcggcaaguucgaccacgccgaccgcaccuucuccuccaucucccgcgccuggcgcaacucccagcgcgacaccuccgacaucaaggagcucauccccgaguucuacuaccuccccgagauguucgucaacuucaacaacuacaaccucggcgucauggacgacggcaccgucgucuccgacgucgagcucccccccugggccaagaccuccgaggaguucguccacaucaaccgccucgcccucgaguccgaguucgucuccugccagcuccaccaguggaucgaccucaucuucggcuacaagcagcagggccccgaggccguccgcgcccucaacgucuucuacuaccucaccuacgagggcgccgucaaccucaacuccaucaccgaccccguccuccgcgaggccgucgaggcccagauccgcuccuucggccagacccccucccagcuccucaucgagccccaccccccccgcggcuccgccaugcaggucuccccccucauguucaccgacaaggcccagcaggacgucaucaugguccucaaguuccccuccaacucccccgucacccacgucgccgccaacacccagcccggccucgccacccccgccgucaucaccgucaccgccaaccgccucuucgccgucaacaaguggcacaaccuccccgcccaccagggcgccguccaggaccagcccuaccagcuccccgucgagaucgacccccucaucgccuccaacaccggcaugcaccgccgccagaucaccgaccuccucgaccaguccauccagguccacucccagugcuucgucaucaccuccgacaaccgcuacauccucgucugcggcuucugggacaaguccuuccgcgucuacuccaccgacaccggccgccucauccaggucgucuucggccacugggacgucgucaccugccucgcccgcuccgaguccuacaucggcggcaacugcuacauccucuccggcucccgcgacgccacccuccuccucugguacuggaacggcaagugcuccggcaucggcgacaaccccggcuccgagaccgccgccccccgcgccauccucaccggccacgacuacgaggucaccugcgccgccgucugcgccgagcucggccucguccucuccggcucccaggagggccccugccucauccacuccaugaacggcgaccuccuccgcacccucgagggccccgagaacugccucaagcccaagcucauccaggccucccgcgagggccacugcgucaucuucuacgagaacggccucuucugcaccuucuccgucaacggcaagcuccaggccaccauggagaccgacgacaacauccgcgccauccagcucucccgcgacggccaguaccuccucaccggcggcgaccgcggcgucgucgucguccgccaggucuccgaccucaagcagcucuucgccuaccccggcugcgacgccggcauccgcgccauggcccucuccuacgaccagcgcugcaucaucuccggcauggccuccggcuccaucguccucuucuacaacgacuucaaccgcuggcaccacgaguaccagacccgcuacuga

SEQ ID NO: 45486 - RNA, 2292 nt, Artificial Sequence
  derived and/or modified sequence opt2 from LRCH1__Homo_sapiens__NP_001157683
auggccacccccggcuccgagccccagcccuucguccccgcccucuccgucgccacccuccacccccuccaccacccccaccaccaccaccaccaccaccagcaccacggcggcaccggcgcccccggcggcgccggcggcggcggcggcggcuccggcggcuucaaccucccccucaaccgcggccucgagcgcgcccucgaggaggccgccaacuccggcggccucaaccucuccgcccgcaagcucaaggaguucccccgcaccgccgcccccggccacgaccucuccgacaccguccaggccgaccucuccaagaaccgccucgucgagguccccauggagcucugccacuucgucucccucgagauccucaaccucuaccacaacugcauccgcgucauccccgaggccaucgucaaccuccagaugcucaccuaccucaaccucucccgcaaccagcucuccgcccuccccgccugccucugcggccucccccucaagguccucaucgccuccaacaacaagcucggcucccuccccgaggagaucggccagcucaagcagcucauggagcucgacgucuccugcaacgagaucaccgcccucccccagcagaucggccagcucaagucccuccgcgagcucaacguccgccgcaacuaccucaagguccucccccaggagcucgucgaccucccccucgucaaguucgacuucuccugcaacaagguccucgucauccccaucugcuuccgcgagaugaagcagcuccagguccuccuccucgagaacaacccccuccaguccccccccgcccagaucugcaccaagggcaagguccacaucuucaaguaccucuccauccaggccugccagaucaagaccgccgacucccucuaccuccacaccauggagcgcccccaccuccaccagcacgucgaggacggcaagaaggacuccgacuccggcgucggcuccgacaacggcgacaagcgccucuccgccaccgagcccuccgacgaggacaccgucucccucaacguccccauguccaacaucauggaggaggagcagaucaucaaggaggacuccugccaccgccucucccccgucaagggcgaguuccaccaggaguuccagcccgagcccucccuccucggcgacuccaccaacuccggcgaggagcgcgaccaguucaccgaccgcgccgacggccuccacuccgaguucaugaacuacaaggcccgcgccgaggacugcgaggagcuccuccgcaucgaggaggacguccacuggcagaccgagggcaucaucuccuccuccaaggaccaggacauggacaucgccaugaucgagcagcuccgcgaggccgucgaccuccuccaggaccccaacggccucuccaccgacaucaccgagcgcuccguccucaaccucuaccccaugggcuccgccgaggcccucgagcuccaggacuccgcccucaacggccagauccagcucgagaccucccccgucugcgagguccaguccgaccucacccuccaguccaacggcucccaguacucccccaacgagauccgcgagaacucccccgccgucucccccaccaccaacuccaccgcccccuucggccucaagccccgcuccgaccccgcccucauccucccccccaucuccuucaacacccucacccaggcccagaccugggacuccuccuccuacuccguccccuccgagggcgacuccgacaacgucuuccuccgcccccagcgcaaccucgaguccaucgacccccaguucaccauccgccgcaagauggagcagaugcgcgaggagaaggagcucgucgagcagcuccgcgaguccaucgagaugcgccucaaggucucccuccacgaggaccucggcgccgcccucauggacggcgucguccucugccaccucgucaaccacauccgcccccgcuccgucgccuccauccacguccccucccccgccguccccaagcucuccauggccaagugccgccgcaacgucgagaacuuccucgaggccugccgcaagcucggcguccccgaggccgaccucugcucccccugcgacauccuccagcucgacuuccgccacauccgcaagaccgucgacacccuccucgcccucggcgagaaggcccccccccccaccuccgcccuccgcucccgcgaccucaucggcuucugccucguccacauccucuucaucguccucgucuacaucaccuaccacuggaacgcccucuccgccuga

SEQ ID NO: 45487 - RNA, 2052 nt, Artificial Sequence
  derived and/or modified sequence opt2 from LRCH4__Homo_sapiens__NP_002310
auggccgccgccgucgccgccccccucgccgccggcggcgaggaggccgccgccaccaccuccguccccggcucccccggccuccccggccgccgcuccgccgagcgcgcccucgaggaggccgucgccaccggcacccucaaccucuccaaccgccgccucaagcacuucccccgcggcgccgcccgcuccuacgaccucuccgacaucacccaggccgaccucucccgcaaccgcuuccccgagguccccgaggccgccugccagcucgucucccucgagggccucucccucuaccacaacugccuccgcugccucaaccccgcccucggcaaccucaccgcccucaccuaccucaaccucucccgcaaccagcucucccuccucccccccuacaucugccagcucccccuccgcguccucaucgucuccaacaacaagcucggcgcccucccccccgacaucggcacccucggcucccuccgccagcucgacgucuccuccaacgagcuccagucccuccccuccgagcucugcggccucuccucccuccgcgaccucaacguccgccgcaaccagcucuccacccuccccgaggagcucggcgaccucccccucguccgccucgacuucuccugcaaccgcgucucccgcauccccgucuccuucugccgccuccgccaccuccaggucauccuccucgacuccaacccccuccaguccccccccgcccaggucugccucaagggcaagcuccacaucuucaaguaccucuccaccgaggccggccagcgcggcuccgcccucggcgaccucgcccccucccgcccccccuccuucucccccugccccgccgaggaccucuuccccggccaccgcuacgacggcggccucgacuccggcuuccacuccgucgacuccggcuccaagcgcugguccggcaacgaguccaccgacgaguucuccgagcucuccuuccgcaucuccgagcucgcccgcgagccccgcggcccccgcgagcgcaaggaggacggcuccgccgacggcgaccccguccagaucgacuucaucgacucccacguccccggcgaggacgaggagcgcggcaccgucgaggagcagcgcccccccgagcucucccccggcgccggcgaccgcgagcgcgcccccuccucccgccgcgaggagcccgccggcgaggagcgccgccgccccgacacccuccagcucuggcaggagcgcgagcgccgccagcagcagcaguccggcgccuggggcgccccccgcaaggacucccuccucaagcccggccuccgcgccgucgucggcggcgccgccgccgucuccacccaggccaugcacaacggcucccccaaguccuccgccucccaggccggcgccgccgccggccagggcgcccccgcccccgcccccgccucccaggagccccuccccaucgccggccccgccaccgcccccgccccccgcccccucggcuccauccagcgccccaacuccuuccucuuccgcuccuccucccaguccggcuccggccccuccucccccgacuccguccuccgcccccgccgcuacccccagguccccgacgagaaggaccucaugacccagcuccgccagguccucgagucccgccuccagcgcccccuccccgaggaccucgccgaggcccucgccuccggcgucauccucugccagcucgccaaccagcuccgcccccgcuccguccccuucauccacguccccucccccgccguccccaagcucuccgcccucaaggcccgcaagaacgucgaguccuuccucgaggccugccgcaagaugggcguccccgaggccgaccucugcucccccuccgaccuccuccagggcaccgcccgcggccuccgcaccgcccucgaggccgucaagcgcgucggcggcaaggcccuccccccccucuggccccccuccggccucggcggcuucgucgucuucuacgucguccucaugcuccuccucuacgucaccuacacccgccuccucggcuccuga

SEQ ID NO: 45488 - RNA, 2370 nt, Artificial Sequence
  derived and/or modified sequence opt2 from LRFN2__Homo_sapiens__NP_065788
auggagacccuccucggcggccuccucgccuucggcauggccuucgccgucgucgacgccugccccaaguacugcgucugccagaaccucuccgagucccucggcacccucugccccuccaagggccuccucuucgucccccccgacaucgaccgccgcaccgucgagcuccgccucggcggcaacuucaucauccacaucucccgccaggacuucgccaacaugaccggccucgucgaccucacccucucccgcaacaccaucucccacauccagcccuucuccuuccucgaccucgagucccuccgcucccuccaccucgacuccaaccgccuccccucccucggcgaggacacccuccgcggccucgucaaccuccagcaccucaucgucaacaacaaccagcucggcggcaucgccgacgaggccuucgaggacuuccuccucacccucgaggaccucgaccucuccuacaacaaccuccacggccuccccugggacuccguccgccgcauggucaaccuccaccagcucucccucgaccacaaccuccucgaccacaucgccgagggcaccuucgccgaccuccagaagcucgcccgccucgaccucaccuccaaccgccuccagaagcucccccccgaccccaucuucgcccgcucccaggccuccgcccucaccgccacccccuucgcccccccccucuccuucuccuucggcggcaacccccuccacugcaacugcgagcuccucuggcuccgccgccucgagcgcgacgacgaccucgagaccugcggcucccccggcggccucaagggccgcuacuucuggcacguccgcgaggaggaguucgucugcgagcccccccucaucacccagcacacccacaagcuccucguccucgagggccaggccgccacccucaagugcaaggccaucggcgaccccuccccccucauccacugggucgcccccgacgaccgccucgucggcaacuccucccgcaccgccgucuacgacaacggcacccucgacaucuucaucaccaccucccaggacuccggcgccuucaccugcaucgccgccaacgccgccggcgaggccaccgccauggucgaggucuccaucguccagcucccccaccucuccaacuccaccucccgcaccgccccccccaagucccgccucuccgacaucaccggcuccuccaagaccucccgcggcggcggcggcuccggcggcggcgagccccccaaguccccccccgagcgcgccguccucgucuccgaggucaccaccaccuccgcccucgucaagugguccgucuccaaguccgccccccgcgucaagauguaccagcuccaguacaacugcuccgacgacgagguccucaucuaccgcaugauccccgccuccaacaaggccuucgucgucaacaaccucgucuccggcaccggcuacgaccucugcguccucgccaugugggacgacaccgccaccacccucaccgccaccaacaucgucggcugcgcccaguucuucaccaaggccgacuacccccagugccaguccaugcacucccagauccucggcggcaccaugauccucgucaucggcggcaucaucgucgccacccuccucgucuucaucgucauccucaugguccgcuacaaggucugcaaccacgaggcccccuccaagauggccgccgccgucuccaacgucuacucccagaccaacggcgcccagccccccccccccuccuccgcccccgccggcgcccccccccagggcccccccaaggucgucguccgcaacgagcuccucgacuucaccgccucccucgcccgcgccuccgacuccuccuccuccuccucccucggcuccggcgaggccgccggccucggccgcgcccccuggcgcaucccccccuccgccccccgccccaagcccucccucgaccgccucaugggcgccuucgccucccucgaccucaagucccagcgcaaggaggagcuccucgacucccgcacccccgccggccgcggcgccggcaccuccgcccgcggccaccacuccgaccgcgagccccuccucggcccccccgccgcccgcgcccgcucccuccucccccucccccucgagggcaaggccaagcgcucccacuccuucgacaugggcgacuucgccgccgccgccgccggcggcgucguccccggcggcuacucccccccccgcaaggucuccaacaucuggaccaagcgcucccucuccgucaacggcaugcuccuccccuucgaggaguccgaccucgucggcgcccgcggcaccuucggcuccuccgagugggucauggaguccaccgucuga

SEQ ID NO: 45489 - RNA, 2160 nt, Artificial Sequence
  derived and/or modified sequence opt2 from LRFN5__Homo_sapiens__NP_689660
auggagaagauccucuucuaccucuuccucaucggcaucgccgucaaggcccagaucugccccaagcgcugcgucugccagauccucucccccaaccucgccacccucugcgccaagaagggccuccucuucgucccccccaacaucgaccgccgcaccgucgagcuccgccucgccgacaacuucgucaccaacaucaagcgcaaggacuucgccaacaugaccucccucgucgaccucacccucucccgcaacaccaucuccuucaucaccccccacgccuucgccgaccuccgcaaccuccgcgcccuccaccucaacuccaaccgccucaccaagaucaccaacgacauguucuccggccucuccaaccuccaccaccucauccucaacaacaaccagcucacccucaucuccuccaccgccuucgacgacgucuucgcccucgaggagcucgaccucuccuacaacaaccucgagaccauccccugggacgccgucgagaagauggucucccuccacacccucucccucgaccacaacaugaucgacaacauccccaagggcaccuucucccaccuccacaagaugacccgccucgacgucaccuccaacaagcuccagaagcucccccccgacccccucuuccagcgcgcccagguccucgccaccuccggcaucaucucccccuccaccuucgcccucuccuucggcggcaacccccuccacugcaacugcgagcuccucuggcuccgccgccucucccgcgaggacgaccucgagaccugcgccucccccccccuccucaccggccgcuacuucugguccauccccgaggaggaguuccucugcgagcccccccucaucacccgccacacccacgagaugcgcguccucgagggccagcgcgccacccuccgcugcaaggcccgcggcgaccccgagcccgccauccacuggaucucccccgagggcaagcucaucuccaacgccacccgcucccucgucuacgacaacggcacccucgacauccucaucaccaccgucaaggacaccggcgccuucaccugcaucgccuccaaccccgccggcgaggccacccagaucgucgaccuccacaucaucaagcucccccaccuccucaacuccaccaaccacauccacgagcccgaccccggcuccuccgacaucuccaccuccaccaaguccggcuccaacaccuccuccuccaacggcgacaccaagcucucccaggacaagaucgucgucgccgaggccaccuccuccaccgcccuccucaaguucaacuuccagcgcaacauccccggcauccgcauguuccagauccaguacaacggcaccuacgacgacacccucgucuaccgcaugaucccccccaccuccaagaccuuccucgucaacaaccucgccgccggcaccauguacgaccucugcguccucgccaucuacgacgacggcaucaccucccucaccgccacccgcgucgucggcugcauccaguucaccaccgagcaggacuacguccgcugccacuucaugcagucccaguuccucggcggcaccaugaucaucaucaucggcggcaucaucgucgccuccguccucgucuucaucaucauccucaugauccgcuacaaggucugcaacaacaacggccagcacaaggucaccaaggucuccaacgucuacucccagaccaacggcgcccagauccagggcugcuccgucacccucccccaguccgucuccaagcaggccgucggccacgaggagaacgcccagugcugcaaggccaccuccgacaacgucauccaguccuccgagaccugcuccucccaggacuccuccaccaccaccuccgcccucccccccuccuggaccuccuccaccuccgucucccagaagcagaagcgcaagaccggcaccaagcccuccaccgagccccagaacgaggccgucaccaacgucgagucccagaacaccaaccgcaacaacuccaccgcccuccagcucgccucccgcccccccgacuccgucaccgagggccccaccuccaagcgcgcccacaucaagcccaacgcccuccucaccaacgucgaccagaucguccaggagacccagcgccucgagcucaucuga

SEQ ID NO: 45490 - RNA, 1044 nt, Artificial Sequence
  derived and/or modified sequence opt2 from LRG1__Homo_sapiens__NP_443204
auguccuccuggucccgccagcgccccaagucccccggcggcauccagccccacgucucccgcacccucuuccuccuccuccuccucgccgccuccgccuggggcgucacccucucccccaaggacugccaggucuuccgcuccgaccacggcuccuccaucuccugccagccccccgccgagauccccggcuaccuccccgccgacaccguccaccucgccgucgaguucuucaaccucacccaccuccccgccaaccuccuccagggcgccuccaagcuccaggagcuccaccucuccuccaacggccucgagucccucucccccgaguuccuccgccccgucccccagcuccgcguccucgaccucacccgcaacgcccucaccggccucccccccggccucuuccaggccuccgccacccucgacacccucguccucaaggagaaccagcucgagguccucgaggucuccuggcuccacggccucaaggcccucggccaccucgaccucuccggcaaccgccuccgcaagcucccccccggccuccucgccaacuucacccuccuccgcacccucgaccucggcgagaaccagcucgagacccucccccccgaccuccuccgcggcccccuccagcucgagcgccuccaccucgagggcaacaagcuccagguccucggcaaggaccuccuccucccccagcccgaccuccgcuaccucuuccucaacggcaacaagcucgcccgcgucgccgccggcgccuuccagggccuccgccagcucgacaugcucgaccucuccaacaacucccucgccuccguccccgagggccucugggccucccucggccagcccaacugggacaugcgcgacggcuucgacaucuccggcaaccccuggaucugcgaccagaaccucuccgaccucuaccgcuggcuccaggcccagaaggacaagauguucucccagaacgacacccgcugcgccggccccgaggccgucaagggccagacccuccucgccgucgccaagucccaguga

SEQ ID NO: 45491 - RNA, 2478 nt, Artificial Sequence
  derived and/or modified sequence opt2 from LRGUK__Homo_sapiens__NP_653249
auggccaccuccgagcgcgcccuccuccgcacccgcgccgccucccuccuccgcggccucggccgcucccgcaccggcgcccgcucccuccaguuccgcgccgagaaggagcgccagcccugcugguccuuccccaugggccagaagaccaagggcuccuccaacaucgccuccuccuaccuccuccagcagcucaugcaccgcuaccaggagcucgacuccgacggcgacgaggaccagggcgagggcgaggccggcuccgaggaguccuccgaguccgagaugcucaaccucgaggaggaguucgacggcguccuccgcgaggaggccgucgccaaggcccuccaccaccucggccgcuccggcuccggcaccgagcaggucuaccucaaccucacccucuccggcugcaaccucaucgacgucuccauccucugcggcuacguccaccuccagaagcucgaccucuccgccaacaagaucgaggaccucuccugcgucuccugcaugcccuaccuccucgagcucaacgccucccagaacaaccucaccaccuucuucaacuucaagccccccaagaaccucaagaaggccgacuucucccacaaccagaucuccgagaucugcgaccucuccgccuaccacgcccucaccaagcucauccucgacggcaacgagaucgaggagaucuccggccucgagaugugcaacaaccucauccaccucucccucgccaacaacaagaucaccaccaucaacggccucaacaagcuccccaucaagauccucugccucuccaacaaccagaucgagaugaucaccggccucgaggaccucaaggcccuccagaaccucgaccucucccacaaccagaucuccucccuccagggccucgagaaccacgaccuccucgaggucaucaaccucgaggacaacaagaucgccgagcuccgcgagaucgaguacaucaagaaccuccccauccuccgcguccucaaccuccucgagaaccccauccaggagaaguccgaguacugguucuucgucaucuucaugcuccuccgccucaccgagcucgaccagaagaagaucaaggucgaggagaaggucuccgccgucaacaaguacgaccccccccccgaggucgucgccgcccaggaccaccucacccacgucgucaacuccgucaugcagccccagcgcaucuucgacuccacccuccccucccucgacgcccccuaccccaugcucauccucgccggccccgaggccugcggcaagcgcgagcucgcccaccgccucugccgccaguucuccaccuacuuccgcuacggcgccugccacaccacccgcccccccuacuucggcgagggcgaccgcgucgacuaccacuucaucucccaggacgucuucgacgagauggucaacaugggcaaguucauccucaccuucuccuacggcaaccacaaguacggccucaaccgcgacaccgucgagggcaucgcccgcgacggccucgccuccugcauccacauggagaucgagggcguccgcucccucaaguacuccuacuucgagccccgcuacauccucgucguccccaugaacaaggagaaguacgagggcuaccuccgccgcaagggccucuucucccgcgccgagaucgaguucgccgucucccgcgucgaccucuacaucaagaucaaccagaacuuccccggcuacuucgacgaggucaucaacgccgacgaccucgacgucgccuaccagaagcucucccagcucauccgcgaguaccucggccucaccgaggagcccgccaagucccucgccaccaccgccgacgucaagaccucccaccucaagcccgaggcccaccccaccaaguacaucuccuccaacaugggcgacuuccuccacuccaccgaccgcaacuaccucaucaaguucugggccaagcucuccgccaagaagacccccgccgagcgcgacuccauccaccgccagcacgaggccgcccgccaggcccucaugggccgcauccgccccgaccacacccuccucuuccagcgcggccccguccccgccccccucaccuccggccuccacuacuacaccacccucgaggagcucuggaaguccuucgaccucugcgaggacuacuucaagccccccuucggccccuaccccgagaaguccggcaaggacucccucgucuccaugaagugcucccucuuccgcuucugccccugguccaaggagcuccccuuccagccccccgagggcuccaucuccucccaccucggcuccggcgccuccgacuccgagaccgaggagacccgcaaggcccuccccauccaguccuucucccacgagaaggagucccaccagcaccgccagcacuccguccccgucaucucccgccccggcuccaacgucaagcccacccucccccccaucccccagggccgccgcuga

SEQ ID NO: 45492 - RNA, 2229 nt, Artificial Sequence
  derived and/or modified sequence opt2 from LRIF1__Homo_sapiens__XP_011540070
auguaccaggucguccagaccaucggcuccgacggcaagaaccuccuccagcuccuccccauccccaaguccuccggcaaccucaucccccucguccaguccuccgucauguccgacgcccucaagggcaacaccggcaagcccguccaggucaccuuccagacccagaucuccuccuccuccaccuccgccuccguccagcuccccaucuuccagcccgccuccuccuccaacuacuuccucacccgcaccgucgacaccuccgagaagggccgcgucaccuccgucggcaccggcaacuucuccuccuccgucuccaagguccagucccacggcgucaagaucgacggccucaccaugcagaccuucgccgucccccccuccacccagaaggacuccuccuucaucgucgucaacacccagucccuccccgucaccgucaagucccccguccuccccuccggccaccaccuccagauccccgcccacgccgaggucaaguccguccccgccuccucccucccccccuccguccagcagaagauccucgccaccgccaccaccuccaccuccggcauggucgaggccucccagaugcccaccgucaucuacgucucccccgucaacaccgucaagaacgucgucaccaagaacuuccagaacaucuaccccaagcccgucaccgagaucgccaagcccgucauccucaacaccacccagauccccaagaacgucgccaccgagacccagcucaagggcggccagcacucccaggccgcccccgucaaguggaucuuccaggacaaccuccagcccuucacccccucccucguccccgucaaguccuccaacaacgucgccuccaagauccucaagaccuucgucgaccgcaagaaccucggcgacaacaccaucaacaugcccccccucuccaccaucgaccccuccggcacccgcuccaagaacaugcccaucaaggacaacgcccucgucauguucaacggcaaggucuaccuccucgccaagaagggcaccgacguccuccccucccagaucgaccagcagaacuccgucucccccgacacccccguccgcaaggacacccuccagaccgucuccuccucccccgucaccgagaucucccgcgaggucgucaacaucguccucgccaaguccaaguccucccagauggagaccaagucccucuccaacacccagcucgccuccauggccaaccuccgcgccgagaagaacaaggucgagaagcccucccccuccaccaccaacccccacaugaaccaguccuccaacuaccucaagcaguccaagacccucuucaccaaccccaucuuccccgucggcuucuccaccggccacaacgccccccgcaaggucaccgccgucaucuacgcccgcaagggcuccguccuccaguccaucgagaagaucuccuccuccgucgacgccaccaccgucaccucccagcagugcgucuuccgcgaccaggagcccaagauccacaacgagauggccuccaccuccgacaagggcgcccagggccgcaacgacaagaaggacucccagggccgcuccaacaaggcccuccaccucaaguccgacgccgaguucaagaagaucuucggccucaccaaggaccuccgcgucugccucacccgcauccccgaccaccucaccuccggcgagggcuucgacuccuucuccucccucgucaaguccggcaccuacaaggagaccgaguucauggucaaggagggcgagcgcaagcagcagaacuucgacaagaagcgcaaggccaagaccaacaagaagauggaccacaucaagaagcgcaagaccgagaacgccuacaacgccaucaucaacggcgaggccaacgucaccggcucccagcuccucuccuccauccuccccaccuccgacgucucccagcacaacauccucaccucccacuccaagacccgccaggagaagcgcaccgagauggaguacuacacccacgagaagcaggagaagggcacccucaacuccaacgccgccuacgagcagucccacuucuucaacaagaacuacaccgaggacaucuuccccgucaccccccccgagcucgaggagaccauccgcgacgagaagauccgccgccucaagcagguccuccgcgagaaggaggccgcccucgaggagaugcgcaagaagaugcaccagaaguga

SEQ ID NO: 45493 - RNA, 3282 nt, Artificial Sequence
  derived and/or modified sequence opt2 from LRIG1__Homo_sapiens__NP_056356
auggcccgccccguccgcggcggccucggcgccccccgccgcucccccugccuccuccuccucuggcuccuccuccuccgccucgagcccgucaccgccgccgccggcccccgcgcccccugcgccgccgccugcaccugcgccggcgacucccucgacugcggcggccgcggccucgccgcccuccccggcgaccuccccuccuggacccgcucccucaaccucuccuacaacaagcucuccgagaucgaccccgccggcuucgaggaccuccccaaccuccaggaggucuaccucaacaacaacgagcucaccgccguccccucccucggcgccgccuccucccacgucgucucccucuuccuccagcacaacaagauccgcuccgucgagggcucccagcucaaggccuaccucucccucgagguccucgaccucucccucaacaacaucaccgagguccgcaacaccugcuucccccacggcccccccaucaaggagcucaaccucgccggcaaccgcaucggcacccucgagcucggcgccuucgacggccucucccgcucccuccucacccuccgccucuccaagaaccgcaucacccagcuccccguccgcgccuucaagcucccccgccucacccagcucgaccucaaccgcaaccgcauccgccucaucgagggccucaccuuccagggccucaacucccucgagguccucaagcuccagcgcaacaacaucuccaagcucaccgacggcgccuucuggggccucuccaagaugcacguccuccaccucgaguacaacucccucgucgaggucaacuccggcucccucuacggccucaccgcccuccaccagcuccaccucuccaacaacuccaucgcccgcauccaccgcaagggcugguccuucugccagaagcuccacgagcucguccucuccuucaacaaccucacccgccucgacgaggagucccucgccgagcucuccucccucuccguccuccgccucucccacaacuccaucucccacaucgccgagggcgccuucaagggccuccgcucccuccgcguccucgaccucgaccacaacgagaucuccggcaccaucgaggacaccuccggcgccuucuccggccucgacucccucuccaagcucacccucuucggcaacaagaucaaguccgucgccaagcgcgccuucuccggccucgagggccucgagcaccucaaccucggcggcaacgccauccgcuccguccaguucgacgccuucgucaagaugaagaaccucaaggagcuccacaucuccuccgacuccuuccucugcgacugccagcucaaguggcucccccccuggcucaucggccgcaugcuccaggccuucgucaccgccaccugcgcccaccccgagucccucaagggccaguccaucuucuccgucccccccgaguccuucgucugcgacgacuuccucaagccccagaucaucacccagcccgagaccaccauggccauggucggcaaggacauccgcuucaccugcuccgccgccuccuccuccuccucccccaugaccuucgccuggaagaaggacaacgagguccucaccaacgccgacauggagaacuucguccacguccacgcccaggacggcgaggucauggaguacaccaccauccuccaccuccgccaggucaccuucggccacgagggccgcuaccagugcgucaucaccaaccacuucggcuccaccuacucccacaaggcccgccucaccgucaacguccuccccuccuucaccaagaccccccacgacaucaccauccgcaccaccaccauggcccgccucgagugcgccgccaccggccaccccaacccccagaucgccuggcagaaggacggcggcaccgacuuccccgccgcccgcgagcgccgcaugcacgucaugcccgacgacgacgucuucuucaucaccgacgucaagaucgacgacgccggcgucuacuccugcaccgcccagaacuccgccggcuccaucuccgccaacgccacccucaccguccucgagacccccucccucgucgucccccucgaggaccgcgucgucuccgucggcgagaccgucgcccuccagugcaaggccaccggcaacccccccccccgcaucaccugguucaagggcgaccgcccccucucccucaccgagcgccaccaccucacccccgacaaccagcuccucgucguccagaacgucgucgccgaggacgccggccgcuacaccugcgagauguccaacacccucggcaccgagcgcgcccacucccagcucuccguccuccccgccgccggcugccgcaaggacggcaccaccgucggcaucuucaccaucgccgucgucuccuccaucguccucaccucccucgucugggucugcaucaucuaccagacccgcaagaaguccgaggaguacuccgucaccaacaccgacgagaccgucgucccccccgacguccccuccuaccucuccucccagggcacccucuccgaccgccaggagaccgucguccgcaccgagggcggcccccaggccaacggccacaucgaguccaacggcgucugcccccgcgacgccucccacuuccccgagcccgacacccacuccgucgccugccgccagcccaagcucugcgccggcuccgccuaccacaaggagcccuggaaggccauggagaaggccgagggcacccccggcccccacaagauggagcacggcggccgcgucgucugcuccgacugcaacaccgaggucgacugcuacucccgcggccaggccuuccacccccagcccgucucccgcgacuccgcccagcccuccgcccccaacggccccgagcccggcggcuccgaccaggagcacuccccccaccaccagugcucccgcaccgccgccggcuccugccccgagugccagggcucccucuaccccuccaaccacgaccgcaugcucaccgccgucaagaagaagcccauggccucccucgacggcaagggcgacuccuccuggacccucgcccgccucuaccaccccgacuccaccgagcuccagcccgccuccucccucaccuccggcucccccgagcgcgccgaggcccaguaccuccucgucuccaacggccaccuccccaaggccugcgacgccucccccgaguccaccccccucaccggccagcuccccggcaagcagcgcgucccccuccuccucgcccccaaguccuga

SEQ ID NO: 45494 - RNA, 3180 nt, Artificial Sequence
  derived and/or modified sequence opt2 from LRIG3__Homo_sapiens__NP_001129523
auggucgacguccuccuccucuucucccucugccuccucuuccacaucucccgccccgaccucucccacaaccgccucuccuucaucaaggccuccuccaugucccaccuccagucccuccgcgaggucaagcucaacaacaacgagcucgagaccauccccaaccucggccccgucuccgccaacaucacccuccucucccucgccggcaaccgcaucgucgagauccuccccgagcaccucaaggaguuccagucccucgagacccucgaccucuccuccaacaacaucuccgagcuccagaccgccuuccccgcccuccagcucaaguaccucuaccucaacuccaaccgcgucaccuccauggagcccggcuacuucgacaaccucgccaacacccuccucguccucaagcucaaccgcaaccgcaucuccgccaucccccccaagauguucaagcucccccagcuccagcaccucgagcucaaccgcaacaagaucaagaacgucgacggccucaccuuccagggccucggcgcccucaagucccucaagaugcagcgcaacggcgucaccaagcucauggacggcgccuucuggggccucuccaacauggagauccuccagcucgaccacaacaaccucaccgagaucaccaagggcuggcucuacggccuccucaugcuccaggagcuccaccucucccagaacgccaucaaccgcaucucccccgacgccugggaguucugccagaagcucuccgagcucgaccucaccuucaaccaccucucccgccucgacgacuccuccuuccucggccucucccuccucaacacccuccacaucggcaacaaccgcgucuccuacaucgccgacugcgccuuccgcggccucuccucccucaagacccucgaccucaagaacaacgagaucuccuggaccaucgaggacaugaacggcgccuucuccggccucgacaagcuccgccgccucauccuccagggcaaccgcauccgcuccaucaccaagaaggccuucaccggccucgacgcccucgagcaccucgaccucuccgacaacgccaucaugucccuccagggcaacgccuucucccagaugaagaagcuccagcagcuccaccucaacaccuccucccuccucugcgacugccagcucaaguggcucccccagugggucgccgagaacaacuuccaguccuucgucaacgccuccugcgcccacccccagcuccucaagggccgcuccaucuucgccgucucccccgacggcuucgucugcgacgacuuccccaagccccagaucaccguccagcccgagacccaguccgccaucaagggcuccaaccucuccuucaucugcuccgccgccuccuccuccgacucccccaugaccuucgccuggaagaaggacaacgagcuccuccacgacgccgagauggagaacuacgcccaccuccgcgcccagggcggcgaggucauggaguacaccaccauccuccgccuccgcgaggucgaguucgccuccgagggcaaguaccagugcgucaucuccaaccacuucggcuccuccuacuccgucaaggccaagcucaccgucaacaugcuccccuccuucaccaagacccccauggaccucaccauccgcgccggcgccauggcccgccucgagugcgccgccgucggccaccccgccccccagaucgccuggcagaaggacggcggcaccgacuuccccgccgcccgcgagcgccgcaugcacgucaugcccgaggacgacgucuucuucaucgucgacgucaagaucgaggacaucggcgucuacuccugcaccgcccagaacuccgccggcuccaucuccgccaacgccacccucaccguccucgagacccccuccuuccuccgcccccuccucgaccgcaccgucaccaagggcgagaccgccguccuccagugcaucgccggcggcucccccccccccaagcucaacuggaccaaggacgacuccccccucgucgucaccgagcgccacuucuucgccgccggcaaccagcuccucaucaucgucgacuccgacgucuccgacgccggcaaguacaccugcgagauguccaacacccucggcaccgagcgcggcaacguccgccucuccgucauccccacccccaccugcgacuccccccagaugaccgcccccucccucgacgacgacggcugggccaccgucggcgucgucaucaucgccgucgucugcugcgucgucggcaccucccucgucugggucgucaucaucuaccacacccgccgccgcaacgaggacugcuccaucaccaacaccgacgagaccaaccuccccgccgacauccccuccuaccucuccucccagggcacccucgccgaccgccaggacggcuacgucuccuccgaguccggcucccaccaccaguucgucaccuccuccggcgccggcuucuuccucccccagcacgacuccuccggcaccugccacaucgacaacuccuccgaggccgacgucgaggccgccaccgaccucuuccucugccccuuccucggcuccaccggccccauguaccucaagggcaacgucuacggcuccgaccccuucgagaccuaccacaccggcugcucccccgacccccgcaccguccucauggaccacuacgagcccuccuacaucaagaagaaggagugcuaccccugcucccaccccuccgaggaguccugcgagcgcuccuucuccaacaucuccuggcccucccacguccgcaagcuccucaacaccuccuacucccacaacgagggccccggcaugaagaaccucugccucaacaaguccucccucgacuucuccgccaaccccgagcccgccuccgucgccuccuccaacuccuucaugggcaccuucggcaaggcccuccgccgcccccaccucgacgccuacuccuccuucggccagcccuccgacugccagccccgcgccuucuaccucaaggcccacuccucccccgaccucgacuccggcuccgaggaggacggcaaggagcgcaccgacuuccaggaggagaaccacaucugcaccuucaagcagacccucgagaacuaccgcacccccaacuuccaguccuacgaccucgacaccuga

SEQ ID NO: 45495 - RNA, 1872 nt, Artificial Sequence
  derived and/or modified sequence opt2 from LRIT1__Homo_sapiens__NP_056428
augcgcgucgcccucggcaugcucuggcuccucgcccucgccuggcccccccaggcccgcggcuucugccccucccagugcuccugcucccuccacaucaugggcgacggcuccaaggcccgcaccgucgucugcaacgaccccgacaugacccucccccccgccuccaucccccccgacaccucccgccuccgccucgagcgcaccgccauccgccgcguccccggcgaggccuuccgcccccucggccgccucgagcagcucuggcuccccuacaacgcccucuccgagcucaacgcccucaugcuccgcggccuccgccgccuccgcgagcuccgccuccccggcaaccgccucgccgccuuccccugggccgcccuccgcgacgcccccaagcuccgccuccucgaccuccaggccaaccgccucuccgccguccccgccgaggccgcccgcuuccucgagaaccucaccuuccucgaccucuccuccaaccagcucaugcgccucccccaggagcucaucgucuccugggcccaccucgagaccggcaucuucccccccggccaccacccccgccgcguccucggccuccaggacaaccccugggccugcgacugccgccucuacgaccucguccaccuccucgacggcugggcccccaaccucgccuucaucgagaccgagcuccgcugcgccuccccccgcucccucgccggcgucgccuucucccagcucgagcuccgcaagugccagggccccgagcuccaccccggcgucgccuccauccgcucccuccucggcggcaccgcccuccuccgcugcggcgccaccggcguccccggccccgagauguccuggcgccgcgccaacggccgcccccucaacggcaccguccaccaggaggucuccuccgacggcaccuccuggacccuccucggccuccccgccgucucccaccucgacuccggcgacuacaucugccaggccaagaacuuccucggcgccuccgagaccgucaucucccucaucgucaccgagccccccaccuccaccgagcacuccggcucccccggcgcccucugggcccgcaccggcggcggcggcgaggccgccgccuacaacaacaagcucgucgcccgccacgucccccagauccccaagcccgccguccucgccaccggccccuccguccccuccaccaaggaggagcucacccucgagcacuuccagauggacgcccucggcgagcucuccgacggccgcgccggccccuccgaggcccgcaugguccgcuccgucaaggucgucggcgacaccuaccacuccgucucccucgucuggaaggccccccaggccaagaacaccaccgccuucuccguccucuacgccgucuucggccagcacuccaugcgccgcgucaucguccagcccggcaagacccgcgucaccaucaccggccuccuccccaagaccaaguacgucgccugcgucugcguccagggccucgucccccgcaaggagcagugcgucaucuucuccaccaacgaggucgucgacgccgagaacacccagcagcucaucaacgucgucgucaucuccgucgccaucgucaucgcccucccccucacccuccucgucugcugcuccgcccuccagaagcgcugccgcaagugcuucaacaaggacuccaccgaggccaccgucaccuacgucaaccucgagcgccucggcuacuccgaggacggccucgaggagcucucccgccacuccgucuccgaggccgaccgccuccucuccgcccgcuccuccgucgacuuccaggccuucggcgucaagggcggccgccgcaucaacgaguacuucugcuga

SEQ ID NO: 45496 - RNA, 2040 nt, Artificial Sequence
  derived and/or modified sequence opt2 from LRIT3__Homo_sapiens__NP_940908
augcaccucuucgccugccucugcaucguccucuccuuccucgagggcgucggcugccucugccccucccagugcaccugcgacuaccacggccgcaacgacggcuccggcucccgccucguccucugcaacgacauggacaugaacgagcuccccaccaaccuccccgucgacaccgucaagcuccgcaucgagaagaccgucauccgccgcaucuccgccgaggccuucuacuaccucgucgagcuccaguaccucugggucaccuacaacuccgucgccuccaucgaccccuccuccuucuacaaccucaagcagcuccacgagcuccgccucgacggcaacucccucgccgccuuccccugggccucccuccucgacaugccccuccuccgcacccucgaccuccacaacaacaagaucaccuccguccccaacgaggcccuccgcuaccucaagaaccucgccuaccucgaccucuccuccaaccgccucaccacccucccccccgacuuccucgaguccuggacccaccucgucuccacccccuccggcguccucgaccucucccccucccgcaucauccucggccuccaggacaaccccugguucugcgacugccacaucuccaagaugaucgagcucuccaaggucgucgaccccgccaucguccuccucgacccccucaugaccugcuccgagcccgagcgccucaccggcauccucuuccagcgcgccgagcucgagcacugccucaagcccuccgucaugaccuccgccaccaagaucauguccgcccucggcuccaacguccuccuccgcugcgacgccaccggcuuccccaccccccagaucaccuggacccgcuccgacuccucccccgucaacuacaccgucauccaggagucccccgaggagggcguccgcugguccaucaugucccucaccggcaucuccuccaaggacgccggcgacuacaagugcaaggccaagaaccucgccggcauguccgaggccgucgucaccgucaccguccucggcaucaccaccacccccaucccccccgacaccuccgagcgcaccggcgaccaccccgagugggacguccagcccggcuccggccgcuccaccuccgucuccuccgccuccuccuaccucugguccuccuccuucucccccaccuccuccuucuccgccuccacccucuccccccccuccaccgccuccuucucccucucccccuucuccuccuccaccgucuccuccaccaccacccucuccaccuccaucuccgccuccaccaccauggccaacaagcgcuccuuccagcuccaccagggcggcaagcgcaaccucaaggucgccaagaacggcuccaagcucccccccgccuccaccuccaagaaggaggagcucgcccuccucgaccagaccaugcucaccgagaccaacgccgccaucgagaaccuccgcgucgucuccgagaccaaggaguccgucacccucaccuggaacaugaucaacaccacccacaacuccgccgucaccguccucuacuccaaguacggcggcaaggaccuccuccuccucaacgccgacuccuccaagaaccaggucaccaucgacggccucgagcccggcggccaguacauggccugcgucugccccaagggcguccccccccagaaggaccagugcaucaccuucuccaccgagcgcgucgagggcgacgacucccaguggucccuccuccucgucgucaccuccaccgccugcgucgucauccucccccucaucugcuuccuccucuacaaggucugcaagcuccagugcaaguccgagcccuucugggaggacgaccucgccaaggagaccuacauccaguucgagacccucuucccccgcucccaguccgucggcgagcucuggacccgcucccaccgcgacgacuccgagaagcuccuccucugcucccgcuccuccgucgagucccaggucaccuucaaguccgagggcucccgccccgaguacuacugcuga

SEQ ID NO: 45497 - RNA, 1500 nt, Artificial Sequence
  derived and/or modified sequence opt2 from LRMP__Homo_sapiens__NP_006143
augaacgacgaccccuccauggaggagaacggcgucgagcgcgucugccccgagucccuccuccagucccgcgaguacuccucccucccccucccccgccacaccuccuccaccgacggcaccaucaccuccuccgaccccggccucgagauccucaacauggccuccugcgaccucgaccgcaacucccucugcaagaaggaggaggacacccgcuccgccucccccaccaucgaggcccagggcaccucccccgcccacgacaacaucgccuuccaggacuccaccuccaaggacaagaccauccucaaccucgaggccaaggaggagcccgagaccaucgaggagcacaagaaggagcacgccuccggcgacuccgucgucuccccccuccccgucaccaccgucaaguccgucaaccuccgccaguccgagaacaccuccgccaacgagaaggaggucgaggccgaguuccuccgccucucccucggcuucaagugcgacugguucacccucgagaagcgcgucaagcucgaggagcgcucccgcgaccucgccgaggagaaccucaagaaggagaucaccaacugccucaagcuccucgagucccucaccccccucugcgaggacgacaaccaggcccaggagaucaucaagaagcucgagaaguccaucaaguuccucucccagugcgccgcccgcgucgccucccgcgccgagaugcucggcgccaucaaccaggagucccgcgucuccaaggccgucgaggucaugauccagcacgucgagaaccucaagcgcauguacgccaaggagcacgccgagcucgaggagcucaagcagguccuccuccagaacgagcgcuccuucaacccccucgaggacgacgacgacugccagaucaagaagcgcuccgccucccucaacuccaagcccuccucccuccgccgcgucaccaucgccucccucccccgcaacaucggcaacgccggcauggucgccggcauggagaacaacgaccgcuucucccgccgcuccuccuccuggcgcauccucggcuccaagcaguccgagcaccgccccucccucccccgcuucaucuccaccuacuccugggccgacgccgaggaggagaagugcgagcucaagaccaaggacgacuccgagcccuccggcgaggagaccgucgagcgcacccgcaagcccucccucuccgagaagaagaacaaccccuccaagugggacgucuccuccgucuacgacaccaucgccuccugggccaccaaccucaaguccuccauccgcaaggccaacaaggcccucuggcucuccaucgccuucaucguccucuucgccgcccucauguccuuccucaccggccagcucuuccagaaguccgucgacgccgcccccacccagcaggaggacuccuggaccucccucgagcacauccucuggcccuucacccgccuccgccacaacggccccccccccgucuga

SEQ ID NO: 45498 - RNA, 2142 nt, Artificial Sequence
  derived and/or modified sequence opt2 from LRP10__Homo_sapiens__NP_054764
augcuccucgccacccuccuccuccuccuccucggcggcgcccucgcccaccccgaccgcaucaucuuccccaaccacgccugcgaggacccccccgccguccuccucgagguccagggcacccuccagcgcccccucguccgcgacucccgcaccucccccgccaacugcaccuggcucauccucggcuccaaggagcagaccgucaccauccgcuuccagaagcuccaccucgccugcggcuccgagcgccucacccuccgcuccccccuccagccccucaucucccucugcgaggccccccccuccccccuccagcuccccggcggcaacgucaccaucaccuacuccuacgccggcgcccgcgcccccaugggccagggcuuccuccucuccuacucccaggacuggcucaugugccuccaggaggaguuccagugccucaaccaccgcugcgucuccgccguccagcgcugcgacggcgucgacgccugcggcgacggcuccgacgaggccggcugcuccuccgaccccuuccccggccucaccccccgccccguccccucccuccccugcaacgucacccucgaggacuucuacggcgucuucuccucccccggcuacacccaccucgccuccgucucccacccccaguccugccacuggcuccucgacccccacgacggccgccgccucgccguccgcuucaccgcccucgaccucggcuucggcgacgccguccacgucuacgacggccccggcccccccgaguccucccgccuccuccgcucccucacccacuucuccaacggcaaggccgucaccgucgagacccucuccggccaggccgucgucuccuaccacaccgucgccugguccaacggccgcggcuucaacgccaccuaccacguccgcggcuacugccuccccugggaccgccccugcggccucggcuccggccucggcgccggcgagggccucggcgagcgcugcuacuccgaggcccagcgcugcgacggcuccugggacugcgccgacggcaccgacgaggaggacugccccggcugcccccccggccacuuccccugcggcgccgccggcaccuccggcgccaccgccugcuaccuccccgccgaccgcugcaacuaccagaccuucugcgccgacggcgccgacgagcgccgcugccgccacugccagcccggcaacuuccgcugccgcgacgagaagugcgucuacgagaccugggucugcgacggccagcccgacugcgccgacggcuccgacgagugggacugcuccuacguccucccccgcaaggucaucaccgccgccgucaucggcucccucgucugcggccuccuccucgucaucgcccucggcugcaccugcaagcucuacgccauccgcacccaggaguacuccaucuucgccccccucucccgcauggaggccgagaucguccagcagcaggccccccccuccuacggccagcucaucgcccagggcgccaucccccccgucgaggacuuccccaccgagaaccccaacgacaacuccguccucggcaaccuccgcucccuccuccagauccuccgccaggacaugacccccggcggcggccccggcgcccgccgccgccagcgcggccgccucaugcgccgccucguccgccgccuccgccgcuggggccuccucccccgcaccaacacccccgcccgcgccuccgaggcccgcucccaggucacccccuccgccgccccccucgaggcccucgacggcggcaccggccccgcccgcgagggcggcgccgucggcggccaggacggcgagcaggcccccccccuccccaucaaggccccccuccccuccgccuccaccucccccgcccccaccaccguccccgaggcccccggcccccuccccucccucccccucgagcccucccuccucuccggcgucguccaggcccuccgcggccgccuccuccccucccucggcccccccggccccacccgcuccccccccggcccccacaccgccguccucgcccucgaggacgaggacgacguccuccucgucccccucgccgagcccggcgucugggucgccgaggccgaggacgagccccuccucaccuga

SEQ ID NO: 45499 - RNA, 2523 nt, Artificial Sequence
  derived and/or modified sequence opt2 from LRP12__Homo_sapiens__NP_001129175
auggccugccgcugguccaccaaggaguccccccgcuggcgcuccgcccuccuccuccucuuccucgccggcgucuacgccugcggcgagacccccgagcagauccgcgcccccuccggcaucaucaccucccccggcuggcccuccgaguaccccgccaagaucaacugcuccugguucauccgcgccaaccccggcgagaucaucaccaucuccuuccaggacuucgacauccagggcucccgccgcugcaaccucgacuggcucaccaucgagaccuacaagaacaucgaguccuaccgcgccugcggcuccaccauccccccccccuacaucuccucccaggaccacaucuggauccgcuuccacuccgacgacaacaucucccgcaagggcuuccgccucgccuacuucuccggcaaguccgaggagcccaacugcgccugcgaccaguuccgcugcggcaacggcaagugcauccccgaggccuggaagugcaacaacauggacgagugcggcgacuccuccgacgaggagaucugcgccaaggaggccaacccccccaccgccgccgccuuccagcccugcgccuacaaccaguuccagugccucucccgcuucaccaaggucuacaccugccuccccgagucccucaagugcgacggcaacaucgacugccucgaccucggcgacgagaucgacugcgacguccccaccugcggccaguggcucaaguacuucuacggcaccuucaacucccccaacuaccccgacuucuacccccccggcuccaacugcaccuggcucaucgacaccggcgaccaccgcaaggucauccuccgcuucaccgacuucaagcucgacggcaccggcuacggcgacuacgucaagaucuacgacggccucgaggagaacccccacaagcuccuccgcguccucaccgccuucgacucccacgccccccucaccgucgucuccuccuccggccagauccgcguccacuucugcgccgacaaggucaacgccgcccgcggcuucaacgccaccuaccaggucgacggcuucugccuccccugggagauccccugcggcggcaacuggggcugcuacaccgagcagcagcgcugcgacggcuacuggcacugccccaacggccgcgacgagaccaacugcaccaugugccagaaggaggaguuccccugcucccgcaacggcgucugcuacccccgcuccgaccgcugcaacuaccagaaccacugccccaacggcuccgacgagaagaacugcuucuucugccagcccggcaacuuccacugcaagaacaaccgcugcgucuucgaguccugggucugcgacucccaggacgacugcggcgacggcuccgacgaggagaacugccccgucaucguccccacccgcgucaucaccgccgccgucaucggcucccucaucugcggccuccuccucgucaucgcccucggcugcaccugcaagcucuacucccuccgcauguucgagcgccgcuccuucgagacccagcucucccgcgucgaggccgagcuccuccgccgcgaggccccccccuccuacggccagcucaucgcccagggccucaucccccccgucgaggacuuccccgucugcucccccaaccaggccuccguccucgagaaccuccgccucgccguccgcucccagcucggcuucaccuccguccgccuccccauggccggccgcuccuccaacaucuggaaccgcaucuucaacuucgcccgcucccgccacuccggcucccucgcccucgucuccgccgacggcgacgaggucguccccucccaguccaccucccgcgagcccgagcgcaaccacacccaccgcucccucuucuccgucgaguccgacgacaccgacaccgagaacgagcgccgcgacauggccggcgccuccggcggcgucgccgccccccucccccagaaggucccccccaccaccgccgucgaggccaccgucggcgccugcgccuccuccuccacccaguccacccgcggcggccacgccgacaacggccgcgacgucaccuccgucgagccccccuccgucucccccgcccgccaccagcucaccuccgcccucucccgcaugacccagggccuccgcuggguccgcuucacccucggccgcuccuccucccucucccagaaccaguccccccuccgccagcucgacaacggcgucuccggccgcgaggacgacgacgacgucgagaugcucauccccaucuccgacggcuccuccgacuucgacgucaacgacugcucccgcccccuccucgaccucgccuccgaccagggccagggccuccgccagcccuacaacgccaccaaccccggcguccgccccuccaaccgcgacggccccugcgagcgcugcggcaucguccacaccgcccagauccccgacaccugccucgaggucacccucaagaacgagaccuccgacgacgaggcccuccuccucugcuga

SEQ ID NO: 45500 - RNA, 13800 nt, Artificial Sequence
  derived and/or modified sequence opt2 from LRP1B__Homo_sapiens__NP_061027
auguccgaguuccuccucgcccuccucacccucuccggccuccuccccaucgcccgcguccucaccgucggcgccgaccgcgaccagcagcucugcgaccccggcgaguuccucugccacgaccacgucaccugcgucucccaguccuggcucugcgacggcgaccccgacugccccgacgacuccgacgagucccucgacaccugccccgaggaggucgagaucaagugcccccucaaccacaucgccugccucggcaccaacaagugcguccaccucucccagcucugcaacggcguccucgacugccccgacggcuacgacgagggcguccacugccaggagcuccucuccaacugccagcagcucaacugccaguacaagugcaccaugguccgcaacuccacccgcugcuacugcgaggacggcuucgagaucaccgaggacggccgcuccugcaaggaccaggacgagugcgccgucuacggcaccugcucccagaccugccgcaacacccacggcuccuacaccugcuccugcgucgagggcuaccucaugcagcccgacaaccgcuccugcaaggccaagaucgagcccaccgaccgcccccccauccuccucaucgccaacuucgagaccaucgaggucuucuaccucaacggcuccaagauggccacccucuccuccgucaacggcaacgagauccacacccucgacuucaucuacaacgaggacaugaucugcuggaucgagucccgcgaguccuccaaccagcucaagugcauccagaucaccaaggccggcggccucaccgacgaguggaccaucaacauccuccaguccuuccacaacguccagcagauggccaucgacuggcucacccgcaaccucuacuucgucgaccacgucggcgaccgcaucuucgucugcaacuccaacggcuccgucugcgucacccucaucgaccucgagcuccacaaccccaaggccaucgccgucgaccccaucgccggcaagcucuucuucaccgacuacggcaacgucgccaaggucgagcgcugcgacauggacggcaugaaccgcacccgcaucaucgacuccaagaccgagcagcccgccgcccucgcccucgaccucgucaacaagcucgucuacugggucgaccucuaccucgacuacgucggcgucgucgacuaccagggcaagaaccgccacaccgucauccagggccgccagguccgccaccucuacggcaucaccgucuucgaggacuaccucuacgccaccaacuccgacaacuacaacaucguccgcaucaaccgcuucaacggcaccgacauccacucccucaucaagaucgagaacgccuggggcauccgcaucuaccagaagcgcacccagcccaccguccgcucccacgccugcgaggucgaccccuacggcaugcccggcggcugcucccacaucugccuccucuccuccuccuacaagacccgcaccugccgcugccgcaccggcuucaaccucggcuccgacggccgcuccugcaagcgccccaagaacgagcucuuccucuucuacggcaagggccgccccggcaucguccgcggcauggaccucaacaccaagaucgccgacgaguacaugauccccaucgagaaccucgucaacccccgcgcccucgacuuccacgccgagaccaacuacaucuacuucgccgacaccaccuccuuccucaucggccgccagaagaucgacggcaccgagcgcgagaccauccucaaggacgaccucgacaacgucgagggcaucgccgucgacuggaucggcaacaaccucuacuggaccaacgacggccaccgcaagaccaucaacgucgcccgccucgagaaggccucccagucccgcaagacccuccucgagggcgagaugucccacccccgcggcaucgucgucgaccccgucaacggcuggauguacuggaccgacugggaggaggacgagaucgacgacuccgucggccgcaucgagaaggccuggauggacggcuucaaccgccagaucuucgucaccuccaagaugcucuggcccaacggccucacccucgacuuccacaccaacacccucuacuggugcgacgccuacuacgaccacaucgagaaggucuuccucaacggcacccaccgcaagaucgucuacuccggccgcgagcucaaccaccccuucggccucucccaccacggcaacuacgucuucuggaccgacuacaugaacggcuccaucuuccagcucgaccucaucaccuccgaggucacccuccuccgccacgagcgccccccccucuucggccuccagaucuacgacccccgcaagcagcagggcgacaacaugugccgcgucaacaacggcggcugcuccacccucugccucgccauccccggcggccgcgucugcgccugcgccgacaaccagcuccucgacgagaacggcaccaccugcaccuucaaccccggcgaggcccucccccacaucugcaaggccggcgaguuccgcugcaagaaccgccacugcauccaggcccgcuggaagugcgacggcgacgacgacugccucgacggcuccgacgaggacuccgucaacugcuucaaccacuccugccccgacgaccaguucaagugccagaacaaccgcugcauccccaagcgcuggcucugcgacggcgccaacgacugcggcuccaacgaggacgaguccaaccagaccugcaccgcccgcaccugccaggucgaccaguucuccugcggcaacggccgcugcaucccccgcgccuggcucugcgaccgcgaggacgacugcggcgaccagaccgacgagauggccuccugcgaguuccccaccugcgagccccucacccaguucgucugcaaguccggccgcugcaucuccuccaaguggcacugcgacuccgacgacgacugcggcgacggcuccgacgaggucggcugcguccacuccugcuucgacaaccaguuccgcugcuccuccggccgcugcauccccggccacugggccugcgacggcgacaacgacugcggcgacuucuccgacgaggcccagaucaacugcaccaaggaggagauccacucccccgccggcugcaacggcaacgaguuccagugccaccccgacggcaacugcguccccgaccucuggcgcugcgacggcgagaaggacugcgaggacggcuccgacgagaagggcugcaacggcaccauccgccucugcgaccacaagaccaaguucuccugcugguccaccggccgcugcaucaacaaggccugggucugcgacggcgacaucgacugcgaggaccaguccgacgaggacgacugcgacuccuuccucugcggcccccccaagcaccccugcgccaacgacaccuccgucugccuccagcccgagaagcucugcaacggcaagaaggacugccccgacggcuccgacgagggcuaccucugcgacgagugcucccucaacaacggcggcugcuccaaccacugcuccgucguccccggccgcggcaucgucugcuccugccccgagggccuccagcucaacaaggacaacaagaccugcgagaucgucgacuacugcuccaaccaccucaagugcucccaggucugcgagcagcacaagcacaccgucaagugcuccugcuacgagggcuggaagcucgacgucgacggcgaguccugcaccuccgucgaccccuucgaggccuucaucaucuucuccauccgccacgagauccgccgcaucgaccuccacaagcgcgacuacucccuccucguccccggccuccgcaacaccaucgcccucgacuuccacuucaaccagucccuccucuacuggaccgacgucgucgaggaccgcaucuaccgcggcaagcucuccgaguccggcggcgucuccgccaucgaggucgucgucgagcacggccucgccacccccgagggccucaccgucgacuggaucgccggcaacaucuacuggaucgacuccaaccucgaccagaucgaggucgccaagcucgacggcucccuccgcaccacccucaucgccggcgccauggagcacccccgcgccaucgcccucgacccccgcuacggcauccucuucuggaccgacugggacgccaacuucccccgcaucgaguccgccuccauguccggcgccggccgcaagaccaucuacaaggacaugaagaccggcgccuggcccaacggccucaccgucgaccacuucgagaagcgcaucgucuggaccgacgcccgcuccgacgccaucuacuccgcccucuacgacggcaccaacaugaucgagaucauccgcggccacgaguaccucucccaccccuucgccgucucccucuacggcuccgaggucuacuggaccgacuggcgcaccaacacccucuccaaggccaacaaguggaccggccagaacgucuccgucauccagaagaccuccgcccagcccuucgaccuccagaucuaccaccccucccgccagccccaggcccccaaccccugcgccgccaacgacggcaagggccccugcucccacaugugccucaucaaccacaaccgcuccgccgccugcgccugcccccaccucaugaagcucuccuccgacaagaagaccugcuacgagaugaagaaguuccuccucuacgcccgccgcuccgagauccgcggcgucgacaucgacaaccccuacuucaacuucaucaccgccuucaccguccccgacaucgacgacgucaccgucaucgacuucgacgccuccgaggagcgccucuacuggaccgacaucaagacccagaccaucaagcgcgccuucaucaacggcaccggccucgagaccgucaucucccgcgacauccaguccauccgcggccucgccgucgacugggucucccgcaaccucuacuggaucuccuccgaguucgacgagacccagaucaacgucgcccgccucgacggcucccucaagaccuccaucauccacggcaucgacaagccccagugccucgccgcccaccccguccgcggcaagcucuacuggaccgacggcaacaccaucaacauggccaacauggacggcuccaacuccaagauccucuuccagaaccagaaggagcccgucggccucuccaucgacuacgucgagaacaagcucuacuggaucuccuccggcaacggcaccaucaaccgcugcaaccucgacggcggcaaccucgaggucaucgaguccaugaaggaggagcucaccaaggccaccgcccucaccaucauggacaagaagcucuggugggccgaccagaaccucgcccagcucggcaccugcuccaagcgcgacggccgcaaccccaccauccuccgcaacaagaccuccggcgucguccacaugaaggucuacgacaaggaggcccagcagggcuccaacuccugccagcucaacaacggcggcugcucccagcucugccuccccaccuccgagaccacccgcaccugcaugugcaccgucggcuacuaccuccagaagaaccgcauguccugccagggcaucgaguccuuccucauguacuccguccacgagggcauccgcggcaucccccucgagcccuccgacaagauggacgcccucaugcccaucuccggcaccuccuucgccgucggcaucgacuuccacgccgagaacgacaccaucuacuggaccgacaugggcuucaacaagaucucccgcgccaagcgcgaccagaccuggaaggaggacaucaucaccaacggccucggccgcgucgagggcaucgccgucgacuggaucgccggcaacaucuacuggaccgaccacggcuucaaccucaucgaggucgcccgccucaacggcuccuuccgcuacgucaucaucucccagggccucgaccagccccgcuccaucgccguccaccccgagaagggccuccucuucuggaccgaguggggccagaugcccugcaucggcaaggcccgccucgacggcuccgagaaggucguccucgucuccaugggcaucgccuggcccaacggcaucuccaucgacuacgaggagaacaagcucuacuggugcgacgcccgcaccgacaagaucgagcgcaucgaccucgagaccggcggcaaccgcgagaugguccucuccggcuccaacgucgacauguucuccgucgccgucuucggcgccuacaucuacugguccgaccgcgcccacgccaacggcuccguccgccgcggccacaagaacgacgccaccgagaccaucaccaugcgcaccggccucggcgucaaccucaaggaggucaagaucuucaaccgcguccgcgagaagggcaccaacgucugcgcccgcgacaacggcggcugcaagcagcucugccucuaccgcggcaacucccgccgcaccugcgccugcgcccacggcuaccucgccgaggacggcgucaccugccuccgccacgagggcuaccuccucuacuccggccgcaccauccucaaguccauccaccucuccgacgagaccaaccucaacucccccauccgccccuacgagaacccccgcuacuucaagaacgucaucgcccucgccuucgacuacaaccagcgccgcaagggcaccaaccgcaucuucuacuccgacgcccacuucggcaacauccagcucaucaaggacaacugggaggaccgccaggucaucgucgagaacgucggcuccgucgagggccucgccuaccaccgcgccugggacacccucuacuggaccuccuccaccaccuccuccaucacccgccacaccgucgaccagacccgccccggcgccuucgaccgcgaggccgucaucaccauguccgaggacgaccacccccacguccucgcccucgacgagugccagaaccucauguucuggaccaacuggaacgagcagcaccccuccaucaugcgcuccacccucaccggcaagaacgcccaggucgucgucuccaccgacauccucacccccaacggccucaccaucgacuaccgcgccgagaagcucuacuucuccgacggcucccucggcaagaucgagcgcugcgaguacgacggcucccagcgccacgucaucgucaaguccggccccggcaccuuccucucccucgccgucuacgacaacuacaucuucugguccgacuggggccgccgcgccauccuccgcuccaacaaguacaccggcggcgacaccaagauccuccgcuccgacaucccccaccagcccaugggcaucaucgccgucgccaacgacaccaacuccugcgagcucucccccugcgcccuccucaacggcggcugccacgaccucugccuccucacccccaacggccgcgucaacugcuccugccgcggcgaccgcauccuccucgaggacaaccgcugcgucaccaagaacuccuccugcaacgccuacuccgaguucgagugcggcaacggcgagugcaucgacuaccagcucaccugcgacggcaucccccacugcaaggacaaguccgacgagaagcuccucuacugcgagaaccgcuccugccgccgcggcuucaagcccugcuacaaccgccgcugcaucccccacggcaagcucugcgacggcgagaacgacugcggcgacaacuccgacgagcucgacugcaaggucuccaccugcgccaccgucgaguuccgcugcgccgacggcaccugcaucccccgcuccgcccgcugcaaccagaacaucgacugcgccgacgccuccgacgagaagaacugcaacaacaccgacugcacccacuucuacaagcucggcgucaagaccaccggcuucauccgcugcaacuccaccucccucugcguccuccccaccuggaucugcgacggcuccaacgacugcggcgacuacuccgacgagcucaagugccccguccagaacaagcacaagugcgaggagaacuacuucuccugccccuccggccgcugcauccucaacaccuggaucugcgacggccagaaggacugcgaggacggccgcgacgaguuccacugcgacuccuccugcuccuggaaccaguucgccugcuccgcccagaagugcaucuccaagcacuggaucugcgacggcgaggacgacugcggcgacggccucgacgaguccgacuccaucugcggcgccaucaccugcgccgccgacauguucuccugccagggcucccgcgccugcgucccccgccacuggcucugcgacggcgagcgcgacugccccgacggcuccgacgagcucuccaccgccggcugcgcccccaacaacaccugcgacgagaacgccuucaugugccacaacaaggucugcauccccaagcaguucgucugcgaccacgacgacgacugcggcgacggcuccgacgaguccccccagugcggcuaccgccagugcggcaccgaggaguucuccugcgccgacggccgcugccuccucaacacccaguggcagugcgacggcgacuucgacugccccgaccacuccgacgaggccccccucaaccccaagugcaaguccgccgagcaguccugcaacuccuccuucuucaugugcaagaacggccgcugcauccccuccggcggccucugcgacaacaaggacgacugcggcgacggcuccgacgagcgcaacugccacaucaacgagugccucuccaagaaggucuccggcugcucccaggacugccaggaccuccccgucuccuacaagugcaagugcuggcccggcuuccagcucaaggacgacggcaagaccugcgucgacaucgacgagugcuccuccggcuuccccugcucccagcagugcaucaacaccuacggcaccuacaagugccucugcaccgacggcuacgagauccagcccgacaaccccaacggcugcaagucccucuccgacgaggagcccuuccucauccucgccgaccaccacgagauccgcaagaucuccaccgacggcuccaacuacacccuccucaagcagggccucaacaacgucaucgccaucgacuucgacuaccgcgaggaguucaucuacuggaucgacuccucccgccccaacggcucccgcaucaaccgcaugugccucaacggcuccgacaucaaggucguccacaacaccgccguccccaacgcccucgccgucgacuggaucggcaagaaccucuacugguccgacaccgagaagcgcaucaucgaggucuccaagcucaacggccucuaccccaccauccucgucuccaagcgccucaaguucccccgcgaccucucccucgacccccaggccggcuaccucuacuggaucgacugcugcgaguacccccacaucggccgcgucggcauggacggcaccaaccaguccgucgucaucgagaccaagaucucccgccccauggcccucaccaucgacuacgucaaccgccgccucuacugggccgacgagaaccacaucgaguucuccaacauggacggcucccaccgccacaagguccccaaccaggacauccccggcgucaucgcccucacccucuucgaggacuacaucuacuggaccgacggcaagaccaagucccucucccgcgcccacaagaccuccggcgccgaccgccucucccucaucuacuccuggcacgccaucaccgacauccaggucuaccacuccuaccgccagcccgacgucuccaagcaccucugcaugaucaacaacggcggcugcucccaccucugccuccucgcccccggcaagacccacaccugcgccugccccaccaacuucuaccucgccgccgacaaccgcaccugccucuccaacugcaccgccucccaguuccgcugcaagaccgacaagugcauccccuucugguggaagugcgacaccgucgacgacugcggcgacggcuccgacgagcccgacgacugccccgaguuccgcugccagcccggccgcuuccagugcggcaccggccucugcgcccuccccgccuucaucugcgacggcgagaacgacugcggcgacaacuccgacgagcucaacugcgacacccacgucugccucuccggccaguucaagugcaccaagaaccagaagugcauccccgucaaccuccgcugcaacggccaggacgacugcggcgacgaggaggacgagcgcgacugccccgagaacuccugcucccccgacuacuuccagugcaagaccaccaagcacugcaucuccaagcucugggucugcgacgaggaccccgacugcgccgacgccuccgacgaggccaacugcgacaagaagaccugcggcccccacgaguuccagugcaagaacaacaacugcauccccgaccacuggcgcugcgacucccagaacgacugcuccgacaacuccgacgaggagaacugcaagccccagaccugcacccucaaggacuuccucugcgccaacggcgacugcgucuccucccgcuucuggugcgacggcgacuucgacugcgccgacggcuccgacgagcgcaacugcgagaccuccugcuccaaggaccaguuccgcugcuccaacggccagugcauccccgccaaguggaagugcgacggccacgaggacugcaaguacggcgaggacgagaaguccugcgagcccgccucccccaccugcuccucccgcgaguacaucugcgccuccgacggcugcaucuccgccucccucaagugcaacggcgaguacgacugcgccgacggcuccgacgagauggacugcgucaccgagugcaaggaggaccaguuccgcugcaagaacaaggcccacugcauccccauccgcuggcucugcgacggcauccacgacugcgucgacggcuccgacgaggagaacugcgagcgcggcggcaacaucugccgcgccgacgaguuccucugcaacaacucccucugcaagcuccacuucugggucugcgacggcgaggacgacugcggcgacaacuccgacgaggcccccgacaugugcgucaaguuccucugccccuccacccgcccccaccgcugccgcaacaaccgcaucugccuccaguccgagcagaugugcaacggcaucgacgagugcggcgacaacuccgacgaggaccacugcggcggcaagcucaccuacaaggcccgccccugcaagaaggacgaguucgccugcuccaacaagaagugcauccccauggaccuccagugcgaccgccucgacgacugcggcgacggcuccgacgagcagggcugccgcaucgcccccaccgaguacaccugcgaggacaacgucaaccccugcggcgacgacgccuacugcaaccagaucaagaccuccgucuucugccgcugcaagcccggcuuccagcgcaacaugaagaaccgccagugcgaggaccucaacgagugccucgucuucggcaccugcucccaccagugcaucaacgucgagggcuccuacaagugcgucugcgaccagaacuuccaggagcgcaacaacaccugcaucgccgagggcuccgaggaccagguccucuacaucgccaacgacaccgacauccucggcuucaucuaccccuucaacuacuccggcgaccaccagcagaucucccacaucgagcacaacucccgcaucaccggcauggacgucuacuaccagcgcgacaugaucaucugguccacccaguucaaccccggcggcaucuucuacaagcgcauccacggccgcgagaagcgccaggccaacuccggccucaucugccccgaguucaagcgcccccgcgacaucgccgucgacugggucgccggcaacaucuacuggaccgaccacucccgcaugcacugguucuccuacuacaccacccacuggaccucccuccgcuacuccaucaacgucggccagcucaacggccccaacugcacccgccuccucaccaacauggccggcgagcccuacgccaucgccgucaaccccaagcgcggcaugauguacuggaccgucgucggcgaccacucccacaucgaggaggccgccauggacggcacccuccgccgcauccucguccagaagaaccuccagcgccccaccggccucgccgucgacuacuucuccgagcgcaucuacugggccgacuucgagcucuccaucaucggcuccguccucuacgacggcuccaacuccgucgucuccgucuccuccaagcagggccuccuccacccccaccgcaucgacaucuucgaggacuacaucuacggcgccggccccaagaacggcgucuuccgcguccagaaguucggccacggcuccgucgaguaccucgcccucaacaucgacaagaccaagggcguccucaucucccaccgcuacaagcagcucgaccuccccaaccccugccucgaccucgccugcgaguuccucugccuccucaaccccuccggcgccaccugcgucugccccgagggcaaguaccucaucaacggcaccugcaacgacgacucccuccucgacgacuccugcaagcucaccugcgagaacggcggccgcugcauccucaacgagaagggcgaccuccgcugccacugcuggcccuccuacuccggcgagcgcugcgaggucaaccacugcuccaacuacugccagaacggcggcaccugcguccccuccguccucggccgccccaccugcuccugcgcccucggcuucaccggccccaacugcggcaagaccgucugcgaggacuucugccagaacggcggcaccugcaucgucaccgccggcaaccagcccuacugccacugccagcccgaguacaccggcgaccgcugccaguacuacgucugccaccacuacugcgucaacuccgaguccugcaccaucggcgacgacggcuccgucgagugcgucugccccacccgcuacgagggccccaagugcgaggucgacaagugcguccgcugccacggcggccacugcaucaucaacaaggacuccgaggacaucuucugcaacugcaccaacggcaagaucgccuccuccugccagcucugcgacggcuacugcuacaacggcggcaccugccagcucgaccccgagaccaacguccccgucugccucugcuccaccaacugguccggcacccagugcgagcgccccgcccccaaguccuccaaguccgaccacaucuccacccgcuccaucgccaucaucgucccccucguccuccucgucacccucaucaccacccucgucaucggccucguccucugcaagcgcaagcgccgcaccaagaccauccgccgccagcccaucaucaacggcggcaucaacgucgagaucggcaaccccuccuacaacauguacgaggucgaccacgaccacaacgacggcggccuccucgaccccggcuucaugaucgaccccaccaaggcccgcuacaucggcggcggccccuccgccuucaagcucccccacaccgccccccccaucuaccucaacuccgaccucaagggcccccucaccgccggccccaccaacuacuccaaccccgucuacgccaagcucuacauggacggccagaacugccgcaacucccucggcuccgucgacgagcgcaaggagcuccuccccaagaagaucgagaucggcauccgcgagaccgucgccuga

SEQ ID NO: 45501 - RNA, 13635 nt, Artificial Sequence
  derived and/or modified sequence opt2 from LRP1__Homo_sapiens__NP_002323
augcucacccccccccuccuccuccuccucccccuccucuccgcccucgucgccgccgccaucgacgcccccaagaccugcucccccaagcaguucgccugccgcgaccagaucaccugcaucuccaagggcuggcgcugcgacggcgagcgcgacugccccgacggcuccgacgaggcccccgagaucugcccccaguccaaggcccagcgcugccagcccaacgagcacaacugccucggcaccgagcucugcguccccaugucccgccucugcaacggcguccaggacugcauggacggcuccgacgagggcccccacugccgcgagcuccagggcaacugcucccgccucggcugccagcaccacugcguccccacccucgacggccccaccugcuacugcaacuccuccuuccagcuccaggccgacggcaagaccugcaaggacuucgacgagugcuccgucuacggcaccugcucccagcucugcaccaacaccgacggcuccuucaucugcggcugcgucgagggcuaccuccuccagcccgacaaccgcuccugcaaggccaagaacgagcccgucgaccgcccccccguccuccucaucgccaacucccagaacauccucgccaccuaccucuccggcgcccaggucuccaccaucacccccaccuccacccgccagaccaccgccauggacuucuccuacgccaacgagaccgucugcuggguccacgucggcgacuccgccgcccagacccagcucaagugcgcccgcaugcccggccucaagggcuucgucgacgagcacaccaucaacaucucccucucccuccaccacgucgagcagauggccaucgacuggcucaccggcaacuucuacuucgucgacgacaucgacgaccgcaucuucgucugcaaccgcaacggcgacaccugcgucacccuccucgaccucgagcucuacaaccccaagggcaucgcccucgaccccgccaugggcaaggucuucuucaccgacuacggccagauccccaaggucgagcgcugcgacauggacggccagaaccgcaccaagcucgucgacuccaagaucgucuucccccacggcaucacccucgaccucgucucccgccucgucuacugggccgacgccuaccucgacuacaucgaggucgucgacuacgagggcaagggccgccagaccaucauccagggcauccucaucgagcaccucuacggccucaccgucuucgagaacuaccucuacgccaccaacuccgacaacgccaacgcccagcagaagaccuccgucauccgcgucaaccgcuucaacuccaccgaguaccaggucgucacccgcgucgacaagggcggcgcccuccacaucuaccaccagcgccgccagccccgcguccgcucccacgccugcgagaacgaccaguacggcaagcccggcggcugcuccgacaucugccuccucgccaacucccacaaggcccgcaccugccgcugccgcuccggcuucucccucggcuccgacggcaaguccugcaagaagcccgagcacgagcucuuccucgucuacggcaagggccgccccggcaucauccgcggcauggacaugggcgccaagguccccgacgagcacaugauccccaucgagaaccucaugaacccccgcgcccucgacuuccacgccgagaccggcuucaucuacuucgccgacaccaccuccuaccucaucggccgccagaagaucgacggcaccgagcgcgagaccauccucaaggacggcauccacaacgucgagggcgucgccgucgacuggaugggcgacaaccucuacuggaccgacgacggccccaagaagaccaucuccgucgcccgccucgagaaggccgcccagacccgcaagacccucaucgagggcaagaugacccacccccgcgccaucgucgucgacccccucaacggcuggauguacuggaccgacugggaggaggaccccaaggacucccgccgcggccgccucgagcgcgccuggauggacggcucccaccgcgacaucuucgucaccuccaagaccguccucuggcccaacggccucucccucgacauccccgccggccgccucuacugggucgacgccuucuacgaccgcaucgagaccauccuccucaacggcaccgaccgcaagaucgucuacgagggccccgagcucaaccacgccuucggccucugccaccacggcaacuaccucuucuggaccgaguaccgcuccggcuccgucuaccgccucgagcgcggcgucggcggcgccccccccaccgucacccuccuccgcuccgagcgcccccccaucuucgagauccgcauguacgacgcccagcagcagcaggucggcaccaacaagugccgcgucaacaacggcggcugcuccucccucugccucgccacccccggcucccgccagugcgccugcgccgaggaccagguccucgacgccgacggcgucaccugccucgccaaccccuccuacgucccccccccccagugccagcccggcgaguucgccugcgccaacucccgcugcauccaggagcgcuggaagugcgacggcgacaacgacugccucgacaacuccgacgaggcccccgcccucugccaccagcacaccugccccuccgaccgcuucaagugcgagaacaaccgcugcauccccaaccgcuggcucugcgacggcgacaacgacugcggcaacuccgaggacgaguccaacgccaccugcuccgcccgcaccugcccccccaaccaguucuccugcgccuccggccgcugcauccccaucuccuggaccugcgaccucgacgacgacugcggcgaccgcuccgacgaguccgccuccugcgccuaccccaccugcuucccccucacccaguucaccugcaacaacggccgcugcaucaacaucaacuggcgcugcgacaacgacaacgacugcggcgacaacuccgacgaggccggcugcucccacuccugcuccuccacccaguucaagugcaacuccggccgcugcauccccgagcacuggaccugcgacggcgacaacgacugcggcgacuacuccgacgagacccacgccaacugcaccaaccaggccacccgcccccccggcggcugccacaccgacgaguuccagugccgccucgacggccucugcaucccccuccgcuggcgcugcgacggcgacaccgacugcauggacuccuccgacgagaaguccugcgagggcgucacccacgucugcgaccccuccgucaaguucggcugcaaggacuccgcccgcugcaucuccaaggccugggucugcgacggcgacaacgacugcgaggacaacuccgacgaggagaacugcgagucccucgccugccgcccccccucccaccccugcgccaacaacaccuccgucugccucccccccgacaagcucugcgacggcaacgacgacugcggcgacggcuccgacgagggcgagcucugcgaccagugcucccucaacaacggcggcugcucccacaacugcuccgucgcccccggcgagggcaucgucugcuccugcccccucggcauggagcucggccccgacaaccacaccugccagauccaguccuacugcgccaagcaccucaagugcucccagaagugcgaccagaacaaguucuccgucaagugcuccugcuacgagggcuggguccucgagcccgacggcgaguccugccgcucccucgaccccuucaagcccuucaucaucuucuccaaccgccacgagauccgccgcaucgaccuccacaagggcgacuacuccguccucguccccggccuccgcaacaccaucgcccucgacuuccaccucucccaguccgcccucuacuggaccgacgucgucgaggacaagaucuaccgcggcaagcuccucgacaacggcgcccucaccuccuucgaggucgucauccaguacggccucgccacccccgagggccucgccgucgacuggaucgccggcaacaucuacugggucgaguccaaccucgaccagaucgaggucgccaagcucgacggcacccuccgcaccacccuccucgccggcgacaucgagcacccccgcgccaucgcccucgacccccgcgacggcauccucuucuggaccgacugggacgccucccucccccgcaucgaggccgccuccauguccggcgccggccgccgcaccguccaccgcgagaccggcuccggcggcuggcccaacggccucaccgucgacuaccucgagaagcgcauccucuggaucgacgcccgcuccgacgccaucuacuccgcccgcuacgacggcuccggccacauggagguccuccgcggccacgaguuccucucccaccccuucgccgucacccucuacggcggcgaggucuacuggaccgacuggcgcaccaacacccucgccaaggccaacaaguggaccggccacaacgucaccgucguccagcgcaccaacacccagcccuucgaccuccaggucuaccaccccucccgccagcccauggcccccaaccccugcgaggccaacggcggccagggccccugcucccaccucugccucaucaacuacaaccgcaccgucuccugcgccugcccccaccucaugaagcuccacaaggacaacaccaccugcuacgaguucaagaaguuccuccucuacgcccgccagauggagauccgcggcgucgaccucgacgcccccuacuacaacuacaucaucuccuucaccguccccgacaucgacaacgucaccguccucgacuacgacgcccgcgagcagcgcgucuacugguccgacguccgcacccaggccaucaagcgcgccuucaucaacggcaccggcgucgagaccgucgucuccgccgaccuccccaacgcccacggccucgccgucgacugggucucccgcaaccucuucuggaccuccuacgacaccaacaagaagcagaucaacgucgcccgccucgacggcuccuucaagaacgccgucguccagggccucgagcagccccacggccucgucguccacccccuccgcggcaagcucuacuggaccgacggcgacaacaucuccauggccaacauggacggcuccaaccgcacccuccucuucuccggccagaagggccccgucggccucgccaucgacuuccccgaguccaagcucuacuggaucuccuccggcaaccacaccaucaaccgcugcaaccucgacggcuccggccucgaggucaucgacgccaugcgcucccagcucggcaaggccaccgcccucgccaucaugggcgacaagcucuggugggccgaccaggucuccgagaagaugggcaccugcuccaaggccgacggcuccggcuccgucguccuccgcaacuccaccacccucgucaugcacaugaaggucuacgacgaguccauccagcucgaccacaagggcaccaaccccugcuccgucaacaacggcgacugcucccagcucugccuccccaccuccgagaccacccgcuccugcaugugcaccgccggcuacucccuccgcuccggccagcaggccugcgagggcgucggcuccuuccuccucuacuccguccacgagggcauccgcggcaucccccucgaccccaacgacaaguccgacgcccucguccccgucuccggcaccucccucgccgucggcaucgacuuccacgccgagaacgacaccaucuacugggucgacaugggccucuccaccaucucccgcgccaagcgcgaccagaccuggcgcgaggacgucgucaccaacggcaucggccgcgucgagggcaucgccgucgacuggaucgccggcaacaucuacuggaccgaccagggcuucgacgucaucgaggucgcccgccucaacggcuccuuccgcuacgucgucaucucccagggccucgacaagccccgcgccaucaccguccaccccgagaagggcuaccucuucuggaccgaguggggccaguacccccgcaucgagcgcucccgccucgacggcaccgagcgcgucguccucgucaacgucuccaucuccuggcccaacggcaucuccgucgacuaccaggacggcaagcucuacuggugcgacgcccgcaccgacaagaucgagcgcaucgaccucgagaccggcgagaaccgcgaggucguccucuccuccaacaacauggacauguucuccgucuccgucuucgaggacuucaucuacugguccgaccgcacccacgccaacggcuccaucaagcgcggcuccaaggacaacgccaccgacuccgucccccuccgcaccggcaucggcguccagcucaaggacaucaaggucuucaaccgcgaccgccagaagggcaccaacgucugcgccgucgccaacggcggcugccagcagcucugccucuaccgcggccgcggccagcgcgccugcgccugcgcccacggcaugcucgccgaggacggcgccuccugccgcgaguacgccggcuaccuccucuacuccgagcgcaccauccucaaguccauccaccucuccgacgagcgcaaccucaacgcccccguccagcccuucgaggaccccgagcacaugaagaacgucaucgcccucgccuucgacuaccgcgccggcaccucccccggcacccccaaccgcaucuucuucuccgacauccacuucggcaacauccagcagaucaacgacgacggcucccgccgcaucaccaucgucgagaacgucggcuccgucgagggccucgccuaccaccgcggcugggacacccucuacuggaccuccuacaccaccuccaccaucacccgccacaccgucgaccagacccgccccggcgccuucgagcgcgagaccgucaucaccauguccggcgacgaccacccccgcgccuucguccucgacgagugccagaaccucauguucuggaccaacuggaacgagcagcaccccuccaucaugcgcgccgcccucuccggcgccaacguccucacccucaucgagaaggacauccgcacccccaacggccucgccaucgaccaccgcgccgagaagcucuacuucuccgacgccacccucgacaagaucgagcgcugcgaguacgacggcucccaccgcuacgucauccucaaguccgagcccguccaccccuucggccucgccgucuacggcgagcacaucuucuggaccgacuggguccgccgcgccguccagcgcgccaacaagcacgucggcuccaacaugaagcuccuccgcgucgacaucccccagcagcccaugggcaucaucgccgucgccaacgacaccaacuccugcgagcucucccccugccgcaucaacaacggcggcugccaggaccucugccuccucacccaccagggccacgucaacugcuccugccgcggcggccgcauccuccaggacgaccucaccugccgcgccgucaacuccuccugccgcgcccaggacgaguucgagugcgccaacggcgagugcaucaacuucucccucaccugcgacggcgucccccacugcaaggacaaguccgacgagaagcccuccuacugcaacucccgccgcugcaagaagaccuuccgccagugcuccaacggccgcugcgucuccaacaugcucuggugcaacggcgccgacgacugcggcgacggcuccgacgagauccccugcaacaagaccgccugcggcgucggcgaguuccgcugccgcgacggcaccugcaucggcaacuccucccgcugcaaccaguucgucgacugcgaggacgccuccgacgagaugaacugcuccgccaccgacugcuccuccuacuuccgccucggcgucaagggcguccucuuccagcccugcgagcgcaccucccucugcuacgcccccuccugggucugcgacggcgccaacgacugcggcgacuacuccgacgagcgcgacugccccggcgucaagcgcccccgcugcccccucaacuacuucgccugccccuccggccgcugcauccccauguccuggaccugcgacaaggaggacgacugcgagcacggcgaggacgagacccacugcaacaaguucugcuccgaggcccaguucgagugccagaaccaccgcugcaucuccaagcaguggcucugcgacggcuccgacgacugcggcgacggcuccgacgaggccgcccacugcgagggcaagaccugcggccccuccuccuucuccugccccggcacccacgucugcguccccgagcgcuggcucugcgacggcgacaaggacugcgccgacggcgccgacgaguccaucgccgccggcugccucuacaacuccaccugcgacgaccgcgaguucaugugccagaaccgccagugcauccccaagcacuucgucugcgaccacgaccgcgacugcgccgacggcuccgacgagucccccgagugcgaguaccccaccugcggccccuccgaguuccgcugcgccaacggccgcugccucuccucccgccagugggagugcgacggcgagaacgacugccacgaccaguccgacgaggcccccaagaacccccacugcaccucccaggagcacaagugcaacgccuccucccaguuccucugcuccuccggccgcugcgucgccgaggcccuccucugcaacggccaggacgacugcggcgacuccuccgacgagcgcggcugccacaucaacgagugccucucccgcaagcucuccggcugcucccaggacugcgaggaccucaagaucggcuucaagugccgcugccgccccggcuuccgccucaaggacgacggccgcaccugcgccgacgucgacgagugcuccaccaccuuccccugcucccagcgcugcaucaacacccacggcuccuacaagugccucugcgucgagggcuacgccccccgcggcggcgacccccacuccugcaaggccgucaccgacgaggagcccuuccucaucuucgccaaccgcuacuaccuccgcaagcucaaccucgacggcuccaacuacacccuccucaagcagggccucaacaacgccgucgcccucgacuucgacuaccgcgagcagaugaucuacuggaccgacgucaccacccagggcuccaugauccgccgcaugcaccucaacggcuccaacguccagguccuccaccgcaccggccucuccaaccccgacggccucgccgucgacugggucggcggcaaccucuacuggugcgacaagggccgcgacaccaucgaggucuccaagcucaacggcgccuaccgcaccguccucgucuccuccggccuccgcgagccccgcgcccucgucgucgacguccagaacggcuaccucuacuggaccgacuggggcgaccacucccucaucggccgcaucggcauggacggcuccucccgcuccgucaucgucgacaccaagaucaccuggcccaacggccucacccucgacuacgucaccgagcgcaucuacugggccgacgcccgcgaggacuacaucgaguucgccucccucgacggcuccaaccgccacgucguccucucccaggacaucccccacaucuucgcccucacccucuucgaggacuacgucuacuggaccgacugggagaccaaguccaucaaccgcgcccacaagaccaccggcaccaacaagacccuccucaucuccacccuccaccgccccauggaccuccacgucuuccacgcccuccgccagcccgacguccccaaccaccccugcaaggucaacaacggcggcugcuccaaccucugccuccucucccccggcggcggccacaagugcgccugccccaccaacuucuaccucggcuccgacggccgcaccugcgucuccaacugcaccgccucccaguucgucugcaagaacgacaagugcauccccuucugguggaagugcgacaccgaggacgacugcggcgaccacuccgacgagccccccgacugccccgaguucaagugccgccccggccaguuccagugcuccaccggcaucugcaccaaccccgccuucaucugcgacggcgacaacgacugccaggacaacuccgacgaggccaacugcgacauccacgucugccuccccucccaguucaagugcaccaacaccaaccgcugcauccccggcaucuuccgcugcaacggccaggacaacugcggcgacggcgaggacgagcgcgacugccccgaggucaccugcgcccccaaccaguuccagugcuccaucaccaagcgcugcaucccccgcgucugggucugcgaccgcgacaacgacugcgucgacggcuccgacgagcccgccaacugcacccagaugaccugcggcgucgacgaguuccgcugcaaggacuccggccgcugcauccccgcccgcuggaagugcgacggcgaggacgacugcggcgacggcuccgacgagcccaaggaggagugcgacgagcgcaccugcgagcccuaccaguuccgcugcaagaacaaccgcugcguccccggccgcuggcagugcgacuacgacaacgacugcggcgacaacuccgacgaggaguccugcaccccccgccccugcuccgaguccgaguucuccugcgccaacggccgcugcaucgccggccgcuggaagugcgacggcgaccacgacugcgccgacggcuccgacgagaaggacugcaccccccgcugcgacauggaccaguuccagugcaaguccggccacugcaucccccuccgcuggcgcugcgacgccgacgccgacugcauggacggcuccgacgaggaggccugcggcaccggcguccgcaccugcccccucgacgaguuccagugcaacaacacccucugcaagccccucgccuggaagugcgacggcgaggacgacugcggcgacaacuccgacgagaaccccgaggagugcgcccgcuucgucugcccccccaaccgccccuuccgcugcaagaacgaccgcgucugccucuggaucggccgccagugcgacggcaccgacaacugcggcgacggcaccgacgaggaggacugcgagccccccaccgcccacaccacccacugcaaggacaagaaggaguuccucugccgcaaccagcgcugccucuccuccucccuccgcugcaacauguucgacgacugcggcgacggcuccgacgaggaggacugcuccaucgaccccaagcucaccuccugcgccaccaacgccuccaucugcggcgacgaggcccgcugcguccgcaccgagaaggccgccuacugcgccugccgcuccggcuuccacaccguccccggccagcccggcugccaggacaucaacgagugccuccgcuucggcaccugcucccagcucugcaacaacaccaagggcggccaccucugcuccugcgcccgcaacuucaugaagacccacaacaccugcaaggccgagggcuccgaguaccagguccucuacaucgccgacgacaacgagauccgcucccucuuccccggccacccccacuccgccuacgagcaggccuuccagggcgacgaguccguccgcaucgacgccauggacguccacgucaaggccggccgcgucuacuggaccaacuggcacaccggcaccaucuccuaccgcucccucccccccgccgccccccccaccaccuccaaccgccaccgccgccagaucgaccgcggcgucacccaccucaacaucuccggccucaagaugccccgcggcaucgccaucgacugggucgccggcaacgucuacuggaccgacuccggccgcgacgucaucgaggucgcccagaugaagggcgagaaccgcaagacccucaucuccggcaugaucgacgagccccacgccaucgucgucgacccccuccgcggcaccauguacugguccgacuggggcaaccaccccaagaucgagaccgccgccauggacggcacccuccgcgagacccucguccaggacaacauccaguggcccaccggccucgccgucgacuaccacaacgagcgccucuacugggccgacgccaagcucuccgucaucggcuccauccgccucaacggcaccgaccccaucgucgccgccgacuccaagcgcggccucucccaccccuucuccaucgacgucuucgaggacuacaucuacggcgucaccuacaucaacaaccgcgucuucaagauccacaaguucggccacuccccccucgucaaccucaccggcggccucucccacgccuccgacgucguccucuaccaccagcacaagcagcccgaggucaccaaccccugcgaccgcaagaagugcgaguggcucugccuccucucccccuccggccccgucugcaccugccccaacggcaagcgccucgacaacggcaccugcguccccguccccucccccacccccccccccgacgccccccgccccggcaccugcaaccuccagugcuucaacggcggcuccugcuuccucaacgcccgccgccagcccaagugccgcugccagccccgcuacaccggcgacaagugcgagcucgaccagugcugggagcacugccgcaacggcggcaccugcgccgccucccccuccggcaugcccaccugccgcugccccaccggcuucaccggccccaagugcacccagcaggucugcgccggcuacugcgccaacaacuccaccugcaccgucaaccagggcaaccagccccagugccgcugccuccccggcuuccucggcgaccgcugccaguaccgccagugcuccggcuacugcgagaacuucggcaccugccagauggccgccgacggcucccgccagugccgcugcaccgccuacuucgagggcucccgcugcgaggucaacaagugcucccgcugccucgagggcgccugcgucgucaacaagcaguccggcgacgucaccugcaacugcaccgacggccgcgucgcccccuccugccucaccugcgucggccacugcuccaacggcggcuccugcaccaugaacuccaagaugaugcccgagugccagugccccccccacaugaccggcccccgcugcgaggagcacgucuucucccagcagcagcccggccacaucgccuccauccucaucccccuccuccuccuccuccuccucguccucgucgccggcgucgucuucugguacaagcgccgcguccagggcgccaagggcuuccagcaccagcgcaugaccaacggcgccaugaacgucgagaucggcaaccccaccuacaagauguacgagggcggcgagcccgacgacgucggcggccuccucgacgccgacuucgcccucgaccccgacaagcccaccaacuucaccaaccccgucuacgccacccucuacaugggcggccacggcucccgccacucccucgccuccaccgacgagaagcgcgagcuccucggccgcggccccgaggacgagaucggcgacccccucgccuga

SEQ ID NO: 45502 - RNA, 1044 nt, Artificial Sequence
  derived and/or modified sequence opt2 from LRP2BP__Homo_sapiens__NP_060879
augaagcucaccuccgagaagcuccccaagaaccccuucuacgccuccgucucccaguacgccgccaagaaccagaaguucuuccaguggaagaaggagaagaccgacuacacccacgccaaccucgucgacaaggcccuccagcuccucaaggagcgcauccucaagggcgacacccucgccuacuuccuccgcggccagcucuacuucgaggagggcugguacgaggaggcccucgagcaguucgaggagaucaaggagaaggaccaccaggccaccuaccagcucggcgucauguacuacgacggccucggcaccacccucgacgccgagaagggcgucgacuacaugaagaagauccucgacucccccugccccaaggcccgccaccucaaguucgccgccgccuacaaccucggccgcgccuacuacgagggcaagggcgucaagcgcuccaacgaggaggccgagcgccucuggcucaucgccgccgacaacggcaaccccaaggccuccgucaaggcccaguccaugcucggccucuacuacuccaccaaggagcccaaggagcucgagaaggccuucuacuggcacuccgaggccugcggcaacggcaaccucgagucccagggcgcccucggccucauguaccucuacggccagggcauccgccaggacaccgaggccgcccuccagugccuccgcgaggccgccgagcgcggcaacgucuacgcccagggcaaccucgucgaguacuacuacaagaugaaguucuucaccaagugcgucgccuucuccaagcgcaucgccgacuacgacgagguccacgacauccccaugaucgcccaggucaccgacugccuccccgaguucaucggccgcggcauggccauggccuccuucuaccacgcccgcugccuccagcucggccucggcaucacccgcgacgagaccaccgccaagcacuacuacuccaaggccugccgccucaaccccgcccucgccgacgagcuccacucccuccucauccgccagcgcaucuga

SEQ ID NO: 45503 - RNA, 13968 nt, Artificial Sequence
  derived and/or modified sequence opt2 from LRP2__Homo_sapiens__NP_004516
auggaccgcggccccgccgccgucgccugcacccuccuccucgcccucgucgccugccucgcccccgccuccggccaggagugcgacuccgcccacuuccgcugcggcuccggccacugcauccccgccgacuggcgcugcgacggcaccaaggacugcuccgacgacgccgacgagaucggcugcgccgucgucaccugccagcagggcuacuucaagugccaguccgagggccagugcauccccaacuccugggucugcgaccaggaccaggacugcgacgacggcuccgacgagcgccaggacugcucccaguccaccugcuccucccaccagaucaccugcuccaacggccagugcauccccuccgaguaccgcugcgaccacguccgcgacugccccgacggcgccgacgagaacgacugccaguaccccaccugcgagcagcucaccugcgacaacggcgccugcuacaacaccucccagaagugcgacuggaaggucgacugccgcgacuccuccgacgagaucaacugcaccgagaucugccuccacaacgaguucuccugcggcaacggcgagugcaucccccgcgccuacgucugcgaccacgacaacgacugccaggacggcuccgacgagcacgccugcaacuaccccaccugcggcggcuaccaguucaccugccccuccggccgcugcaucuaccagaacugggucugcgacggcgaggacgacugcaaggacaacggcgacgaggacggcugcgaguccggcccccacgacguccacaagugcuccccccgcgagugguccugccccgaguccggccgcugcaucuccaucuacaaggucugcgacggcauccucgacugccccggccgcgaggacgagaacaacaccuccaccggcaaguacugcuccaugacccucugcuccgcccucaacugccaguaccagugccacgagacccccuacggcggcgccugcuucugcccccccggcuacaucaucaaccacaacgacucccgcaccugcgucgaguucgacgacugccagaucuggggcaucugcgaccagaagugcgagucccgccccggccgccaccucugccacugcgaggagggcuacauccucgagcgcggccaguacugcaaggccaacgacuccuucggcgaggccuccaucaucuucuccaacggccgcgaccuccucaucggcgacauccacggccgcuccuuccgcauccucgucgagucccagaaccgcggcgucgccgucggcgucgccuuccacuaccaccuccagcgcgucuucuggaccgacaccguccagaacaaggucuucuccgucgacaucaacggccucaacauccaggagguccucaacgucuccgucgagacccccgagaaccucgccgucgacugggucaacaacaagaucuaccucgucgagaccaaggucaaccgcaucgacauggucaaccucgacggcuccuaccgcgucacccucaucaccgagaaccucggccacccccgcggcaucgccgucgaccccaccgucggcuaccucuucuucuccgacugggagucccucuccggcgagcccaagcucgagcgcgccuucauggacggcuccaaccgcaaggaccucgucaagaccaagcucggcuggcccgccggcgucacccucgacaugaucuccaagcgcgucuacugggucgacucccgcuucgacuacaucgagaccgucaccuacgacggcauccagcgcaagaccgucguccacggcggcucccucaucccccaccccuucggcgucucccucuucgagggccaggucuucuucaccgacuggaccaagauggccguccucaaggccaacaaguucaccgagaccaacccccaggucuacuaccaggccucccuccgccccuacggcgucaccgucuaccacucccuccgccagcccuacgccaccaaccccugcaaggacaacaacggcggcugcgagcaggucugcguccucucccaccgcaccgacaacgacggccucggcuuccgcugcaagugcaccuucggcuuccagcucgacaccgacgagcgccacugcaucgccguccagaacuuccucaucuucuccucccaggucgccauccgcggcauccccuucacccucuccacccaggaggacgucaugguccccgucuccggcaaccccuccuucuucgucggcaucgacuucgacgcccaggacuccaccaucuucuucuccgacauguccaagcacaugaucuucaagcagaagaucgacggcaccggccgcgagauccucgccgccaaccgcgucgagaacgucgagucccucgccuucgacuggaucuccaagaaccucuacuggaccgacucccacuacaaguccaucuccgucaugcgccucgccgacaagacccgccgcaccgucguccaguaccucaacaacccccgcuccgucgucguccaccccuucgccggcuaccucuucuucaccgacugguuccgccccgccaagaucaugcgcgccugguccgacggcucccaccuccuccccgucaucaacaccacccucggcuggcccaacggccucgccaucgacugggccgccucccgccucuacugggucgacgccuacuucgacaagaucgagcacuccaccuucgacggccucgaccgccgccgccucggccacaucgagcagaugacccaccccuucggccucgccaucuucggcgagcaccucuucuucaccgacuggcgccucggcgccaucauccgcguccgcaaggccgacggcggcgagaugaccgucauccgcuccggcaucgccuacauccuccaccucaaguccuacgacgucaacauccagaccggcuccaacgccugcaaccagcccacccaccccaacggcgacugcucccacuucugcuuccccguccccaacuuccagcgcgucugcggcugccccuacggcaugcgccucgccuccaaccaccucaccugcgagggcgaccccaccaacgagccccccaccgagcagugcggccucuucuccuuccccugcaagaacggccgcugcguccccaacuacuaccucugcgacggcgucgacgacugccacgacaacuccgacgagcagcucugcggcacccucaacaacaccugcuccuccuccgccuucaccugcggccacggcgagugcauccccgcccacuggcgcugcgacaagcgcaacgacugcgucgacggcuccgacgagcacaacugccccacccacgcccccgccuccugccucgacacccaguacaccugcgacaaccaccagugcaucuccaagaacugggucugcgacaccgacaacgacugcggcgacggcuccgacgagaagaacugcaacuccaccgagaccugccagcccucccaguucaacugccccaaccaccgcugcaucgaccucuccuucgucugcgacggcgacaaggacugcgucgacggcuccgacgaggucggcugcguccucaacugcaccgccucccaguucaagugcgccuccggcgacaagugcaucggcgucaccaaccgcugcgacggcgucuucgacugcuccgacaacuccgacgaggccggcugccccacccgcccccccggcaugugccacuccgacgaguuccagugccaggaggacggcaucugcauccccaacuucugggagugcgacggccaccccgacugccucuacggcuccgacgagcacaacgccugcguccccaagaccugccccuccuccuacuuccacugcgacaacggcaacugcauccaccgcgccuggcucugcgaccgcgacaacgacugcggcgacauguccgacgagaaggacugccccacccagcccuuccgcugccccuccuggcaguggcagugccucggccacaacaucugcgucaaccucuccgucgucugcgacggcaucuucgacugccccaacggcaccgacgaguccccccucugcaacggcaacuccugcuccgacuucaacggcggcugcacccacgagugcguccaggagcccuucggcgccaagugccucugcccccucggcuuccuccucgccaacgacuccaagaccugcgaggacaucgacgagugcgacauccucggcuccugcucccagcacugcuacaacaugcgcggcuccuuccgcugcuccugcgacaccggcuacaugcucgaguccgacggccgcaccugcaaggucaccgccuccgagucccuccuccuccucgucgccucccagaacaagaucaucgccgacuccgucaccucccagguccacaacaucuacucccucgucgagaacggcuccuacaucgucgccgucgacuucgacuccaucuccggccgcaucuucugguccgacgccacccagggcaagaccugguccgccuuccagaacggcaccgaccgccgcgucgucuucgacuccuccaucauccucaccgagaccaucgccaucgacugggucggccgcaaccucuacuggaccgacuacgcccucgagaccaucgaggucuccaagaucgacggcucccaccgcaccguccucaucuccaagaaccucaccaacccccgcggccucgcccucgacccccgcaugaacgagcaccuccucuucugguccgacuggggccaccacccccgcaucgagcgcgccuccauggacggcuccaugcgcaccgucaucguccaggacaagaucuucuggcccugcggccucaccaucgacuaccccaaccgccuccucuacuucauggacuccuaccucgacuacauggacuucugcgacuacaacggccaccaccgccgccaggucaucgccuccgaccucaucauccgccaccccuacgcccucacccucuucgaggacuccgucuacuggaccgaccgcgccacccgccgcgucaugcgcgccaacaaguggcacggcggcaaccaguccgucgucauguacaacauccaguggccccucggcaucgucgccguccaccccuccaagcagcccaacuccgucaaccccugcgccuucucccgcugcucccaccucugccuccucuccucccagggcccccacuucuacuccugcgucugccccuccggcuggucccucucccccgaccuccucaacugccuccgcgacgaccagcccuuccucaucaccguccgccagcacaucaucuucggcaucucccucaaccccgaggucaaguccaacgacgccaugguccccaucgccggcauccagaacggccucgacgucgaguucgacgacgccgagcaguacaucuacugggucgagaaccccggcgagauccaccgcgucaagaccgacggcaccaaccgcaccgucuucgccuccaucuccauggucggccccuccaugaaccucgcccucgacuggaucucccgcaaccucuacuccaccaacccccgcacccaguccaucgagguccucacccuccacggcgacauccgcuaccgcaagacccucaucgccaacgacggcaccgcccucggcgucggcuuccccaucggcaucaccgucgaccccgcccgcggcaagcucuacugguccgaccagggcaccgacuccggcguccccgccaagaucgccuccgccaacauggacggcaccuccgucaagacccucuucaccggcaaccucgagcaccucgagugcgucacccucgacaucgaggagcagaagcucuacugggccgucaccggccgcggcgucaucgagcgcggcaacgucgacggcaccgaccgcaugauccucguccaccagcucucccaccccuggggcaucgccguccacgacuccuuccucuacuacaccgacgagcaguacgaggucaucgagcgcgucgacaaggccaccggcgccaacaagaucguccuccgcgacaacguccccaaccuccgcggccuccaggucuaccaccgccgcaacgccgccgaguccuccaacggcugcuccaacaacaugaacgccugccagcagaucugccuccccguccccggcggccucuucuccugcgccugcgccaccggcuucaagcucaaccccgacaaccgcuccugcucccccuacaacuccuucaucgucgucuccaugcucuccgccauccgcggcuucucccucgagcucuccgaccacuccgagaccaugguccccgucgccggccagggccgcaacgcccuccacgucgacgucgacgucuccuccggcuucaucuacuggugcgacuucuccuccuccgucgccuccgacaacgccauccgccgcaucaagcccgacggcuccucccucaugaacaucgucacccacggcaucggcgagaacggcguccgcggcaucgccgucgacugggucgccggcaaccucuacuucaccaacgccuucgucuccgagacccucaucgagguccuccgcaucaacaccaccuaccgccgcguccuccucaaggucaccgucgacaugccccgccacaucgucgucgaccccaagaaccgcuaccucuucugggccgacuacggccagcgccccaagaucgagcgcuccuuccucgacugcaccaaccgcaccguccucgucuccgagggcaucgucaccccccgcggccucgccgucgaccgcuccgacggcuacgucuacugggucgacgacucccucgacaucaucgcccgcauccgcaucaacggcgagaacuccgaggucauccgcuacggcucccgcuaccccacccccuacggcaucaccgucuucgagaacuccaucaucugggucgaccgcaaccucaagaagaucuuccaggccuccaaggagcccgagaacaccgagccccccaccgucauccgcgacaacaucaacuggcuccgcgacgucaccaucuucgacaagcagguccagccccgcucccccgccgaggucaacaacaaccccugccucgagaacaacggcggcugcucccaccucugcuucgcccuccccggccuccacacccccaagugcgacugcgccuucggcacccuccaguccgacggcaagaacugcgccaucuccaccgagaacuuccucaucuucgcccucuccaacucccuccgcucccuccaccucgaccccgagaaccacuccccccccuuccagaccaucaacgucgagcgcaccgucaugucccucgacuacgacuccgucuccgaccgcaucuacuucacccagaaccucgccuccggcgucggccagaucuccuacgccacccucuccuccggcauccacacccccaccgucaucgccuccggcaucggcaccgccgacggcaucgccuucgacuggaucacccgccgcaucuacuacuccgacuaccucaaccagaugaucaacuccauggccgaggacggcuccaaccgcaccgucaucgcccgcguccccaagccccgcgccaucguccucgaccccugccagggcuaccucuacugggccgacugggacacccacgccaagaucgagcgcgccacccucggcggcaacuuccgcguccccaucgucaacuccucccucgucaugcccuccggccucacccucgacuacgaggaggaccuccucuacugggucgacgccucccuccagcgcaucgagcgcuccacccucaccggcgucgaccgcgaggucaucgucaacgccgccguccacgccuucggccucacccucuacggccaguacaucuacuggaccgaccucuacacccagcgcaucuaccgcgccaacaaguacgacggcuccggccagaucgccaugaccaccaaccuccucucccagccccgcggcaucaacaccgucgucaagaaccagaagcagcagugcaacaaccccugcgagcaguucaacggcggcugcucccacaucugcgcccccggccccaacggcgccgagugccagugcccccacgagggcaacugguaccucgccaacaaccgcaagcacugcaucgucgacaacggcgagcgcugcggcgccuccuccuucaccugcuccaacggccgcugcaucuccgaggaguggaagugcgacaacgacaacgacugcggcgacggcuccgacgagauggaguccgucugcgcccuccacaccugcucccccaccgccuucaccugcgccaacggccgcugcguccaguacuccuaccgcugcgacuacuacaacgacugcggcgacggcuccgacgaggccggcugccucuuccgcgacugcaacgccaccaccgaguucaugugcaacaaccgccgcugcaucccccgcgaguucaucugcaacggcgucgacaacugccacgacaacaacaccuccgacgagaagaacugccccgaccgcaccugccaguccggcuacaccaagugccacaacuccaacaucugcaucccccgcgucuaccucugcgacggcgacaacgacugcggcgacaacuccgacgagaaccccaccuacugcaccacccacaccugcuccuccuccgaguuccagugcgccuccggccgcugcaucccccagcacugguacugcgaccaggagaccgacugcuucgacgccuccgacgagcccgccuccugcggccacuccgagcgcaccugccucgccgacgaguucaagugcgacggcggccgcugcauccccuccgaguggaucugcgacggcgacaacgacugcggcgacauguccgacgaggacaagcgccaccagugccagaaccagaacugcuccgacuccgaguuccucugcgucaacgaccgcccccccgaccgccgcugcaucccccaguccugggucugcgacggcgacgucgacugcaccgacggcuacgacgagaaccagaacugcacccgccgcaccugcuccgagaacgaguucaccugcggcuacggccucugcauccccaagaucuuccgcugcgaccgccacaacgacugcggcgacuacuccgacgagcgcggcugccucuaccagaccugccagcagaaccaguucaccugccagaacggccgcugcaucuccaagaccuucgucugcgacgaggacaacgacugcggcgacggcuccgacgagcucaugcaccucugccacacccccgagcccaccugccccccccacgaguucaagugcgacaacggccgcugcaucgagaugaugaagcucugcaaccaccucgacgacugccucgacaacuccgacgagaagggcugcggcaucaacgagugccacgaccccuccaucuccggcugcgaccacaacugcaccgacacccucaccuccuucuacugcuccugccgccccggcuacaagcucauguccgacaagcgcaccugcgucgacaucgacgagugcaccgagaugcccuucgucugcucccagaagugcgagaacgucaucggcuccuacaucugcaagugcgcccccggcuaccuccgcgagcccgacggcaagaccugccgccagaacuccaacaucgagcccuaccucaucuucuccaaccgcuacuaccuccgcaaccucaccaucgacggcuacuucuacucccucauccucgagggccucgacaacgucgucgcccucgacuucgaccgcgucgagaagcgccucuacuggaucgacacccagcgccaggucaucgagcgcauguuccucaacaagaccaacaaggagaccaucaucaaccaccgccuccccgccgccgagucccucgccgucgacugggucucccgcaagcucuacuggcucgacgcccgccucgacggccucuucgucuccgaccucaacggcggccaccgccgcaugcucgcccagcacugcgucgacgccaacaacaccuucugcuucgacaacccccgcggccucgcccuccacccccaguacggcuaccucuacugggccgacuggggccaccgcgccuacaucggccgcgucggcauggacggcaccaacaaguccgucaucaucuccaccaagcucgaguggcccaacggcaucaccaucgacuacaccaacgaccuccucuacugggccgacgcccaccucggcuacaucgaguacuccgaccucgagggccaccaccgccacaccgucuacgacggcgcccucccccaccccuucgccaucaccaucuucgaggacaccaucuacuggaccgacuggaacacccgcaccgucgagaagggcaacaaguacgacggcuccaaccgccagacccucgucaacaccacccaccgccccuucgacauccacgucuaccaccccuaccgccagcccaucgucuccaaccccugcggcaccaacaacggcggcugcucccaccucugccucaucaagcccggcggcaagggcuucaccugcgagugccccgacgacuuccgcacccuccagcucuccggcuccaccuacugcaugcccaugugcuccuccacccaguuccucugcgccaacaacgagaagugcauccccaucugguggaagugcgacggccagaaggacugcuccgacggcuccgacgagcucgcccucugcccccagcgcuucugccgccucggccaguuccagugcuccgacggcaacugcaccuccccccagacccucugcaacgcccaccagaacugccccgacggcuccgacgaggaccgccuccucugcgagaaccaccacugcgacuccaacgaguggcagugcgccaacaagcgcugcauccccgaguccuggcagugcgacaccuucaacgacugcgaggacaacuccgacgaggacuccucccacugcgccucccgcaccugccgccccggccaguuccgcugcgccaacggccgcugcaucccccaggccuggaagugcgacgucgacaacgacugcggcgaccacuccgacgagcccaucgaggagugcauguccuccgcccaccucugcgacaacuucaccgaguucuccugcaagaccaacuaccgcugcauccccaagugggccgucugcaacggcgucgacgacugccgcgacaacuccgacgagcagggcugcgaggagcgcaccugccaccccgucggcgacuuccgcugcaagaaccaccacugcaucccccuccgcuggcagugcgacggccagaacgacugcggcgacaacuccgacgaggagaacugcgccccccgcgagugcaccgaguccgaguuccgcugcgucaaccagcagugcauccccucccgcuggaucugcgaccacuacaacgacugcggcgacaacuccgacgagcgcgacugcgagaugcgcaccugccaccccgaguacuuccagugcaccuccggccacugcguccacuccgagcucaagugcgacggcuccgccgacugccucgacgccuccgacgaggccgacugccccacccgcuuccccgacggcgccuacugccaggccaccauguucgagugcaagaaccacgucugcaucccccccuacuggaagugcgacggcgacgacgacugcggcgacggcuccgacgaggagcuccaccucugccucgacguccccugcaacucccccaaccgcuuccgcugcgacaacaaccgcugcaucuacucccacgaggucugcaacggcgucgacgacugcggcgacggcaccgacgagaccgaggagcacugccgcaagcccacccccaagcccugcaccgaguacgaguacaagugcggcaacggccacugcaucccccacgacaacgucugcgacgacgccgacgacugcggcgacugguccgacgagcucggcugcaacaagggcaaggagcgcaccugcgccgagaacaucugcgagcagaacugcacccagcucaacgagggcggcuucaucugcuccugcaccgccggcuucgagaccaacgucuucgaccgcaccuccugccucgacaucaacgagugcgagcaguucggcaccugcccccagcacugccgcaacaccaagggcuccuacgagugcgucugcgccgacggcuucaccuccauguccgaccgccccggcaagcgcugcgccgccgagggcuccuccccccuccuccuccuccccgacaacguccgcauccgcaaguacaaccucuccuccgagcgcuucuccgaguaccuccaggacgaggaguacauccaggccgucgacuacgacugggaccccaaggacaucggccucuccgucgucuacuacaccguccgcggcgagggcucccgcuucggcgccaucaagcgcgccuacauccccaacuucgaguccggccgcaacaaccucguccaggaggucgaccucaagcucaaguacgucaugcagcccgacggcaucgccgucgacugggucggccgccacaucuacugguccgacgucaagaacaagcgcaucgaggucgccaagcucgacggccgcuaccgcaaguggcucaucuccaccgaccucgaccagcccgccgccaucgccgucaaccccaagcucggccucauguucuggaccgacuggggcaaggagcccaagaucgaguccgccuggaugaacggcgaggaccgcaacauccucgucuucgaggaccucggcuggcccaccggccucuccaucgacuaccucaacaacgaccgcaucuacugguccgacuucaaggaggacgucaucgagaccaucaaguacgacggcaccgaccgccgcgucaucgccaaggaggccaugaaccccuacucccucgacaucuucgaggaccagcucuacuggaucuccaaggagaagggcgaggucuggaagcagaacaaguucggccagggcaagaaggagaagacccucgucgucaaccccuggcucacccagguccgcaucuuccaccagcuccgcuacaacaaguccguccccaaccucugcaagcagaucugcucccaccucugccuccuccgccccggcggcuacuccugcgccugcccccagggcuccuccuucaucgagggcuccaccaccgagugcgacgccgccaucgagcuccccaucaaccuccccccccccugccgcugcaugcacggcggcaacugcuacuucgacgagaccgaccuccccaagugcaagugccccuccggcuacaccggcaaguacugcgagauggccuucuccaagggcaucucccccggcaccaccgccgucgccguccuccucaccauccuccucaucgucgucaucggcgcccucgccaucgccggcuucuuccacuaccgccgcaccggcucccuccuccccgcccuccccaagcuccccucccucuccucccucgucaagcccuccgagaacggcaacggcgucaccuuccgcuccggcgccgaccucaacauggacaucggcgucuccggcuucggccccgagaccgccaucgaccgcuccauggccauguccgaggacuucgucauggagaugggcaagcagcccaucaucuucgagaaccccauguacuccgcccgcgacuccgccgucaaggucguccagcccauccaggucaccgucuccgagaacgucgacaacaagaacuacggcucccccaucaaccccuccgagaucguccccgagaccaaccccaccucccccgccgccgacggcacccaggucaccaaguggaaccucuucaagcgcaaguccaagcagaccaccaacuucgagaaccccaucuacgcccagauggagaacgagcagaaggaguccgucgccgccacccccccccccucccccucccuccccgccaagcccaagccccccucccgccgcgaccccacccccaccuacuccgccaccgaggacaccuucaaggacaccgccaaccucgucaaggaggacuccgaggucuga

SEQ ID NO: 45504 - RNA, 5718 nt, Artificial Sequence
  derived and/or modified sequence opt2 from LRP4__Homo_sapiens__NP_002325
augcgccgccaguggggcgcccuccuccucggcgcccuccucugcgcccacggccucgccuccucccccgagugcgccugcggccgcucccacuucaccugcgccgucuccgcccucggcgagugcaccugcauccccgcccaguggcagugcgacggcgacaacgacugcggcgaccacuccgacgaggacggcugcauccuccccaccugcuccccccucgacuuccacugcgacaacggcaagugcauccgccgcuccugggucugcgacggcgacaacgacugcgaggacgacuccgacgagcaggacugccccccccgcgagugcgaggaggacgaguuccccugccagaacggcuacugcauccgcucccucuggcacugcgacggcgacaacgacugcggcgacaacuccgacgagcagugcgacaugcgcaagugcuccgacaaggaguuccgcugcuccgacggcuccugcaucgccgagcacugguacugcgacggcgacaccgacugcaaggacggcuccgacgaggagaacugccccuccgccguccccgccccccccugcaaccucgaggaguuccagugcgccuacggccgcugcauccucgacaucuaccacugcgacggcgacgacgacugcggcgacugguccgacgaguccgacugcuccucccaccagcccugccgcuccggcgaguucaugugcgacuccggccucugcaucaacgccggcuggcgcugcgacggcgacgccgacugcgacgaccaguccgacgagcgcaacugcaccaccuccaugugcaccgccgagcaguuccgcugccacuccggccgcugcguccgccucuccuggcgcugcgacggcgaggacgacugcgccgacaacuccgacgaggagaacugcgagaacaccggcuccccccagugcgcccucgaccaguuccucugcuggaacggccgcugcaucggccagcgcaagcucugcaacggcgucaacgacugcggcgacaacuccgacgaguccccccagcagaacugccgcccccgcaccggcgaggagaacugcaacgucaacaacggcggcugcgcccagaagugccagaugguccgcggcgccguccagugcaccugccacaccggcuaccgccucaccgaggacggccacaccugccaggacgucaacgagugcgccgaggagggcuacugcucccagggcugcaccaacuccgagggcgccuuccagugcuggugcgagaccggcuacgagcuccgccccgaccgccgcuccugcaaggcccucggccccgagcccguccuccucuucgccaaccgcaucgacauccgccagguccucccccaccgcuccgaguacacccuccuccucaacaaccucgagaacgccaucgcccucgacuuccaccaccgccgcgagcucgucuucugguccgacgucacccucgaccgcauccuccgcgccaaccucaacggcuccaacgucgaggaggucgucuccaccggccucgagucccccggcggccucgccgucgacuggguccacgacaagcucuacuggaccgacuccggcaccucccgcaucgaggucgccaaccucgacggcgcccaccgcaagguccuccucuggcagaaccucgagaagccccgcgccaucgcccuccaccccauggagggcaccaucuacuggaccgacuggggcaacaccccccgcaucgaggccuccuccauggacggcuccggccgccgcaucaucgccgacacccaccucuucuggcccaacggccucaccaucgacuacgccggccgccgcauguacugggucgacgccaagcaccacgucaucgagcgcgccaaccucgacggcucccaccgcaaggccgucaucucccagggccucccccaccccuucgccaucaccgucuucgaggacucccucuacuggaccgacuggcacaccaaguccaucaacuccgccaacaaguucaccggcaagaaccaggagaucauccgcaacaagcuccacuuccccauggacauccacacccuccacccccagcgccagcccgccggcaagaaccgcugcggcgacaacaacggcggcugcacccaccucugccuccccuccggccagaacuacaccugcgccugccccaccggcuuccgcaagaucuccucccacgccugcgcccagucccucgacaaguuccuccucuucgcccgccgcauggacauccgccgcaucuccuucgacaccgaggaccucuccgacgacgucaucccccucgccgacguccgcuccgccgucgcccucgacugggacucccgcgacgaccacgucuacuggaccgacgucuccaccgacaccaucucccgcgccaagugggacggcaccggccaggaggucgucgucgacaccucccucgagucccccgccggccucgccaucgacugggucaccaacaagcucuacuggaccgacgccggcaccgaccgcaucgaggucgccaacaccgacggcuccaugcgcaccguccucaucugggagaaccucgaccgcccccgcgacaucgucgucgagcccaugggcggcuacauguacuggaccgacuggggcgccucccccaagaucgagcgcgccggcauggacgccuccggccgccaggucaucaucuccuccaaccucaccuggcccaacggccucgccaucgacuacggcucccagcgccucuacugggccgacgccggcaugaagaccaucgaguucgccggccucgacggcuccaagcgcaagguccucaucggcucccagcucccccaccccuucggccucacccucuacggcgagcgcaucuacuggaccgacuggcagaccaaguccauccaguccgccgaccgccucaccggccucgaccgcgagacccuccaggagaaccucgagaaccucauggacauccacgucuuccaccgccgccgcccccccgucuccacccccugcgccauggagaacggcggcugcucccaccucugccuccgcucccccaaccccuccggcuucuccugcaccugccccaccggcaucaaccuccucuccgacggcaagaccugcucccccggcaugaacuccuuccucaucuucgcccgccgcaucgacauccgcauggucucccucgacauccccuacuucgccgacgucgucguccccaucaacaucaccaugaagaacaccaucgccaucggcgucgacccccaggagggcaaggucuacugguccgacuccacccuccaccgcaucucccgcgccaaccucgacggcucccagcacgaggacaucaucaccaccggccuccagaccaccgacggccucgccgucgacgccaucggccgcaaggucuacuggaccgacaccggcaccaaccgcaucgaggucggcaaccucgacggcuccaugcgcaagguccucgucuggcagaaccucgacuccccccgcgccaucguccucuaccacgagaugggcuucauguacuggaccgacuggggcgagaacgccaagcucgagcgcuccggcauggacggcuccgaccgcgccguccucaucaacaacaaccucggcuggcccaacggccucaccgucgacaaggccuccucccagcuccucugggccgacgcccacaccgagcgcaucgaggccgccgaccucaacggcgccaaccgccacacccucgucucccccguccagcaccccuacggccucacccuccucgacuccuacaucuacuggaccgacuggcagacccgcuccauccaccgcgccgacaagggcaccggcuccaacgucauccucguccgcuccaaccuccccggccucauggacaugcaggccgucgaccgcgcccagccccucggcuucaacaagugcggcucccgcaacggcggcugcucccaccucugccucccccgccccuccggcuucuccugcgccugccccaccggcauccagcucaagggcgacggcaagaccugcgaccccucccccgagaccuaccuccucuucuccucccgcggcuccauccgccgcaucucccucgacaccuccgaccacaccgacguccacguccccguccccgagcucaacaacgucaucucccucgacuacgacuccgucgacggcaaggucuacuacaccgacgucuuccucgacgucauccgccgcgccgaccucaacggcuccaacauggagaccgucaucggccgcggccucaagaccaccgacggccucgccgucgacugggucgcccgcaaccucuacuggaccgacaccggccgcaacaccaucgaggccucccgccucgacggcuccugccgcaagguccucaucaacaacucccucgacgagccccgcgccaucgccgucuucccccgcaagggcuaccucuucuggaccgacuggggccacaucgccaagaucgagcgcgccaaccucgacggcuccgagcgcaagguccucaucaacaccgaccucggcuggcccaacggccucacccucgacuacgacacccgccgcaucuacugggucgacgcccaccucgaccgcaucgaguccgccgaccucaacggcaagcuccgccagguccucgucucccacgucucccaccccuucgcccucacccagcaggaccgcuggaucuacuggaccgacuggcagaccaaguccauccagcgcgucgacaaguacuccggccgcaacaaggagaccguccucgccaacgucgagggccucauggacaucaucgucgucuccccccagcgccagaccggcaccaacgccugcggcgucaacaacggcggcugcacccaccucugcuucgcccgcgccuccgacuucgucugcgccugccccgacgagcccgacucccgccccugcucccucguccccggccucgucccccccgccccccgcgccaccggcauguccgagaagucccccguccuccccaacaccccccccaccacccucuacuccuccaccacccgcacccgcaccucccucgaggaggucgagggccgcugcuccgagcgcgacgcccgccucggccucugcgcccgcuccaacgacgccguccccgccgcccccggcgagggccuccacaucuccuacgccaucggcggccuccucuccauccuccucauccucgucgucaucgccgcccucaugcucuaccgccacaagaaguccaaguucaccgaccccggcaugggcaaccucaccuacuccaaccccuccuaccgcaccuccacccaggaggucaagaucgaggccauccccaagcccgccauguacaaccagcucugcuacaagaaggagggcggccccgaccacaacuacaccaaggagaagaucaagaucgucgagggcaucugccuccucuccggcgacgacgccgagugggacgaccucaagcagcuccgcuccucccgcggcggccuccuccgcgaccacgucugcaugaagaccgacaccgucuccauccaggccuccuccggcucccucgacgacaccgagaccgagcagcuccuccaggaggagcaguccgagugcuccuccguccacaccgccgccacccccgagcgccgcggcucccuccccgacaccggcuggaagcacgagcgcaagcucuccuccgagucccaggucuga

SEQ ID NO: 45505 - RNA, 4848 nt, Artificial Sequence
  derived and/or modified sequence opt2 from LRP5__Homo_sapiens__NP_002326
auggaggccgccccccccggcccccccuggccccuccuccuccuccuccuccuccuccucgcccucugcggcugccccgcccccgccgccgccuccccccuccuccucuucgccaaccgccgcgacguccgccucgucgacgccggcggcgucaagcucgaguccaccaucgucgucuccggccucgaggacgccgccgccgucgacuuccaguucuccaagggcgccgucuacuggaccgacgucuccgaggaggccaucaagcagaccuaccucaaccagaccggcgccgccguccagaacgucgucaucuccggccucgucucccccgacggccucgccugcgacugggucggcaagaagcucuacuggaccgacuccgagaccaaccgcaucgaggucgccaaccucaacggcaccucccgcaagguccucuucuggcaggaccucgaccagccccgcgccaucgcccucgaccccgcccacggcuacauguacuggaccgacuggggcgagaccccccgcaucgagcgcgccggcauggacggcuccacccgcaagaucaucgucgacuccgacaucuacuggcccaacggccucaccaucgaccucgaggagcagaagcucuacugggccgacgccaagcucuccuucauccaccgcgccaaccucgacggcuccuuccgccagaaggucgucgagggcucccucacccaccccuucgcccucacccucuccggcgacacccucuacuggaccgacuggcagacccgcuccauccacgccugcaacaagcgcaccggcggcaagcgcaaggagauccucuccgcccucuacucccccauggacauccagguccucucccaggagcgccagcccuucuuccacacccgcugcgaggaggacaacggcggcugcucccaccucugccuccucucccccuccgagcccuucuacaccugcgccugccccaccggcguccagcuccaggacaacggccgcaccugcaaggccggcgccgaggagguccuccuccucgcccgccgcaccgaccuccgccgcaucucccucgacacccccgacuucaccgacaucguccuccaggucgacgacauccgccacgccaucgccaucgacuacgacccccucgagggcuacgucuacuggaccgacgacgagguccgcgccauccgccgcgccuaccucgacggcuccggcgcccagacccucgucaacaccgagaucaacgaccccgacggcaucgccgucgacugggucgcccgcaaccucuacuggaccgacaccggcaccgaccgcaucgaggucacccgccucaacggcaccucccgcaagauccucgucuccgaggaccucgacgagccccgcgccaucgcccuccaccccgucaugggccucauguacuggaccgacuggggcgagaaccccaagaucgagugcgccaaccucgacggccaggagcgccgcguccucgucaacgccucccucggcuggcccaacggccucgcccucgaccuccaggagggcaagcucuacuggggcgacgccaagaccgacaagaucgaggucaucaacgucgacggcaccaagcgccgcacccuccucgaggacaagcucccccacaucuucggcuucacccuccucggcgacuucaucuacuggaccgacuggcagcgccgcuccaucgagcgcguccacaaggucaaggccucccgcgacgucaucaucgaccagcuccccgaccucaugggccucaaggccgucaacgucgccaaggucgucggcaccaaccccugcgccgaccgcaacggcggcugcucccaccucugcuucuucaccccccacgccacccgcugcggcugccccaucggccucgagcuccucuccgacaugaagaccugcaucguccccgaggccuuccucgucuucaccucccgcgccgccauccaccgcaucucccucgagaccaacaacaacgacgucgccaucccccucaccggcgucaaggaggccuccgcccucgacuucgacgucuccaacaaccacaucuacuggaccgacgucucccucaagaccaucucccgcgccuucaugaacggcuccuccgucgagcacgucgucgaguucggccucgacuaccccgagggcauggccgucgacuggaugggcaagaaccucuacugggccgacaccggcaccaaccgcaucgaggucgcccgccucgacggccaguuccgccagguccucgucuggcgcgaccucgacaacccccgcucccucgcccucgaccccaccaagggcuacaucuacuggaccgaguggggcggcaagccccgcaucguccgcgccuucauggacggcaccaacugcaugacccucgucgacaaggucggccgcgccaacgaccucaccaucgacuacgccgaccagcgccucuacuggaccgaccucgacaccaacaugaucgaguccuccaacaugcucggccaggagcgcgucgucaucgccgacgaccucccccaccccuucggccucacccaguacuccgacuacaucuacuggaccgacuggaaccuccacuccaucgagcgcgccgacaagaccuccggccgcaaccgcacccucauccagggccaccucgacuucgucauggacauccucgucuuccacuccucccgccaggacggccucaacgacugcaugcacaacaacggccagugcggccagcucugccucgccauccccggcggccaccgcugcggcugcgccucccacuacacccucgaccccuccucccgcaacugcuccccccccaccaccuuccuccucuucucccagaaguccgccaucucccgcaugauccccgacgaccagcacucccccgaccucauccucccccuccacggccuccgcaacgucaaggccaucgacuacgacccccucgacaaguucaucuacugggucgacggccgccagaacaucaagcgcgccaaggacgacggcacccagcccuucguccucaccucccucucccagggccagaaccccgaccgccagccccacgaccucuccaucgacaucuacucccgcacccucuucuggaccugcgaggccaccaacaccaucaacguccaccgccucuccggcgaggccaugggcgucguccuccgcggcgaccgcgacaagccccgcgccaucgucgucaacgccgagcgcggcuaccucuacuucaccaacaugcaggaccgcgccgccaagaucgagcgcgccgcccucgacggcaccgagcgcgagguccucuucaccaccggccucauccgccccgucgcccucgucgucgacaacacccucggcaagcucuucugggucgacgccgaccucaagcgcaucgaguccugcgaccucuccggcgccaaccgccucacccucgaggacgccaacaucguccagccccucggccucaccauccucggcaagcaccucuacuggaucgaccgccagcagcagaugaucgagcgcgucgagaagaccaccggcgacaagcgcacccgcauccagggccgcgucgcccaccucaccggcauccacgccgucgaggaggucucccucgaggaguucuccgcccaccccugcgcccgcgacaacggcggcugcucccacaucugcaucgccaagggcgacggcaccccccgcugcuccugccccguccaccucguccuccuccagaaccuccucaccugcggcgagccccccaccugcucccccgaccaguucgccugcgccaccggcgagaucgacugcauccccggcgccuggcgcugcgacggcuuccccgagugcgacgaccaguccgacgaggagggcugccccgucugcuccgccgcccaguuccccugcgcccgcggccagugcgucgaccuccgccuccgcugcgacggcgaggccgacugccaggaccgcuccgacgaggccgacugcgacgccaucugccuccccaaccaguuccgcugcgccuccggccagugcguccucaucaagcagcagugcgacuccuuccccgacugcaucgacggcuccgacgagcucaugugcgagaucaccaagccccccuccgacgacucccccgcccacuccuccgccaucggccccgucaucggcaucauccucucccucuucgucaugggcggcgucuacuucgucugccagcgcgucgucugccagcgcuacgccggcgccaacggccccuucccccacgaguacgucuccggcaccccccacgucccccucaacuucaucgcccccggcggcucccagcacggccccuucaccggcaucgccugcggcaaguccaugauguccuccgucucccucaugggcggccgcggcggcgucccccucuacgaccgcaaccacgucaccggcgccuccuccuccuccuccuccuccaccaaggccacccucuacccccccauccucaaccccccccccucccccgccaccgaccccucccucuacaacauggacauguucuacuccuccaacauccccgccaccgcccgccccuaccgccccuacaucauccgcggcauggccccccccaccacccccugcuccaccgacgucugcgacuccgacuacuccgccucccgcuggaaggccuccaaguacuaccucgaccucaacuccgacuccgaccccuacccccccccccccaccccccacucccaguaccucuccgccgaggacuccugcccccccucccccgccaccgagcgcuccuacuuccaccucuucccccccccccccucccccugcaccgacuccuccuga

SEQ ID NO: 45506 - RNA, 4842 nt, Artificial Sequence
  derived and/or modified sequence opt2 from LRP6__Homo_sapiens__NP_002327
augggcgccguccuccgcucccuccucgccugcuccuucugcguccuccuccgcgccgccccccuccuccucuacgccaaccgccgcgaccuccgccucgucgacgccaccaacggcaaggagaacgccaccaucgucgucggcggccucgaggacgccgccgccgucgacuucgucuucucccacggccucaucuacugguccgacgucuccgaggaggccaucaagcgcaccgaguucaacaagaccgaguccguccagaacgucgucgucuccggccuccucucccccgacggccucgccugcgacuggcucggcgagaagcucuacuggaccgacuccgagaccaaccgcaucgaggucuccaaccucgacggcucccuccgcaagguccucuucuggcaggagcucgaccagccccgcgccaucgcccucgaccccuccuccggcuucauguacuggaccgacuggggcgagguccccaagaucgagcgcgccggcauggacggcuccucccgcuucaucaucaucaacuccgagaucuacuggcccaacggccucacccucgacuacgaggagcagaagcucuacugggccgacgccaagcucaacuucauccacaaguccaaccucgacggcaccaaccgccaggccgucgucaagggcucccucccccaccccuucgcccucacccucuucgaggacauccucuacuggaccgacugguccacccacuccauccucgccugcaacaaguacaccggcgagggccuccgcgagauccacuccgacaucuucucccccauggacauccacgccuucucccagcagcgccagcccaacgccaccaaccccugcggcaucgacaacggcggcugcucccaccucugccucaugucccccgucaagcccuucuaccagugcgccugccccaccggcgucaagcuccucgagaacggcaagaccugcaaggacggcgccaccgagcuccuccuccucgcccgccgcaccgaccuccgccgcaucucccucgacacccccgacuucaccgacaucguccuccagcucgaggacauccgccacgccaucgccaucgacuacgaccccgucgagggcuacaucuacuggaccgacgacgagguccgcgccauccgccgcuccuucaucgacggcuccggcucccaguucgucgucaccgcccagaucgcccaccccgacggcaucgccgucgacugggucgcccgcaaccucuacuggaccgacaccggcaccgaccgcaucgaggucacccgccucaacggcaccaugcgcaagauccucaucuccgaggaccucgaggagccccgcgccaucguccucgaccccauggucggcuacauguacuggaccgacuggggcgagauccccaagaucgagcgcgccgcccucgacggcuccgaccgcgucguccucgucaacaccucccucggcuggcccaacggccucgcccucgacuacgacgagggcaagaucuacuggggcgacgccaagaccgacaagaucgaggucaugaacaccgacggcaccggccgccgcguccucgucgaggacaagaucccccacaucuucggcuucacccuccucggcgacuacgucuacuggaccgacuggcagcgccgcuccaucgagcgcguccacaagcgcuccgccgagcgcgaggucaucaucgaccagcuccccgaccucaugggccucaaggccaccaacguccaccgcgucaucggcuccaaccccugcgccgaggagaacggcggcugcucccaccucugccucuaccgcccccagggccuccgcugcgccugccccaucggcuucgagcucaucuccgacaugaagaccugcaucguccccgaggccuuccuccucuucucccgccgcgccgacauccgccgcaucucccucgagaccaacaacaacaacgucgccaucccccucaccggcgucaaggaggccuccgcccucgacuucgacgucaccgacaaccgcaucuacuggaccgacaucucccucaagaccaucucccgcgccuucaugaacggcuccgcccucgagcacgucgucgaguucggccucgacuaccccgagggcauggccgucgacuggcucggcaagaaccucuacugggccgacaccggcaccaaccgcaucgaggucuccaagcucgacggccagcaccgccagguccucgucuggaaggaccucgacuccccccgcgcccucgcccucgaccccgccgagggcuucauguacuggaccgaguggggcggcaagcccaagaucgaccgcgccgccauggacggcuccgagcgcaccacccucguccccaacgucggccgcgccaacggccucaccaucgacuacgccaagcgccgccucuacuggaccgaccucgacaccaaccucaucgaguccuccaacaugcucggccucaaccgcgaggucaucgccgacgaccucccccaccccuucggccucacccaguaccaggacuacaucuacuggaccgacuggucccgccgcuccaucgagcgcgccaacaagaccuccggccagaaccgcaccaucauccagggccaccucgacuacgucauggacauccucgucuuccacuccucccgccaguccggcuggaacgagugcgccuccuccaacggccacugcucccaccucugccucgccguccccgucggcggcuucgucugcggcugccccgcccacuacucccucaacgccgacaaccgcaccugcuccgcccccaccaccuuccuccucuucucccagaaguccgccaucaaccgcauggucaucgacgagcagcagucccccgacaucauccuccccauccacucccuccgcaacguccgcgccaucgacuacgacccccucgacaagcagcucuacuggaucgacucccgccagaacaugauccgcaaggcccaggaggacggcucccagggcuucaccgucgucgucuccuccguccccucccagaaccucgagauccagcccuacgaccucuccaucgacaucuacucccgcuacaucuacuggaccugcgaggccaccaacgucaucaacgucacccgccucgacggccgcuccgucggcgucguccucaagggcgagcaggaccgcccccgcgccgucgucgucaaccccgagaagggcuacauguacuucaccaaccuccaggagcgcucccccaagaucgagcgcgccgcccucgacggcaccgagcgcgagguccucuucuucuccggccucuccaagcccaucgcccucgcccucgacucccgccucggcaagcucuucugggccgacuccgaccuccgccgcaucgaguccuccgaccucuccggcgccaaccgcaucguccucgaggacuccaacauccuccagcccgucggccucaccgucuucgagaacuggcucuacuggaucgacaagcagcagcagaugaucgagaagaucgacaugaccggccgcgagggccgcaccaagguccaggcccgcaucgcccagcucuccgacauccacgccgucaaggagcucaaccuccaggaguaccgccagcaccccugcgcccaggacaacggcggcugcucccacaucugccucgucaagggcgacggcaccacccgcugcuccugccccaugcaccucguccuccuccaggacgagcucuccugcggcgagccccccaccugcuccccccagcaguucaccugcuucaccggcgagaucgacugcauccccgucgccuggcgcugcgacggcuucaccgagugcgaggaccacuccgacgagcucaacugccccgucugcuccgagucccaguuccagugcgccuccggccagugcaucgacggcgcccuccgcugcaacggcgacgccaacugccaggacaaguccgacgagaagaacugcgagguccucugccucaucgaccaguuccgcugcgccaacggccagugcaucggcaagcacaagaagugcgaccacaacgucgacugcuccgacaaguccgacgagcucgacugcuaccccaccgaggagcccgccccccaggccaccaacaccgucggcuccgucaucggcgucaucgucaccaucuucgucuccggcaccgucuacuucaucugccagcgcaugcucugcccccgcaugaagggcgacggcgagaccaugaccaacgacuacgucguccacggccccgccuccgucccccucggcuacgucccccaccccuccucccucuccggcucccuccccggcaugucccgcggcaaguccaugaucuccucccucuccaucaugggcggcuccuccggcccccccuacgaccgcgcccacgucaccggcgccuccuccuccuccuccuccuccaccaagggcaccuacuuccccgccauccucaaccccccccccucccccgccaccgagcgcucccacuacaccauggaguucggcuacuccuccaacucccccuccacccaccgcuccuacuccuaccgccccuacuccuaccgccacuucgccccccccaccacccccugcuccaccgacgucugcgacuccgacuacgcccccucccgccgcaugaccuccgucgccaccgccaagggcuacaccuccgaccucaacuacgacuccgagcccgucccccccccccccaccccccgcucccaguaccucuccgccgaggagaacuacgaguccugcccccccucccccuacaccgagcgcuccuacucccaccaccucuacccccccccccccucccccugcaccgacuccuccuga

SEQ ID NO: 45507 - RNA, 1074 nt, Artificial Sequence
  derived and/or modified sequence opt2 from LRPAP1__Homo_sapiens__NP_002328
auggccccccgccgcguccgcuccuuccuccgcggccuccccgcccuccuccuccuccuccucuuccucggccccuggcccgccgccucccacggcggcaaguacucccgcgagaagaaccagcccaagcccucccccaagcgcgaguccggcgaggaguuccgcauggagaagcucaaccagcucugggagaaggcccagcgccuccaccucccccccguccgccucgccgagcuccacgccgaccucaagauccaggagcgcgacgagcucgccuggaagaagcucaagcucgacggccucgacgaggacggcgagaaggaggcccgccucauccgcaaccucaacgucauccucgccaaguacggccucgacggcaagaaggacgcccgccaggucaccuccaacucccucuccggcacccaggaggacggccucgacgacccccgccucgagaagcucuggcacaaggccaagaccuccggcaaguucuccggcgaggagcucgacaagcucuggcgcgaguuccuccaccacaaggagaagguccacgaguacaacguccuccucgagacccucucccgcaccgaggagauccacgagaacgucaucucccccuccgaccucuccgacaucaagggcuccguccuccacucccgccacaccgagcucaaggagaagcuccgcuccaucaaccagggccucgaccgccuccgccgcgucucccaccagggcuacuccaccgaggccgaguucgaggagccccgcgucaucgaccucugggaccucgcccaguccgccaaccucaccgacaaggagcucgaggccuuccgcgaggagcucaagcacuucgaggccaagaucgagaagcacaaccacuaccagaagcagcucgagaucgcccacgagaagcuccgccacgccgaguccgucggcgacggcgagcgcgucucccgcucccgcgagaagcacgcccuccucgagggccgcaccaaggagcucggcuacaccgucaagaagcaccuccaggaccucuccggccgcaucucccgcgcccgccacaacgagcucuga

SEQ ID NO: 45508 - RNA, 4185 nt, Artificial Sequence
  derived and/or modified sequence opt2 from LRPPRC__Homo_sapiens__NP_573566
auggccgcccuccuccgcuccgcccgcuggcuccuccgcgccggcgccgccccccgccucccccucucccuccgccuccuccccggcggccccggccgccuccacgccgccuccuaccuccccgccgcccgcgccggccccgucgccggcggccuccucucccccgcccgccucuacgccaucgccgccaaggagaaggacauccaggaggaguccaccuucuccucccgcaagaucuccaaccaguucgacugggcccucaugcgccucgaccucuccguccgccgcaccggccgcauccccaagaagcuccuccagaaggucuucaacgacaccugccgcuccggcggccucggcggcucccacgcccuccuccuccuccgcuccugcggcucccuccuccccgagcucaagcucgaggagcgcaccgaguucgcccaccgcaucugggacacccuccagaagcucggcgccgucuacgacgucucccacuacaacgcccuccucaaggucuaccuccagaacgaguacaaguucucccccaccgacuuccucgccaagauggaggaggccaacauccagcccaaccgcgucaccuaccagcgccucaucgccuccuacugcaacgucggcgacaucgagggcgccuccaagauccucggcuucaugaagaccaaggaccuccccgucaccgaggccgucuucuccgcccucgucaccggccacgcccgcgccggcgacauggagaacgccgagaacauccucaccgucaugcgcgacgccggcaucgagcccggccccgacaccuaccucgcccuccucaacgccuacgccgagaagggcgacaucgaccacgucaagcagacccucgagaaggucgagaaguccgagcuccaccucauggaccgcgaccuccuccagaucaucuucuccuucuccaaggccggcuacccccaguacgucuccgagauccucgagaaggucaccugcgagcgccgcuacauccccgacgccaugaaccucauccuccuccucgucaccgagaagcucgaggacgucgcccuccagauccuccucgccugccccgucuccaaggaggacggccccuccgucuucggcuccuucuuccuccagcacugcgucaccaugaacacccccgucgagaagcucaccgacuacugcaagaagcucaaggagguccagaugcacuccuucccccuccaguucacccuccacugcgcccuccucgccaacaagaccgaccucgccaaggcccucaugaaggccgucaaggaggagggcuuccccauccgcccccacuacuucuggccccuccucgucggccgccgcaaggagaagaacguccagggcaucaucgagauccucaagggcaugcaggagcucggcguccaccccgaccaggagaccuacaccgacuacgucauccccugcuucgacuccgucaacuccgcccgcgccauccuccaggagaacggcugccucuccgacuccgacauguucucccaggccggccuccgcuccgaggccgccaacggcaaccucgacuucguccucuccuuccucaaguccaacacccuccccaucucccuccaguccauccgcuccucccuccuccucggcuuccgccgcuccaugaacaucaaccucugguccgagaucaccgagcuccucuacaaggacggccgcuacugccaggagccccgcggccccaccgaggccgucggcuacuuccucuacaaccucaucgacuccauguccgacuccgagguccaggccaaggaggagcaccuccgccaguacuuccaccagcucgagaagaugaacgucaagauccccgagaacaucuaccgcggcauccgcaaccuccucgaguccuaccacguccccgagcucaucaaggacgcccaccuccucgucgaguccaagaaccucgacuuccagaagaccguccagcucaccuccuccgagcucgaguccacccucgagacccucaaggccgagaaccagcccauccgcgacguccucaagcagcucauccucguccucugcuccgaggagaacaugcagaaggcccucgagcucaaggccaaguacgaguccgacauggucaccggcggcuacgccgcccucaucaaccucugcugccgccacgacaaggucgaggacgcccucaaccucaaggaggaguucgaccgccucgacuccuccgccguccucgacaccggcaaguacgucggccucguccgcguccucgccaagcacggcaagcuccaggacgccaucaacauccucaaggagaugaaggagaaggacguccucaucaaggacaccaccgcccucuccuucuuccacaugcucaacggcgccgcccuccgcggcgagaucgagaccgucaagcagcuccacgaggccaucgucacccucggccucgccgagcccuccaccaacaucuccuucccccucgucaccguccaccucgagaagggcgaccucuccaccgcccucgaggucgccaucgacugcuacgagaaguacaagguccucccccgcauccacgacguccucugcaagcucgucgagaagggcgagaccgaccucauccagaaggccauggacuucgucucccaggagcagggcgagauggucaugcucuacgaccucuucuucgccuuccuccagaccggcaacuacaaggaggccaagaagaucaucgagacccccggcauccgcgcccgcuccgcccgccuccagugguucugcgaccgcugcgucgccaacaaccaggucgagacccucgagaagcucgucgagcucacccagaagcucuucgagugcgaccgcgaccagauguacuacaaccuccucaagcucuacaagaucaacggcgacuggcagcgcgccgacgccgucuggaacaagauccaggaggagaacgucaucccccgcgagaagacccuccgccuccucgccgagauccuccgcgagggcaaccaggagguccccuucgacguccccgagcucugguacgaggacgagaagcacucccucaacuccuccuccgccuccaccaccgagcccgacuuccagaaggacauccucaucgccugccgccucaaccagaagaagggcgccuacgacaucuuccucaacgccaaggagcagaacaucgucuucaacgccgagaccuacuccaaccucaucaagcuccucauguccgaggacuacuucacccaggccauggaggucaaggccuucgccgagacccacaucaagggcuucacccucaacgacgccgccaacucccgccucaucaucacccagguccgccgcgacuaccucaaggaggccgucaccacccucaagaccguccucgaccagcagcagacccccucccgccucgccgucacccgcgucauccaggcccucgccaugaagggcgacgucgagaacaucgaggucguccagaagaugcucaacggccucgaggacuccaucggccucuccaagauggucuucaucaacaacaucgcccucgcccagaucaagaacaacaacaucgacgccgccaucgagaacaucgagaacaugcucaccuccgagaacaaggucaucgagccccaguacuucggccucgccuaccucuuccgcaaggucaucgaggagcagcucgagcccgccgucgagaagaucuccaucauggccgagcgccucgccaaccaguucgccaucuacaagcccgucaccgacuucuuccuccagcucgucgacgccggcaaggucgacgacgcccgcgcccuccuccagcgcugcggcgccaucgccgagcagacccccauccuccuccucuuccuccuccgcaacucccgcaagcagggcaaggccuccaccgucaaguccguccucgagcucauccccgagcucaacgagaaggaggaggccuacaacucccucaugaaguccuacgucuccgagaaggacgucaccuccgccaaggcccucuacgagcaccucaccgccaagaacaccaagcucgacgaccucuuccucaagcgcuacgccucccuccucaaguacgccggcgagcccguccccuucaucgagccccccgaguccuucgaguucuacgcccagcagcuccgcaagcuccgcgagaacuccuccuga

SEQ ID NO: 45509 - RNA, 1245 nt, Artificial Sequence
  derived and/or modified sequence opt2 from LRR1__Homo_sapiens__NP_689542
augaagcuccacugcgaggucgaggucaucucccgccaccuccccgcccucggccuccgcaaccgcggcaagggcguccgcgccguccucucccucugccagcagaccucccgcucccagccccccguccgcgccuuccuccucaucuccacccucaaggacaagcgcggcacccgcuacgagcuccgcgagaacaucgagcaguucuucaccaaguucgucgacgagggcaaggccaccguccgccucaaggagccccccgucgacaucugccucuccaaggccaucuccuccucccucaagggcuuccucuccgccaugcgccucgcccaccgcggcugcaacgucgacacccccgucuccacccucacccccgucaagaccuccgaguucgagaacuucaagaccaagauggucaucaccuccaagaaggacuacccccucuccaagaacuuccccuacucccucgagcaccuccagaccuccuacugcggccucguccgcgucgacaugcgcaugcucugccucaagucccuccgcaagcucgaccucucccacaaccacaucaagaagcuccccgccaccaucggcgaccucauccaccuccaggagcucaaccucaacgacaaccaccucgaguccuucuccgucgcccucugccacuccacccuccagaagucccuccgcucccucgaccucuccaagaacaagaucaaggcccuccccguccaguucugccagcuccaggagcucaagaaccucaagcucgacgacaacgagcucauccaguuccccugcaagaucggccagcucaucaaccuccgcuuccucuccgccgcccgcaacaagcuccccuuccuccccuccgaguuccgcaaccucucccucgaguaccucgaccucuucggcaacaccuucgagcagcccaagguccuccccgucaucaagcuccaggccccccucacccuccucgaguccuccgcccgcaccauccuccacaaccgcauccccuacggcucccacaucauccccuuccaccucugccaggaccucgacaccgccaagaucugcgucugcggccgcuucugccucaacuccuucauccagggcaccaccaccaugaaccuccacuccgucgcccacaccgucguccucgucgacaaccucggcggcaccgaggcccccaucaucuccuacuucugcucccucggcugcuacgucaacuccuccgacaugcucaaguga

SEQ ID NO: 45510 - RNA, 1764 nt, Artificial Sequence
  derived and/or modified sequence opt2 from LRRC15__Homo_sapiens__NP_001128529
augccccucgacaaggccaugccccucaagcacuaccuccuccuccucgucggcugccaggccuggggcgccggccucgccuaccacggcugccccuccgagugcaccugcucccgcgccucccaggucgagugcaccggcgcccgcaucgucgccguccccaccccccuccccuggaacgccaugucccuccagauccucaacacccacaucaccgagcucaacgagucccccuuccucaacaucuccgcccucaucgcccuccgcaucgagaagaacgagcucucccgcaucacccccggcgccuuccgcaaccucggcucccuccgcuaccucucccucgccaacaacaagcuccagguccuccccaucggccucuuccagggccucgacucccucgagucccuccuccucuccuccaaccagcuccuccagauccagcccgcccacuucucccagugcuccaaccucaaggagcuccagcuccacggcaaccaccucgaguacauccccgacggcgccuucgaccaccucgucggccucaccaagcucaaccucggcaagaacucccucacccacaucuccccccgcgucuuccagcaccucggcaaccuccagguccuccgccucuacgagaaccgccucaccgacauccccaugggcaccuucgacggccucgucaaccuccaggagcucgcccuccagcagaaccagaucggccuccucucccccggccucuuccacaacaaccacaaccuccagcgccucuaccucuccaacaaccacaucucccagcucccccccuccgucuucaugcagcucccccagcucaaccgccucacccucuucggcaacucccucaaggagcucucccccggcaucuucggccccaugcccaaccuccgcgagcucuggcucuacgacaaccacaucuccucccuccccgacaacgucuucuccaaccuccgccagcuccagguccucauccucucccgcaaccagaucuccuucaucucccccggcgccuucaacggccucaccgagcuccgcgagcucucccuccacaccaacgcccuccaggaccucgacggcaacgucuuccgcaugcucgccaaccuccagaacaucucccuccagaacaaccgccuccgccagcuccccggcaacaucuucgccaacgucaacggccucauggccauccagcuccagaacaaccagcucgagaaccucccccucggcaucuucgaccaccucggcaagcucugcgagcuccgccucuacgacaaccccuggcgcugcgacuccgacauccucccccuccgcaacuggcuccuccucaaccagccccgccucggcaccgacaccguccccgucugcuucucccccgccaacguccgcggccagucccucaucaucaucaacgucaacgucgccguccccuccguccacguccccgagguccccuccuaccccgagacccccugguaccccgacacccccuccuaccccgacaccaccuccgucuccuccaccaccgagcucaccucccccgucgaggacuacaccgaccucaccaccauccaggucaccgacgaccgcuccgucuggggcaugacccaggcccaguccggccucgccaucgccgccaucgucaucggcaucgucgcccucgccugcucccucgccgccugcgucggcugcugcugcugcaagaagcgcucccaggccguccucaugcagaugaaggcccccaacgagugcuga

SEQ ID NO: 45511 - RNA, 4098 nt, Artificial Sequence
  derived and/or modified sequence opt2 from LRRC16A__Homo_sapiens__NP_001167448
augaccgaggaguccuccgacgucccccgcgagcucaucgaguccaucaaggacgucaucggccgcaagaucaagaucuccgucaagaagaaggucaagcucgaggucaagggcgacaaggucgagaacaagguccucguccucaccuccugccgcgccuuccucgucaccgcccgcauccccaccaagcucgagcucaccuucuccuaccucgagauccacggcgucgucugcuccaaguccgcccagaugaucgucgagaccgagaagugcuccaucuccaugaagauggccucccccgaggacgucuccgagguccucgcccacaucggcaccugccuccgcaagaucuuccccggccucucccccguccgcaucaugaagaaggucuccauggagcccuccgagcgccucgccucccuccaggcccucugggacucccagaccgucgccgagcagggccccugcggcggcuucucccagauguacgccugcgucugcgacuggcucggcuucuccuaccgcgaggagguccagugggacgucgacaccaucuaccucacccaggacacccgcgagcucaaccuccaggacuucucccaccucgaccaccgcgaccucauccccaucaucgccgcccucgaguacaaccagugguucaccaagcucuccuccaaggaccucaagcucuccaccgacgucugcgagcagauccuccgcgucgucucccgcuccaaccgccucgaggagcucguccucgagaacgccggccuccgcaccgacuucgcccagaagcucgccuccgcccucgcccacaaccccaacuccggccuccacaccaucaaccucgccggcaacccccucgaggaccgcggcgucuccucccucuccauccaguucgccaagcuccccaagggccucaagcaccucaaccucuccaagaccucccucucccccaagggcgucaacucccucucccagucccucuccgccaacccccucaccgccuccacccucguccaccucgaccucuccggcaacguccuccgcggcgacgaccucucccacauguacaacuuccucgcccagcccaacgccaucguccaccucgaccucuccaacaccgagugcucccucgacauggucugcggcgcccuccuccgcggcugccuccaguaccucgccguccucaaccucucccgcaccgucuucucccaccgcaagggcaaggaggucccccccuccuucaagcaguucuucuccuccucccucgcccucaugcacaucaaccucuccggcaccaagcucucccccgagccccucaaggcccuccuccucggccucgccugcaaccacaaccucaagggcgucucccucgaccucuccaacugcgagcuccgcuccggcggcgcccagguccucgagggcugcaucgccgagauccacaacaucaccucccucgacaucuccgacaacggccucgaguccgaccucuccacccucaucgucuggcucuccaagaaccgcuccauccagcaccucgcccucggcaagaacuucaacaacaugaaguccaagaaccucacccccguccucgacaaccucguccagaugauccaggacgaggaguccccccuccagucccucucccucgccgacuccaagcucaagaccgaggucaccaucaucaucaacgcccucggcuccaacaccucccucaccaaggucgacaucuccggcaacggcaugggcgacaugggcgccaagaugcucgccaaggcccuccagaucaacaccaagcuccgcaccgucaucugggacaagaacaacaucaccgcccagggcuuccaggacaucgccgucgccauggagaagaacuacacccuccgcuucaugcccauccccauguacgacgccucccaggcccucaagaccaaccccgagaagaccgaggacgcccuccagaagaucgagaacuaccuccuccgcaaccacgagacccgcaaguaccuccaggagcaggccuaccgccuccagcagggcaucgucaccuccaccacccagcagaugaucgaccgcaucugcgucaagguccaggaccaccucaacucccuccgcaacugcggcggcgacgccauccaggaggaccucaaguccgccgagcgccucaugcgcgacgccaagaacuccaagacccuccuccccaaccucuaccacgucggcggcgccuccugggccggcgccuccggccuccucuccucccccauccaggagacccucgaguccauggccggcgaggucacccgcgucgucgacgagcagcucaaggcccuccucgaguccauggucgacgccgccgagaaccucugccccaacgucaugaagaaggcccacauccgccaggaccucauccacgccuccaccgagaagaucuccaucccccgcaccuucgucaagaacguccuccucgagcaguccggcaucgacauccucaacaagaucuccgaggucaagcucaccgucgccuccuuccucuccgaccgcaucgucgacgagauccucgacgcccucucccacugccaccacaagcucgccgaccacuucucccgccgcggcaagacccucccccagcaggagucccucgagaucgagcucgccgaggagaagcccgucaagcgcuccaucaucaccgucgaggagcucaccgagaucgagcgccucgaggaccucgacaccugcaugaugacccccaaguccaagcgcaaguccauccacucccgcaugcuccgccccgucucccgcgccuucgagauggaguucgaccucgacaaggcccucgaggagguccccauccacaucgaggacccccccuuccccucccuccgccaggagaagcgcuccuccggcuucaucuccgagcuccccuccgaggagggcaagaagcucgagcacuucaccaagcuccgccccaagcgcaacaagaagcagcagcccacccaggccgccgucugcgccgccaacaucgucucccaggacggcgagcagaacggccucaugggccgcgucgacgagggcgucgacgaguucuucaccaagaaggucaccaagauggacuccaagaagugguccacccgcggcuccgagucccacgagcucaacgagggcggcgacgagaagaagaagcgcgacucccgcaaguccuccggcuuccucaaccucaucaagucccgcuccaaguccgagcgcccccccaccauccucaugaccgaggagcccuccucccccaagggcgccguccgcuccccccccgucgacugcccccgcaaggacaccaaggccgccgagcacaacggcaacuccgagcgcaucgaggagaucaagacccccgacuccuucgaggagucccagggcgaggagaucggcaaggucgagcgcuccgacuccaaguccuccccccaggccggccgccgcuacggcguccaggucaugggcuccggccuccucgccgagaugaaggccaagcaggagaagcgcgccgccugcgcccagaagaagcucggcaacgacgccgucucccaggacuccuccucccccgcccucuccggcgucgagcgcuccgacggcggcggcgccggccuccccgagaaccgcuucggccucggcacccccgagaagaacaccaaggccgagcccaaggccgaggccggcucccgcucccgcuccuccuccuccacccccaccucccccaagccccuccuccagucccccaagcccucccucgccgcccgccccgucaucccccagaagccccgcaccgccucccgccccgacgacauccccgacucccccuccucccccaaggucgcccuccucccccccguccucaagaagguccccuccgacaaggagcgcgacggccaguccuccccccagcccuccccccgcaccuucucccaggaggucucccgccgcuccuggggccagcaggcccaggaguaccaggagcagaagcagcgcuccuccuccaaggacggccaccagggcuccaaguccaacgacuccggcgaggaggccgagaaggaguucaucuucgucuga

SEQ ID NO: 45512 - RNA, 4119 nt, Artificial Sequence
  derived and/or modified sequence opt2 from LRRC16B__Homo_sapiens__NP_612369
auggccaagcccuccgucgagcucacccgcgagcuccaggacuccauccgccgcugccucucccagggcgccguccuccagcagcaccacgucaagcucgagaccaagcccaagaaguucgaggaccgcguccucgcccucaccuccuggcgccuccaccucuuccuccucaagguccccgccaaggucgaguccuccuucaacguccucgagauccgcgccuucaacacccucucccagaaccagauccucgucgagaccgagcgcggcauggucuccaugcgccuccccuccgccgaguccgucgaccaggucacccgccacgucuccuccgcccucuccaaggucugccccggccccggcugccucauccgccgcggcaacgccgacacccccgagggcccccgcgacaccucccccaacuccgagaccuccaccuccaccacccacuccgucugcggcggcuucuccgagaccuacgccgcccucugcgacuacaacggccuccacugccgcgaggagguccagugggacgucgacaccaucuaccacgccgaggacaaccgcgaguucaaccuccucgacuucucccaccucgagucccgcgaccucgcccucauggucgccgcccucgccuacaaccagugguucaccaagcucuacugcaaggaccuccgccucggcuccgagguccucgagcagguccuccacacccucuccaaguccggcucccucgaggagcucguccucgacaacgccggccucaagaccgacuucguccagaagcucgccggcgucuucggcgagaacggcuccugcguccuccacgcccucacccucucccacaaccccaucgaggacaagggcuuccucucccucucccagcagcuccucugcuuccccuccggccucaccaagcucugccucgccaagaccgccaucuccccccgcggccuccaggcccucggccagaccuucggcgccaaccccgccuucgccuccucccuccgcuaccucgaccucuccaagaaccccggccuccucgccaccgacgaggccaacgcccucuacuccuuccucgcccagcccaacgcccucguccaccucgaccucuccggcaccgacugcgucaucgaccuccuccucggcgcccuccuccacggcugcugcucccaccucaccuaccucaaccucgcccgcaacuccugcucccaccgcaagggccgcgaggccccccccgccuucaagcaguucuucuccuccgccuacacccucucccacgucaaccucuccgccaccaagcucccccucgaggcccuccgcgcccuccuccagggccucucccucaacucccaccucuccgaccuccaccucgaccucuccuccugcgagcuccgcuccgccggcgcccaggcccuccaggagcagcucggcgccgucaccugcgucggcucccucgaccucuccgacaacggcuucgacuccgaccuccucacccucguccccgcccucggcaagaacaagucccucaagcaccucuuccucggcaagaacuucaacgucaaggccaagacccucgaggagauccuccacaagcucguccagcucauccaggaggaggacugcucccuccagucccucuccgucgccgacucccgccucaagcuccgcaccuccauccucaucaacgcccucggcuccaacaccugccucgccaaggucgaccucuccggcaacggcauggaggacaucggcgccaagaugcucuccaaggcccuccagaucaacuccucccuccgcaccauccucugggaccgcaacaacaccuccgcccucggcuuccucgacaucgcccgcgcccucgaguccaaccacacccuccgcuucauguccuuccccgucuccgacaucucccaggccuaccgcuccgcccccgagcgcaccgaggacgucuggcagaagauccaguggugccucguccgcaacaaccacucccagaccugcccccaggagcaggccuuccgccuccagcagggccucgucaccuccuccgccgagcagaugcuccagcgccucugcggccgcguccaggaggagguccgcgcccuccgccucugcccccucgagcccguccaggacgagcuccucuacgcccgcgaccucaucaaggacgccaagaacucccgcgcccucuuccccucccucuacgagcucggccacguccucgccaacgacggccccguccgccagcgccucgaguccgucgccuccgaggucuccaaggccgucgacaaggagcuccaggucauccucgaguccauggucucccucacccaggagcucugccccgucgccaugcgcgucgccgagggccacaacaagaugcucuccaacgucgccgagcgcgucaccgucccccgcaacuucauccgcggcgcccuccucgagcaggccggccaggacauccagaacaagcucgacgaggucaagcucuccgucgucaccuaccucaccuccuccaucgucgacgagauccuccaggagcucuaccacucccacaagucccucgcccgccaccucacccagcuccgcacccucuccgacccccccggcugccccggccagggccaggaccucuccucccgcggccgcggccgcaaccacgaccacgaggagaccaccgacgacgagcucggcaccaacaucgacaccauggccaucaagaagcagaagcgcugccgcaagauccgccccgucuccgccuucaucuccggcuccccccaggacauggagucccagcucggcaaccucggcaucccccccggcugguucuccggccucggcggcucccagcccaccgccuccggcuccugggagggccucuccgagcuccccacccacggcuacaagcuccgccaccagacccagggccgcccccgccccccccgcaccaccccccccggccccggccgccccuccaugcccgcccccggcacccgccaggagaacggcauggccacccgccucgacgagggccucgaggacuucuucucccgccgcguccucgaggaguccuccuccuacccccgcacccuccgcaccguccgccccggccucuccgaggccccccuccccccccuccagaagaagcgccgccgcggccucuuccacuuccgccgcccccgcuccuucaagggcgaccgcggccccggcucccccaccaccggccuccuccucccccccccccccccccccccccccacccaggaguccccccccucccccgacccccccucccucggcaacaacuccucccccugcuggucccccgaggaggaguccucccuccuccccggcuucggcggcggccgcggccccuccuuccgccgcaagaugggcaccgagggcuccgagcccggcgagggcggccccgcccccggcaccgcccagcagccccgcguccacggcgucgcccuccccggccucgagcgcgccaagggcugguccuucgacggcaagcgcgagggccccggccccgaccaggagggcuccacccaggccuggcagaagcgccgcuccuccgacgacgccggccccggcuccuggaagccccccccccccccccaguccaccaagcccuccuucuccgccaugcgccgcgccgaggccaccuggcacaucgccgaggaguccgcccccaaccacuccugccagucccccucccccgccucccaggacggcgaggaggagaaggagggcacccucuuccccgagcgcacccuccccgcccgcaacgccaagcuccaggaccccgcccucgcccccuggccccccaagcccgucgccgucccccgcggccgccagcccccccaggagcccggcguccgcgaggaggccgaggccggcgacgccgcccccggcgucaacaagccccgccuccgccucuccucccagcaggaccaggaggagcccgagguccagggcccccccgaccccggccgccgcaccgccccccucaagcccaagcgcacccgccgcgcccaguccugcgacaagcucgagcccgaccgccgccgcccccccgaccccaccggcaccuccgagcccggcaccgacuga

SEQ ID NO: 45513 - RNA, 942 nt, Artificial Sequence
  derived and/or modified sequence opt2 from LRRC17__Homo_sapiens__NP_005815
augcgcgucgucaccaucgucauccuccucugcuucugcaaggccgccgagcuccgcaaggccucccccggcuccguccgcucccgcgucaaccacggccgcgccggcggcggccgccgcggcuccaaccccgucaagcgcuacgcccccggccuccccugcgacgucuacaccuaccuccacgagaaguaccucgacugccaggagcgcaagcucgucuacguccuccccggcuggccccaggaccuccuccacaugcuccucgcccgcaacaagauccgcacccucaagaacaacauguucuccaaguucaagaagcucaagucccucgaccuccagcagaacgagaucuccaagaucgaguccgaggccuucuucggccucaacaagcucaccacccuccuccuccagcacaaccagaucaagguccucaccgaggaggucuucaucuacaccccccuccucuccuaccuccgccucuacgacaaccccuggcacugcaccugcgagaucgagacccucaucuccaugcuccagaucccccgcaaccgcaaccucggcaacuacgccaagugcgaguccccccaggagcagaagaacaagaagcuccgccagaucaaguccgagcagcucugcaacgaggaggagaaggagcagcucgaccccaagccccaggucuccggccgcccccccgucaucaagcccgaggucgacuccaccuucugccacaacuacgucuuccccauccagacccucgacugcaagcgcaaggagcucaagaagguccccaacaacaucccccccgacaucgucaagcucgaccucuccuacaacaagaucaaccagcuccgccccaaggaguucgaggacguccacgagcucaagaagcucaaccucuccuccaacggcaucgaguucaucgaccccggcucccuccgcuga

SEQ ID NO: 45514 - RNA, 786 nt, Artificial Sequence
  derived and/or modified sequence opt2 from LRRC18__Homo_sapiens__XP_011538131
auggucaagggcgagaagggccccaagggcaagaagaucacccucaaggucgcccgcaacugcaucaagaucaccuucgacggcaagaagcgccucgaccucuccaagaugggcaucaccaccuuccccaagugcauccuccgccucuccgacauggacgagcucgaccucucccgcaaccucauccgcaagauccccgacuccaucuccaaguuccagaaccuccgcuggcucgaccuccacuccaacuacaucgacaagcuccccgaguccaucggccagaugaccucccuccucuaccucaacgucuccaacaaccgccucaccuccaacggccuccccgucgagcucaagcagcucaagaacauccgcgccgucaaccucggccucaaccaccucgacuccguccccaccacccucggcgcccucaaggagcuccacgaggucggccuccacgacaaccuccucaacaacauccccgucuccaucuccaagcuccccaagcucaagaagcucaacaucaagcgcaaccccuuccccaagcccggcgaguccgagaucuucaucgacuccauccgccgccucgagaaccucuacgucgucgaggagaaggaccucugcgccgccugccuccgcaagugccagaacgcccgcgacaaccucaaccgcaucaagaacauggccaccaccaccccccgcaagaccaucuuccccaaccucaucucccccaacuccauggccaaggacuccugggaggacuggcgcauccgccucaccuccuccuga

SEQ ID NO: 45515 - RNA, 1575 nt, Artificial Sequence
  derived and/or modified sequence opt2 from LRRC1__Homo_sapiens__NP_060684
auguuccacugcaucccccucuggcgcugcaaccgccacgucgaguccaucgacaagcgccacugcucccucgucuacguccccgaggagaucuaccgcuacgcccgcucccucgaggagcuccuccucgacgccaaccagcuccgcgagcuccccgagcaguucuuccagcucgucaagcuccgcaagcucggccucuccgacaacgagauccagcgccucccccccgagaucgccaacuucaugcagcucgucgagcucgacgucucccgcaacgagauccccgagauccccgaguccaucuccuucugcaaggcccuccaggucgccgacuucuccggcaacccccucacccgccuccccgaguccuuccccgagcuccagaaccucaccugccucuccgucaacgacaucucccuccagucccuccccgagaacaucggcaaccucuacaaccucgccucccucgagcuccgcgagaaccuccucaccuaccuccccgacucccucacccagcuccgccgccucgaggagcucgaccucggcaacaacgagaucuacaaccuccccgaguccaucggcgcccuccuccaccucaaggaccucuggcucgacggcaaccagcucuccgagcucccccaggagaucggcaaccucaagaaccuccucugccucgacgucuccgagaaccgccucgagcgccuccccgaggagaucuccggccucaccucccucaccgaccucgucaucucccagaaccuccucgagaccauccccgacggcaucggcaagcucaagaagcucuccauccucaaggucgaccagaaccgccucacccagcuccccgaggccgucggcgagugcgagucccucaccgagcucguccucaccgagaaccagcuccucacccuccccaaguccaucggcaagcucaagaagcucuccaaccucaacgccgaccgcaacaagcucgucucccuccccaaggagaucggcggcugcugcucccucaccgucuucugcguccgcgacaaccgccucacccgcauccccgccgaggucucccaggccaccgagcuccacguccucgacgucgccggcaaccgccuccuccaccucccccucucccucaccgcccucaagcucaaggcccucuggcucuccgacaaccagucccagccccuccucaccuuccagaccgacaccgacuacaccaccggcgagaagauccucaccugcguccuccucccccagcuccccuccgagcccaccugccaggagaaccucccccgcugcggcgcccucgagaaccucgucaacgacgucuccgacgaggccuggaacgagcgcgccgucaaccgcgucuccgccauccgcuucgucgaggacgagaaggacgaggaggacaacgagacccgcacccuccuccgccgcgccaccccccaccccggcgagcucaagcacaugaagaagaccgucgagaaccuccgcaacgacaugaacgccgccaagggccucgacuccaacaagaacgaggucaaccacgccaucgaccgcgucaccaccuccgucuga

SEQ ID NO: 45516 - RNA, 555 nt, Artificial Sequence
  derived and/or modified sequence opt2 from LRRC20__Homo_sapiens__NP_001265141
augcucaagaagaugggcgaggccgucgcccgcgucgcccgcaaggucaacgagaccgucgaguccggcuccgacacccucgaccucgccgagugcaagcucgucuccuuccccaucggcaucuacaagguccuccgcaacgucuccggccagauccaccucaucacccucgccaacaacgagcucaagucccucaccuccaaguucaugaccaccuucucccagcuccgcgagcuccaccucgagggcaacuuccuccaccgccuccccuccgaggucuccgcccuccagcaccucaaggccaucgaccucucccgcaaccaguuccaggacuuccccgagcagcucaccgcccuccccgcccucgagaccaucaaccucgaggagaacgagaucgucgacguccccgucgagaagcucgccgccaugcccgcccuccgcuccaucaaccuccgcuucaacccccucaacgccgagguccgcgucaucgcccccccccucaucaaguucgacaugcucaugucccccgagggcgcccgcgccccccuccccuga

SEQ ID NO: 45517 - RNA, 1005 nt, Artificial Sequence
  derived and/or modified sequence opt2 from LRRC26__Homo_sapiens__NP_001013675
augcgcggccccuccuggucccgcccccgcccccuccuccuccuccuccuccuccucucccccuggcccgucugggcccaggucuccgccaccgccucccccuccggcucccucggcgcccccgacugccccgaggucugcaccugcguccccggcggccucgccuccugcuccgcccucucccuccccgccgucccccccggccucucccuccgccuccgcgcccuccuccucgaccacaaccgcguccgcgcccucccccccggcgccuucgccggcgccggcgcccuccagcgccucgaccuccgcgagaacggccuccacuccguccacguccgcgccuucuggggccucggcgcccuccagcuccucgaccucuccgccaaccagcucgaggcccucgcccccggcaccuucgccccccuccgcgcccuccgcaaccucucccucgccggcaaccgccucgcccgccucgagcccgccgcccucggcgcccucccccuccuccgcucccucucccuccaggacaacgagcucgccgcccucgcccccggccuccucggccgccuccccgcccucgacgcccuccaccuccgcggcaaccccuggggcugcggcugcgcccuccgcccccucugcgccuggcuccgccgccacccccuccccgccuccgaggccgagaccguccucugcgucuggcccggccgccucacccucuccccccucaccgccuucuccgacgccgccuucucccacugcgcccagccccucgcccuccgcgaccucgccgucgucuacacccucggccccgccuccuuccucgucucccucgccuccugccucgcccucggcuccggccucaccgccugccgcgcccgccgccgccgccuccgcaccgccgcccuccgccccccccgcccccccgaccccaaccccgaccccgacccccacggcugcgccucccccgccgaccccggcucccccgccgccgccgcccaggccuga

SEQ ID NO: 45518 - RNA, 906 nt, Artificial Sequence
  derived and/or modified sequence opt2 from LRRC30__Homo_sapiens__NP_001099051
augggcgcccgccagucccgcgccuccuccaaggacaagggccccaagcgcaugcucuucaccggccgccgccagaaguucucccccugggacgacgcccuccucuccggccgcgacccccgcucccuccucaagcgcggcaugcaccacgucuccuucucccucgucacccgcggcaugaccgacauccccgacuuccucuggggccucuccgagguccagaagcucaaccucucccacaaccagcuccgcguccucccccccgaggucggcaagcucacccgcaucgucguccucaaccucugcggcaaccgccucaagucccucccccgcgaggucucccuccuccagugccucaagguccucuucgucaacaugaacugccucaccgagguccccgccgagcucucccucugccgcaagcucgagguccucucccucucccacaacugccucucccagcuccccgccugcuucgccgaccucucccgccuccgcaagcucaaccucuccaacaacuucuucgcccacauccccaugugcgucuucucccucaaggagcucaucuuccuccacgucggcuccaaccgccucgagaacaucgccgaguccauccagcaccucgccucccuccagaucuucaucgccgagggcaacaacauccacuccuucccccgcucccucugccucgucaccucccucgagcuccucaaccucaacaacaacgacauccagacccuccccuccgagcuccaccuccucugccgccucguccgcaucgccuggaaccccauggacaagggccuccacaucucccacaacccccucuccaagccccuccccgagcucgucgagggcggccucgagaugcucuucggcuaccucaaggacaagaagcacaccuga

SEQ ID NO: 45519 - RNA, 1989 nt, Artificial Sequence
  derived and/or modified sequence opt2 from LRRC32__Homo_sapiens__XP_005273959
augcgcccccagauccuccuccuccucgcccuccucacccucggccucgccgcccagcaccaggacaagguccccugcaagauggucgacaagaaggucuccugccagguccucggccuccuccagguccccuccguccucccccccgacaccgagacccucgaccucuccggcaaccagcuccgcuccauccucgccuccccccucggcuucuacaccgcccuccgccaccucgaccucuccaccaacgagaucuccuuccuccagcccggcgccuuccaggcccucacccaccucgagcaccucucccucgcccacaaccgccucgccauggccaccgcccucuccgccggcggccucggcccccucccccgcgucaccucccucgaccucuccggcaacucccucuacuccggccuccucgagcgccuccucggcgaggcccccucccuccacacccucucccucgccgagaacucccucacccgccucacccgccacaccuuccgcgacaugcccgcccucgagcagcucgaccuccacuccaacguccucauggacaucgaggacggcgccuucgagggccucccccgccucacccaccucaaccucucccgcaacucccucaccugcaucuccgacuucucccuccagcagcuccgcguccucgaccucuccugcaacuccaucgaggccuuccagaccgccucccagccccaggccgaguuccagcucaccuggcucgaccuccgcgagaacaagcuccuccacuuccccgaccucgccgcccucccccgccucaucuaccucaaccucuccaacaaccucauccgccuccccaccggccccccccaggacuccaagggcauccacgcccccuccgagggcugguccgcccucccccucuccgcccccuccggcaacgccuccggccgcccccucucccagcuccucaaccucgaccucuccuacaacgagaucgagcucauccccgacuccuuccucgagcaccucaccucccucugcuuccucaaccucucccgcaacugccuccgcaccuucgaggcccgccgccucggcucccuccccugccucaugcuccucgaccucucccacaacgcccucgagacccucgagcucggcgcccgcgcccucggcucccuccgcacccuccuccuccagggcaacgcccuccgcgaccucccccccuacaccuucgccaaccucgccucccuccagcgccucaaccuccagggcaaccgcgucucccccugcggcggccccgacgagcccggccccuccggcugcgucgccuucuccggcaucaccucccuccgcucccucucccucgucgacaacgagaucgagcuccuccgcgccggcgccuuccuccacaccccccucaccgagcucgaccucuccuccaaccccggccucgaggucgccaccggcgcccucggcggccucgaggccucccucgagguccucgcccuccagggcaacggccucaugguccuccaggucgaccuccccugcuucaucugccucaagcgccucaaccucgccgagaaccgccucucccaccuccccgccuggacccaggccgucucccucgagguccucgaccuccgcaacaacuccuucucccuccuccccggcuccgccaugggcggccucgagaccucccuccgccgccucuaccuccagggcaacccccucuccugcugcggcaacggcuggcucgccgcccagcuccaccagggccgcgucgacgucgacgccacccaggaccucaucugccgcuucuccucccaggaggaggucucccucucccacguccgccccgaggacugcgagaagggcggccucaagaacaucaaccucaucaucauccucaccuucauccucgucuccgccauccuccucaccacccucgccgccugcugcugcguccgccgccagaaguucaaccagcaguacaaggccuga

SEQ ID NO: 45520 - RNA, 5103 nt, Artificial Sequence
  derived and/or modified sequence opt2 from LRRC37A__Homo_sapiens__NP_055649
auguccuccgcccagugccccgcccucgucugcgucaugucccgccuccgcuucuggggccccuggccccuccucauguggcagcuccucuggcuccucgucaaggaggcccagccccucgagugggucaaggacccccuccagcucaccuccaacccccucggcccccccgaguccugguccucccacuccucccacuucccccgcgaguccccccacgcccccacccuccccgccgaccccugggacuucgaccaccucggccccuccgccuccuccgagaugcccgcccccccccaggaguccaccgagaaccucguccccuuccucgacaccugggacuccgccggcgagcagccccucgagcccgagcaguuccucgccucccagcaggaccucaaggacaagcucuccccccaggagcgccuccccgucucccccaagaagcucaagaaggaccccgcccagcgcuggucccucgccgagaucaucggcaucacccgccagcucuccaccccccagucccagaagcagacccuccagaacgaguacuccuccaccgacacccccuaccccggcucccucccccccgagcuccgcgucaaguccgacgagccccccggccccuccgagcaggucggccccucccaguuccaccucgagcccgagacccagaaccccgagacccucgaggacauccaguccuccucccuccagcaggaggcccccgcccagcucccccagcuccucgaggaggagcccuccuccaugcagcaggaggcccccgcccucccccccgaguccuccauggagucccucacccuccccaaccacgaggucuccguccagccccccggcgaggaccaggccuacuaccaccuccccaacaucaccgucaagcccgccgacgucgaggucaccaucaccuccgagcccaccaacgagaccgaguccucccaggcccagcaggagacccccauccaguuccccgaggaggucgagcccuccgccacccagcaggaggcccccaucgagccccccgucccccccauggagcacgagcucuccaucuccgagcagcagcagcccguccagcccuccgaguccccccgcgaggucgaguccucccccacccagcaggagacccccggccagccccccgagcaccacgaggucaccgucuccccccccggccaccaccagacccaccaccucgccucccccuccgucuccgucaagccccccgacguccagcucaccaucgccgccgagcccuccgccgaggucggcaccucccucguccaccaggaggccaccacccgccucuccggcuccggcaacgacgucgagccccccgccauccagcacggcggccccccccuccuccccgaguccuccgaggaggccggcccccucgccguccagcaggagaccuccuuccagucccccgagcccaucaacaacgagaaccccucccccacccagcaggaggccgccgccgagcacccccagaccgccgaggagggcgaguccucccucacccaccaggaggcccccgcccagacccccgaguuccccaacgucgucgucgcccagccccccgagcacucccaccucacccaggccaccguccagccccucgaccucggcuucaccaucacccccgaguccaagaccgaggucgagcucucccccaccaugaaggagacccccacccagccccccaagaaggucgucccccagcuccgcgucuaccagggcgucaccaaccccacccccggccaggaccaggcccagcaccccgucucccccuccgucaccguccagcuccucgaccucggccucaccaucacccccgagcccaccaccgaggucggccacuccaccccccccaagcgcaccaucgucucccccaagcaccccgaggucacccucccccaccccgaccagguccagacccagcacucccaccucacccgcgccaccguccagccccucgaccucggcuucaccaucacccccaaguccaugaccgaggucgagcccuccaccgcccucaugaccaccgcccccccccccggccaccccgaggucacccucccccccuccgacaagggccaggcccagcacucccaccucacccaggccaccguccagccccucgaccucgagcucaccaucaccaccaagcccaccaccgaggucaagcccucccccaccaccgaggagaccuccacccagccccccgaccucggccucgccaucauccccgagcccaccaccgagaccggccacuccaccgcccucgagaagaccaccgccccccgccccgaccgcguccagacccuccaccgcucccucaccgaggucaccggcccccccaccgagcucgagcccgcccaggacucccucguccaguccgaguccuacacccagaacaaggcccucaccgcccccgaggagcacaaggccuccaccuccaccaacaucugcgagcucugcaccugcggcgacgagaugcucuccugcaucgaccucaaccccgagcagcgccuccgccagguccccguccccgagcccaacacccacaacggcaccuucaccauccucaacuuccagggcaacuacaucuccuacaucgacggcaacgucuggaaggccuacuccuggaccgagaagcucauccuccgcgagaacaaccucaccgagcuccacaaggacuccuucgagggccuccucucccuccaguaccucgaccucuccugcaacaagauccaguccaucgagcgccacaccuucgagccccuccccuuccucaaguucaucaaccucuccugcaacgucaucaccgagcucuccuucggcaccuuccaggccuggcacggcaugcaguuccuccacaagcucauccucaaccacaacccccucaccaccgucgaggaccccuaccucuucaagcuccccgcccucaaguaccucgacaugggcaccacccucgucccccucaccacccucaagaacauccucaugaugaccgucgagcucgagaagcucauccuccccucccacauggccugcugccucugccaguucaagaacuccaucgaggccgucugcaagaccgucaagcuccacugcaacuccgccugccucaccaacaccacccacugccccgaggaggccuccgucggcaaccccgagggcgccuucaugaagguccuccaggcccgcaagaacuacaccuccaccgagcucaucgucgagcccgaggagcccuccgacuccuccggcaucaaccucuccggcuucggcuccgagcagcucgacaccaacgacgaguccgacuucaucuccacccucuccuacauccuccccuacuucuccgccgucaaccucgacgucaagucccuccuccuccccuucaucaagcuccccaccaccggcaacucccucgccaagauccagaccgucggccagaaccgccagcgcgucaagcgcguccucaugggcccccgcuccauccagaagcgccacuucaaggaggucggccgccaguccauccgccgcgagcagggcgcccaggccuccgucgagaacgccgccgaggagaagcgccucaccucccccgccccccgcgaggucgagcagccccacacccagcagggccccgagaagcucgccggcaacgccgucuacaccaagcccuccuucacccaggagcacaaggccgccgucuccguccucaagcccuucuccaagggcacccccuccaccuccucccccgccaaggcccucccccagguccgcgaccgcuccaaggaccucacccacgccaucuccauccucgaguccgccaaggcccgcgucaccaacaccaagaccuccaagcccaucguccacgcccgcaagaaguaccgcuuccacaagacccgcucccacgucacccaccgcaccaccaaggucaagaagucccccaagguccgcaagaaguccuaccucucccgccucaugcucgccaaccgccuccccuucuccgccgccaagucccucaucaacucccccucccagggcgccuucuccucccucggcgaccucuccccccaggagaaccccuuccucgaggucuccgcccucuccgagcacuucaucgagaagaacaacaccaagcacaccaccgcccgcaacgccuucgaggagaacgacuucauggagaacaccaacaugcccgagggcaccaucuccgagaacaccaacuacaaccacccccccgaggccgacuccgccggcaccgccuucaaccucggccccaccgucaagcagaccgagaccaagugggaguacaacaacgucggcaccgaccucucccccgagcccaaguccuucaacuacccccuccucuccucccccggcgaccaguucgagauccagcucacccagcagcuccagucccucauccccaacaacaacguccgccgccucaucgcccacgucauccgcacccucaagauggacugcuccggcgcccacguccaggucaccugcgccaagcucaucucccgcaccggccaccucaugaagcuccucuccggccagcaggaggucaaggccuccaagaucgagugggacaccgaccaguggaagaucgagaacuacaucaacgaguccaccgaggcccaguccgagcagaaggagaagucccucgagcucaagaaggagguccccggcuacggcuacaccgacaagcucauccucgcccucaucgucaccggcauccucaccauccucaucauccucuucugccucaucgucaucugcugccaccgccgcucccuccaggaggacgaggagggcuucucccgcggcaucuuccgcuuccuccccuggcgcggcugcuccucccgccgcgagucccaggacggccucuccuccuucggccagccccucugguucaaggaccucuacaagccccucuccgccacccgcaucaacaaccacgccuggaagcuccacaagaaguccuccaacgaggacaagauccucaaccgcgaccccggcgacuccgaggcccccaccgaggaggaggaguccgaggcccuccccuga

SEQ ID NO: 45521 - RNA, 2844 nt, Artificial Sequence
  derived and/or modified sequence opt2 from LRRC37B__Homo_sapiens__NP_443120
auguccuggcuccgcuucuggggccccuggccccuccucaccuggcagcuccucucccuccucgucaaggaggcccagccccucgucugggucaaggacccccuccagcucaccuccaacccccucggcccccccgagcccugguccucccgcuccucccaccuccccugggaguccccccacgcccccgccccccccgccgcccccggcgacuucgacuaccucggccccuccgccuccucccagauguccgcccucccccaggagcccaccgagaaccucgcccccuuccucaaggagcucgacuccgccggcgagcucccccucggccccgagcccuuccucgccgcccaccaggaccucaacgacaagcgcacccccgaggagcgccuccccgaggucgucccccuccucaaccgcgaccagaaccaggcccucguccagcucccccgccucaaguggguccagaccaccgaccucgaccgcgccgccggccaccaggccgacgagauccucgucccccucgacuccaaggucucccgccccaccaaguucgucgucucccccaagaaccucaagaaggaccucgccgagcgcuggucccuccccgagaucgucggcaucccccaccagcucuccaagccccagcgccagaagcagacccuccccgacgacuaccucuccauggacacccucuaccccggcucccucccccccgagcuccgcgucaacgccgacgagccccccggcccccccgagcaggucggccucucccaguuccaccucgagcccaagucccagaaccccgagacccucgaggacauccaguccuccucccuccaggaggaggcccccgcccagcuccuccagcucccccaggaggucgagcccuccacccagcaggaggcccccgcccucccccccgaguccuccauggagucccucgcccagaccccccucaaccacgaggucaccguccagccccccggcgaggaccaggcccacuacaaccuccccaaguucaccgucaagcccgccgacgucgaggucaccaugaccuccgagcccaagaacgagaccgaguccacccaggcccagcaggaggcccccauccagccccccgaggaggccgagcccuccuccaccgcccuccgcaccaccgaccccccccccgagcaccccgaggucacccucccccccuccgacaagggccaggcccagcacucccaccucaccgaggccaccguccagccccucgaccucgagcucuccaucaccaccgagcccaccaccgaggucaagcccucccccaccaccgaggagaccuccgcccagccccccgaccccggccucgccaucacccccgagcccaccaccgagaucggccacuccaccgcccucgagaagacccgcgccccccaccccgaccagguccagacccuccaccgcucccucaccgaggucaccggcccccccaccaagcucgaguccucccaggacucccucguccaguccgagaccgcccccgaggagcagaaggccuccaccuccaccaacaucugcgagcucugcaccugcggcgacgagacccucuccugcgucggccucucccccaagcagcgccuccgccagguccccguccccgagcccgacaccuacaacggcaucuucaccacccucaacuuccagggcaacuacaucuccuaccucgacggcaacgucuggaaggccuacuccuggaccgagaagcucauccucuccgagaacuaccucaccgagcuccccaaggacuccuucgagggccuccucuaccuccaguaccucgaccucuccugcaacaagauccgcuacaucgagcgccagaccuucgagucccuccccuuccuccaguacaucaaccucggcugcaaccucaucaccaagcucucccucggcaccuuccaggccuggcacggcaugcaguuccuccacaaccucauccucaaccgcaacccccucaccaccgucgaggaccccuaccucuucgagcuccccgcccucaaguaccucgacaugggcaccacccacaucacccucaccacccucaagaacauccucaccaugaccgucgagcucgagaagcucauccuccccucccacauggccugcugccucugccaguucaagaacuccaucgaggccgucugcaagaccgucaagcuccacugcaacaccgccugccucaccaacuccauccacugccccgaggaggccuccgucggcaaccccgagggcgccuucaugaagaugcuccaggcccgcaagcagcacauguccacccagcucaccaucgaguccgaggcccccuccgacuccuccggcaucaaccucuccggcuucggcggcgaccagcucgagauccagcucaccgagcagcuccgcucccucauccccaacgaggacguccgcaaguucaugucccacgucauccgcacccucaagauggagugcuccgagacccacguccagggcuccugcgccaagcucaugcuccgcaccggccuccucaugaagcuccucuccgagcagcaggaggccaaggcccucaacgucgagugggacaccgaccagcagaagaccaacuacaucaacgagaacauggagcagaacgagcagaaggagcagaaguccuccgagcucaugaaggagguccccggcgacgacuacaagaacaagcucaucuucgccaucuccgucaccgucauccucaucauccucaucaucaucuucugccucaucgaggucaacucccacaagcgcgccuccgagaaguacaaggacaaccccuccaucuccggcgccuga

SEQ ID NO: 45522 - RNA, 1008 nt, Artificial Sequence
  derived and/or modified sequence opt2 from LRRC39__Homo_sapiens__XP_011538980
augaccgagaacgucgucugcaccggcgccgucaacgccgucaaggaggucugggagaagcgcaucaagaagcucaacgaggaccucaagcgcgagaaggaguuccagcacaagcucguccgcaucugggaggagcgcgucucccucaccaagcuccgcgagaaggucacccgcgaggacggccgcgucauccucaagaucgagaaggaggaguggaagacccuccccuccucccuccucaagcucaaccagcuccaggaguggcagcuccaccgcaccggccuccucaagauccccgaguucaucggccgcuuccagaaccucaucguccucgaccucucccgcaacaccaucuccgagaucccccccggcaucggccuccucacccgccuccaggagcucauccucuccuacaacaagaucaagaccguccccaaggagcucuccaacugcgccucccucgagaagcucgagcucgccgucaaccgcgacaucugcgaccucccccaggagcucuccaaccuccucaagcucacccaccucgaccucuccaugaacgacuucaccaccaucccccucgccguccucaacaugcccgcccucgaguggcucgacaugggcuccaacaagcucgagcagcuccccgacaccaucgagcgcaugcagaaccuccacacccucuggcuccagcgcaacgagaucaccugccucccccagaccaucuccaacaugaagaaccucggcacccucguccucuccaacaacaagcuccaggacauccccgucugcauggaggagauggccaaccuccgcuucgucaacuuccgcgacaacccccucaagcucaaggucucccucccccccuccgagggcaccgacgaggaggaggagcgcgagcucuucggccuccaguucaugcacaccuacauccaggagucccgccgccgcgccgaccaccaggucaacggcuccaccacccuccccaucuccaucaacaccgacggcuga

SEQ ID NO: 45523 - RNA, 2061 nt, Artificial Sequence
  derived and/or modified sequence opt2 from LRRC49__Homo_sapiens__NP_060161
augauccccggcaaguaccgcuccgucuccggccgcgccgccaacaacgucaacugcggccuccaccucgucauccagaccuccucccuccccgagaagaacaaggucgaguucaagcucaacaaggacaccuccuccuuccccggccgccuccuccagcacgaccucgagcgcaacuacuccucccgccagggcgaccacaucaaccucgucuccuccucccucuccuccuuccccauccuccagcgcuccuccgaggagaagauccucuacuccgaccgccucucccucgagcgccagaagcucaccgucugccccaucaucaacggcgaggaccaccuccgccuccucaacuuccagcacaacuucaucacccgcauccagaacaucuccaaccuccagaagcucaucucccucgaccucuacgacaaccagaucgaggagaucuccggccucuccacccuccgcugccuccgcguccuccuccucggcaagaaccgcaucaagaagaucuccaaccucgagaaccucaagucccucgacguccucgaccuccacggcaaccagaucaccaagaucgagaacaucaaccaccucugcgagcuccgcguccucaaccucgcccgcaacuuccucucccacgucgacaaccucaacggccucgacucccucaccgagcucaaccuccgccacaaccagaucaccuucguccgcgacgucgacaaccuccccugccuccagcaccucuuccucuccuucaacaacaucuccuccuucgacuccgucuccugccucgccgacuccuccucccucuccgacaucaccuucgacggcaaccccaucgcccaggaguccugguacaagcacaccguccuccagaacaugaugcagcuccgccagcucgacaugaagcgcaucaccgaggaggagcgccgcauggccuccguccucgccaagaaggaggaggagaagaagcgcgagucccacaagcagucccuccucaaggagaagaagcgccucaccaucaacaacgucgcccgccagugggaccuccagcagcagcgcgucgccaacaucgccaccaacgaggaccgcaaggacuccgacuccccccaggaccccugccagaucgacggcuccacccucuccgccuuccccgaggagaccggcccccucgacuccggccucaacaacgcccuccagggccucuccgucaucgacaccuaccucgucgaggucgacggcgacacccucucccucuacggcuccggcgcccucgagucccucgaccgcaacugguccguccagaccgccggcaugaucaccaccgucuccuucaccuucaucgaguucgacgagaucguccagguccuccccaagcucaagaucaaguuccccaacucccuccaccucaaguucaaggagaccaaccucgucaugcuccagcaguucaacgcccucgcccagcuccgccgcaucgaccagcucaccaucgacccccagggcaaccccgucgucaacuucacccucuggaaguacuacguccucuuccgccucucccacuucuccaugcagaagaucaacggcaccgaggucacccagaacgacaugaucauggccgagcgccucuucggcauccucgcccacgucgccuccuccgagcucccccaguaccgccucaucuccauccucggcgacgcccgcaagaagcaguuccgcuaccuccucgaguccaagggcaagaagcccggcaucaucaacgaggagaacaacgacuccaagcgccucgucggcgagaacaccaaccgcgccacccucaacuacaccacccgcgacuucuacaacgagaagcucgaggagaucaaggagaagaagaaguucugcaagaccuacaucgaggaccucgucaaggaggccaccgagaucaacaugaagaacgaggcccuccagaagcucuggccccagauguucaucgagcucguccgcgacgccgucaucgagauccgcaacaagaacuccuacaugaagcucugccuccagcagaucaccgaccagaaguga

SEQ ID NO: 45524 - RNA, 2142 nt, Artificial Sequence
  derived and/or modified sequence opt2 from LRRC4B__Homo_sapiens__XP_011525822
auggcccgcgcccgcggcucccccugccccccccucccccccggccgcauguccuggccccacggcgcccuccucuuccucuggcucuucucccccccccucggcgccggcggcggcggcgucgccgucaccuccgccgccggcggcggcuccccccccgccaccuccugccccgucgccugcuccugcuccaaccaggccucccgcgucaucugcacccgccgcgaccucgccgagguccccgccuccauccccgucaacacccgcuaccucaaccuccaggagaacggcauccaggucauccgcaccgacaccuucaagcaccuccgccaccucgagauccuccagcucuccaagaaccucguccgcaagaucgaggucggcgccuucaacggccuccccucccucaacacccucgagcucuucgacaaccgccucaccaccguccccacccaggccuucgaguaccucuccaagcuccgcgagcucuggcuccgcaacaaccccaucgaguccauccccuccuacgccuucaaccgcguccccucccuccgccgccucgaccucggcgagcucaagcgccucgaguacaucuccgaggccgccuucgagggccucgucaaccuccgcuaccucaaccucggcaugugcaaccucaaggacauccccaaccucaccgcccucguccgccucgaggagcucgagcucuccggcaaccgccucgaccucauccgccccggcuccuuccagggccucaccucccuccgcaagcucuggcucaugcacgcccaggucgccaccaucgagcgcaacgccuucgacgaccucaagucccucgaggagcucaaccucucccacaacaaccucaugucccucccccacgaccucuucaccccccuccaccgccucgagcgcguccaccucaaccacaaccccuggcacugcaacugcgacguccucuggcucuccugguggcucaaggagaccguccccuccaacaccaccugcugcgcccgcugccacgcccccgccggccucaagggccgcuacaucggcgagcucgaccagucccacuucaccugcuacgcccccgucaucgucgagccccccaccgaccucaacgucaccgagggcauggccgccgagcucaagugccgcaccggcaccuccaugaccuccgucaacuggcucacccccaacggcacccucaugacccacggcuccuaccgcguccgcaucuccguccuccacgacggcacccucaacuucaccaacgucaccguccaggacaccggccaguacaccugcauggucaccaacuccgccggcaacaccaccgccuccgccacccucaacgucuccgccgucgaccccgucgccgccggcggcaccggcuccggcggcggcggccccggcggcuccggcggcgucggcggcggcuccggcggcuacaccuacuucaccaccgucaccgucgagacccucgagacccagcccggcgaggaggcccuccagccccgcggcaccgagaaggagccccccggccccaccaccgacggcgucuggggcggcggccgccccggcgacgccgccggccccgccuccuccuccaccaccgcccccgccccccgcuccucccgccccaccgagaaggccuucaccguccccaucaccgacgucaccgagaacgcccucaaggaccucgacgacgucaugaagaccaccaagaucaucaucggcugcuucgucgccaucaccuucauggccgccgucaugcucgucgccuucuacaagcuccgcaagcagcaccagcuccacaagcaccacggccccacccgcaccgucgagaucaucaacgucgaggacgagcuccccgccgccuccgccgucuccgucgccgccgccgccgccgucgccuccggcggcggcgucggcggcgacucccaccucgcccuccccgcccucgagcgcgaccaccucaaccaccaccacuacgucgccgccgccuucaaggcccacuacuccuccaaccccuccggcggcggcugcggcggcaagggcccccccggccucaacuccauccacgagccccuccucuucaaguccggcuccaaggagaacguccaggagacccagaucuga

SEQ ID NO: 45525 - RNA, 1923 nt, Artificial Sequence
  derived and/or modified sequence opt2 from LRRC4C__Homo_sapiens__NP_001245348
augcucaacaagaugacccuccacccccagcagaucaugaucggcccccgcuucaaccgcgcccucuucgacccccuccucgucguccuccucgcccuccagcuccucgucgucgccggccucguccgcgcccagaccugccccuccgucugcuccugcuccaaccaguucuccaaggucaucugcguccgcaagaaccuccgcgagguccccgacggcaucuccaccaacacccgccuccucaaccuccacgagaaccagauccagaucaucaaggucaacuccuucaagcaccuccgccaccucgagauccuccagcucucccgcaaccacauccgcaccaucgagaucggcgccuucaacggccucgccaaccucaacacccucgagcucuucgacaaccgccucaccaccauccccaacggcgccuucgucuaccucuccaagcucaaggagcucuggcuccgcaacaaccccaucgaguccauccccuccuacgccuucaaccgcauccccucccuccgccgccucgaccucggcgagcucaagcgccucuccuacaucuccgagggcgccuucgagggccucuccaaccuccgcuaccucaaccucgccaugugcaaccuccgcgagauccccaaccucaccccccucaucaagcucgacgagcucgaccucuccggcaaccaccucuccgccauccgccccggcuccuuccagggccucaugcaccuccagaagcucuggaugauccagucccagauccaggucaucgagcgcaacgccuucgacaaccuccagucccucgucgagaucaaccucgcccacaacaaccucacccuccucccccacgaccucuucaccccccuccaccaccucgagcgcauccaccuccaccacaaccccuggaacugcaacugcgacauccucuggcucuccugguggaucaaggacauggcccccuccaacaccgccugcugcgcccgcugcaacaccccccccaaccucaagggccgcuacaucggcgagcucgaccagaacuacuucaccugcuacgcccccgucaucgucgagccccccgccgaccucaacgucaccgagggcauggccgccgagcucaagugccgcgccuccaccucccucaccuccgucuccuggaucacccccaacggcaccgucaugacccacggcgccuacaagguccgcaucgccguccucuccgacggcacccucaacuucaccaacgucaccguccaggacaccggcauguacaccugcauggucuccaacuccgucggcaacaccaccgccuccgccacccucaacgucaccgccgccaccaccacccccuucuccuacuucuccaccgucaccgucgagaccauggagcccucccaggacgaggcccgcaccaccgacaacaacgucggccccacccccgucgucgacugggagaccaccaacgucaccaccucccucaccccccaguccacccgcuccaccgagaagaccuucaccauccccgucaccgacaucaacuccggcauccccggcaucgacgaggucaugaagaccaccaagaucaucaucggcugcuucgucgccaucacccucauggccgccgucaugcucgucaucuucuacaagaugcgcaagcagcaccaccgccagaaccaccacgcccccacccgcaccgucgagaucaucaacgucgacgacgagaucaccggcgacacccccauggagucccaccuccccaugcccgccaucgagcacgagcaccucaaccacuacaacuccuacaagucccccuucaaccacaccaccaccgucaacaccaucaacuccauccacuccuccguccacgagccccuccucauccgcaugaacuccaaggacaacguccaggagacccagaucuga

SEQ ID NO: 45526 - RNA, 1962 nt, Artificial Sequence
  derived and/or modified sequence opt2 from LRRC4__Homo_sapiens__XP_011514763
augaagcuccucuggcaggucaccguccaccaccacaccuggaacgccauccuccuccccuucgucuaccucaccgcccaggucuggauccucugcgccgccaucgccgccgccgccuccgccggcccccagaacugccccuccgucugcuccugcuccaaccaguucuccaaggucgucugcacccgccgcggccucuccgaggucccccagggcauccccuccaacacccgcuaccucaaccucauggagaacaacauccagaugauccaggccgacaccuuccgccaccuccaccaccucgagguccuccagcucggccgcaacuccauccgccagaucgaggucggcgccuucaacggccucgccucccucaacacccucgagcucuucgacaacuggcucaccgucauccccuccggcgccuucgaguaccucuccaagcuccgcgagcucuggcuccgcaacaaccccaucgaguccauccccuccuacgccuucaaccgcguccccucccucaugcgccucgaccucggcgagcucaagaagcucgaguacaucuccgagggcgccuucgagggccucuucaaccucaaguaccucaaccucggcaugugcaacaucaaggacaugcccaaccucaccccccucgucggccucgaggagcucgagauguccggcaaccacuuccccgagauccgccccggcuccuuccacggccucuccucccucaagaagcucugggucaugaacucccaggucucccucaucgagcgcaacgccuucgacggccucgccucccucgucgagcucaaccucgcccacaacaaccucuccucccucccccacgaccucuucaccccccuccgcuaccucgucgagcuccaccuccaccacaaccccuggaacugcgacugcgacauccucuggcucgccugguggcuccgcgaguacauccccaccaacuccaccugcugcggccgcugccacgcccccaugcacaugcgcggccgcuaccucgucgaggucgaccaggccuccuuccagugcuccgcccccuucaucauggacgccccccgcgaccucaacaucuccgagggccgcauggccgagcucaagugccgcaccccccccauguccuccgucaaguggcuccuccccaacggcaccguccucucccacgccucccgccacccccgcaucuccguccucaacgacggcacccucaacuucucccacguccuccucuccgacaccggcgucuacaccugcauggucaccaacgucgccggcaacuccaacgccuccgccuaccucaacgucuccaccgccgagcucaacaccuccaacuacuccuucuucaccaccgucaccgucgagaccaccgagaucucccccgaggacaccacccgcaaguacaagcccguccccaccaccuccaccggcuaccagcccgccuacaccaccuccaccaccguccucauccagaccacccgcguccccaagcaggucgccguccccgccaccgacaccaccgacaagaugcagaccucccucgacgaggucaugaagaccaccaagaucaucaucggcugcuucgucgccgucacccuccucgccgccgccaugcucaucgucuucuacaagcuccgcaagcgccaccagcagcgcuccaccgucaccgccgcccgcaccgucgagaucauccaggucgacgaggacauccccgccgccaccuccgccgccgccaccgccgcccccuccggcgucuccggcgagggcgccgucguccuccccaccauccacgaccacaucaacuacaacaccuacaagcccgcccacggcgcccacuggaccgagaacucccucggcaacucccuccaccccaccgucaccaccaucuccgagcccuacaucauccagacccacaccaaggacaagguccaggagacccagaucuga

SEQ ID NO: 45527 - RNA, 942 nt, Artificial Sequence
  derived and/or modified sequence opt2 from LRRC52__Homo_sapiens__NP_001005214
augucccucgccuccggccccggccccggcuggcuccucuucuccuucggcaugggccucgucuccggcuccaagugccccaacaacugccucugccaggcccaggaggucaucugcaccggcaagcagcucaccgaguacccccucgacaucccccucaacacccgccgccucuuccucaacgagaaccgcaucaccucccuccccgccaugcaccucggccuccucuccgaccucgucuaccucgacugccagaacaaccgcauccgcgaggucauggacuacaccuucaucggcgucuucaagcucaucuaccucgaccucuccuccaacaaccucaccuccaucucccccuucaccuucuccguccucuccaaccucguccagcucaacaucgccaacaacccccaccuccucucccuccacaaguucaccuucgccaacaccaccucccuccgcuaccucgaccuccgcaacaccggccuccagacccucgacuccgccgcccucuaccaccucaccacccucgagacccucuuccucuccggcaaccccuggaagugcaacugcuccuuccucgacuucgccaucuuccucaucgucuuccacauggaccccuccgacgaccucaacgccaccugcgucgagcccaccgagcucaccggcuggcccaucacccgcgucggcaacccccuccgcuacaugugcaucacccaccucgaccacaaggacuacaucuuccuccuccucaucggcuucugcaucuucgccgccggcaccgucgccgccuggcucaccggcgucugcgccguccucuaccagaacacccgccacaaguccuccgaggaggacgaggacgaggccggcacccgcgucgaggucucccgccgcaucuuccagacccagaccuccuccguccaggaguucccccagcucaucuga

SEQ ID NO: 45528 - RNA, 924 nt, Artificial Sequence
  derived and/or modified sequence opt2 from LRRC59__Homo_sapiens__NP_060979
augaccaaggccggcuccaagggcggcaaccuccgcgacaagcucgacggcaacgagcucgaccucucccucuccgaccucaacgagguccccgucaaggagcucgccgcccuccccaaggccaccauccucgaccucuccugcaacaagcucaccacccuccccuccgacuucugcggccucacccaccucgucaagcucgaccucuccaagaacaagcuccagcagcuccccgccgacuucggccgccucgucaaccuccagcaccucgaccuccucaacaacaagcucgucacccuccccgucuccuucgcccagcucaagaaccucaaguggcucgaccucaaggacaacccccucgaccccguccucgccaaggucgccggcgacugccucgacgagaagcagugcaagcagugcgccaacaagguccuccagcacaugaaggccguccaggccgaccaggagcgcgagcgccagcgccgccucgaggucgagcgcgaggccgagaagaagcgcgaggccaagcagcgcgccaaggaggcccaggagcgcgagcuccgcaagcgcgagaaggccgaggagaaggagcgccgccgcaaggaguacgacgcccucaaggccgccaagcgcgagcaggagaagaagcccaagaaggaggccaaccaggcccccaaguccaaguccggcucccgcccccgcaagccccccccccgcaagcacacccgcuccugggccguccucaagcuccuccuccuccuccuccucuucggcgucgccggcggccucgucgccugccgcgucaccgagcuccagcagcagccccucugcaccuccgucaacaccaucuacgacaacgccguccagggccuccgccgccacgagauccuccaguggguccuccagaccgacucccagcaguga

SEQ ID NO: 45529 - RNA, 780 nt, Artificial Sequence
  derived and/or modified sequence opt2 from LRRC61__Homo_sapiens__XP_011514822
auggacccccccgccgagaagcccggcgaggccggcggccuccagaucaccccccagcuccucaagucccgcaccggcgaguucucccucgaguccauccuccuccucaagcuccgcggccucggccucgccgaccucggcugccucggcgagugccucggccucgaguggcucgaccucuccggcaacgcccucacccaccucggcccccucgccucccuccgccagcucgccguccucaacgucuccaacaaccgccucaccggccucgagccccucgccaccugcgagaaccuccagucccucaacgccgccggcaaccuccucgccacccccggccagcuccagugccucgccggccuccccugccucgaguaccuccgccuccgcgacccccucgcccgccucuccaacccccucugcgccaaccccuccuacugggccgccguccgcgagcuccuccccggccucaaggucaucgacggcgagcgcgucaucggccgcggcuccgaguucuaccagcucugccgcgaccucgacuccucccuccgccccuccuccucccccggcccccgcgccaccgaggcccagcccugggucgagcccggcuacugggaguccuggcccucccgcuccuccuccauccucgaggaggccugccgccaguuccaggacacccuccaggagugcugggaccucgaccgccaggccuccgacucccucgcccaggccgagcagguccucuccuccgccggccccaccuccuccuucgucuucuga

SEQ ID NO: 45530 - RNA, 1764 nt, Artificial Sequence
  derived and/or modified sequence opt2 from LRRC63__Homo_sapiens__NP_001269389
augcagaagcccccccuccuccuccgccgcccccucccccccaaguucaccaagcucucccuccacgagaagaagacccacaccgccaagaccggcaagaucgagucccuccacgucgccuucaccgaggacgagaccaccuccaucaagauggaccgcacccgcuuccccgacguccuccgcaaccagucccucacccccaucaacauccagaacaucuuccucgaccacugcguccaggagcgcgucaccgccaucuccuccccccagaaguccaccaagcacguccgcgagcagauccccgacaccgccaccggcuccaucuucuucccccacugcaacuccgccuccacccgcaucuucggcaagcagaccaacaagauggaguccucccgcaaguucaagaccaugaaggacgucuacaccgagaagcgccucgagaacauccucauccucuccuccaaguucuccaagcccaaguccacccccggcuccgucaucgcccagaagcucgagaagaugcaccccaagcaccagccccuccccgagucccccggcuacaccuaccagcacaucucccgcgaccucuccgccaccguccccucccccccccccaugaccgucuccaugaagcccgagggccaguggcccgagcacuucaaguccaccgccacccucacccuccgcgucaccgaguuccccggcuucgucucccuccccacccccguccucccccgcaagccccaccgccaguccgucaucgagacccucgucaccgagaacggcaacaucgaguccguccccaagcagauccccccccgcccccccgagggccucaccaagaccgagaagaucgaguccgagauccacgucguccgcggcgagggcuucaagaccgucgccgccacccgcuacgagaccaucaccgccaugaccaaccucgccaucgucaacugccaggucuacggccgcaacgcccucaaccucaagggcuucuucauccucaacugccccgaccucaccccccucgccuuccagcucaucuaccucaaccucuccuucaacgaccuccacuacuuccccaccgagauccucugccucaagaaccuccagauccucaagcuccgcaacaaccccaucaaggagauccccuccgagauccagcagcucgaguuccuccgcaucuucaccaucgccuucaaccucaucaccguccuccccaucggccucuucucccucuccuaccucgaggagcucgacgucuccuacaacgagcucaccuucauccccaacgagauccagaagcuccgcucccucgagaagcucaccgucgacggcaacgagcucuccuucuucccccacggcauccucaagcucaaccucaccaagauccaguucgagaacaacuucacccaccccugcuucuggcgcgacaacuaccucaacaacccccagcagcucacccagaucaucucccucuucaucguccagaacaagcuccacaaguucuacgacaagauccccgucgagguccagaagcuccucaagugcaccucccgcugcgaguggugccacggccccaaguucggcgagggcuuccgcgucauccgcuccugcgacaucuucggcgccucccagcuccccgucauguucuacgucugcucccccuccugcuaccgccgcaucaaggaguccuccuucguccucgacggcucccccucccgccgcaucgcccucgacgucgagcucuccaaggagcucuga

SEQ ID NO: 45531 - RNA, 1044 nt, Artificial Sequence
  derived and/or modified sequence opt2 from LRRC69__Homo_sapiens__NP_001123362
augaccgagcgccuccucaucaaggcccucuccggcggcaagaacaccaagaucaucacccucaacggcaagaagaugaccaagaugcccuccgcccucggcaagcuccccggccucaagacccucguccuccagaacaaccucauccccaaggucugccccgagcucugcaaccucacccagcucaccacccucaaccucggcaacaaccuccucgaggagguccccgaggagaugaaguaccucaccucccucaagaaccuccaccucuccggcaaccgcaucugccgcuucgcccccggcgccugcgacggccuccagaaccucauccuccucaaccucaacaacaaccaccucacccagcucccccaggaggucucccgccucaagucccucaccuacauguccaucaacuacaaccagcucgccuccaucccccgcgagcucugcuuccucgagaaccucgucgagcuccagcucaacuacaaccagcucaucugcauccccgaggagaucaaguuccucaagaagcuccagaagcuccuccucgcccgcaacaacaucggcguccuccccgaggagcucugcgaccucaagaagcuccgcauccucgacaucgccggcaacaucauccagaucuuccccuccggcuuccaggaccucaagcuccgcgaguucuacugcgagggcaacccccucuuccuccagcagcccgucaucuccacccagcaggagaacgucuggucccuccaggagaucaccucccgcuucgucaugaaccagcucgccgagaacaaccccuuccucauggacgacaucgagcgcuacccccagguccgcuccaugaucucccagggcaagaccugcgccaucugcggccaguacuucaucaccgucuggcucgagugcguccgcuucguccccccccccaaggacuggaagaucuccaagaaccucaagcucgucccccuccagguccucaucugcuccuacaagugcuucacccagcgcgaccccaaccucuucggcaucgcccaggucuga

SEQ ID NO: 45532 - RNA, 1401 nt, Artificial Sequence
  derived and/or modified sequence opt2 from LRRC6__Homo_sapiens__NP_036604
augggcuggaucaccgaggaccucauccgccgcaacgccgagcacaacgacugcgucaucuucucccucgaggagcucucccuccaccagcaggagaucgagcgccucgagcacaucgacaaguggugccgcgaccucaagauccucuaccuccagaacaaccucaucggcaagaucgagaacgucuccaagcucaagaagcucgaguaccucaaccucgcccucaacaacaucgagaagaucgagaaccucgagggcugcgaggagcucgccaagcucgaccucaccgucaacuucaucggcgagcucuccuccaucaagaaccuccagcacaacauccaccucaaggagcucuuccucaugggcaaccccugcgccuccuucgaccacuaccgcgaguucgucgucgccacccucccccagcucaaguggcucgacggcaaggagaucgagcccuccgagcgcaucaaggcccuccaggacuacuccgucaucgagccccagauccgcgagcaggagaaggaccacugccucaagcgcgccaagcucaaggaggaggcccagcgcaagcaccaggaggaggacaagaacgaggacaagcgcuccaacgccggcuucgacggccgcugguacaccgacaucaacgccacccucuccucccucgaguccaaggaccaccuccaggcccccgacaccgaggagcacaacaccaagaagcucgacaacuccgaggacgaccucgaguucuggaacaagcccugccucuucacccccgagucccgccucgagacccuccgccacauggagaagcagcgcaagaagcaggagaagcucuccgagaagaagaagaaggucaagcccccccgcacccucaucaccgaggacggcaaggcccucaacgucaacgagcccaagaucgacuucucccucaaggacaacgagaagcagaucauccucgaccucgccgucuaccgcuacauggacaccucccucaucgacgucgacguccagcccaccuacguccgcgucaugaucaagggcaagcccuuccagcucguccuccccgccgaggucaagcccgacuccuccuccgccaagcgcucccagaccaccggccaccucgucaucugcaugcccaaggucggcgaggucaucaccggcggccagcgcgccuucaaguccaugaagaccaccuccgaccgcucccgcgagcagaccaacacccgcuccaagcacauggagaagcucgaggucgaccccuccaagcacuccuuccccgacgucaccaacaucguccaggagaagaagcacaccccccgccgccgccccgagcccaagaucauccccuccgaggaggaccccaccuucgaggacaaccccgagguccccccccucaucuga

SEQ ID NO: 45533 - RNA, 1467 nt, Artificial Sequence
  derived and/or modified sequence opt2 from LRRC74A__Homo_sapiens__NP_919263
augcacauccaguuccccuccaagcccacccucccccgcgccugcugggagggccgcaucaccgccggcucccccggcaugccccccgacgagaucgagaucgagcccguccgccaguccuccgacaagaugcucuacugcgaggccgaguccccccccaccgucgagaaggucaagcccgcccgcgagaacuccgagaccgaccucgagaucgaggacgacgagaaguucuucaccaccggccagaaggagcucuaccucgaggccugcaagcucaugggcgucguccccgucuccuacuucauccgcaacauggaggaguccuacgucaaccucaaccaccacggccucggcccccgcggcaccaaggccaucgccaucgcccucgucuccaacauggccgucaccaagcucgagcucgaggacaacugcaucauggaggagggcguccucucccucgucgagaugcuccaggagaacuacuaccuccaggagaugaacaucuccaacaaccaccucggccucgagggcgcccgcaucaucuccgacuucuucgagcgcaacuccuccuccaucuggucccucgagcucuccggcaacgacuucaaggaggacuccgccgcccuccucugccaggcccucuccaccaacuaccagaucaagaagcucgaccucucccacaaccaguucuccgacgucggcggcgagcaccucggccagaugcucgccaucaacgucggccucaccucccucgaccucuccuggaacaacuuccacacccgcggcgccgucgcccucugcaacggccuccgcggcaacgucacccucaccaagcucgaccucuccaugaacggcuucggcaacgaggucgcccucgcccucggcgagguccuccgccucaaccgcugccucgucuaccucgacaucggcggcaacgacaucggcaacgagggcgccuccaagaucuccaagggccucgaguccaacgagucccuccgcguccucaagcucuuccucaaccccaucaacauggacggcgccauccuccucauccucgccaucaagcgcaaccccaagucccgcauggaggagcucgacaucuccaacguccucgucuccgagcaguucaugaagacccucgacggcgucuacgccguccacccccagcucgacgucgucuucaaggccguccagggccucucccccaagaagaccaucuuccuccucaccaaccccaugaagcucauccaguccuacgccgaccagcacaagaucaccaucgucgacuucuucaagucccucaaccccaccggcaccaugaagauguccgucgacgaguuccagaaggucaugaucgagcagaacaaggucccccucaaccaguaccagguccgcgaggucaucaagaagcucgacgagaagaccggcauggucaacuucuccuuccucaacaccaugaagcccuga

SEQ ID NO: 45534 - RNA, 4944 nt, Artificial Sequence
  derived and/or modified sequence opt2 from LRRC7__Homo_sapiens__XP_011540138
auguggauggagaaccucauccgcggccgcaaccccccccaguaccagcgcucccccugcaaggagguccgcgccgcccuccgcaagcgccccgaggaggagcuccagugccucgagaugaccaccaagcgcaagaucaucggccgccucguccccugccgcugcuuccgcggcgaggaggagaucaucuccguccucgacuacucccacugcucccuccagcagguccccaaggaggucuucaacuucgagcgcacccucgaggagcucuaccucgacgccaaccagaucgaggagcuccccaagcagcucuucaacugccaggcccuccgcaagcucuccauccccgacaacgaccucuccaaccuccccaccaccaucgccucccucgucaaccucaaggagcucgacaucuccaagaacggcguccaggaguuccccgagaacaucaagugcugcaagugccucaccaucaucgaggccuccgucaaccccaucuccaagcuccccgacggcuucacccagcuccucaaccucacccagcucuaccucaacgacgccuuccucgaguuccuccccgccaacuucggccgccucgucaagcuccgcauccucgagcuccgcgagaaccaccucaagacccuccccaaguccaugcacaagcucgcccagcucgagcgccucgaccucggcaacaacgaguucggcgagcuccccgagguccucgaccagauccagaaccuccgcgagcucuggauggacaacaacgcccuccagguccuccccggcuccaucggcaagcucaagaugcucgucuaccucgacauguccaagaaccgcaucgagaccgucgacauggacaucuccggcugcgaggcccucgaggaccuccuccucuccuccaacaugcuccagcagcuccccgacuccaucggccuccucaagaagcucaccacccucaaggucgacgacaaccagcucaccaugcuccccaacaccaucggcaaccucucccuccucgaggaguucgacugcuccugcaacgagcucgagucccuccccuccaccaucggcuaccuccacucccuccgcacccucgccgucgacgagaacuuccuccccgagcucccccgcgagaucggcuccugcaagaacgucaccgucaugucccuccgcuccaacaagcucgaguuccuccccgaggagaucggccagaugcagaagcuccgcguccucaaccucuccgacaaccgccucaagaaccuccccuucuccuucaccaagcucaaggagcucgccgcccucuggcucuccgacaaccaguccaaggcccucaucccccuccagaccgaggcccaccccgagaccaagcagcgcguccucaccaacuacauguucccccagcagccccgcggcgacgaggacuuccaguccgacuccgacuccuucaaccccacccucugggaggagcagcgccagcagcgcaugaccgucgccuucgaguucgaggacaagaaggaggacgacgagaacgccggcaaggucaaggaccucuccugccaggcccccugggagcgcggccagcgcggcaucacccuccagcccgcccgccucuccggcgacugcugcacccccugggcccgcugcgaccagcagauccaggacaugcccgucccccagaacgacccccagcucgccuggggcugcaucuccggccuccagcaggagcgcuccaugugcaccccccuccccgucgccgcccaguccaccacccuccccucccucuccggccgccaggucgagaucaaccucaagcgcuaccccacccccuaccccgaggaccucaagaacauggucaaguccguccagaaccucgucggcaagcccucccacggcguccgcgucgagaacuccaaccccaccgccaacaccgagcagaccgucaaggagaaguacgagcacaaguggcccgucgcccccaaggagaucaccgucgaggacuccuucguccaccccgccaacgagaugcgcaucggcgagcuccaccccucccucgccgagaccccccucuacccccccaagcucguccuccucggcaaggacaagaaggaguccaccgacgaguccgaggucgacaagacccacugccucaacaacuccgucuccuccggcaccuacuccgacuacucccccucccaggccuccuccggcuccuccaacacccgcgucaaggucggcucccuccagaccaccgccaaggacgccguccacaacucccucuggggcaaccgcaucgcccccuccuucccccagccccucgacuccaagccccuccucucccagcgcgaggccgucccccccggcaacaucccccagcgccccgaccgccuccccauguccgacaccuucaccgacaacuggaccgacggcucccacuacgacaacaccggcuucgucgccgaggagaccaccgccgagaacgccaacuccaacccccuccucuccuccaagucccgcuccaccuccucccacggccgccgcccccucauccgccaggaccgcaucgucggcgucccccucgagcucgagcaguccacccaccgccacacccccgagaccgaggucccccccuccaaccccuggcagaacuggacccgcacccccucccccuucgaggaccgcaccgccuuccccuccaagcucgagaccacccccaccaccuccccccuccccgagcgcaaggagcacaucaaggaguccaccgagauccccucccccuucucccccggcguccccugggaguaccacgacuccaaccccaaccgcucccucuccaacgucuucucccagauccacugccgccccgaguccuccaagggcgucaucuccaucuccaaguccaccgagcgccucuccccccucaugaaggacaucaaguccaacaaguucaagaagucccaguccaucgacgagaucgacaucggcaccuacaaggucuacaacaucccccucgagaacuacgccuccggcuccgaccaccucggcucccacgagcgccccgacaagaugcucggccccgagcacggcauguccuccaugucccgcucccaguccguccccaugcucgacgacgagaugcucaccuacggcuccuccaagggcccccagcagcagaaggccuccaugaccaagaaggucuaccaguucgaccaguccuucaacccccagggcuccgucgaggucaaggccgagaagcgcauccccccccccuuccagcacaaccccgaguacguccagcaggccuccaagaacaucgccaaggaccucaucuccccccgcgccuaccgcggcuacccccccauggagcagauguucuccuucucccagcccuccgucaacgaggacgccgucgucaacgcccaguucgccucccagggcgcccgcgccggcuuccuccgccgcgccgacucccucgucuccgccaccgagauggccauguuccgccgcgucaacgagccccacgagcucccccccaccgaccgcuacggccgcccccccuaccgcggcggccucgaccgccaguccuccgucaccgucaccgagucccaguuccucaagcgcaacggccgcuacgaggacgagcaccccuccuaccaggaggucaaggcccaggccggcuccuuccccgucaagaaccucacccagcgccgcccccucuccgcccgcuccuacuccaccgaguccuacggcgccucccagacccgccccgucuccgcccgccccaccauggccgcccuccucgagaagauccccuccgacuacaaccucggcaacuacggcgacaagcccuccgacaacuccgaccucaagacccgccccacccccgucaagggcgaggaguccugcggcaagaugcccgccgacuggcgccagcagcuccuccgccacaucgaggcccgccgccucgaccgcaacgccgccuacaagcacaacaccgucaaccucggcaugcuccccuacggcggcaucuccgccaugcacgccggccgcuccaugacccucaaccuccagaccaaguccaaguucgaccaccaggagcucccccuccagaagacccccucccagcaguccaacauccucgacaacggccaggaggacgucucccccuccggccaguggaaccccuacccccucggccgccgcgacgucccccccgacaccaucaccaagaaggccggcucccacauccagacccucaugggcucccagucccuccagcaccgcucccgcgagcagcagcccuacgagggcaacaucaacaaggucaccauccagcaguuccaguccccccuccccauccagauccccuccucccaggccacccgcggcccccagcccggccgcugccucauccagaccaagggccagcgcuccauggacggcuaccccgagcaguucugcguccgcaucgagaagaaccccggccucggcuucuccaucuccggcggcaucuccggccagggcaaccccuucaagcccuccgacaagggcaucuucgucacccgcguccagcccgacggccccgccuccaaccuccuccagcccggcgacaagauccuccaggccaacggccacuccuucguccacauggagcacgagaaggccguccuccuccucaaguccuuccagaacaccgucgaccucgucauccagcucuucccccuccgcggccuccucuucggccucaacgucgagaaggccuccggcuccgagaagaagcucaucaccgucgacccccacuacuccuggguccucuaccuccagaccugccuccucaccaaggucuacacccccaaguccaugugcggcaccuccgaggucauccacaagcaggcccagcgcuccaagaagcucgaguccccccacggccacgucccccgcuga

SEQ ID NO: 45535 - RNA, 2433 nt, Artificial Sequence
  derived and/or modified sequence opt2 from LRRC8A__Homo_sapiens__NP_062540
augauccccgucaccgagcuccgcuacuucgccgacacccagcccgccuaccgcauccucaagcccuggugggacgucuucaccgacuacaucuccaucgucaugcucaugaucgccgucuucggcggcacccuccaggucacccaggacaagaugaucugccuccccugcaagugggucaccaaggacuccugcaacgacuccuuccgcggcugggccgcccccggccccgagcccaccuaccccaacuccaccauccuccccacccccgacaccggccccaccggcaucaaguacgaccucgaccgccaccaguacaacuacgucgacgccgucugcuacgagaaccgccuccacugguucgccaaguacuuccccuaccucguccuccuccacacccucaucuuccucgccugcuccaacuucugguucaaguucccccgcaccuccuccaagcucgagcacuucgucuccauccuccucaagugcuucgacucccccuggaccacccgcgcccucuccgagaccgucgucgaggaguccgaccccaagcccgccuucuccaagaugaacggcuccauggacaagaaguccuccaccgucuccgaggacgucgaggccaccguccccaugcuccagcgcaccaagucccgcaucgagcagggcaucgucgaccgcuccgagaccggcguccucgacaagaaggagggcgagcaggccaaggcccucuucgagaaggucaagaaguuccgcacccacgucgaggagggcgacaucgucuaccgccucuacaugcgccagaccaucaucaaggucaucaaguucauccucaucaucugcuacaccgucuacuacguccacaacaucaaguucgacgucgacugcaccgucgacaucgagucccucaccggcuaccgcaccuaccgcugcgcccacccccucgccacccucuucaagauccucgccuccuucuacaucucccucgucaucuucuacggccucaucugcauguacacccucugguggaugcuccgccgcucccucaagaaguacuccuucgaguccauccgcgaggaguccuccuacuccgacauccccgacgucaagaacgacuucgccuucaugcuccaccucaucgaccaguacgacccccucuacuccaagcgcuucgccgucuuccucuccgaggucuccgagaacaagcuccgccagcucaaccucaacaacgaguggacccucgacaagcuccgccagcgccucaccaagaacgcccaggacaagcucgagcuccaccucuucaugcucuccggcauccccgacaccgucuucgaccucgucgagcucgagguccucaagcucgagcucauccccgacgucaccaucccccccuccaucgcccagcucaccggccucaaggagcucuggcucuaccacaccgccgccaagaucgaggcccccgcccucgccuuccuccgcgagaaccuccgcgcccuccacaucaaguucaccgacaucaaggagaucccccucuggaucuacucccucaagacccucgaggagcuccaccucaccggcaaccucuccgccgagaacaaccgcuacaucgucaucgacggccuccgcgagcucaagcgccucaagguccuccgccucaaguccaaccucuccaagcucccccaggucgucaccgacgucggcguccaccuccagaagcucuccaucaacaacgagggcaccaagcucaucguccucaacucccucaagaagauggccaaccucaccgagcucgagcucauccgcugcgaccucgagcgcaucccccacuccaucuucucccuccacaaccuccaggagaucgaccucaaggacaacaaccucaagaccaucgaggagaucaucuccuuccagcaccuccaccgccucaccugccucaagcucugguacaaccacaucgccuacauccccauccagaucggcaaccucaccaaccucgagcgccucuaccucaaccgcaacaagaucgagaagauccccacccagcucuucuacugccgcaagcuccgcuaccucgaccucucccacaacaaccucaccuuccuccccgccgacaucggccuccuccagaaccuccagaaccucgccaucaccgccaaccgcaucgagacccucccccccgagcucuuccagugccgcaagcuccgcgcccuccaccucggcaacaacguccuccagucccuccccucccgcgucggcgagcucaccaaccucacccagaucgagcuccgcggcaaccgccucgagugccuccccgucgagcucggcgagugcccccuccucaagcgcuccggccucgucgucgaggaggaccucuucaacacccucccccccgaggucaaggagcgccucuggcgcgccgacaaggagcaggccuga

SEQ ID NO: 45536 - RNA, 2412 nt, Artificial Sequence
  derived and/or modified sequence opt2 from LRRC8C__Homo_sapiens__XP_011540584
augauccccgucaccgaguuccgccaguucuccgagcagcagcccgccuuccgcguccucaagcccuggugggacgucuucaccgacuaccucuccgucgccaugcucaugaucggcgucuucggcugcacccuccaggucaugcaggacaagaucaucugccuccccaagcgcguccagcccgcccagaaccacuccucccucuccaacgucucccaggccgucgccuccaccaccccccuccccccccccaagcccucccccgccaaccccaucaccgucgagaugaagggccucaagaccgaccucgaccuccagcaguacuccuucaucaaccagaugugcuacgagcgcgcccuccacugguacgccaaguacuuccccuaccucguccucauccacacccucgucuucaugcucugcuccaacuucugguucaaguuccccggcuccuccuccaagaucgagcacuucaucuccauccucggcaagugcuucgacucccccuggaccacccgcgcccucuccgaggucuccggcgaggacuccgaggagaaggacaaccgcaagaacaacaugaaccgcuccaacaccauccaguccggccccgaggacucccucgucaacucccagucccucaaguccauccccgagaaguucgucgucgacaaguccaccgccggcgcccucgacaagaaggagggcgagcaggccaaggcccucuucgagaaggucaagaaguuccgccuccacgucgaggagggcgacauccucuacgccauguacguccgccagaccguccucaaggucaucaaguuccucaucaucaucgccuacaacuccgcccucgucuccaagguccaguucaccgucgacugcaacgucgacauccaggacaugaccggcuacaagaacuucuccugcaaccacaccauggcccaccucuucuccaagcucuccuucugcuaccucugcuucgucuccaucuacggccucaccugccucuacacccucuacuggcucuucuaccgcucccuccgcgaguacuccuucgaguacguccgccaggagaccggcaucgacgacauccccgacgucaagaacgacuucgccuucaugcuccacaugaucgaccaguacgacccccucuacuccaagcgcuucgccgucuuccucuccgaggucuccgagaacaagcucaagcagcucaaccucaacaacgaguggacccccgacaagcuccgccagaagcuccagaccaacgcccacaaccgccucgagcucccccucaucaugcucuccggccuccccgacaccgucuucgagaucaccgagcuccagucccucaagcucgagaucaucaagaacgucaugauccccgccaccaucgcccagcucgacaaccuccaggagcucucccuccaccagugcuccgucaagauccacuccgccgcccucuccuuccucaaggagaaccucaagguccucuccgucaaguucgacgacaugcgcgagcucccccccuggauguacggccuccgcaaccucgaggagcucuaccucgucggcucccucucccacgacaucucccgcaacgucacccucgagucccuccgcgaccucaagucccucaagauccucuccaucaaguccaacgucuccaagaucccccaggccgucgucgacgucuccucccaccuccagaagaugugcauccacaacgacggcaccaagcucgucaugcucaacaaccucaagaagaugaccaaccucaccgagcucgagcucguccacugcgaccucgagcgcaucccccacgccgucuucucccuccucucccuccaggagcucgaccucaaggagaacaaccucaaguccaucgaggagaucgucuccuuccagcaccuccgcaagcucaccguccucaagcucuggcacaacuccaucaccuacauccccgagcacaucaagaagcucaccucccucgagcgccucuccuucucccacaacaagaucgagguccuccccucccaccucuuccucugcaacaagauccgcuaccucgaccucuccuacaacgacauccgcuucaucccccccgagaucggcguccuccagucccuccaguacuucuccaucaccugcaacaaggucgagucccuccccgacgagcucuacuucugcaagaagcucaagacccucaagaucggcaagaacucccucuccguccucucccccaagaucggcaaccuccucuuccucuccuaccucgacgucaagggcaaccacuucgagauccucccccccgagcucggcgacugccgcgcccucaagcgcgccggccucgucgucgaggacgcccucuucgagacccuccccuccgacguccgcgagcagaugaagaccgaguga

SEQ ID NO: 45537 - RNA, 3099 nt, Artificial Sequence
  derived and/or modified sequence opt2 from LRRCC1__Homo_sapiens__NP_208325
auggaggccgccgccgccgucgucgccgccgaggccgaggucgagaacgaggacggcgacuccuccugcggcgacgucugcuucauggacaagggccuccaguccaucuccgagcucucccucgacuccacccuccacgccgucaaccuccacugcaacaacaucuccaagaucgaggccaucgaccacaucuggaaccuccagcaccucgaccucuccuccaaccagaucucccgcaucgagggccucaacacccucaccaagcucugcacccucaaccucuccugcaaccucaucaccaaggucgagggccucgaggagcucaucaaccucacccgccucaacgucuccuacaaccacaucgacgaccucuccggccucaucccccuccacggcaucaagcacaagcuccgcuacaucgaccuccacuccaaccgcaucgacuccauccaccaccuccuccagugcauggucggccuccacuuccucaccaaccucauccucgagaaggacggcgacgacaaccccgucugccgccuccccggcuaccgcgccgucauccuccagacccucccccagcuccgcauccucgacugcaagaacaucuucggcgagcccgucaaccucaccgagaucaacuccucccagcuccagugccucgagggccuccucgacaaccucgucuccuccgacuccccccucaacaucuccgaggacgagaucaucgaccgcaugcccgucaucaccgcccccaucgacgagcucgucccccucgagcaguucgccuccacccccuccgacgccguccucaccuccuucauguccgucugccaguccuccgagcccgagaagaacaaccacgagaacgaccuccagaacgagaucaagcuccagaagcucgacgaccagauccuccagcuccucaacgagaccuccaacuccaucgacaacguccucgagaaggacccccgccccaagcgcgacaccgacaucaccuccgaguccgacuacggcaaccgcaaggagugcaaccgcaaggucccccgccgcuccaagauccccuacgacgccaagaccauccagaccaucaagcaccacaacaagaacuacaacuccuucgucuccugcaaccgcaagaugaagccccccuaccucaaggagcucuacgucuccuccucccucgccaacugccccaugcuccaggaguccgagaagcccaagaccgagaucaucaaggucgaccagucccacuccgaggacaacaccuaccagucccucgucgagcagcucgaccaggagcgcgagaagcgcuggcgcgccgagcaggccgagaacaagcucauggacuacaucgacgagcuccacaagcacgccaacgagaaggaggacauccacucccucgcccuccucaccaccgaccgccucaaggagaucaucuuccgcgagcgcaacuccaagggccagcucgaggucaugguccacaagcuccagaacgagaucaagaagcucaccgucgagcucaugaaggccaaggaccagcaggaggaccaccucaagcaccuccgcacccucgagaagacccucgagaagauggagcgccagaagcgccagcagcaggccgcccagauccgccucauccaggaggucgagcucaaggccuccgccgccgaccgcgagaucuaccuccuccgcaccucccuccaccgcgagcgcgagcaggcccagcagcuccaccagcuccucgcccucaaggagcaggagcaccgcaaggagcucgagacccgcgaguucuucaccgacgccgacuuccaggacgcccucgccaaggagaucgccaaggaggagaagaagcacgagcagaugaucaaggaguaccaggagaagaucgacguccucucccagcaguacauggaccucgagaacgaguuccgcaucgcccucaccgucgaggcccgccgcuuccaggacgucaaggacggcuucgagaacgucgccaccgagcucgccaaguccaagcacgcccucaucugggcccagcgcaaggagaacgaguccuccucccucaucaaggaccucaccugcauggucaaggagcagaagaccaagcucgccgaggucuccaagcucaagcaggagaccgccgccaaccuccagaaccagaucaacacccucgagauccucaucgaggacgacaagcagaaguccauccagaucgagcuccucaagcacgagaagguccagcucaucuccgagcucgccgccaaggagucccucaucuucggccuccgcaccgagcgcaaggucuggggccacgagcucgcccagcagggcuccucccucgcccagaaccgcggcaagcucgaggcccagaucgagucccucucccgcgagaacgagugccuccgcaagaccaacgaguccgacuccgacgcccuccgcaucaagugcaagaucaucgacgaccagaccgagaccauccgcaagcucaaggacugccuccaggagaaggacgagcacaucaagcgccuccaggagaagaucaccgagaucgagaagugcacccaggagcagcucgacgagaaguccucccagcucgacgagguccucgagaagcucgagcgccacaacgagcgcaaggagaagcucaagcagcagcucaagggcaaggaggucgagcucgaggagauccgcaaggccuacuccacccucaaccgcaaguggcacgacaagggcgagcuccucugccaccucgagacccaggucaaggaggucaaggagaaguucgagaacaaggagaagaagcucaaggccgagcgcgacaaguccaucgagcuccagaagaacgccauggagaagcuccacuccauggacgacgccuucaagcgccaggucgacgccaucgucgaggcccaccaggccgagaucgcccagcucgccaacgagaagcagaagugcaucgacuccgccaaccucaagguccaccagaucgagaaggagaugcgcgagcuccucgaggagaccugcaagaacaagaagaccauggaggccaagaucaagcagcucgccuucgcccucaacgagauccagcaggacauguga

SEQ ID NO: 45538 - RNA, 1923 nt, Artificial Sequence
  derived and/or modified sequence opt2 from LRRFIP1__Homo_sapiens__NP_001131022
auggacaugggcacccagggcuccggccgcaagcgccuccccaaccgcgagcgccucaccgccgaggacgacgcccucaaccagaucgcccgcgaggccgaggcccgccucgccgccaagcgcgccgcccgcgccgaggcccgcgagauccgcaugaaggagcucgagcgccagcagaaggagaucuaccagguccagaagaaguacuacggccucgacaccaaguggggcgacaucgagcaguggauggaggacuccgagcgcuacucccgccgcucccgccgcaacaccuccgccuccgacgaggacgagcgcauguccgucggcucccgcggcucccuccgcucccagcccgaccucgaguacggcggccccuacgccuggaccaacggcuacgacggcgagcucuacggcucccagucccucaaccgccgcuccggccgccccuccugccucuacuccgccgcccgccccuccggcuccuaccgcgccuccguccucgacgagggcuccuucggcggcacccgccgcggcuccaccuccggcucccgcgcccccuccgaguacuccggccaccucaacuccuccucccgcgccuccucccgcgccuccuccgcccgcgccucccccgucgucgaggagcgccccgagaaggacuucaccgagaagggcucccgcaacaugcccggccucuccgccgccacccucgccucccucggcggcaccuccucccgccgcggcuccggcgacaccuccaucuccaucgacaccgaggccuccauccgcgagaucaaggagcucaacgagcucaaggaccagauccaggacgucgagggcaaguacaugcagggccucaaggagaugaaggacucccucgccgaggucgaggagaaguacaagaaggccauggucuccaacgcccagcucgacaacgagaagaccaacuucauguaccaggucgacacccucaaggacaugcuccucgagcucgaggagcagcucgccgagucccgccgccaguacgaggagaagaacaaggaguucgagcgcgagaagcacgcccacuccauccuccaguuccaguucgccgaggucaaggaggcccucaagcagcgcgaggagaugcucgaggagauccgccagcuccagcagaagcaggccuccuccauccgcgagaucuccgaccuccaggagaccaucgaguggaaggacaagaagaucggcgcccucgagcgccagaaggaguucuucgacuccguccgcuccgagcgcgacgaccuccgcgaggaggucgucaugcucaaggaggagcucaagaagcacggcaucauccucaacuccgagaucgccaccaacggcgagaccuccgacacccucaacaacgucggcuaccagggccccaccaagaugaccaaggaggagcucaacgcccucaaguccaccggcgacggcacccucgacauccgccucaagaagcucgucgacgagcgcgagugccuccucgagcagaucaagaagcucaagggccagcucgaggagcgccagaagaucggcaagcucgacaaccuccgcuccgaggacgacguccucgagaacggcaccgacaugcacgucauggaccuccagcgcgacgccaaccgccagaucuccgaccucaaguucaagcucgccaaguccgagcaggagaucaccgcccucgagcagaacgucauccgccucgagucccaggucucccgcuacaaguccgccgccgagaacgccgagaagaucgaggacgagcucaaggccgagaagcgcaagcuccagcgcgagcuccgcuccgcccucgacaagaccgaggagcucgaggucuccaacggccaccucgucaagcgccucgagaagaugaaggccaaccgcuccgcccuccucucccagcaguga

SEQ ID NO: 45539 - RNA, 1275 nt, Artificial Sequence
  derived and/or modified sequence opt2 from LRRFIP2__Homo_sapiens__NP_001127841
augggcacccccgccuccggccgcaagcgcacccccgucaaggaccgcuucuccgccgaggacgaggcccucuccaacaucgcccgcgaggccgaggcccgccucgccgccaagcgcgccgcccgcgccgaggcccgcgacauccgcaugcgcgagcucgagcgccagcagaaggagcucgacgagaaguccgacaagcaguacgccgagaacuacacccgccccuccucccgcaacuccgccuccgccaccaccccccucuccggcaacuccucccgccgcggcuccggcgacaccuccucccucaucgaccccgacaccucccucuccgagcuccgcgacaucuacgaccucaaggaccagauccaggacgucgagggccgcuacaugcagggccucaaggagcucaaggagucccucuccgaggucgaggagaaguacaagaaggccauggucuccaacgcccagcucgacaacgagaagaacaaccucaucuaccaggucgacacccucaaggacgucaucgaggagcaggaggagcagauggccgaguucuaccgcgagaacgaggagaaguccaaggagcucgagcgccagaagcacaugugcuccguccuccagcacaagauggaggagcucaaggagggccuccgccagcgcgacgagcucaucgagaagcacggccucgucaucauccccgacggcacccccaacggcgacgucucccacgagcccgucgccggcgccaucaccgucgucucccaggaggccgcccagguccucgaguccgccggcgagggcccccucgacguccgccuccgcaagcucgccggcgagaaggaggagcuccucucccagauccgcaagcucaagcuccagcucgaggaggagcgccagaagugcucccgcaacgacggcaccgucggcgaccucgccggccuccagaacggcuccgaccuccaguucaucgagaugcagcgcgacgccaaccgccagaucuccgaguacaaguucaagcucuccaaggccgagcaggacaucaccacccucgagcaguccaucucccgccucgagggccagguccuccgcuacaagaccgccgccgagaacgccgagaaggucgaggacgagcucaaggccgagaagcgcaagcuccagcgcgagcuccgcaccgcccucgacaagaucgaggagauggagaugaccaacucccaccucgccaagcgccucgagaagaugaaggccaaccgcaccgcccuccucgcccagcaguga

SEQ ID NO: 45540 - RNA, 6048 nt, Artificial Sequence
  derived and/or modified sequence opt2 from LRRK1__Homo_sapiens__XP_011520315
auggccggcaugucccagcgcccccccuccauguacuggugcgucggccccgaggaguccgccgucugccccgagcgcgccauggagacccucaacggcgccggcgacaccggcggcaagcccuccacccgcggcggcgaccccgccgcccgcucccgccgcaccgagggcauccgcgccgccuaccgccgcggcgaccgcggcggcgcccgcgaccuccucgaggaggccugcgaccagugcgccucccagcucgagaagggccagcuccucuccauccccgccgccuacggcgaccucgagaugguccgcuaccuccucuccaagcgccucgucgagcuccccaccgagcccaccgacgacaaccccgccgucgucgccgccuacuucggccacaccgccgucguccaggagcuccucgagucccuccccggccccugcuccccccagcgccuccucaacuggaugcucgcccucgccugccagcgcggccaccucggcgucgucaagcuccucguccucacccacggcgccgaccccgaguccuacgccguccgcaagaacgaguuccccgucaucguccgccucccccucuacgccgccaucaaguccggcaacgaggacaucgccaucuuccuccuccgccacggcgccuacuucugcuccuacauccuccucgacucccccgaccccuccaagcaccuccuccgcaaguacuucaucgaggccuccccccuccccuccuccuaccccggcaagaccgcccuccgcgucaaguggucccaccuccgccuccccugggucgaccucgacuggcucaucgacaucuccugccagaucaccgagcucgaccucuccgccaacugccucgccacccuccccuccgucauccccuggggccucaucaaccuccgcaagcucaaccucuccgacaaccaccucggcgagcuccccggcguccaguccuccgacgagaucaucugcucccgccuccucgagaucgacaucuccuccaacaagcucucccaccucccccccggcuuccuccaccucuccaagcuccagaagcucaccgccuccaagaacugccucgagaagcucuucgaggaggagaacgccaccaacuggaucggccuccgcaagcuccaggagcucgacaucuccgacaacaagcucaccgagcuccccgcccucuuccuccacuccuucaagucccucaacucccucaacgucucccgcaacaaccucaaggucuuccccgaccccugggccugcccccucaagugcugcaaggccucccgcaacgcccucgagugccuccccgacaagauggccgucuucuggaagaaccaccucaaggacgucgacuucuccgagaacgcccucaaggaggucccccucggccucuuccagcucgacgcccucauguuccuccgccuccagggcaaccagcucgccgcccuccccccccaggagaaguggaccugccgccagcucaagacccucgaccucucccgcaaccagcucggcaagaacgaggacggccucaagaccaagcgcaucgccuucuucaccacccgcggccgccagcgcuccggcaccgaggccgccuccguccucgaguuccccgccuuccucuccgagucccucgagguccucugccucaacgacaaccaccucgacaccgucccccccuccgucugccuccucaagucccucuccgagcucuaccucggcaacaaccccggccuccgcgagcucccccccgagcucggccagcucggcaaccucuggcagcucgacaccgaggaccucaccaucuccaacguccccgccgagauccagaaggagggccccaaggccaugcucuccuaccuccgcgcccagcuccgcaaggccgagaagugcaagcucaugaagaugaucaucgucggccccccccgccagggcaaguccacccuccucgagauccuccagaccggccgcgccccccaggucguccacggcgaggccaccauccgcaccaccaagugggagcuccagcgccccgccggcucccgcgccaaggucgaguccgucgaguucaacgucugggacaucggcggccccgccuccauggccaccgucaaccagugcuucuucaccgacaaggcccucuacgucgucgucuggaaccucgcccucggcgaggaggccgucgccaaccuccaguucuggcuccucaacaucgaggccaaggcccccaacgccgucguccucgucgucggcacccaccucgaccucaucgaggccaaguuccgcgucgagcgcaucgccacccuccgcgccuacguccucgcccucugccgcucccccuccggcucccgcgccaccggcuuccccgacaucaccuucaagcaccuccacgagaucuccugcaagucccucgagggccaggagggccuccgccagcucaucuuccacgucaccugcuccaugaaggacgucggcuccaccaucggcugccagcgccucgccggccgccucaucccccgcuccuaccucucccuccaggaggccguccucgccgagcagcagcgccgcucccgcgacgacgacguccaguaccucaccgaccgccagcucgagcagcucgucgagcagacccccgacaacgacaucaaggacuacgaggaccuccaguccgccaucuccuuccucaucgagaccggcacccuccuccacuuccccgacaccucccacggccuccgcaaccucuacuuccucgaccccaucuggcucuccgagugccuccagcgcaucuucaacaucaagggcucccgcuccgucgccaagaacggcgucauccgcgccgaggaccuccgcaugcuccucgucggcaccggcuucacccagcagaccgaggagcaguacuuccaguuccucgccaaguucgagaucgcccuccccgucgccaacgacuccuaccuccucccccaccuccuccccuccaagcccggccucgacacccacggcaugcgccaccccaccgccaacaccauccagcgcgucuucaagauguccuucguccccgucggcuucuggcagcgcuucaucgcccgcaugcucaucucccucgccgagauggaccuccagcucuucgagaacaagaagaacaccaagucccgcaaccgcaaggucaccaucuacuccuucaccggcaaccagcgcaaccgcugcuccaccuuccgcgucaagcgcaaccagaccaucuacuggcaggagggccuccucgucaccuucgacggcggcuaccucuccgucgaguccuccgacgucaacuggaagaagaagaaguccggcggcaugaagaucgucugccaguccgagguccgcgacuucuccgccauggccuucaucaccgaccacgucaacucccucaucgaccagugguuccccgcccucaccgccaccgaguccgacggcaccccccucauggagcaguacguccccugccccgucugcgagaccgccugggcccagcacaccgaccccuccgagaaguccgaggacguccaguacuucgacauggaggacugcguccucaccgccaucgagcgcgacuucaucuccugcccccgccaccccgaccuccccgucccccuccaggagcucguccccgagcucuucaugaccgacuuccccgcccgccucuuccucgagaacuccaagcucgagcacuccgaggacgagggcuccguccucggccagggcggcuccggcaccgucaucuaccgcgcccgcuaccagggccagcccgucgccgucaagcgcuuccacaucaagaaguucaagaacuucgccaacguccccgccgacaccaugcuccgccaccuccgcgccaccgacgccaugaagaacuucuccgaguuccgccaggaggccuccaugcuccacgcccuccagcaccccugcaucgucgcccucaucggcaucuccauccacccccucugcuucgcccucgagcucgccccccucuccucccucaacaccguccucuccgagaacgcccgcgacuccuccuucaucccccucggccacaugcucacccagaagaucgccuaccagaucgccuccggccucgccuaccuccacaagaagaacaucaucuucugcgaccucaaguccgacaacauccucgucuggucccucgacgucaaggagcacaucaacaucaagcucuccgacuacggcaucucccgccaguccuuccacgagggcgcccucggcgucgagggcacccccggcuaccaggcccccgagauccgcccccgcaucgucuacgacgagaaggucgacauguucuccuacggcaugguccucuacgagcuccucuccggccagcgccccgcccucggccaccaccagcuccagaucgccaagaagcucuccaagggcauccgccccguccucggccagcccgaggagguccaguuccgccgccuccaggcccucaugauggagugcugggacaccaagcccgagaagcgcccccucgcccucuccgucgucucccagaugaaggaccccaccuucgccaccuucauguacgagcucugcugcggcaagcagaccgccuucuucuccucccagggccaggaguacaccgucgucuucugggacggcaaggaggagucccgcaacuacaccgucgucaacaccgagaagggccucauggagguccagcgcaugugcugccccggcaugaaggucuccugccagcuccagguccagcgcucccucuggaccgccaccgaggaccagaagaucuacaucuacacccucaagggcaugugcccccucaacaccccccagcaggcccucgacacccccgccgucgucaccugcuuccucgccguccccgucaucaagaagaacuccuaccucguccucgccggccucgccgacggccucgucgccgucuuccccgucguccgcggcacccccaaggacuccugcuccuaccucugcucccacaccgccaaccgcuccaaguucuccaucgccgacgaggacgcccgccagaaccccuaccccgucaaggccauggaggucgucaacuccggcuccgaggucugguacuccaacggccccggccuccucgucaucgacugcgccucccucgagaucugccgccgccucgagcccuacauggcccccuccauggucaccuccgucgucugcuccuccgagggccgcggcgaggaggucgucuggugccucgacgacaaggccaacucccucgucauguaccacuccaccaccuaccagcucugcgcccgcuacuucugcggcguccccuccccccuccgcgacauguuccccguccgcccccucgacaccgagccccccgccgccucccacaccgccaaccccaagguccccgagggcgacuccaucgccgacgucuccaucauguacuccgaggagcucggcacccagauccucauccaccaggagucccucaccgacuacugcuccauguccuccuacuccuccucccccccccgccaggccgcccgcucccccuccucccuccccuccucccccgccuccuccuccuccguccccuucuccaccgacugcgaggacuccgacaugcuccacacccccggcgccgccuccgaccgcuccgagcacgaccucacccccauggacggcgagaccuucucccagcaccuccaggccgucaagauccucgccguccgcgaccucaucugggucccccgccgcggcggcgacgucaucgucaucggccucgagaaggacuccggcgcccagcgcggccgcgucaucgccguccucaaggcccgcgagcucaccccccacggcguccucgucgacgccgccgucgucgccaaggacaccgucgucugcaccuucgagaacgagaacaccgaguggugccucgccgucuggcgcggcuggggcgcccgcgaguucgacaucuucuaccaguccuacgaggagcucggccgccucgaggccugcacccgcaagcgccgcuga

SEQ ID NO: 45541 - RNA, 7584 nt, Artificial Sequence
  derived and/or modified sequence opt2 from LRRK2__Homo_sapiens__NP_940980
auggccuccggcuccugccagggcugcgaggaggacgaggagacccucaagaagcucaucguccgccucaacaacguccaggagggcaagcagaucgagacccucguccagauccucgaggaccuccucgucuucaccuacuccgagcacgccuccaagcucuuccagggcaagaacauccacgucccccuccucaucguccucgacuccuacaugcgcgucgccuccguccagcaggucggcuggucccuccucugcaagcucaucgaggucugccccggcaccaugcagucccucaugggcccccaggacgucggcaacgacugggagguccucggcguccaccagcucauccucaagaugcucaccguccacaacgccuccgucaaccucuccgucaucggccucaagacccucgaccuccuccucaccuccggcaagaucacccuccucauccucgacgaggaguccgacaucuucaugcucaucuucgacgccaugcacuccuuccccgccaacgacgagguccagaagcucggcugcaaggcccuccacguccucuucgagcgcgucuccgaggagcagcucaccgaguucgucgagaacaaggacuacaugauccuccucuccgcccucaccaacuucaaggacgaggaggagaucguccuccacguccuccacugccuccacucccucgccauccccugcaacaacgucgagguccucauguccggcaacguccgcugcuacaacaucgucgucgaggccaugaaggccuuccccauguccgagcgcauccaggaggucuccugcugccuccuccaccgccucacccucggcaacuucuucaacauccucguccucaacgagguccacgaguucgucgucaaggccguccagcaguaccccgagaacgccgcccuccagaucuccgcccucuccugccucgcccuccucaccgagaccaucuuccucaaccaggaccucgaggagaagaacgagaaccaggagaacgacgacgagggcgaggaggacaagcucuucuggcucgaggccugcuacaaggcccucaccuggcaccgcaagaacaagcacguccaggaggccgccugcugggcccucaacaaccuccucauguaccagaacucccuccacgagaagaucggcgacgaggacggccacuuccccgcccaccgcgaggucaugcucuccaugcucaugcacuccuccuccaaggaggucuuccaggccuccgccaacgcccucuccacccuccucgagcagaacgucaacuuccgcaagauccuccucuccaagggcauccaccucaacguccucgagcucaugcagaagcacauccacucccccgaggucgccgaguccggcugcaagaugcucaaccaccucuucgagggcuccaacaccucccucgacaucauggccgccgucguccccaagauccucaccgucaugaagcgccacgagaccucccuccccguccagcucgaggcccuccgcgccauccuccacuucaucguccccggcaugcccgaggagucccgcgaggacaccgaguuccaccacaagcucaacauggucaagaagcagugcuucaagaacgacauccacaagcucguccucgccgcccucaaccgcuucaucggcaaccccggcauccagaagugcggccucaaggucaucuccuccaucguccacuuccccgacgcccucgagaugcucucccucgagggcgccauggacuccguccuccacacccuccagauguaccccgacgaccaggagauccagugccucggccucucccucaucggcuaccucaucaccaagaagaacgucuucaucggcaccggccaccuccucgccaagauccucgucuccucccucuaccgcuucaaggacgucgccgagauccagaccaagggcuuccagaccauccucgccauccucaagcucuccgccuccuucuccaagcuccucguccaccacuccuucgaccucgucaucuuccaccagauguccuccaacaucauggagcagaaggaccagcaguuccucaaccucugcugcaagugcuucgccaaggucgccauggacgacuaccucaagaacgucaugcucgagcgcgccugcgaccagaacaacuccaucauggucgagugccuccuccuccucggcgccgacgccaaccaggccaaggagggcuccucccucaucugccaggucugcgagaaggaguccucccccaagcucgucgagcuccuccucaacuccggcucccgcgagcaggacguccgcaaggcccucaccaucuccaucggcaagggcgacucccagaucaucucccuccuccuccgccgccucgcccucgacgucgccaacaacuccaucugccucggcggcuucugcaucggcaaggucgagcccuccuggcucggcccccucuuccccgacaagaccuccaaccuccgcaagcagaccaacaucgccuccacccucgcccgcauggucauccgcuaccagaugaaguccgccgucgaggagggcaccgccuccggcuccgacggcaacuucuccgaggacguccucuccaaguucgacgaguggaccuucauccccgacuccuccauggacuccgucuucgcccaguccgacgaccucgacuccgagggcuccgagggcuccuuccucgucaagaagaaguccaacuccaucuccgucggcgaguucuaccgcgacgccguccuccagcgcugcucccccaaccuccagcgccacuccaacucccucggccccaucuucgaccacgaggaccuccucaagcgcaagcgcaagauccucuccuccgacgacucccuccgcuccuccaagcuccagucccacaugcgccacuccgacuccaucuccucccucgccuccgagcgcgaguacaucaccucccucgaccucuccgccaacgagcuccgcgacaucgacgcccucucccagaagugcugcaucuccguccaccucgagcaccucgagaagcucgagcuccaccagaacgcccucaccuccuucccccagcagcucugcgagacccucaagucccucacccaccucgaccuccacuccaacaaguucaccuccuuccccuccuaccuccucaagauguccugcaucgccaaccucgacgucucccgcaacgacaucggccccuccgucguccucgaccccaccgucaagugccccacccucaagcaguucaaccucuccuacaaccagcucuccuucguccccgagaaccucaccgacgucgucgagaagcucgagcagcucauccucgagggcaacaagaucuccggcaucugcuccccccuccgccucaaggagcucaagauccucaaccucuccaagaaccacaucuccucccucuccgagaacuuccucgaggccugccccaaggucgaguccuucuccgcccgcaugaacuuccucgccgccaugcccuuccucccccccuccaugaccauccucaagcucucccagaacaaguucuccugcauccccgaggccauccucaaccucccccaccuccgcucccucgacauguccuccaacgacauccaguaccuccccggccccgcccacuggaagucccucaaccuccgcgagcuccucuucucccacaaccagaucuccauccucgaccucuccgagaaggccuaccucuggucccgcgucgagaagcuccaccucucccacaacaagcucaaggagaucccccccgagaucggcugccucgagaaccucaccucccucgacgucuccuacaaccucgagcuccgcuccuuccccaacgagaugggcaagcucuccaagaucugggaccucccccucgacgagcuccaccucaacuucgacuucaagcacaucggcugcaaggccaaggacaucauccgcuuccuccagcagcgccucaagaaggccguccccuacaaccgcaugaagcucaugaucgucggcaacaccggcuccggcaagaccacccuccuccagcagcucaugaagaccaagaaguccgaccucggcaugcaguccgccaccgucggcaucgacgucaaggacuggcccauccagauccgcgacaagcgcaagcgcgaccucguccucaacgucugggacuucgccggccgcgaggaguucuacuccacccacccccacuucaugacccagcgcgcccucuaccucgccgucuacgaccucuccaagggccaggccgaggucgacgccaugaagcccuggcucuucaacaucaaggcccgcgccuccuccucccccgucauccucgucggcacccaccucgacgucuccgacgagaagcagcgcaaggccugcauguccaagaucaccaaggagcuccucaacaagcgcggcuuccccgccauccgcgacuaccacuucgucaacgccaccgaggaguccgacgcccucgccaagcuccgcaagaccaucaucaacgagucccucaacuucaagauccgcgaccagcucgucgucggccagcucauccccgacugcuacgucgagcucgagaagaucauccucuccgagcgcaagaacguccccaucgaguuccccgucaucgaccgcaagcgccuccuccagcucguccgcgagaaccagcuccagcucgacgagaacgagcucccccacgccguccacuuccucaacgaguccggcguccuccuccacuuccaggaccccgcccuccagcucuccgaccucuacuucgucgagcccaaguggcucugcaagaucauggcccagauccucaccgucaaggucgagggcugccccaagcaccccaagggcaucaucucccgccgcgacgucgagaaguuccucuccaagaagcgcaaguuccccaagaacuacaugucccaguacuucaagcuccucgagaaguuccagaucgcccuccccaucggcgaggaguaccuccucguccccuccucccucuccgaccaccgccccgucaucgagcucccccacugcgagaacuccgagaucaucauccgccucuacgagaugcccuacuuccccaugggcuucuggucccgccucaucaaccgccuccucgagaucucccccuacaugcucuccggccgcgagcgcgcccuccgccccaaccgcauguacuggcgccagggcaucuaccucaacuggucccccgaggccuacugccucgucggcuccgagguccucgacaaccaccccgaguccuuccucaagaucaccguccccuccugccgcaagggcugcauccuccucggccaggucgucgaccacaucgacucccucauggaggagugguuccccggccuccucgagaucgacaucugcggcgagggcgagacccuccucaagaagugggcccucuacuccuucaacgacggcgaggagcaccagaagauccuccucgacgaccucaugaagaaggccgaggagggcgaccuccucgucaaccccgaccagccccgccucaccauccccaucucccagaucgcccccgaccucauccucgccgaccucccccgcaacaucaugcucaacaacgacgagcucgaguucgagcaggcccccgaguuccuccucggcgacggcuccuucggcuccgucuaccgcgccgccuacgagggcgaggaggucgccgucaagaucuucaacaagcacaccucccuccgccuccuccgccaggagcucgucguccucugccaccuccaccaccccucccucaucucccuccucgccgccggcauccgcccccgcaugcucgucauggagcucgccuccaagggcucccucgaccgccuccuccagcaggacaaggccucccucacccgcacccuccagcaccgcaucgcccuccacgucgccgacggccuccgcuaccuccacuccgccaugaucaucuaccgcgaccucaagccccacaacguccuccucuucacccucuaccccaacgccgccaucaucgccaagaucgccgacuacggcaucgcccaguacugcugccgcaugggcaucaagaccuccgagggcacccccggcuuccgcgcccccgaggucgcccgcggcaacgucaucuacaaccagcaggccgacgucuacuccuucggccuccuccucuacgacauccucaccaccggcggccgcaucgucgagggccucaaguuccccaacgaguucgacgagcucgagauccagggcaagcuccccgaccccgucaaggaguacggcugcgcccccuggcccauggucgagaagcucaucaagcagugccucaaggagaacccccaggagcgccccaccuccgcccaggucuucgacauccucaacuccgccgagcucgucugccucacccgccgcauccuccuccccaagaacgucaucgucgagugcauggucgccacccaccacaacucccgcaacgccuccaucuggcucggcugcggccacaccgaccgcggccagcucuccuuccucgaccucaacaccgagggcuacaccuccgaggaggucgccgacucccgcauccucugccucgcccucguccaccuccccgucgagaaggaguccuggaucgucuccggcacccaguccggcacccuccucgucaucaacaccgaggacggcaagaagcgccacacccucgagaagaugaccgacuccgucaccugccucuacugcaacuccuucuccaagcaguccaagcagaagaacuuccuccucgucggcaccgccgacggcaagcucgccaucuucgaggacaagaccgucaagcucaagggcgccgccccccucaagauccucaacaucggcaacgucuccaccccccucaugugccucuccgaguccaccaacuccaccgagcgcaacgucauguggggcggcugcggcaccaagaucuucuccuucuccaacgacuucaccauccagaagcucaucgagacccgcaccucccagcucuucuccuacgccgccuucuccgacuccaacaucaucaccgucgucgucgacaccgcccucuacaucgccaagcagaacucccccgucgucgaggucugggacaagaagaccgagaagcucugcggccucaucgacugcguccacuuccuccgcgaggucauggucaaggagaacaaggaguccaagcacaagauguccuacuccggccgcgucaagacccucugccuccagaagaacaccgcccucuggaucggcaccggcggcggccacauccuccuccucgaccucuccacccgccgccucauccgcgucaucuacaacuucugcaacuccguccgcgucaugaugaccgcccagcucggcucccucaagaacgucaugcucguccucggcuacaaccgcaagaacaccgagggcacccagaagcagaaggagauccaguccugccucaccgucugggacaucaaccucccccacgagguccagaaccucgagaagcacaucgagguccgcaaggagcucgccgagaagaugcgccgcaccuccgucgaguga

SEQ ID NO: 45542 - RNA, 2151 nt, Artificial Sequence
  derived and/or modified sequence opt2 from LRRN1__Homo_sapiens__NP_065924
auggcccgcauguccuucgucaucgccgccugccagcucguccucggccuccucaugaccucccucaccgaguccuccauccagaacuccgagugcccccagcucugcgucugcgagauccgccccugguucaccccccaguccaccuaccgcgaggccaccaccgucgacugcaacgaccuccgccucacccgcauccccuccaaccucuccuccgacacccagguccuccuccuccaguccaacaacaucgccaagaccgucgacgagcuccagcagcucuucaaccucaccgagcucgacuucucccagaacaacuucaccaacaucaaggaggucggccucgccaaccucacccagcucaccacccuccaccucgaggagaaccagaucaccgagaugaccgacuacugccuccaggaccucuccaaccuccaggagcucuacaucaaccacaaccagaucuccaccaucuccgcccacgccuucgccggccucaagaaccuccuccgccuccaccucaacuccaacaagcucaaggucaucgacucccgcugguucgacuccacccccaaccucgagauccucaugaucggcgagaaccccgucaucggcauccucgacaugaacuucaagccccucgccaaccuccgcucccucguccucgccggcauguaccucaccgacauccccggcaacgcccucgucggccucgacucccucgagucccucuccuucuacgacaacaagcucgucaaggucccccagcucgcccuccagaagguccccaaccucaaguuccucgaccucaacaagaaccccauccacaagauccaggagggcgacuucaagaacaugcuccgccucaaggagcucggcaucaacaacaugggcgagcucgucuccgucgaccgcuacgcccucgacaaccuccccgagcucaccaagcucgaggccaccaacaaccccaagcucuccuacauccaccgccucgccuuccgcuccguccccgcccucgagucccucaugcucaacaacaacgcccucaacgccaucuaccagaagaccgucgagucccuccccaaccuccgcgagaucuccauccacuccaacccccuccgcugcgacugcgucauccacuggaucaacuccaacaagaccaacauccgcuucauggagccccucuccauguucugcgccaugccccccgaguacaagggccaccaggucaaggagguccucauccaggacuccuccgagcagugccuccccaugaucucccacgacuccuuccccaaccgccucaacgucgacaucggcaccaccgucuuccucgacugccgcgccauggccgagcccgagcccgagaucuacugggucacccccaucggcaacaagaucaccgucgagacccucuccgacaaguacaagcucuccuccgagggcacccucgagaucuccaacauccagaucgaggacuccggccgcuacaccugcgucgcccagaacguccagggcgccgacacccgcgucgccaccaucaaggucaacggcacccuccucgacggcacccagguccucaagaucuacgucaagcagaccgagucccacuccauccucgucuccuggaaggucaacuccaacgucaugaccuccaaccucaagugguccuccgccaccaugaagaucgacaacccccacaucaccuacaccgcccgcguccccgucgacguccacgaguacaaccucacccaccuccagcccuccaccgacuacgaggucugccucaccgucuccaacauccaccagcagacccagaaguccugcgucaacgucaccaccaagaacgccgccuucgccgucgacaucuccgaccaggagaccuccaccgcccucgccgccgucaugggcuccauguucgccgucaucucccucgccuccaucgccgucuacuucgccaagcgcuucaagcgcaagaacuaccaccacucccucaagaaguacaugcagaagaccuccuccaucccccucaacgagcucuaccccccccucaucaaccucugggagggcgacuccgagaaggacaaggacggcuccgccgacaccaagcccacccaggucgacaccucccgcuccuacuacaugugguga

SEQ ID NO: 45543 - RNA, 2142 nt, Artificial Sequence
  derived and/or modified sequence opt2 from LRRN2__Homo_sapiens__NP_006329
augcgccuccucgucgccccccuccuccucgccugggucgccggcgccaccgccgccguccccgucguccccuggcacguccccugccccccccagugcgccugccagauccgccccugguacaccccccgcuccuccuaccgcgaggccaccaccgucgacugcaacgaccucuuccucaccgccgucccccccgcccuccccgccggcacccagacccuccuccuccaguccaacuccaucguccgcgucgaccaguccgagcucggcuaccucgccaaccucaccgagcucgaccucucccagaacuccuucuccgacgcccgcgacugcgacuuccacgcccucccccagcuccucucccuccaccucgaggagaaccagcucacccgccucgaggaccacuccuucgccggccucgccucccuccaggagcucuaccucaaccacaaccagcucuaccgcaucgccccccgcgccuucuccggccucuccaaccuccuccgccuccaccucaacuccaaccuccuccgcgccaucgacucccgcugguucgagaugcuccccaaccucgagauccucaugaucggcggcaacaaggucgacgccauccucgacaugaacuuccgcccccucgccaaccuccgcucccucguccucgccggcaugaaccuccgcgagaucuccgacuacgcccucgagggccuccagucccucgagucccucuccuucuacgacaaccagcucgcccgcgucccccgccgcgcccucgagcagguccccggccucaaguuccucgaccucaacaagaacccccuccagcgcgucggccccggcgacuucgccaacaugcuccaccucaaggagcucggccucaacaacauggaggagcucgucuccaucgacaaguucgcccucgucaaccuccccgagcucaccaagcucgacaucaccaacaacccccgccucuccuucauccacccccgcgccuuccaccaccucccccagauggagacccucaugcucaacaacaacgcccucuccgcccuccaccagcagaccgucgagucccuccccaaccuccaggaggucggccuccacggcaaccccauccgcugcgacugcgucauccgcugggccaacgccaccggcacccgcguccgcuucaucgagccccaguccacccucugcgccgagccccccgaccuccagcgccuccccguccgcgagguccccuuccgcgagaugaccgaccacugccucccccucaucuccccccgcuccuucccccccucccuccaggucgccuccggcgaguccaugguccuccacugccgcgcccucgccgagcccgagcccgagaucuacugggucacccccgccggccuccgccucacccccgcccacgccggccgccgcuaccgcgucuaccccgagggcacccucgagcuccgccgcgucaccgccgaggaggccggccucuacaccugcgucgcccagaaccucgucggcgccgacaccaagaccgucuccgucgucgucggccgcgcccuccuccagcccggccgcgacgagggccagggccucgagcuccgcguccaggagacccaccccuaccacauccuccucuccugggucaccccccccaacaccgucuccaccaaccucaccugguccuccgccuccucccuccgcggccagggcgccaccgcccucgcccgccucccccgcggcacccacuccuacaacaucacccgccuccuccaggccaccgaguacugggccugccuccaggucgccuucgccgacgcccacacccagcucgccugcgucugggcccgcaccaaggaggccaccuccugccaccgcgcccucggcgaccgccccggccucaucgccauccucgcccucgccguccuccuccucgccgccggccucgccgcccaccucggcaccggccagccccgcaagggcgucggcggccgccgcccccucccccccgccugggccuucuggggcugguccgcccccuccguccgcgucgucuccgccccccucguccuccccuggaaccccggccgcaagcucccccgcuccuccgagggcgagacccuccuccccccccucucccagaacuccuga

SEQ ID NO: 45544 - RNA, 2127 nt, Artificial Sequence
  derived and/or modified sequence opt2 from LRRN3__Homo_sapiens__NP_001093128
augaaggacaugccccuccgcauccacguccuccucggccucgccaucaccacccucguccaggccgucgacaagaaggucgacugcccccgccucugcaccugcgagauccgccccugguucaccccccgcuccaucuacauggaggccuccaccgucgacugcaacgaccucggccuccucaccuuccccgcccgccuccccgccaacacccagauccuccuccuccagaccaacaacaucgccaagaucgaguacuccaccgacuuccccgucaaccucaccggccucgaccucucccagaacaaccucuccuccgucaccaacaucaacgucaagaagaugccccagcuccucuccgucuaccucgaggagaacaagcucaccgagcuccccgagaagugccucuccgagcucuccaaccuccaggagcucuacaucaaccacaaccuccucuccaccaucucccccggcgccuucaucggccuccacaaccuccuccgccuccaccucaacuccaaccgccuccagaugaucaacuccaagugguucgacgcccuccccaaccucgagauccucaugaucggcgagaaccccaucauccgcaucaaggacaugaacuucaagccccucaucaaccuccgcucccucgucaucgccggcaucaaccucaccgagauccccgacaacgcccucgucggccucgagaaccucgaguccaucuccuucuacgacaaccgccucaucaaggucccccacgucgcccuccagaaggucgucaaccucaaguuccucgaccucaacaagaaccccaucaaccgcauccgccgcggcgacuucuccaacaugcuccaccucaaggagcucggcaucaacaacaugcccgagcucaucuccaucgacucccucgccgucgacaaccuccccgaccuccgcaagaucgaggccaccaacaacccccgccucuccuacauccaccccaacgccuucuuccgccuccccaagcucgagucccucaugcucaacuccaacgcccucuccgcccucuaccacggcaccaucgagucccuccccaaccucaaggagaucuccauccacuccaaccccauccgcugcgacugcgucauccgcuggaugaacaugaacaagaccaacauccgcuucauggagcccgacucccucuucugcgucgacccccccgaguuccagggccagaacguccgccagguccacuuccgcgacaugauggagaucugccucccccucaucgcccccgaguccuuccccuccaaccucaacgucgaggccggcuccuacgucuccuuccacugccgcgccaccgccgagccccagcccgagaucuacuggaucacccccuccggccagaagcuccuccccaacacccucaccgacaaguucuacguccacuccgagggcacccucgacaucaacggcgucacccccaaggagggcggccucuacaccugcaucgccaccaaccucgucggcgccgaccucaaguccgucaugaucaaggucgacggcuccuucccccaggacaacaacggcucccucaacaucaagauccgcgacauccaggccaacuccguccucgucuccuggaaggccuccuccaagauccucaaguccuccgucaaguggaccgccuucgucaagaccgagaacucccacgccgcccaguccgcccgcauccccuccgacgucaaggucuacaaccucacccaccucaaccccuccaccgaguacaagaucugcaucgacauccccaccaucuaccagaagaaccgcaagaagugcgucaacgucaccaccaagggccuccaccccgaccagaaggaguacgagaagaacaacaccaccacccucauggccugccucggcggccuccucggcaucaucggcgucaucugccucaucuccugccucucccccgagaugaacugcgacggcggccacuccuacguccgcaacuaccuccagaagcccaccuucgcccucggcgagcucuaccccccccucaucaaccucugggaggccggcaaggagaaguccaccucccucaaggucaaggccaccgucaucggccuccccaccaacauguccuga

SEQ ID NO: 45545 - RNA, 2223 nt, Artificial Sequence
  derived and/or modified sequence opt2 from LRRN4__Homo_sapiens__NP_689824
augcgccagacccucccccuccuccuccucaccguccuccgccccuccugggccgaccccccccaggagaaggucccccucuuccgcgucacccagcagggccccuggggcuccuccggcuccaacgccaccgacucccccugcgagggccuccccgccgccgacgccaccgcccucacccucgccaaccgcaaccucgagcgccuccccggcugccucccccgcacccuccgcucccucgacgccucccacaaccuccuccgcgcccucuccaccuccgagcucggccaccucgagcagcuccagguccucacccuccgccacaaccgcaucgccgcccuccgcuggggccccggcggccccgccggccuccacacccucgaccucuccuacaaccagcucgccgcccucccccccugcaccggccccgcccucuccucccuccgcgcccucgcccucgccggcaacccccuccgcgcccuccagccccgcgccuucgccugcuuccccgcccuccagcuccucaaccucuccugcaccgcccucggccgcggcgcccagggcggcaucgccgaggccgccuucgccggcgaggacggcgccccccucgucacccucgagguccucgaccucuccggcaccuuccucgagcgcgucgaguccggcuggauccgcgaccuccccaagcucaccucccucuaccuccgcaagaugccccgccucaccacccucgagggcgacaucuucaagaugacccccaaccuccagcagcucgacugccaggacucccccgcccucgccuccgucgccacccacaucuuccaggacaccccccaccuccagguccuccucuuccagaacugcaaccucuccuccuucccccccuggacccucgacuccucccagguccucuccaucaaccucuucggcaacccccucaccugcuccugcgaccucuccuggcuccucaccgacgccaagcgcaccguccucucccgcgccgccgacaccaugugcgcccccgccgccggcuccuccggccccuucuccgccucccucucccucucccagcuccccggcgucugccaguccgaccaguccaccacccucggcgccucccacccccccugcuucaaccgcuccaccuacgcccagggcaccaccgucgcccccuccgccgcccccgccacccgccccgccggcgaccagcaguccgucuccaaggcccccaacgucggcucccgcaccaucgccgccuggccccacuccgacgcccgcgagggcaccgcccccuccaccaccaacuccgucgccggccacuccaacuccuccgucuucccccgcgccgccuccaccacccgcacccagcaccgcggcgagcacgcccccgagcucguccucgagcccgacaucuccgccgccuccaccccccucgccuccaagcuccucggccccuuccccaccuccugggaccgcuccaucuccuccccccagcccggccagcgcacccacgccaccccccaggcccccaaccccucccucuccgagggcgagauccccguccuccuccucgacgacuacuccgaggaggaggagggccgcaaggaggaggucggcaccccccaccaggacguccccugcgacuaccaccccugcaagcaccuccagacccccugcgccgagcuccagcgccgcuggcgcugccgcugccccggccucuccggcgaggacaccauccccgaccccccccgccuccagggcgucaccgagaccaccgacaccuccgcccucguccacuggugcgcccccaacuccgucguccacggcuaccagauccgcuacuccgccgagggcugggccggcaaccaguccgucgucggcgucaucuacgccaccgcccgccagcacccccucuacggccucucccccggcaccaccuaccgcgucugcguccucgccgccaaccgcgccggccucucccagccccgcuccuccggcuggcgcucccccugcgccgccuucaccaccaagcccuccuucgcccuccuccucuccggccucugcgccgccuccggccuccuccucgccuccaccgucguccucuccgccugccucugccgccgcggccagacccucggccuccagcgcugcgacacccaccucgucgccuacaagaaccccgccuucgacgacuacccccucggccuccagaccgucuccuga

SEQ ID NO: 45546 - RNA, 1569 nt, Artificial Sequence
  derived and/or modified sequence opt2 from LRRTM1__Homo_sapiens__NP_849161
auggacuuccuccuccucggccucugccucuacuggcuccuccgccgccccuccggcgucguccucugccuccucggcgccugcuuccagaugcuccccgccgcccccuccggcugcccccagcucugccgcugcgagggccgccuccucuacugcgaggcccucaaccucaccgaggccccccacaaccucuccggccuccucggccucucccuccgcuacaacucccucuccgagcuccgcgccggccaguucaccggccucaugcagcucaccuggcucuaccucgaccacaaccacaucugcuccguccagggcgacgccuuccagaagcuccgccgcgucaaggagcucacccucuccuccaaccagaucacccagcuccccaacaccaccuuccgccccaugcccaaccuccgcuccgucgaccucuccuacaacaagcuccaggcccucgcccccgaccucuuccacggccuccgcaagcucaccacccuccacaugcgcgccaacgccauccaguucguccccguccgcaucuuccaggacugccgcucccucaaguuccucgacaucggcuacaaccagcucaagucccucgcccgcaacuccuucgccggccucuucaagcucaccgagcuccaccucgagcacaacgaccucgucaaggucaacuucgcccacuucccccgccucaucucccuccacucccucugccuccgccgcaacaaggucgccaucgucgucuccucccucgacugggucuggaaccucgagaagauggaccucuccggcaacgagaucgaguacauggagccccacgucuucgagaccgucccccaccuccagucccuccagcucgacuccaaccgccucaccuacaucgagccccgcauccucaacuccuggaagucccucaccuccaucacccucgccggcaaccucugggacugcggccgcaacgucugcgcccucgccuccuggcucaacaacuuccagggccgcuacgacggcaaccuccagugcgccucccccgaguacgcccagggcgaggacguccucgacgccgucuacgccuuccaccucugcgaggacggcgccgagcccaccuccggccaccuccucuccgccgucaccaaccgcuccgaccucggcccccccgccuccuccgccaccacccucgccgacggcggcgagggccagcacgacggcaccuucgagcccgccaccgucgcccuccccggcggcgagcacgccgagaacgccguccagauccacaaggucgucaccggcaccauggcccucaucuucuccuuccucaucgucguccucguccucuacgucuccuggaagugcuuccccgccucccuccgccagcuccgccagugcuucgucacccagcgccgcaagcagaagcagaagcagaccaugcaccagauggccgccauguccgcccaggaguacuacgucgacuacaagcccaaccacaucgagggcgcccucgucaucaucaacgaguacggcuccugcaccugccaccagcagcccgcccgcgagugcgaggucuga

SEQ ID NO: 45547 - RNA, 1551 nt, Artificial Sequence
  derived and/or modified sequence opt2 from LRRTM2__Homo_sapiens__NP_056379
augggccuccacuucaaguggccccucggcgcccccaugcucgccgccaucuacgccauguccaugguccucaagaugcuccccgcccucggcauggccugcccccccaagugccgcugcgagaagcuccucuucuacugcgacucccagggcuuccacuccguccccaacgccaccgacaagggcucccucggccucucccuccgccacaaccacaucaccgagcucgagcgcgaccaguucgccuccuucucccagcucaccuggcuccaccucgaccacaaccagaucuccaccgucaaggaggacgccuuccagggccucuacaagcucaaggagcucauccucuccuccaacaagaucuucuaccuccccaacaccaccuucacccagcucaucaaccuccagaaccucgaccucuccuucaaccagcucuccucccuccaccccgagcucuucuacggccuccgcaagcuccagacccuccaccuccgcuccaacucccuccgcaccauccccguccgccucuucugggacugccgcucccucgaguuccucgaccucuccaccaaccgccuccgcucccucgcccgcaacggcuucgccggccucaucaagcuccgcgagcuccaccucgagcacaaccagcucaccaagaucaacuucgcccacuuccuccgccucuccucccuccacacccucuuccuccaguggaacaagaucuccaaccucaccugcggcauggaguggaccuggggcacccucgagaagcucgaccucaccggcaacgagaucaaggccaucgaccucaccgucuucgagaccaugcccaaccucaagauccuccucauggacaacaacaagcucaacucccucgacuccaagauccucaacucccuccgcucccucaccaccgucggccucuccggcaaccucugggagugcuccgcccgcaucugcgcccucgccuccuggcucggcuccuuccagggccgcugggagcacuccauccucugccacucccccgaccacacccagggcgaggacauccucgacgccguccacggcuuccagcucugcuggaaccucuccaccaccgucaccgucauggccaccaccuaccgcgaccccaccaccgaguacaccaagcgcaucuccuccuccuccuaccacgucggcgacaaggagauccccaccaccgccggcaucgccgucaccaccgaggagcacuuccccgagcccgacaacgccaucuucacccagcgcgucaucaccggcaccauggcccuccucuucuccuucuucuucaucaucuucaucgucuucaucucccgcaagugcugcccccccacccuccgccgcauccgccagugcuccaugguccagaaccaccgccagcuccgcucccagacccgccuccacauguccaacauguccgaccagggccccuacaacgaguacgagcccacccacgagggccccuucaucaucaucaacggcuacggccagugcaagugccagcagcuccccuacaaggagugcgaggucuga

SEQ ID NO: 45548 - RNA, 1746 nt, Artificial Sequence
  derived and/or modified sequence opt2 from LRRTM3__Homo_sapiens__NP_821079
augggcuucaacgucauccgccuccucuccggcuccgccgucgcccucgucaucgcccccaccguccuccucaccaugcucuccuccgccgagcgcggcugccccaagggcugccgcugcgagggcaagauggucuacugcgagucccagaagcuccaggagauccccuccuccaucuccgccggcugccucggccucucccuccgcuacaacucccuccagaagcucaaguacaaccaguucaagggccucaaccagcucaccuggcucuaccucgaccacaaccacaucuccaacaucgacgagaacgccuucaacggcauccgccgccucaaggagcucauccucuccuccaaccgcaucuccuacuuccucaacaacaccuuccgccccgucaccaaccuccgcaaccucgaccucuccuacaaccagcuccacucccucggcuccgagcaguuccgcggccuccgcaagcuccucucccuccaccuccgcuccaacucccuccgcaccauccccguccgcaucuuccaggacugccgcaaccucgagcuccucgaccucggcuacaaccgcauccgcucccucgcccgcaacgucuucgccggcaugauccgccucaaggagcuccaccucgagcacaaccaguucuccaagcucaaccucgcccucuucccccgccucgucucccuccagaaccucuaccuccaguggaacaagaucuccgucaucggccagaccauguccuggaccugguccucccuccagcgccucgaccucuccggcaacgagaucgaggccuucuccggccccuccgucuuccagugcguccccaaccuccagcgccucaaccucgacuccaacaagcucaccuucaucggccaggagauccucgacuccuggaucucccucaacgacaucucccucgccggcaacaucugggagugcucccgcaacaucugcucccucgucaacuggcucaaguccuucaagggccuccgcgagaacaccaucaucugcgccucccccaaggagcuccagggcgucaacgucaucgacgccgucaagaacuacuccaucugcggcaaguccaccaccgagcgcuucgaccucgcccgcgcccuccccaagcccaccuucaagcccaagcucccccgccccaagcacgaguccaagcccccccucccccccaccgucggcgccaccgagcccggccccgagaccgacgccgacgccgagcacaucuccuuccacaagaucaucgccggcuccgucgcccucuuccucuccguccucgucauccuccucgucaucuacgucuccuggaagcgcuaccccgccuccaugaagcagcuccagcagcgcucccucaugcgccgccaccgcaagaagaagcgccagucccucaagcagaugacccccuccacccaggaguucuacgucgacuacaagcccaccaacaccgagaccuccgagaugcuccucaacggcaccggccccugcaccuacaacaaguccggcucccgcgagugcgagaucccccucuccaugaacgucuccaccuuccucgccuacgaccagcccaccaucuccuacugcggcguccaccacgagcuccucucccacaaguccuucgagaccaacgcccaggaggacaccauggagacccaccucgagaccgagcucgaccucuccaccaucaccaccgccggccgcaucuccgaccacaagcagcagcucgccuga

SEQ ID NO: 45549 - RNA, 1773 nt, Artificial Sequence
  derived and/or modified sequence opt2 from LRRTM4__Homo_sapiens__NP_001128217
augggcuuccaccucaucacccagcucaagggcauguccgucguccucguccuccuccccacccuccuccucgucaugcucaccggcgcccagcgcgccugccccaagaacugccgcugcgacggcaagaucgucuacugcgagucccacgccuucgccgacauccccgagaacaucuccggcggcucccagggccucucccuccgcuucaacuccauccagaagcucaaguccaaccaguucgccggccucaaccagcucaucuggcucuaccucgaccacaacuacaucuccuccgucgacgaggacgccuuccagggcauccgccgccucaaggagcucauccucuccuccaacaagaucaccuaccuccacaacaagaccuuccaccccguccccaaccuccgcaaccucgaccucuccuacaacaagcuccagacccuccaguccgagcaguucaagggccuccgcaagcucaucauccuccaccuccgcuccaacucccucaagaccguccccauccgcgucuuccaggacugccgcaaccucgacuuccucgaccucggcuacaaccgccuccgcucccucucccgcaacgccuucgccggccuccucaagcucaaggagcuccaccucgagcacaaccaguucuccaagaucaacuucgcccacuucccccgccucuucaaccuccgcuccaucuaccuccaguggaaccgcauccgcuccaucucccagggccucaccuggaccugguccucccuccacaaccucgaccucuccggcaacgacauccagggcaucgagcccggcaccuucaagugccuccccaaccuccagaagcucaaccucgacuccaacaagcucaccaacaucucccaggagaccgucaacgccuggaucucccucaucuccaucacccucuccggcaacaugugggagugcucccgcuccaucugcccccucuucuacuggcucaagaacuucaagggcaacaaggaguccaccaugaucugcgccggccccaagcacauccagggcgagaaggucuccgacgccgucgagaccuacaacaucugcuccgagguccaggucgucaacaccgagcgcucccaccucgucccccagaccccccagaagccccucaucaucccccgccccaccaucuucaagcccgacgucacccaguccaccuucgagacccccucccccucccccggcuuccagauccccggcgccgagcaggaguacgagcacgucuccuuccacaagaucaucgccggcuccgucgcccucuuccucuccgucgccaugauccuccucgucaucuacgucuccuggaagcgcuaccccgccuccaugaagcagcuccagcagcacucccucaugaagcgccgccgcaagaaggcccgcgaguccgagcgccagaugaacuccccccuccaggaguacuacgucgacuacaagcccaccaacuccgagaccauggacaucuccgucaacggcuccggccccugcaccuacaccaucuccggcucccgcgagugcgagaugccccaccacaugaagccccuccccuacuacuccuacgaccagcccgucaucggcuacugccaggcccaccagccccuccacgucaccaagggcuacgagaccgucucccccgagcaggacgagucccccggccucgagcucggccgcgaccacuccuucaucgccaccaucgcccgcuccgccgcccccgccaucuaccucgagcgcaucgccaacuga

SEQ ID NO: 45550 - RNA, 2091 nt, Artificial Sequence
  derived and/or modified sequence opt2 from LRSAM1__Homo_sapiens__NP_001177652
augccccucuucuuccgcaagcgcaagcccuccgaggaggcccgcaagcgccucgaguaccagaugugccucgccaaggaggccggcgccgacgacauccucgacaucuccaagugcgagcucuccgagauccccuucggcgccuucgccaccugcaagguccuccagaagaagguccucaucguccacaccaaccaccucaccucccuccuccccaaguccugcucccuccucucccucgccaccaucaagguccucgaccuccacgacaaccagcucaccgcccuccccgacgaccucggccagcucaccgcccuccagguccucaacgucgagcgcaaccagcucaugcagcucccccgcuccaucggcaaccucacccagcuccagacccucaacgucaaggacaacaagcucaaggagcuccccgacaccgucggcgagcuccgcucccuccgcacccucaacaucuccggcaacgagauccagcgccucccccagaugcucgcccacguccgcacccucgagaugcucucccucgacgccuccgccauggucuaccccccccgcgaggucugcggcgccggcaccgccgccauccuccaguuccucugcaaggaguccggccucgaguacuacccccccucccaguaccuccuccccauccucgagcaggacggcaucgagaacucccgcgacucccccgacggccccaccgaccgcuucucccgcgaggagcucgaguggcagaaccgcuucuccgacuacgagaagcgcaaggagcagaagaugcucgagaagcucgaguucgagcgccgccucgagcucggccagcgcgagcacacccagcuccuccagcaguccuccucccagaaggacgagauccuccagaccgucaaggaggagcagucccgccucgagcagggccucuccgagcaccagcgccaccucaacgccgagcgccagcgccuccaggagcagcucaagcagaccgagcagaacaucuccucccgcauccagaagcuccuccaggacaaccagcgccagaagaaguccuccgagauccucaagucccucgagaacgagcgcauccgcauggagcagcucauguccaucacccaggaggagaccgagucccuccgccgccgcgacgucgccuccgccaugcagcagaugcucaccgaguccugcaagaaccgccucauccagauggccuacgagucccagcgccagaaccucguccagcaggccugcuccuccauggccgagauggacgagcgcuuccagcagauccucuccuggcagcagauggaccagaacaaggccaucucccagauccuccaggaguccgccaugcagaaggccgccuucgaggcccuccaggucaagaaggaccucaugcaccgccagauccgcucccaggagaugaucuccgagcagcgcugggcccucuccucccuccuccagcagcuccucaaggagaagcagcagcgcgaggaggagcuccgcgagauccucaccgagcucgaggccaaguccgagacccgccaggagaacuacuggcucauccaguaccagcgccuccucaaccagaagccccucucccucaagcuccaggaggagggcauggagcgccagcucgucgcccuccucgaggagcucuccgccgagcacuaccuccccaucuucgcccaccaccgccucucccucgaccuccucucccagaugucccccggcgaccucgccaaggucggcgucuccgaggccggccuccagcacgagauccuccgccgcguccaggagcuccucgacgccgcccgcauccagcccgagcucaagccccccaugggcgaggucgucacccccaccgccccccaggagccccccgaguccguccgccccuccgccccccccgccgagcucgagguccaggccuccgagugcgucgucugccucgagcgcgaggcccagaugaucuuccucaacugcggccacgucugcugcugccagcagugcugccagccccuccgcaccugcccccucugccgccaggacaucgcccagcgccuccgcaucuaccacuccuccuga

SEQ ID NO: 45551 - RNA, 810 nt, Artificial Sequence
  derived and/or modified sequence opt2 from LRTM1__Homo_sapiens__NP_001291318
augacccucaaccucuccaacaacucccucuccaaccucgcccccggcgccuuccacggccuccagcaccuccagguccucaaccucacccagaacucccuccucucccucgagucccgccucuuccacucccucccccagcuccgcgagcucgaccucuccuccaacaacaucucccaccuccccaccucccucggcgagaccugggagaaccucaccauccucgccguccagcagaaccagcuccagcagcucgaccgcgcccuccucgaguccaugcccuccguccgccuccuccuccucaaggacaaccucuggaagugcaacugccaccuccucggccucaagcucuggcucgagaaguucgucuacaagggcggccucaccgacggcaucaucugcgagucccccgacaccuggaagggcaaggaccuccuccgcaucccccacgagcucuaccagcccugcccccuccccgcccccgaccccgucuccucccaggcccaguggcccggcuccgcccacggcgucguccuccgcccccccgagaaccacaacgccggcgagcgcgagcuccucgagugcgagcucaagcccaagccccgccccgccaaccuccgccacgccaucgccaccgucaucaucaccggcgucgucugcggcaucgucugccucaugaugcucgccgccgccaucuacggcugcaccuacgccgccaucaccgcccaguaccacggcggcccccucgcccagaccaacgaccccggcaaggucgaggagaaggagcgcuucgacuccucccccgccuga

SEQ ID NO: 45552 - RNA, 477 nt, Artificial Sequence
  derived and/or modified sequence opt2 from LRTOMT__Homo_sapiens__NP_001138779
augaacaagcgcgacuacaugaacaccuccguccaggagcccccccucgacuacuccuuccgcuccauccacgucauccaggaccucgucaacgaggagccccgcaccggccuccgcccccucaagcgcuccaaguccggcaagucccucacccagucccucuggcucaacaacaacguccucaacgaccuccgcgacuucaaccaggucgccucccagcuccucgagcaccccgagaaccucgccuggaucgaccucuccuucaacgaccucaccuccaucgaccccguccucaccaccuucuucaaccucuccguccucuaccuccacggcaacuccauccagcgccucggcgaggucaacaagcucgccguccucccccgccuccgcucccucacccuccacggcaaccccauggaggaggagaagggcuaccgcguccccggcuccgucgagaugccccaccgcccccccuga

SEQ ID NO: 45553 - RNA, 1017 nt, Artificial Sequence
  derived and/or modified sequence opt2 from LSAMP__Homo_sapiens__NP_002329
augguccgccgcguccagcccgaccgcaagcagcucccccucguccuccuccgccuccucugccuccuccccaccggccuccccguccgcuccgucgacuucaaccgcggcaccgacaacaucaccguccgccagggcgacaccgccauccuccgcugcgucgucgaggacaagaacuccaaggucgccuggcucaaccgcuccggcaucaucuucgccggccacgacaaguggucccucgacccccgcgucgagcucgagaagcgccacucccucgaguacucccuccgcauccagaaggucgacgucuacgacgagggcuccuacaccugcuccguccagacccagcacgagcccaagaccucccaggucuaccucaucguccaggucccccccaagaucuccaacaucuccuccgacgucaccgucaacgagggcuccaacgucacccucgucugcauggccaacggccgccccgagcccgucaucaccuggcgccaccucacccccaccggccgcgaguucgagggcgaggaggaguaccucgagauccucggcaucacccgcgagcaguccggcaaguacgagugcaaggccgccaacgaggucuccuccgccgacgucaagcaggucaaggucaccgucaacuacccccccaccaucaccgaguccaaguccaacgaggccaccaccggccgccaggccucccucaagugcgaggccuccgccguccccgcccccgacuucgagugguaccgcgacgacacccgcaucaacuccgccaacggccucgagaucaaguccaccgagggccaguccucccucaccgucaccaacgucaccgaggagcacuacggcaacuacaccugcgucgccgccaacaagcucggcgucaccaacgccucccucguccucuuccgccccggcuccguccgcggcaucaacggcuccaucucccucgccgucccccucuggcuccucgccgccucccuccucugccuccucuccaagugcuga

SEQ ID NO: 45554 - RNA, 1083 nt, Artificial Sequence
  derived and/or modified sequence opt2 from LSM11__Homo_sapiens__NP_775762
auggaggagcgcgagcgcggcgcccgcuccgccggcgccggcucccccgcccgcccccccuccccccgccucgacgucuccuccgacuccuucgacccccuccucgcccucuacgccccccgccucccccccauccccuaccccaacgcccccugcuucaacaacgucgccgaguacgaguccuuccuccgcaccggcguccgcggcggcggccgcggccgcggccgcgcccgcggcgccgccgccggcuccggcguccccgccgcccccggccccuccggccgcacccgccgccgccccgacgcccccgcccccgaccccgagcgcauccagcgccuccgccgccucauggucgccaaggaggagggcgacggcgccgccggcgccggccgccgcggccccggccgcucccgcaaggccccccgcaacguccucacccgcaugccccuccacgagggcuccccccucggcgagcuccaccgcugcauccgcgagggcgucaaggucaacguccacauccgcaccuucaagggccuccgcggcgucugcaccggcuuccucgucgccuucgacaaguucuggaacauggcccucaccgacgucgacgagaccuaccgcaagcccguccucggcaaggccuacgagcgcgacuccucccucacccucacccgccucuucgaccgccucaagcuccaggacuccuccaagaaggaggccgacuccaaguccgccgucgaggacuccacccucucccgcuacucccagaccuccaccuggaagcucgccuccgucuggggccgcgccgacaccggccgcggcucccacaagcgcucccgcuccguccccuccucccuccaggccuccgcccgcgaggagucccgcuccgagcucuccggccgcaccacccgcaccgacggcuccuccgucggcggcaccuucucccgcgccaccacccucucccgcggccagucccgcaagaagaagcgcaagcccaaggucgacuaccagcaggucuucacccgccacaucaaccagaucuucauccgcggcgagaacguccuccucguccaccucgcccaguga

SEQ ID NO: 45555 - RNA, 402 nt, Artificial Sequence
  derived and/or modified sequence opt2 from LSM1__Homo_sapiens__NP_055277
augaacuacaugcccggcaccgccucccucaucgaggacaucgacaagaagcaccucguccuccuccgcgacggccgcacccucaucggcuuccuccgcuccaucgaccaguucgccaaccucguccuccaccagaccgucgagcgcauccacgucggcaagaaguacggcgacaucccccgcggcaucuucgucguccgcggcgagaacgucguccuccucggcgagaucgaccucgagaaggaguccgacaccccccuccagcaggucuccaucgaggagauccucgaggagcagcgcgucgagcagcagaccaagcucgaggccgagaagcucaagguccaggcccucaaggaccgcggccucuccaucccccgcgccgacacccucgacgaguacuga

SEQ ID NO: 45556 - RNA, 288 nt, Artificial Sequence
  derived and/or modified sequence opt2 from LSM2__Homo_sapiens__NP_067000
augcucuucuacuccuucuucaagucccucgucggcaaggacgucgucgucgagcucaagaacgaccucuccaucugcggcacccuccacuccgucgaccaguaccucaacaucaagcucaccgacaucuccgucaccgaccccgagaaguacccccacaugcucuccgucaagaacugcuucauccgcggcuccgucguccgcuacguccagcuccccgccgacgaggucgacacccagcuccuccaggacgccgcccgcaaggaggcccuccagcagaagcaguga

SEQ ID NO: 45557 - RNA, 309 nt, Artificial Sequence
  derived and/or modified sequence opt2 from LSM3__Homo_sapiens__NP_055278
auggccgacgacgucgaccagcagcagaccaccaacaccgucgaggagccccucgaccucauccgccucucccucgacgagcgcaucuacgucaagaugcgcaacgaccgcgagcuccgcggccgccuccacgccuacgaccagcaccucaacaugauccucggcgacgucgaggagaccgucaccaccaucgagaucgacgaggagaccuacgaggagaucuacaaguccaccaagcgcaacauccccaugcucuucguccgcggcgacggcgucguccucgucgcccccccccuccgcgucggcuga

SEQ ID NO: 45558 - RNA, 420 nt, Artificial Sequence
  derived and/or modified sequence opt2 from LSM4__Homo_sapiens__NP_036453
augcucccccucucccuccucaagaccgcccagaaccaccccaugcucgucgagcucaagaacggcgagaccuacaacggccaccucgucuccugcgacaacuggaugaacaucaaccuccgcgaggucaucugcaccucccgcgacggcgacaaguucuggcgcaugcccgagugcuacauccgcggcuccaccaucaaguaccuccgcauccccgacgagaucaucgacauggucaaggaggaggucgucgccaagggccgcggccgcggcggccuccagcagcagaagcagcagaagggccgcggcaugggcggcgccggccgcggcgucuucggcggccgcggccgcggcggcauccccggcaccggccgcggccagcccgagaagaagcccggccgccaggccggcaagcaguga

SEQ ID NO: 45559 - RNA, 276 nt, Artificial Sequence
  derived and/or modified sequence opt2 from LSM5__Homo_sapiens__NP_036454
auggccgccaacgccaccaccaaccccucccagcuccucccccucgagcucgucgacaagugcaucggcucccgcauccacaucgucaugaaguccgacaaggagaucgucggcacccuccucggcuucgacgacuucgucaacaugguccucgaggacgucaccgaguucgagaucacccccgagggccgccgcaucaccaagcucgaccagauccuccucaacggcaacaacaucaccaugcucguccccggcggcgagggccccgaggucuga

SEQ ID NO: 45560 - RNA, 243 nt, Artificial Sequence
  derived and/or modified sequence opt2 from LSM6__Homo_sapiens__NP_009011
augucccuccgcaagcagacccccuccgacuuccucaagcagaucaucggccgccccgucgucgucaagcucaacuccggcgucgacuaccgcggcguccucgccugccucgacggcuacaugaacaucgcccucgagcagaccgaggaguacgucaacggccagcucaagaacaaguacggcgacgccuucauccgcggcaacaacguccucuacaucuccacccagaagcgccgcauguga

SEQ ID NO: 45561 - RNA, 312 nt, Artificial Sequence
  derived and/or modified sequence opt2 from LSM7__Homo_sapiens__NP_057283
auggccgacaaggagaagaagaagaaggaguccauccucgaccucuccaaguacaucgacaagaccauccgcgucaaguuccagggcggccgcgaggccuccggcauccucaagggcuucgacccccuccucaaccucguccucgacggcaccaucgaguacaugcgcgaccccgacgaccaguacaagcucaccgaggacacccgccagcucggccucgucgucugccgcggcaccuccgucguccucaucugcccccaggacggcauggaggccauccccaaccccuucauccagcagcaggacgccuga

SEQ ID NO: 45562 - RNA, 834 nt, Artificial Sequence
  derived and/or modified sequence opt2 from LSP1__Homo_sapiens__NP_001013273
augcuccucucccucaagcccuccgaggcccccgagcucgacgaggacgagggcuucggcgacuggucccagcgccccgagcagcgccagcagcacgagggcgcccagggcgcccucgacuccggcgagcccccccagugccgcucccccgagggcgagcaggaggaccgccccggccuccacgccuacgagaaggaggacuccgacgagguccaccucgaggagcucucccucuccaaggagggccccggccccgaggacaccguccaggacaaccucggcgccgccggcgccgaggaggagcaggaggagcaccagaagugccagcagccccgcacccccuccccccucguccucgagggcaccaucgagcaguccucccccccccucucccccaccaccaagcucaucgaccgcaccgagucccucaaccgcuccaucgagaaguccaacuccgucaagaagucccagcccgaccuccccaucuccaagaucgaccaguggcucgagcaguacacccaggccaucgagaccgccggccgcacccccaagcucgcccgccaggccuccaucgagcuccccuccauggccgucgccuccaccaagucccgcugggagaccggcgagguccaggcccaguccgccgccaagacccccuccugcaaggacaucgucgccggcgacauguccaagaagucccucugggagcagaagggcggcuccaagaccuccuccaccaucaaguccacccccuccggcaagcgcuacaaguucgucgccaccggccacggcaaguacgagaagguccucgucgagggcggccccgcccccuga

SEQ ID NO: 45563 - RNA, 1890 nt, Artificial Sequence
  derived and/or modified sequence opt2 from LSR__Homo_sapiens__NP_001247418
augcagcaggacggccucggcgucggcacccgcaacggcuccggcaagggccgcuccguccaccccuccuggcccuggugcgccccccgcccccuccgcuacuucggccgcgacgcccgcgcccgccgcgcccagaccgccgccauggcccuccucgccggcggccucucccgcggccucggcucccaccccgccgccgccggccgcgacgccgucgucuucgucuggcuccuccucuccaccuggugcaccgcccccgcccgcgccauccaggucaccgucuccaaccccuaccacgucgucauccucuuccagcccgucacccuccccugcaccuaccagaugaccuccacccccacccagcccaucgucaucuggaaguacaaguccuucugccgcgaccgcaucgccgacgccuucucccccgccuccgucgacaaccagcucaacgcccagcucgccgccggcaaccccggcuacaaccccuacgucgagugccaggacuccguccgcaccguccgcgucgucgccaccaagcagggcaacgccgucacccucggcgacuacuaccagggccgccgcaucaccaucaccggcaacgccgaccucaccuucgaccagaccgccuggggcgacuccggcgucuacuacugcuccgucgucuccgcccaggaccuccagggcaacaacgaggccuacgccgagcucaucguccucgacuggcucuucgucgucgucgucugccucgccgccuuccucaucuuccuccuccucggcaucugcuggugccagugcugcccccacaccugcugcugcuacguccgcugccccugcugccccgacaagugcugcugccccgaggcccucuacgccgccggcaaggccgccaccuccggcguccccuccaucuacgcccccuccaccuacgcccaccucucccccgccaagaccccccccccccccgccaugauccccaugggccccgccuacaacggcuaccccggcggcuaccccggcgacgucgaccgcuccuccuccgccggcggccagggcuccuacgucccccuccuccgcgacaccgacuccuccgucgccuccguccgcuccggcuaccgcauccaggccucccagcaggacgacuccaugcgcguccucuacuacauggagaaggagcucgccaacuucgaccccucccgccccggcccccccuccggccgcgucgagcgcgccauguccgaggucaccucccuccacgaggacgacuggcgcucccgccccucccgcggccccgcccucacccccauccgcgacgaggaguggggcggccacuccccccgcuccccccgcggcugggaccaggagcccgcccgcgagcaggccggcggcggcuggcgcgcccgccgcccccgcgcccgcuccgucgacgcccucgacgaccucaccccccccuccaccgccgaguccggcucccgcucccccaccuccaacggcggccgcucccgcgccuacaugcccccccgcucccgcucccgcgacgaccucuacgaccaggacgacucccgcgacuucccccgcucccgcgacccccacuacgacgacuuccgcucccgcgagcgcccccccgccgacccccgcucccaccaccaccgcacccgcgacccccgcgacaacggcucccgcuccggcgaccuccccuacgacggccgccuccucgaggaggccguccgcaagaagggcuccgaggagcgccgccgcccccacaaggaggaggaggaggaggccuacuacccccccgcccccccccccuacuccgagaccgacucccaggccucccgcgagcgccgccucaagaagaaccucgcccucucccgcgagucccucgucgucuga

SEQ ID NO: 45564 - RNA, 2199 nt, Artificial Sequence
  derived and/or modified sequence opt2 from LSS__Homo_sapiens__NP_001001438
augaccgagggcaccugccuccgccgccgcggcggccccuacaagaccgagcccgccaccgaccucggccgcuggcgccucaacugcgagcgcggccgccagaccuggaccuaccuccaggacgagcgcgccggccgcgagcagaccggccucgaggccuacgcccucggccucgacaccaagaacuacuucaaggaccuccccaaggcccacaccgccuucgagggcgcccucaacggcaugaccuucuacgucggccuccaggccgaggacggccacuggaccggcgacuacggcggcccccucuuccuccuccccggccuccucaucaccugccacgucgcccgcaucccccuccccgccggcuaccgcgaggagaucguccgcuaccuccgcuccguccagcuccccgacggcggcuggggccuccacaucgaggacaaguccaccgucuucggcaccgcccucaacuacgucucccuccgcauccucggcgucggccccgacgaccccgaccucguccgcgcccgcaacauccuccacaagaagggcggcgccgucgccauccccuccuggggcaaguucuggcucgccguccucaacgucuacuccugggagggccucaacacccucuuccccgagauguggcucuuccccgacugggcccccgcccaccccuccacccucuggugccacugccgccaggucuaccuccccauguccuacugcuacgccguccgccucuccgccgccgaggacccccucguccagucccuccgccaggagcucuacgucgaggacuucgccuccaucgacuggcucgcccagcgcaacaacgucgcccccgacgagcucuacaccccccacuccuggcuccuccgcgucgucuacgcccuccucaaccucuacgagcaccaccacuccgcccaccuccgccagcgcgccguccagaagcucuacgagcacaucgucgccgacgaccgcuucaccaaguccaucuccaucggccccaucuccaagaccaucaacaugcucguccgcugguacgucgacggccccgccuccaccgccuuccaggagcacgucucccgcauccccgacuaccucuggaugggccucgacggcaugaagaugcagggcaccaacggcucccagaucugggacaccgccuucgccauccaggcccuccucgaggccggcggccaccaccgccccgaguucuccuccugccuccagaaggcccacgaguuccuccgccucucccagguccccgacaacccccccgacuaccagaaguacuaccgccagaugcgcaagggcggcuucuccuucuccacccucgacugcggcuggaucgucuccgacugcaccgccgaggcccucaaggccguccuccuccuccaggagaagugcccccacgucaccgagcacaucccccgcgagcgccucugcgacgccgucgccguccuccucaacaugcgcaaccccgacggcggcuucgccaccuacgagaccaagcgcggcggccaccuccucgagcuccucaaccccuccgaggucuucggcgacaucaugaucgacuacaccuacgucgagugcaccuccgccgucaugcaggcccucaaguacuuccacaagcgcuuccccgagcaccgcgccgccgagauccgcgagacccucacccagggccucgaguucugccgccgccagcagcgcgccgacggcuccugggagggcuccuggggcgucugcuucaccuacggcaccugguucggccucgaggccuucgccugcaugggccagaccuaccgcgacggcaccgccugcgccgaggucucccgcgccugcgacuuccuccucucccgccagauggccgacggcggcuggggcgaggacuucgaguccugcgaggagcgccgcuaccuccaguccgcccagucccagauccacaacaccugcugggccaugaugggccucauggccguccgccaccccgacaucgaggcccaggagcgcggcguccgcugccuccucgagaagcagcuccccaacggcgacuggccccaggagaacaucgccggcgucuucaacaaguccugcgccaucuccuacaccuccuaccgcaacaucuuccccaucugggcccucggccgcuucucccagcucuaccccgagcgcgcccucgccggccaccccuga

SEQ ID NO: 45565 - RNA, 201 nt, Artificial Sequence
  derived and/or modified sequence opt2 from LST1__Homo_sapiens__NP_995309
augcucucccgcaacgacgacaucugcaucuacggcggccucggccucggcggccuccuccuccucgccgucguccuccucuccgccugccucugcuggcuccaccgccgcgcccccuccguccucguccccggccccggccuccuccgcgccggcaccccccucugcaucuccgccgaggccgccuccgcccagcaguga

SEQ ID NO: 45566 - RNA, 1836 nt, Artificial Sequence
  derived and/or modified sequence opt2 from LTA4H__Homo_sapiens__NP_000886
augcccgagaucgucgacaccugcucccucgccucccccgccuccgucugccgcaccaagcaccuccaccuccgcugcuccgucgacuucacccgccgcacccucaccggcaccgccgcccucaccguccagucccaggaggacaaccuccgcucccucguccucgacaccaaggaccucaccaucgagaaggucgucaucaacggccaggaggucaaguacgcccucggcgagcgccaguccuacaagggcucccccauggagaucucccuccccaucgcccucuccaagaaccaggagaucgucaucgagaucuccuucgagaccucccccaaguccuccgcccuccaguggcucacccccgagcagaccuccggcaaggagcaccccuaccucuucucccagugccaggccauccacugccgcgccauccuccccugccaggacacccccuccgucaagcucaccuacaccgccgaggucuccguccccaaggagcucgucgcccucauguccgccauccgcgacggcgagacccccgaccccgaggaccccucccgcaagaucuacaaguucauccagaagguccccauccccugcuaccucaucgcccucgucgucggcgcccucgagucccgccagaucggcccccgcacccucgucugguccgagaaggagcaggucgagaaguccgccuacgaguucuccgagaccgaguccaugcucaagaucgccgaggaccucggcggccccuacgucuggggccaguacgaccuccucguccucccccccuccuuccccuacggcggcauggagaaccccugccucaccuucgucacccccacccuccucgccggcgacaagucccucuccaacgucaucgcccacgagaucucccacuccuggaccggcaaccucgucaccaacaagaccugggaccacuucuggcucaacgagggccacaccgucuaccucgagcgccacaucugcggccgccucuucggcgagaaguuccgccacuucaacgcccucggcggcuggggcgagcuccagaacuccgucaagaccuucggcgagacccaccccuucaccaagcucgucgucgaccucaccgacaucgaccccgacgucgccuacuccuccguccccuacgagaagggcuucgcccuccucuucuaccucgagcagcuccucggcggccccgagaucuuccucggcuuccucaaggccuacgucgagaaguucuccuacaaguccaucaccaccgacgacuggaaggacuuccucuacuccuacuucaaggacaaggucgacguccucaaccaggucgacuggaacgccuggcucuacucccccggccucccccccaucaagcccaacuacgacaugacccucaccaacgccugcaucgcccucucccagcgcuggaucaccgccaaggaggacgaccucaacuccuucaacgccaccgaccucaaggaccucuccucccaccagcucaacgaguuccucgcccagacccuccagcgcgccccccucccccucggccacaucaagcgcaugcaggaggucuacaacuucaacgccaucaacaacuccgagauccgcuuccgcuggcuccgccucugcauccaguccaagugggaggacgccaucccccucgcccucaagauggccaccgagcagggccgcaugaaguucacccgcccccucuucaaggaccucgccgccuucgacaagucccacgaccaggccguccgcaccuaccaggagcacaaggccuccaugcaccccgucaccgccaugcucgucggcaaggaccucaaggucgacuga

SEQ ID NO: 45567 - RNA, 618 nt, Artificial Sequence
  derived and/or modified sequence opt2 from LTA__Homo_sapiens__XP_011512920
augaccccccccgagcgccucuuccucccccgcgucugcggcaccacccuccaccuccuccuccucggccuccuccucguccuccuccccggcgcccagggccuccccggcgucggccucacccccuccgccgcccagaccgcccgccagcaccccaagaugcaccucgcccacuccacccucaagcccgccgcccaccucaucggcgaccccuccaagcagaacucccuccucuggcgcgccaacaccgaccgcgccuuccuccaggacggcuucucccucuccaacaacucccuccucguccccaccuccggcaucuacuucgucuacucccaggucgucuucuccggcaaggccuacucccccaaggccaccuccuccccccucuaccucgcccacgagguccagcucuucuccucccaguaccccuuccacgucccccuccucuccucccagaagauggucuaccccggccuccaggagcccuggcuccacuccauguaccacggcgccgccuuccagcucacccagggcgaccagcucuccacccacaccgacggcaucccccaccucguccucucccccuccaccgucuucuucggcgccuucgcccucuga

SEQ ID NO: 45568 - RNA, 1077 nt, Artificial Sequence
  derived and/or modified sequence opt2 from LTB4R2__Homo_sapiens__NP_062813
auguccgucugcuaccgcccccccggcaacgagacccuccucuccuggaagaccucccgcgccaccggcaccgccuuccuccuccucgccgcccuccucggccuccccggcaacggcuucgucgucuggucccucgccggcuggcgccccgcccgcggccgcccccucgccgccacccucguccuccaccucgcccucgccgacggcgccguccuccuccucaccccccucuucgucgccuuccucacccgccaggccuggccccucggccaggccggcugcaaggccgucuacuacgucugcgcccucuccauguacgccuccguccuccucaccggccuccucucccuccagcgcugccucgccgucacccgccccuuccucgccccccgccuccgcucccccgcccucgcccgccgccuccuccucgccgucuggcucgccgcccuccuccucgccguccccgccgccgucuaccgccaccucuggcgcgaccgcgucugccagcucugccaccccucccccguccacgccgccgcccaccucucccucgagacccucaccgccuucguccuccccuucggccucaugcucggcugcuacuccgucacccucgcccgccuccgcggcgcccgcuggggcuccggccgccacggcgcccgcgucggccgccucgucuccgccaucguccucgccuucggccuccucugggcccccuaccacgccgucaaccuccuccaggccgucgccgcccucgccccccccgagggcgcccucgccaagcucggcggcgccggccaggccgcccgcgccggcaccaccgcccucgccuucuucuccuccuccgucaaccccguccucuacgucuucaccgccggcgaccuccucccccgcgccggcccccgcuuccucacccgccucuucgagggcuccggcgaggcccgcggcggcggccgcucccgcgagggcaccauggagcuccgcaccaccccccagcucaaggucgucggccagggccgcggcaacggcgaccccggcggcggcauggagaaggacggccccgagugggaccucuga

SEQ ID NO: 45569 - RNA, 1059 nt, Artificial Sequence
  derived and/or modified sequence opt2 from LTB4R__Homo_sapiens__NP_001137391
augaacaccaccuccuccgccgccccccccucccucggcgucgaguucaucucccuccucgccaucauccuccucuccgucgcccucgccgucggccuccccggcaacuccuucgucgucugguccauccucaagcgcaugcagaagcgcuccgucaccgcccucaugguccucaaccucgcccucgccgaccucgccguccuccucaccgcccccuucuuccuccacuuccucgcccagggcaccugguccuucggccucgccggcugccgccucugccacuacgucugcggcgucuccauguacgccuccguccuccucaucaccgccaugucccucgaccgcucccucgccgucgcccgccccuucgucucccagaagcuccgcaccaaggccauggcccgccgcguccucgccggcaucuggguccucuccuuccuccucgccacccccguccucgccuaccgcaccgucguccccuggaagaccaacaugucccucugcuucccccgcuaccccuccgagggccaccgcgccuuccaccucaucuucgaggccgucaccggcuuccuccuccccuuccucgccgucgucgccuccuacuccgacaucggccgccgccuccaggcccgccgcuuccgccgcucccgccgcaccggccgccucgucguccucaucauccucaccuucgccgccuucuggcuccccuaccacgucgucaaccucgccgaggccggccgcgcccucgccggccaggccgccggccucggccucgucggcaagcgccucucccucgcccgcaacguccucaucgcccucgccuuccucuccuccuccgucaaccccguccucuacgccugcgccggcggcggccuccuccgcuccgccggcgucggcuucgucgccaagcuccucgagggcaccggcuccgaggccuccuccacccgccgcggcggcucccucggccagaccgcccgcuccggccccgccgcccucgagcccggccccuccgagucccucaccgccuccuccccccucaagcucaacgagcucaacuga

SEQ ID NO: 45570 - RNA, 735 nt, Artificial Sequence
  derived and/or modified sequence opt2 from LTB__Homo_sapiens__NP_002332
augggcgcccucggccucgagggccgcggcggccgccuccagggccgcggcucccuccuccucgccgucgccggcgccaccucccucgucacccuccuccucgccguccccaucaccguccucgccguccucgcccucgucccccaggaccagggcggccucgucaccgagaccgccgaccccggcgcccaggcccagcagggccucggcuuccagaagcuccccgaggaggagcccgagaccgaccucucccccggccuccccgccgcccaccucaucggcgccccccucaagggccagggccucggcugggagaccaccaaggagcaggccuuccucaccuccggcacccaguucuccgacgccgagggccucgcccucccccaggacggccucuacuaccucuacugccucgucggcuaccgcggccgcgccccccccggcggcggcgacccccagggccgcuccgucacccuccgcuccucccucuaccgcgccggcggcgccuacggccccggcacccccgagcuccuccucgagggcgccgagaccgucacccccguccucgaccccgcccgccgccagggcuacggcccccucugguacaccuccgucggcuucggcggccucguccagcuccgccgcggcgagcgcgucuacgucaacaucucccaccccgacauggucgacuucgcccgcggcaagaccuucuucggcgccgucauggucggcuga

SEQ ID NO: 45571 - RNA, 4188 nt, Artificial Sequence
  derived and/or modified sequence opt2 from LTBP1__Homo_sapiens__NP_000618
auggacaccaagcucaugugccuccucuucuucuucucccuccccccccuccucgucuccaaccacaccggccgcaucaaggucgucuucacccccuccaucugcaaggucaccugcaccaagggcuccugccagaacuccugcgagaagggcaacaccaccacccucaucuccgagaacggccacgccgccgacacccucaccgccaccaacuuccgcgucgucaucugccaccuccccugcaugaacggcggccagugcuccucccgcgacaagugccagugcccccccaacuucaccggcaagcucugccagauccccguccacggcgccuccguccccaagcucuaccagcacucccagcagcccggcaaggcccucggcacccacgucauccacuccacccacacccucccccucaccgucaccucccagcagggcgucaaggucaaguucccccccaacaucgucaacauccacgucaagcacccccccgaggccuccguccagauccaccaggucucccgcaucgacggccccaccggccagaagaccaaggaggcccagcccggccagucccaggucuccuaccagggccuccccguccagaagacccagaccauccacuccaccuacucccaccagcaggucaucccccacgucuaccccgucgccgccaagacccagcucggccgcugcuuccaggagaccaucggcucccagugcggcaaggcccuccccggccucuccaagcaggaggacugcugcggcaccgucggcaccuccuggggcuucaacaagugccagaagugccccaagaagcccuccuaccacggcuacaaccagaugauggagugccuccccggcuacaagcgcgucaacaacaccuucugccaggacaucaacgagugccagcuccagggcgucugccccaacggcgagugccucaacaccaugggcuccuaccgcugcaccugcaagaucggcuucggccccgaccccaccuucuccuccugcguccccgacccccccgucaucuccgaggagaagggccccugcuaccgccucgucuccuccggccgccagugcaugcacccccucuccguccaccucaccaagcagcucugcugcugcuccgucggcaaggccuggggcccccacugcgagaagugcccccuccccggcaccgccgccuucaaggagaucugccccggcggcaugggcuacaccgucuccggcguccaccgccgccgccccauccaccaccacgucggcaagggccccgucuucgucaagcccaagaacacccagcccgucgccaaguccacccacccccccccccuccccgccaaggaggagcccgucgaggcccucaccuucucccgcgagcacggccccggcgucgccgagcccgaggucgccaccgccccccccgagaaggagauccccucccucgaccaggagaagaccaagcucgagcccggccagccccagcucucccccggcaucuccaccauccaccuccacccccaguuccccgucgucaucgagaagaccuccccccccguccccgucgaggucgcccccgaggccuccaccuccuccgccucccaggucaucgcccccacccaggucaccgagaucaacgagugcaccgucaaccccgacaucugcggcgccggccacugcaucaaccuccccguccgcuacaccugcaucugcuacgagggcuaccgcuucuccgagcagcagcgcaagugcgucgacaucgacgagugcacccagguccagcaccucugcucccagggccgcugcgagaacaccgagggcuccuuccucugcaucugccccgccggcuucauggccuccgaggagggcaccaacugcaucgacgucgacgagugccuccgccccgacgucugcggcgagggccacugcgucaacaccgucggcgccuuccgcugcgaguacugcgacuccggcuaccgcaugacccagcgcggccgcugcgaggacaucgacgagugccucaaccccuccaccugccccgacgagcagugcgucaacucccccggcuccuaccagugcguccccugcaccgagggcuuccgcggcuggaacggccagugccucgacgucgacgagugccucgagcccaacgucugcgccaacggcgacugcuccaaccucgagggcuccuacaugugcuccugccacaagggcuacacccgcacccccgaccacaagcacugccgcgacaucgacgagugccagcagggcaaccucugcgucaacggccagugcaagaacaccgagggcuccuuccgcugcaccugcggccagggcuaccagcucuccgccgccaaggaccagugcgaggacaucgacgagugccagcaccgccaccucugcgcccacggccagugccgcaacaccgagggcuccuuccagugcgucugcgaccagggcuaccgcgccuccggccucggcgaccacugcgaggacaucaacgagugccucgaggacaaguccgucugccagcgcggcgacugcaucaacaccgccggcuccuacgacugcaccugccccgacggcuuccagcucgacgacaacaagaccugccaggacaucaacgagugcgagcaccccggccucugcggcccccagggcgagugccucaacaccgagggcuccuuccacugcgucugccagcagggcuucuccaucuccgccgacggccgcaccugcgaggacaucgacgagugcgucaacaacaccgucugcgacucccacggcuucugcgacaacaccgccggcuccuuccgcugccucugcuaccagggcuuccaggccccccaggacggccagggcugcgucgacgucaacgagugcgagcuccucuccggcgucugcggcgaggccuucugcgagaacgucgagggcuccuuccucugcgucugcgccgacgagaaccaggaguacucccccaugaccggccagugccgcucccgcaccuccaccgaccucgacgucgacgucgaccagcccaaggaggagaagaaggagugcuacuacaaccucaacgacgccucccucugcgacaacguccucgcccccaacgucaccaagcaggagugcugcugcaccuccggcgccggcuggggcgacaacugcgagaucuuccccugccccguccucggcaccgccgaguucaccgagaugugccccaagggcaagggcuucguccccgccggcgaguccuccuccgaggccggcggcgagaacuacaaggacgccgacgagugccuccucuucggccaggagaucugcaagaacggcuucugccucaacacccgccccggcuacgagugcuacugcaagcagggcaccuacuacgaccccgucaagcuccagugcuucgacauggacgagugccaggaccccuccuccugcaucgacggccagugcgucaacaccgagggcuccuacaacugcuucugcacccaccccaugguccucgacgccuccgagaagcgcugcauccgccccgccgaguccaacgagcagaucgaggagaccgacgucuaccaggaccucugcugggagcaccucuccgacgaguacgucugcucccgcccccucgucggcaagcagaccaccuacaccgagugcugcugccucuacggcgaggccuggggcaugcagugcgcccucugcccccucaaggacuccgacgacuacgcccagcucugcaacauccccgucaccggccgccgccagcccuacggccgcgacgcccucgucgacuucuccgagcaguacacccccgaggccgaccccuacuucauccaggaccgcuuccucaacuccuucgaggagcuccaggccgaggagugcggcauccucaacggcugcgagaacggccgcugcguccgcguccaggagggcuacaccugcgacugcuucgacggcuaccaccucgacaccgccaagaugaccugcgucgacgucaacgagugcgacgagcucaacaaccgcaugucccucugcaagaacgccaagugcaucaacaccgacggcuccuacaagugccucugccuccccggcuacguccccuccgacaagcccaacuacugcaccccccucaacaccgcccucaaccucgagaaggacuccgaccucgaguga

SEQ ID NO: 45572 - RNA, 5466 nt, Artificial Sequence
  derived and/or modified sequence opt2 from LTBP2__Homo_sapiens__NP_000419
augcgcccccgcaccaaggcccgcucccccggccgcgcccuccgcaaccccuggcgcggcuuccucccccucacccucgcccucuucgucggcgccggccacgcccagcgcgaccccgucggccgcuacgagcccgccggcggcgacgccaaccgccuccgccgccccggcggcuccuaccccgccgccgccgccgccaaggucuacucccucuuccgcgagcaggacgcccccgucgccggccuccagcccgucgagcgcgcccagcccggcuggggcuccccccgccgccccaccgaggccgaggcccgccgccccucccgcgcccagcagucccgccgcguccagccccccgcccagacccgccgcuccaccccccucggccagcagcagcccgccccccgcacccgcgccgcccccgcccucccccgccucggcaccccccagcgcuccggcgccgccccccccacccccccccgcggccgccucaccggccgcaacgucugcggcggccagugcugccccggcuggaccaccgccaacuccaccaaccacugcaucaagcccgucugcgagccccccugccagaaccgcggcuccugcucccgcccccagcucugcgucugccgcuccggcuuccgcggcgcccgcugcgaggaggucauccccgacgaggaguucgacccccagaacucccgccucgccccccgccgcugggccgagcgcucccccaaccuccgccgcuccuccgccgccggcgagggcacccucgcccgcgcccagccccccgccccccaguccccccccgccccccaguccccccccgccggcacccucuccggccucucccagacccaccccucccagcagcacgucggccucucccgcaccguccgccuccaccccaccgccaccgccuccucccagcucuccuccaacgcccucccccccggccccggccucgagcagcgcgacggcacccagcaggccgucccccucgagcaccccuccucccccuggggccucaaccucaccgagaagaucaagaagaucaagaucgucuucacccccaccaucugcaagcagaccugcgcccgcggccacugcgccaacuccugcgagcgcggcgacaccaccacccucuacucccagggcggccacggccacgaccccaaguccggcuuccgcaucuacuucugccagauccccugccucaacggcggccgcugcaucggccgcgacgagugcuggugccccgccaacuccaccggcaaguucugccaccuccccaucccccagcccgaccgcgagccccccggccgcggcucccgcccccgcgcccuccucgaggccccccucaagcaguccaccuucacccucccccucuccaaccagcucgccuccgucaaccccucccucgucaagguccacauccaccacccccccgaggccuccguccagauccaccaggucgcccagguccgcggcggcgucgaggaggcccucgucgagaacuccgucgagacccgccccccccccuggcuccccgccucccccggccacucccucugggacuccaacaacauccccgcccgcuccggcgagcccccccgcccccucccccccgccgccccccgcccccgcggccuccucggccgcugcuaccucaacaccgucaacggccagugcgccaacccccuccucgagcucaccacccaggaggacugcugcggcuccgucggcgccuucuggggcgucacccucugcgcccccugccccccccgccccgccucccccgucaucgagaacggccagcucgagugcccccagggcuacaagcgccucaaccucacccacugccaggacaucaacgagugccucacccucggccucugcaaggacgccgagugcgucaacacccgcggcuccuaccucugcaccugccgccccggccucaugcucgaccccucccgcucccgcugcgucuccgacaaggccaucuccaugcuccagggccucugcuaccgcucccucggccccggcaccugcacccucccccucgcccagcgcaucaccaagcagaucugcugcugcucccgcgucggcaaggccuggggcuccgagugcgagaagugcccccuccccggcaccgaggccuuccgcgagaucugccccgccggccacggcuacaccuacgccuccuccgacauccgccucuccaugcgcaaggccgaggaggaggagcucgcccgccccccccgcgagcagggccagcgcuccuccggcgcccuccccggccccgccgagcgccagccccuccgcgucgucaccgacaccuggcucgaggccggcaccauccccgacaagggcgacucccaggccggccaggucaccaccuccgucacccacgcccccgccugggucaccggcaacgccaccaccccccccaugcccgagcagggcaucgccgagauccaggaggagcaggucacccccuccaccgacguccucgucacccucuccacccccggcaucgaccgcugcgccgccggcgccaccaacgucugcggccccggcaccugcgucaaccuccccgacggcuaccgcugcgucugcucccccggcuaccagcuccaccccucccaggccuacugcaccgacgacaacgagugccuccgcgaccccugcaagggcaagggccgcugcaucaaccgcgucggcuccuacuccugcuucugcuaccccggcuacacccucgccaccuccggcgccacccaggagugccaggacaucaacgagugcgagcagcccggcgucugcuccggcggccagugcaccaacaccgagggcuccuaccacugcgagugcgaccagggcuacaucaugguccgcaagggccacugccaggacaucaacgagugccgccaccccggcaccugccccgacggccgcugcgucaacucccccggcuccuacaccugccucgccugcgaggagggcuaccgcggccaguccggcuccugcgucgacgucaacgagugccucacccccggcgucugcgcccacggcaagugcaccaaccucgagggcuccuuccgcugcuccugcgagcagggcuacgaggucaccuccgacgagaagggcugccaggacgucgacgagugcgccucccgcgccuccugccccaccggccucugccucaacaccgagggcuccuucgccugcuccgccugcgagaacggcuacugggucaacgaggacggcaccgccugcgaggaccucgacgagugcgccuuccccggcgucugccccuccggcgucugcaccaacaccgccggcuccuucuccugcaaggacugcgacggcggcuaccgccccuccccccucggcgacuccugcgaggacgucgacgagugcgaggacccccaguccuccugccucggcggcgagugcaagaacaccgucggcuccuaccagugccucugcccccagggcuuccagcucgccaacggcaccgucugcgaggacgucaacgagugcaugggcgaggagcacugcgccccccacggcgagugccucaacucccacggcuccuucuucugccucugcgcccccggcuucgucuccgccgagggcggcaccuccugccaggacgucgacgagugcgccaccaccgaccccugcgucggcggccacugcgucaacaccgagggcuccuucaacugccucugcgagaccggcuuccagcccucccccgaguccggcgagugcgucgacaucgacgagugcgaggacuacggcgaccccgucugcggcaccuggaagugcgagaacucccccggcuccuaccgcugcguccucggcugccagcccggcuuccacauggcccccaacggcgacugcaucgacaucgacgagugcgccaacgacaccaugugcggcucccacggcuucugcgacaacaccgacggcuccuuccgcugccucugcgaccagggcuucgagaucucccccuccggcugggacugcgucgacgucaacgagugcgagcucaugcucgccgucugcggcgccgcccucugcgagaacgucgagggcuccuuccucugccucugcgccuccgaccucgaggaguacgacgcccaggagggccacugccgcccccgcggcgccggcggccaguccauguccgaggcccccaccggcgaccacgcccccgcccccacccgcauggacugcuacuccggccagaagggccacgcccccugcuccuccguccucggccgcaacaccacccaggccgagugcugcugcacccagggcgccuccuggggcgacgccugcgaccucugccccuccgaggacuccgccgaguucuccgagaucugccccuccggcaagggcuacauccccgucgagggcgccuggaccuucggccagaccauguacaccgacgccgacgagugcgucaucuucggccccggccucugccccaacggccgcugccucaacaccguccccggcuacgucugccucugcaaccccggcuuccacuacgacgccucccacaagaagugcgaggaccacgacgagugccaggaccucgccugcgagaacggcgagugcgucaacaccgagggcuccuuccacugcuucugcucccccccccucacccucgaccucucccagcagcgcugcaugaacuccaccuccuccaccgaggaccuccccgaccacgacauccacauggacaucugcuggaagaaggucaccaacgacgucugcuccgagccccuccgcggccaccgcaccaccuacaccgagugcugcugccaggacggcgaggccuggucccagcagugcgcccucugccccccccgcuccuccgaggucuacgcccagcucugcaacgucgcccgcaucgaggccgagcgcgaggccggcguccacuuccgccccggcuacgaguacggccccggccccgacgaccuccacuacuccaucuacggccccgacggcgcccccuucuacaacuaccucggccccgaggacaccguccccgagcccgccuuccccaacaccgccggccacuccgccgaccgcacccccauccucgaguccccccuccagcccuccgagcuccagccccacuacgucgccucccaccccgagccccccgccggcuucgagggccuccaggccgaggagugcggcauccucaacggcugcgagaacggccgcugcguccgcguccgcgagggcuacaccugcgacugcuucgagggcuuccagcucgacgccgcccacauggccugcgucgacgucaacgagugcgacgaccucaacggccccgccguccucugcguccacggcuacugcgagaacaccgagggcuccuaccgcugccacugcucccccggcuacgucgccgaggccggccccccccacugcaccgccaaggaguga

SEQ ID NO: 45573 - RNA, 3912 nt, Artificial Sequence
  derived and/or modified sequence opt2 from LTBP3__Homo_sapiens__NP_001123616
augcccggcccccgcggcgccgccggcggccucgcccccgagaugcgcggcgccggcgccgccggccuccucgcccuccuccuccuccuccuccuccuccuccucggccucggcggccgcgucgagggcggccccgccggcgagcgcggcgccggcggcggcggcgcccucgcccgcgagcgcuucaaggucgucuucgcccccgucaucugcaagcgcaccugccucaagggccagugccgcgacuccugccagcagggcuccaacaugacccucaucggcgagaacggccacuccaccgacacccucaccggcuccggcuuccgcgucgucgucugcccccuccccugcaugaacggcggccagugcuccucccgcaaccagugccucugcccccccgacuucaccggccgcuucugccagguccccgccggcggcgccggcggcggcaccggcggcuccggccccggccucucccgcaccggcgcccucuccaccggcgcccuccccccccucgcccccgagggcgacuccgucgccuccaagcacgccaucuacgccguccaggucaucgccgacccccccggccccggcgagggcccccccgcccagcacgccgccuuccucgucccccucggccccggccagaucuccgccgagguccaggcccccccccccgucgucaacguccgcguccaccacccccccgaggccuccguccagguccaccgcaucgaguccuccaacgccgaguccgccgcccccucccagcaccuccucccccaccccaagcccucccacccccgcccccccacccagaagccccucggccgcugcuuccaggacacccuccccaagcagcccugcggcuccaacccccuccccggccucaccaagcaggaggacugcugcggcuccaucggcaccgccuggggccaguccaagugccacaagugcccccagcuccaguacaccggcguccagaagcccggccccguccgcggcgaggucggcgccgacugcccccagggcuacaagcgccucaacuccacccacugccaggacaucaacgagugcgccaugcccggcgucugccgccacggcgacugccucaacaaccccggcuccuaccgcugcgucugcccccccggccacucccucggccccucccgcacccagugcaucgccgacaagcccgaggagaagucccucugcuuccgccucgucucccccgagcaccagugccagcacccccucaccacccgccucacccgccagcucugcugcugcuccgucggcaaggccuggggcgcccgcugccagcgcugccccaccgacggcaccgccgccuucaaggagaucugccccgccggcaagggcuaccacauccucaccucccaccagacccucaccauccagggcgaguccgacuucucccucuuccuccaccccgacggcccccccaagccccagcagcuccccgagucccccucccaggcccccccccccgaggacaccgaggaggagcgcggcgucaccaccgacucccccgucuccgaggagcgcuccguccagcagucccaccccaccgccaccaccacccccgcccgccccuaccccgagcucaucucccgccccuccccccccaccaugcgcugguuccuccccgaccucccccccucccgcuccgccgucgagaucgcccccacccaggucaccgagaccgacgagugccgccucaaccagaacaucugcggccacggcgagugcguccccggcccccccgacuacuccugccacugcaaccccggcuaccgcucccacccccagcaccgcuacugcgucgacgucaacgagugcgaggccgagcccugcggccccggccgcggcaucugcaugaacaccggcggcuccuacaacugccacugcaaccgcggcuaccgccuccacgucggcgccggcggccgcuccugcgucgaccucaacgagugcgccaagccccaccucugcggcgacggcggcuucugcaucaacuuccccggccacuacaagugcaacugcuaccccggcuaccgccucaaggccucccgcccccccgucugcgaggacaucgacgagugccgcgaccccuccuccugccccgacggcaagugcgagaacaagcccggcuccuucaagugcaucgccugccagcccggcuaccgcucccagggcggcggcgccugccgcgacgucaacgagugcgccgagggcucccccugcucccccggcuggugcgagaaccuccccggcuccuuccgcugcaccugcgcccagggcuacgcccccgcccccgacggccgcuccugccucgacgucgacgagugcgaggccggcgacgucugcgacaacggcaucugcuccaacacccccggcuccuuccagugccagugccucuccggcuaccaccucucccgcgaccgcucccacugcgaggacaucgacgagugcgacuuccccgccgccugcaucggcggcgacugcaucaacaccaacggcuccuaccgcugccucugcccccagggccaccgccucgucggcggccgcaagugccaggacaucgacgagugcucccaggaccccucccucugccucccccacggcgccugcaagaaccuccagggcuccuacgucugcgucugcgacgagggcuucacccccacccaggaccagcacggcugcgaggaggucgagcagccccaccacaagaaggagugcuaccucaacuucgacgacaccgucuucugcgacuccguccucgccaccaacgucacccagcaggagugcugcugcucccucggcgccggcuggggcgaccacugcgagaucuaccccugccccgucuacuccuccgccgaguuccacucccucugccccgacggcaagggcuacacccaggacaacaacaucgucaacuacggcauccccgcccaccgcgacaucgacgagugcaugcucuucggcuccgagaucugcaaggagggcaagugcgucaacacccagcccggcuacgagugcuacugcaagcagggcuucuacuacgacggcaaccuccucgagugcgucgacgucgacgagugccucgacgaguccaacugccgcaacggcgucugcgagaacacccgcggcggcuaccgcugcgccugcaccccccccgccgaguacucccccgcccagcgccagugccucucccccgaggagauggacgucgacgagugccaggaccccgccgccugccgccccggccgcugcgucaaccuccccggcuccuaccgcugcgagugccgcccccccuggguccccggccccuccggccgcgacugccagcuccccgagucccccgccgagcgcgcccccgagcgccgcgacgucugcuggucccagcgcggcgaggacggcaugugcgccggcccccucgccggccccgcccucaccuucgacgacugcugcugccgccagggccgcggcuggggcgcccagugccgccccugccccccccgcggcgccggcucccacugccccaccucccaguccgaguccaacuccuucugggacaccuccccccuccuccucggcaagcccccccgcgacgaggacuccuccgaggaggacuccgacgagugccgcugcgucuccggccgcugcgucccccgccccggcggcgccgucugcgagugccccggcggcuuccagcucgacgccucccgcgcccgcugcgucgacaucgacgagugccgcgagcucaaccagcgcggccuccucugcaaguccgagcgcugcgucaacaccuccggcuccuuccgcugcgucugcaaggccggcuucgcccgcucccgcccccacggcgccugcgucccccagcgccgccgcuga

SEQ ID NO: 45574 - RNA, 4875 nt, Artificial Sequence
  derived and/or modified sequence opt2 from LTBP4__Homo_sapiens__NP_001036009
augccccgccccggcaccuccggccgccgcccccuccuccucguccuccuccucccccucuucgccgccgccaccuccgccgccucccccucccccucccccucccaggucgucgagguccccggcguccccucccgccccgccuccgucgccgucugccgcugcugccccggccagaccucccgccgcucccgcugcauccgcgccuucugccgcguccgcuccugccagcccaagaagugcgccggcccccagcgcugccucaaccccguccccgccguccccucccccucccccuccguccgcaagcgccaggucucccucaacuggcagccccucacccuccaggaggcccgcgcccuccucaagcgccgccgcccccgcggccccggcggccgcggccuccuccgccgccgccccccccagcgcgcccccgccggcaaggcccccguccucugcccccucaucugccacaacggcggcgucugcgucaagcccgaccgcugccucugcccccccgacuucgccggcaaguucugccagcuccacuccuccggcgcccgcccccccgcccccgccguccccggccucacccgcuccgucuacaccaugccccucgccaaccaccgcgacgacgagcacggcgucgccuccauggucuccguccacgucgagcacccccaggaggccuccgucgucguccaccaggucgagcgcgucuccggccccugggaggaggccgacgccgaggccgucgcccgcgccgaggccgccgcccgcgccgaggccgccgcccccuacaccguccucgcccaguccgccccccgcgaggacggcuacuccgacgccuccggcuucggcuacugcuuccgcgagcuccgcggcggcgagugcgccuccccccuccccggccuccgcacccaggaggucugcugccgcggcgccggccucgccuggggcguccacgacugccagcucugcuccgagcgccucggcaacuccgagcgcgucuccgcccccgacggccccugccccaccggcuucgagcgcgucaacggcuccugcgaggacgucgacgagugcgccaccggcggccgcugccagcacggcgagugcgccaacacccgcggcggcuacaccugcgucugccccgacggcuuccuccucgacuccucccgcuccuccugcaucucccagcacgucaucuccgaggccaagggccccugcuuccgcguccuccgcgacggcggcugcucccuccccauccuccgcaacaucaccaagcagaucugcugcugcucccgcgucggcaaggccuggggccgcggcugccagcucugcccccccuucggcuccgagggcuuccgcgagaucugccccgccggccccggcuaccacuacuccgccuccgaccuccgcuacaacacccgcccccucggccaggagcccccccgcgucucccucucccagccccgcacccuccccgccaccucccgccccuccgccggcuuccuccccacccaccgccucgagccccgccccgagccccgccccgacccccgccccggccccgagcucccccuccccuccauccccgccuggaccggccccgagauccccgaguccggccccuccuccggcaugugccagcgcaacccccaggucugcggccccggccgcugcaucucccgccccuccggcuacaccugcgccugcgacuccggcuuccgccucuccccccagggcacccgcugcaucgacgucgacgagugccgccgcguccccccccccugcgcccccggccgcugcgagaacucccccggcuccuuccgcugcgucugcggccccggcuuccgcgccggcccccgcgccgccgagugccucgacgucgacgagugccaccgcguccccccccccugcgaccucggccgcugcgagaacacccccggcuccuuccucugcgucugccccgccggcuaccaggccgccccccacggcgccuccugccaggacgucgacgagugcacccagucccccggccucugcggccgcggcgccugcaagaaccuccccggcuccuuccgcugcgucugccccgccggcuuccgcggcuccgccugcgaggaggacgucgacgagugcgcccaggagcccccccccugcggccccggccgcugcgacaacaccgccggcuccuuccacugcgccugccccgccggcuuccgcucccgcggccccggcgcccccugccaggacgucgacgagugcgcccgcucccccccccccugcaccuacggccgcugcgagaacaccgagggcuccuuccagugcgucugccccaugggcuuccagcccaacaccgccggcuccgagugcgaggacgucgacgagugcgagaaccaccucgccugccccggccaggagugcgucaacucccccggcuccuuccagugccgcaccugccccuccggccaccaccuccaccgcggccgcugcaccgacgucgacgagugcuccuccggcgccccccccugcggcccccacggccacugcaccaacaccgagggcuccuuccgcugcuccugcgcccccggcuaccgcgcccccuccggccgccccggccccugcgccgacgucaacgagugccucgagggcgacuucugcuucccccacggcgagugccucaacaccgacggcuccuucgccugcaccugcgcccccggcuaccgccccggcccccgcggcgccuccugccucgacgucgacgagugcuccgaggaggaccucugccaguccggcaucugcaccaacaccgacggcuccuucgagugcaucugcccccccggccaccgcgccggccccgaccucgccuccugccucgacgucgacgagugccgcgagcgcggccccgcccucugcggcucccagcgcugcgagaacucccccggcuccuaccgcugcguccgcgacugcgaccccggcuaccacgccggccccgagggcaccugcgacgacgucgacgagugccaggaguacggccccgagaucugcggcgcccagcgcugcgagaacacccccggcuccuaccgcugcacccccgccugcgaccccggcuaccagcccacccccggcggcggcugccaggacgucgacgagugccgcaaccgcuccuucugcggcgcccacgccgucugccagaaccuccccggcuccuuccagugccucugcgaccagggcuacgagggcgcccgcgacggccgccacugcgucgacgucaacgagugcgagacccuccagggcgucugcggcgccgcccucugcgagaacgucgagggcuccuuccucugcgucugccccaacucccccgaggaguucgaccccaugaccggccgcugcguccccccccgcaccuccgccggcaccuuccccggcucccagccccaggcccccgccucccccguccuccccgcccgcccccccccccccccccucccccgccgccccuccaccccccgccagggccccgucggcuccggccgccgcgagugcuacuucgacaccgccgcccccgacgccugcgacaacauccucgcccgcaacgucaccuggcaggagugcugcugcaccgucggcgagggcuggggcuccggcugccgcauccagcagugccccggcaccgagaccgccgaguaccagucccucugcccccacggccgcggcuaccucgcccccuccggcgaccucucccuccgccgcgacgucgacgagugccagcucuuccgcgaccaggucugcaaguccggcgucugcgucaacaccgcccccggcuacuccugcuacugcuccaacggcuacuacuaccacacccagcgccucgagugcaucgacaacgacgagugcgccgacgaggagcccgccugcgagggcggccgcugcgucaacaccgucggcuccuaccacugcaccugcgagcccccccucguccucgacggcucccagcgccgcugcgucuccaacgagucccagucccucgacgacaaccucggcgucugcuggcaggaggucggcgccgaccucgucugcucccacccccgccucgaccgccaggccaccuacaccgagugcugcugccucuacggcgaggccuggggcauggacugcgcccucugccccgcccaggacuccgacgacuucgaggcccucugcaacguccuccgcccccccgccuacucccccccccgccccggcggcuucggccuccccuacgaguacggccccgaccucggcccccccuaccagggccuccccuacggccccgagcucuaccccccccccgcccuccccuacgaccccuacccccccccccccggccccuucgcccgccgcgaggcccccuacggcgccccccgcuucgacaugcccgacuucgaggacgacggcggccccuacggcgaguccgaggcccccgccccccccggccccggcacccgcuggcccuaccgcucccgcgacacccgccgcuccuuccccgagcccgaggagccccccgagggcggcuccuacgccggcucccucgccgagcccuacgaggagcucgaggccgaggagugcggcauccucgacggcugcaccaacggccgcugcguccgcguccccgagggcuucaccugccgcugcuucgacggcuaccgccucgacaugacccgcauggccugcgucgacaucaacgagugcgacgaggccgaggccgccuccccccucugcgucaacgcccgcugccucaacaccgacggcuccuuccgcugcaucugccgccccggcuucgcccccacccaccagccccaccacugcgcccccgcccgcccccgcgccuga

SEQ ID NO: 45575 - RNA, 1251 nt, Artificial Sequence
  derived and/or modified sequence opt2 from LTBR__Homo_sapiens__NP_001257916
auggaggccaccggcaucucccucgccucccagcucaaggucccccccuacgccuccgagaaccagaccugccgcgaccaggagaaggaguacuacgagccccagcaccgcaucugcugcucccgcugcccccccggcaccuacgucuccgccaagugcucccgcauccgcgacaccgucugcgccaccugcgccgagaacuccuacaacgagcacuggaacuaccucaccaucugccagcucugccgccccugcgaccccgucaugggccucgaggagaucgcccccugcaccuccaagcgcaagacccagugccgcugccagcccggcauguucugcgccgccugggcccucgagugcacccacugcgagcuccucuccgacugcccccccggcaccgaggccgagcucaaggacgaggucggcaagggcaacaaccacugcguccccugcaaggccggccacuuccagaacaccuccucccccuccgcccgcugccagccccacacccgcugcgagaaccagggccucgucgaggccgcccccggcaccgcccaguccgacaccaccugcaagaacccccucgagccccucccccccgagauguccggcaccaugcucaugcucgccguccuccucccccucgccuucuuccuccuccucgccaccgucuucuccugcaucuggaagucccaccccucccucugccgcaagcucggcucccuccucaagcgccgcccccagggcgagggccccaaccccgucgccggcuccugggagccccccaaggcccaccccuacuuccccgaccucguccagccccuccuccccaucuccggcgacgucucccccgucuccaccggccuccccgccgcccccguccucgaggccggcgucccccagcagcaguccccccucgaccucacccgcgagccccagcucgagcccggcgagcagucccaggucgcccacggcaccaacggcauccacgucaccggcggcuccaugaccaucaccggcaacaucuacaucuacaacggccccguccucggcggcccccccggccccggcgaccuccccgccacccccgagccccccuaccccauccccgaggagggcgaccccggcccccccggccucuccaccccccaccaggaggacggcaaggccuggcaccucgccgagaccgagcacugcggcgccacccccuccaaccgcggcccccgcaaccaguucaucacccacgacuga

SEQ ID NO: 45576 - RNA, 453 nt, Artificial Sequence
  derived and/or modified sequence opt2 from LTC4S__Homo_sapiens__NP_665874
augaaggacgaggucgcccuccucgccgccgucacccuccucggcguccuccuccaggccuacuucucccuccaggucaucuccgcccgccgcgccuuccgcgucucccccccccucaccaccggcccccccgaguucgagcgcgucuaccgcgcccaggucaacugcuccgaguacuucccccucuuccucgccacccucugggucgccggcaucuucuuccacgagggcgccgccgcccucugcggccucgucuaccucuucgcccgccuccgcuacuuccagggcuacgcccgcuccgcccagcuccgccucgccccccucuacgccuccgcccgcgcccucuggcuccucgucgcccucgccgcccucggccuccucgcccacuuccuccccgccgcccuccgcgccgcccuccucggccgccuccgcacccuccuccccugggccuga

SEQ ID NO: 45577 - RNA, 2001 nt, Artificial Sequence
  derived and/or modified sequence opt2 from LTF__Homo_sapiens__NP_001186078
augcgcaagguccgcggcccccccgucuccugcaucaagcgcgacucccccauccagugcauccaggccaucgccgagaaccgcgccgacgccgucacccucgacggcggcuucaucuacgaggccggccucgcccccuacaagcuccgccccgucgccgccgaggucuacggcaccgagcgccagccccgcacccacuacuacgccgucgccgucgucaagaagggcggcuccuuccagcucaacgagcuccagggccucaaguccugccacaccggccuccgccgcaccgccggcuggaacguccccaucggcacccuccgccccuuccucaacuggaccggcccccccgagcccaucgaggccgccgucgcccgcuucuucuccgccuccugcguccccggcgccgacaagggccaguuccccaaccucugccgccucugcgccggcaccggcgagaacaagugcgccuucuccucccaggagcccuacuucuccuacuccggcgccuucaagugccuccgcgacggcgccggcgacgucgccuucauccgcgaguccaccgucuucgaggaccucuccgacgaggccgagcgcgacgaguacgagcuccucugccccgacaacacccgcaagcccgucgacaaguucaaggacugccaccucgcccgcguccccucccacgccgucgucgcccgcuccgucaacggcaaggaggacgccaucuggaaccuccuccgccaggcccaggagaaguucggcaaggacaagucccccaaguuccagcucuucggcucccccuccggccagaaggaccuccucuucaaggacuccgccaucggcuucucccgcguccccccccgcaucgacuccggccucuaccucggcuccggcuacuucaccgccauccagaaccuccgcaaguccgaggaggaggucgccgcccgccgcgcccgcgucgucuggugcgccgucggcgagcaggagcuccgcaagugcaaccagugguccggccucuccgagggcuccgucaccugcuccuccgccuccaccaccgaggacugcaucgcccucguccucaagggcgaggccgacgccaugucccucgacggcggcuacgucuacaccgccggcaagugcggccucguccccguccucgccgagaacuacaagucccagcaguccuccgaccccgaccccaacugcgucgaccgccccgucgagggcuaccucgccgucgccgucguccgccgcuccgacaccucccucaccuggaacuccgucaagggcaagaaguccugccacaccgccgucgaccgcaccgccggcuggaacauccccaugggccuccucuucaaccagaccggcuccugcaaguucgacgaguacuucucccaguccugcgcccccggcuccgacccccgcuccaaccucugcgcccucugcaucggcgacgagcagggcgagaacaagugcguccccaacuccaacgagcgcuacuacggcuacaccggcgccuuccgcugccucgccgagaacgccggcgacgucgccuucgucaaggacgucaccguccuccagaacaccgacggcaacaacaacgaggccugggccaaggaccucaagcucgccgacuucgcccuccucugccucgacggcaagcgcaagcccgucaccgaggcccgcuccugccaccucgccauggcccccaaccacgccgucgucucccgcauggacaaggucgagcgccucaagcagguccuccuccaccagcaggccaaguucggccgcaacggcuccgacugccccgacaaguucugccucuuccaguccgagaccaagaaccuccucuucaacgacaacaccgagugccucgcccgccuccacggcaagaccaccuacgagaaguaccucggcccccaguacgucgccggcaucaccaaccucaagaagugcuccaccuccccccuccucgaggccugcgaguuccuccgcaaguga

SEQ ID NO: 45578 - RNA, 2205 nt, Artificial Sequence
  derived and/or modified sequence opt2 from LTK__Homo_sapiens__NP_001129157
augggcugcuggggccagcuccucgucugguucggcgccgccggcgccauccucugcuccucccccggcucccaggagaccuuccuccgcuccuccccccucccccucgccucccccuccccccgcgaccccaaggucuccgccccccccuccauccucgagcccgccuccccccucaacucccccggcaccgagggcuccuggcucuucuccaccugcggcgccuccggccgccacggccccacccagacccagugcgacggcgccuacgccggcaccuccgucgucgucaccgucggcgccgccggccagcuccgcggcguccagcucuggcgcguccccggccccggccaguaccucaucuccgccuacggcgccgccggcggcaagggcgccaagaaccaccucucccgcgcccacggcgucuucgucuccgccaucuucucccucggccucggcgagucccucuacauccucgucggccagcagggcgaggacgccugccccggcggcucccccgagucccagcucgucugccucggcgagucccgcgccgucgaggagcacgccgccauggacggcuccgagggcguccccggcucccgccgcugggccggcggcggcggcggcggcggcggcgccaccuacgucuuccgcguccgcgccggcgagcucgagccccuccucgucgccgccggcggcggcggccgcgccuaccuccgcccccgcgaccgcggccgcacccaggccucccccgagaagcucgagaaccgcuccgaggcccccggcuccggcggccgcggcggcgccgccggcggcgacgccuccgagaccgacaaccucugggccgacggcgaggacggcgucuccuucauccaccccuccuccgagcucuuccuccagccccucgccgucaccgagaaccacggcgaggucgagauccgccgccaccucaacugcucccacugcccccuccgcgacugccaguggcaggccgagcuccagcucgccgagugccucugccccgagggcauggagcucgccgucgacaacgucaccugcauggaccuccacaagccccccggcccccucguccucauggucgccgucgucgccaccuccacccucucccuccucauggucugcggcguccucauccucggcggcgccuggcccggccccguccucgccuccgccacccgcugccaccgcggcuuccccucccagugcuacuccgcccagacccuccccgagcucugcuccccccaggacgagcucgacuuccucauggaggcccucaucaucuccaaguuccgccaccagaacaucguccgcugcgucggccucucccuccgcgccaccccccgccucauccuccucgagcucauguccggcggcgacaugaaguccuuccuccgccacucccgcccccaccucggccagcccuccccccucgucaugcgcgaccuccuccagcucgcccaggacaucgcccagggcugccacuaccucgaggagaaccacuucauccaccgcgacaucgccgcccgcaacugccuccucuccugcgccggccccucccgcgucgccaagaucggcgacuucggcauggcccgcgacaucuaccgcgccuccuacuaccgccgcggcgaccgcgcccuccuccccgucaaguggaugccccccgaggccuuccucgagggcaucuucaccuccaagaccgacuccugguccuucggcguccuccucugggagaucuucucccucggcuacaugcccuaccccggccgcaccaaccaggagguccucgacuucgucgucggcggcggccgcauggaccccccccgcggcugccccggccccgucuaccgcaucaugacccagugcuggcagcacgagcccgagcuccgccccuccuucgccuccauccucgagcgccuccaguacugcacccaggaccccgacguccucaacucccuccuccccauggagcucggccccacccccgaggaggagggcaccuccggccucggcaaccgcucccucgagugccuccgccccccccagccccaggagcucucccccgagaagcucaaguccuggggcggcuccccccucggccccuggcucuccuccggccucaagccccucaagucccgcggccuccagccccagaaccucuggaaccccaccuaccgcuccuga

SEQ ID NO: 45579 - RNA, 1299 nt, Artificial Sequence
  derived and/or modified sequence opt2 from LUC7L3__Homo_sapiens__NP_057508
augaucuccgccgcccagcuccucgacgagcucaugggccgcgaccgcaaccucgcccccgacgagaagcgcuccaacguccgcugggaccacgaguccgucugcaaguacuaccucugcggcuucugccccgccgagcucuucaccaacacccgcuccgaccucggccccugcgagaagauccacgacgagaaccuccgcaagcaguacgagaaguccucccgcuucaugaaggucggcuacgagcgcgacuuccuccgcuaccuccagucccuccucgccgaggucgagcgccgcauccgccgcggccacgcccgccucgcccucucccagaaccagcaguccuccggcgccgccggccccaccggcaagaacgaggagaagauccagguccucaccgacaagaucgacguccuccuccagcagaucgaggagcucggcuccgagggcaaggucgaggaggcccagggcaugaugaagcucgucgagcagcucaaggaggagcgcgagcuccuccgcuccaccaccuccaccaucgaguccuucgccgcccaggagaagcagauggaggucugcgaggucugcggcgccuuccucaucgucggcgacgcccagucccgcgucgacgaccaccucaugggcaagcagcacaugggcuacgccaagaucaaggccaccgucgaggagcucaaggagaagcuccgcaagcgcaccgaggagcccgaccgcgacgagcgccucaagaaggagaagcaggagcgcgaggagcgcgagaaggagcgcgagcgcgagcgcgaggagcgcgagcgcaagcgccgccgcgaggaggaggagcgcgagaaggagcgcgcccgcgaccgcgagcgccgcaagcgcucccgcucccgcucccgccacuccucccgcaccuccgaccgccgcugcucccgcucccgcgaccacaagcgcucccgcucccgcgagcgccgccgcucccgcucccgcgaccgccgccgcucccgcucccacgaccgcuccgagcgcaagcaccgcucccgcucccgcgaccgccgccgcuccaagucccgcgaccgcaaguccuacaagcaccgcuccaagucccgcgaccgcgagcaggaccgcaaguccaaggagaaggagaagcgcggcuccgacgacaagaaguccuccgucaaguccggcucccgcgagaagcaguccgaggacaccaacaccgaguccaaggaguccgacaccaagaacgaggucaacggcaccuccgaggacaucaaguccgagggcgacacccaguccaacuga

SEQ ID NO: 45580 - RNA, 978 nt, Artificial Sequence
  derived and/or modified sequence opt2 from LUC7L__Homo_sapiens__NP_060502
auguccgcccaggcccagaugcgcgcccuccucgaccagcucaugggcaccgcccgcgacggcgacgagacccgccagcgcgucaaguucaccgacgaccgcgucugcaagucccaccuccucgacugcugcccccacgacauccucgccggcacccgcauggaccucggcgagugcaccaagauccacgaccucgcccuccgcgccgacuacgagaucgccuccaaggagcgcgaccucuucuucgagcucgacgccauggaccaccucgaguccuucaucgccgagugcgaccgccgcaccgagcucgccaagaagcgccucgccgagacccaggaggagaucuccgccgaggucuccgccaaggccgagaagguccacgagcucaacgaggagaucggcaagcuccucgccaaggccgagcagcucggcgccgagggcaacgucgacgagucccagaagauccucauggaggucgagaagguccgcgccaagaagaaggaggccgaggaggaguaccgcaacuccaugcccgccuccuccuuccagcagcagaagcuccgcgucugcgaggucugcuccgccuaccucggccuccacgacaacgaccgccgccucgccgaccacuucggcggcaagcuccaccucggcuucauccagauccgcgagaagcucgaccagcuccgcaagaccgucgccgagaagcaggagaagcgcaaccaggaccgccuccgccgccgcgaggagcgcgagcgcgaggagcgccucucccgccgcuccggcucccgcacccgcgaccgccgccgcucccgcucccgcgaccgccgccgccgccgcucccgcuccaccucccgcgagcgccgcaagcucucccgcucccgcucccgcgaccgccaccgccgccaccgcucccgcucccgcucccacucccgcggccaccgccgcgccucccgcgaccgcuccgccaaguacaaguga

SEQ ID NO: 45581 - RNA, 1017 nt, Artificial Sequence
  derived and/or modified sequence opt2 from LUM__Homo_sapiens__NP_002336
augucccucuccgccuucacccucuuccucgcccucaucggcggcaccuccggccaguacuacgacuacgacuucccccucuccaucuacggccaguccucccccaacugcgcccccgagugcaacugccccgaguccuaccccuccgccauguacugcgacgagcucaagcucaaguccguccccauggucccccccggcaucaaguaccucuaccuccgcaacaaccagaucgaccacaucgacgagaaggccuucgagaacgucaccgaccuccaguggcucauccucgaccacaaccuccucgagaacuccaagaucaagggccgcgucuucuccaagcucaagcagcucaagaagcuccacaucaaccacaacaaccucaccgaguccgucggcccccuccccaagucccucgaggaccuccagcucacccacaacaagaucaccaagcucggcuccuucgagggccucgucaaccucaccuucauccaccuccagcacaaccgccucaaggaggacgccgucuccgccgccuucaagggccucaagucccucgaguaccucgaccucuccuucaaccagaucgcccgccuccccuccggccuccccgucucccuccucacccucuaccucgacaacaacaagaucuccaacauccccgacgaguacuucaagcgcuucaacgcccuccaguaccuccgccucucccacaacgagcucgccgacuccggcauccccggcaacuccuucaacgucuccucccucgucgagcucgaccucuccuacaacaagcucaagaacauccccaccgucaacgagaaccucgagaacuacuaccucgaggucaaccagcucgagaaguucgacaucaaguccuucugcaagauccucggcccccucuccuacuccaagaucaagcaccuccgccucgacggcaaccgcaucuccgagaccucccucccccccgacauguacgagugccuccgcgucgccaacgaggucacccucaacuga

SEQ ID NO: 45582 - RNA, 687 nt, Artificial Sequence
  derived and/or modified sequence opt2 from LURAP1L__Homo_sapiens__NP_981948
auggaggacuccccccuccccgaccuccgcgacaucgagcucaagcucggccgcaagguccccgagucccucguccgcucccuccgcggcgaggagcccgucccccgcgagcgcgaccgcgaccccugcggcggcuccggcggcggcggcggcggcggcggcggcugcuccuccuccuccuccuacugcuccuucccccccucccucuccuccuccuccuccuccucccccaccuccggcuccccccgcggcucccacuccuccgcccucgagcgccucgagaccaagcuccaccuccuccgccaggagauggucaaccuccgcgccaccgacguccgccucaugcgccagcuccucgucaucaacgaguccaucgaguccaucaaguggaugaucgaggagaaggccaccaucaccucccgcggcuccucccucuccggcucccucugcucccuccucgagucccaguccaccucccuccgcggcuccuacaacucccuccacgacggcuccgacggccucgacggcaucuccgucggcuccuaccucgacacccucgccgacgacguccccggccaccagacccccuccgaccucgaccaguucuccgacuccucccucaucgaggacucccaggcccuccacaagcgccccaagcucgacuccgaguacuacugcuucggcuga

SEQ ID NO: 45583 - RNA, 942 nt, Artificial Sequence
  derived and/or modified sequence opt2 from LUZP4__Homo_sapiens__NP_057467
auggccuccuuccgcaagcucacccucuccgagaaggucccccccaaccaccccucccgcaagaaggucaacuuccucgacaugucccucgacgacaucaucaucuacaaggagcucgagggcaccaacgccgaggaggagaagaacaagcgccagaaccacuccaagaaggagucccccucccgccagcaguccaaggcccaccgccaccgccaccgccgcggcuacucccgcugccgcuccaacuccgaggagggcaaccacgacaagaagcccucccagaagcccuccggcuucaaguccggccagcacccccucaacggccagccccucaucgagcaggagaagugcuccgacaacuacgaggcccaggccgagaagaaccagggccaguccgagggcaaccagcaccaguccgagggcaaccccgacaaguccgaggagucccagggccagcccgaggagaaccaccacuccgagcgcucccgcaaccaccucgagcgcucccucucccaguccgaccgcucccagggccagcucaagcgccaccacccccaguacgagcgcucccacggccaguacaagcgcucccacggccaguccgagcgcucccacggccacuccgagcgcucccacggccacuccgagcgcucccacggccacuccgagcgcucccacggccacuccaagcgcucccgcucccagggcgaccucgucgacacccaguccgaccucaucgccacccagcgcgaccucaucgccacccagaaggaccucaucgccacccagcgcgaccucaucgccacccagcgcgaccucaucgucacccagcgcgaccucgucgccaccgagcgcgaccucaucaaccaguccggccgcucccacggccaguccgagcgccaccagcgcuacuccaccggcaagaacaccaucaccaccuga

SEQ ID NO: 45584 - RNA, 177 nt, Artificial Sequence
  derived and/or modified sequence opt2 from LUZP6__Homo_sapiens__NP_001122091
augaaguccgucaucuccuacgcccucuaccagguccagaccggcucccuccccgucuacuccuccguccucaccaaguccccccuccagcuccagaccgucaucuaccgccucaucguccagauccagcaccucaacauccccuccuccuccuccacccacuccucccccuucuga

SEQ ID NO: 45585 - RNA, 2973 nt, Artificial Sequence
  derived and/or modified sequence opt2 from LVRN__Homo_sapiens__NP_776161
augggcccccccuccuccuccggcuucuacgucucccgcgccgucgcccuccuccucgccggccucgucgccgcccuccuccucgcccucgccguccucgccgcccucuacggccacugcgagcgcgucccccccuccgagcuccccggccuccgcgaccucgaggccgaguccucccccccccuccgccagaagcccacccccacccccaagcccuccuccgcccgcgagcucgccgucaccaccacccccuccaacuggcgcccccccggccccugggaccagcuccgccucccccccuggcucgucccccuccacuacgaccucgagcucuggccccagcuccgccccgacgagcuccccgccggcucccuccccuucaccggccgcgucaacaucaccguccgcugcaccgucgccaccucccgccuccuccuccacucccucuuccaggacugcgagcgcgccgagguccgcggcccccucucccccggcaccggcaacgccaccgucggccgcguccccgucgacgacgucugguucgcccucgacaccgaguacaugguccucgagcucuccgagccccucaagcccggcuccuccuacgagcuccagcucuccuucuccggccucgucaaggaggaccuccgcgagggccucuuccucaacgucuacaccgaccagggcgagcgccgcgcccuccucgccucccagcucgagcccaccuucgcccgcuacgucuuccccugcuucgacgagcccgcccucaaggccaccuucaacaucaccaugauccaccaccccuccuacgucgcccucuccaacaugcccaagcucggccaguccgagaaggaggacgucaacggcuccaaguggaccgucaccaccuucuccaccaccccccacaugcccaccuaccucgucgccuucgucaucugcgacuacgaccacgucaaccgcaccgagcgcggcaaggagauccgcaucugggcccgcaaggacgccaucgccaacggcuccgccgacuucgcccucaacaucaccggccccaucuucuccuuccucgaggaccucuucaacaucuccuacucccuccccaagaccgacaucaucgcccuccccuccuucgacaaccacgccauggagaacuggggccucaugaucuucgacgaguccggccuccuccucgagcccaaggaccagcucaccgagaagaagacccucaucuccuacgucgucucccacgagaucggccaccagugguucggcaaccucgucaccaugaacugguggaacaacaucuggcucaacgagggcuucgccuccuacuucgaguucgaggucaucaacuacuucaaccccaagcucccccgcaacgagaucuucuucuccaacauccuccacaacauccuccgcgaggaccacgcccucgucacccgcgccgucgccaugaaggucgagaacuucaagaccuccgagauccaggagcucuucgacaucuucaccuacuccaagggcgccuccauggcccgcaugcucuccugcuuccucaacgagcaccucuucgucuccgcccucaaguccuaccucaagaccuucuccuacuccaacgccgagcaggacgaccucuggcgccacuuccagauggccaucgacgaccaguccaccgucauccuccccgccaccaucaagaacaucauggacuccuggacccaccaguccggcuuccccgucaucacccucaacgucuccaccggcgucaugaagcaggagcccuucuaccucgagaacaucaagaaccgcacccuccucaccuccaacgacaccuggaucguccccauccucuggaucaagaacggcaccacccagccccucgucuggcucgaccaguccuccaaggucuuccccgagaugcaggucuccgacuccgaccacgacugggucauccucaaccucaacaugaccggcuacuaccgcgucaacuacgacaagcucggcuggaagaagcucaaccagcagcucgagaaggaccccaaggccauccccgucauccaccgccuccagcucaucgacgacgccuucucccucuccaagaacaacuacaucgagaucgagaccgcccucgagcucaccaaguaccucgccgaggaggacgagaucaucgucuggcacaccguccucgucaaccucgucacccgcgaccucgucuccgaggucaacaucuacgacaucuacucccuccucaagcgcuaccuccucaagcgccucaaccucaucuggaacaucuacuccaccaucauccgcgagaacguccucgcccuccaggacgacuaccucgcccucaucucccucgagaagcucuucgucaccgccugcuggcucggccucgaggacugccuccagcucuccaaggagcucuucgccaagugggucgaccaccccgagaacgagauccccuaccccaucaaggacgucguccucugcuacggcaucgcccucggcuccgacaaggagugggacauccuccucaacaccuacaccaacaccaccaacaaggaggagaagauccagcucgccuacgccauguccugcuccaaggaccccuggauccucaaccgcuacauggaguacgccaucuccaccucccccuucaccuccaacgagaccaacaucaucgaggucgucgccuccuccgaggucggccgcuacgucgccaaggacuuccucgucaacaacuggcaggccgucuccaagcgcuacggcacccagucccucaucaaccucaucuacaccaucggccgcaccgucaccaccgaccuccagaucgucgagcuccagcaguucuucuccaacaugcucgaggagcaccagcgcauccgcguccacgccaaccuccagaccaucaagaacgagaaccucaagaacaagaagcucuccgcccgcaucgccgccuggcuccgccgcaacaccuga

SEQ ID NO: 45586 - RNA, 669 nt, Artificial Sequence
  derived and/or modified sequence opt2 from LXN__Homo_sapiens__NP_064554
auggagaucccccccaccaacuaccccgccucccgcgccgcccucgucgcccagaacuacaucaacuaccagcagggcaccccccaccgcgucuucgagguccagaaggucaagcaggccuccauggaggacauccccggccgcggccacaaguaccaccucaaguucgccgucgaggagaucauccagaagcaggucaaggucaacugcaccgccgagguccucuaccccuccaccggccaggagaccgcccccgaggucaacuucaccuucgagggcgagaccggcaagaaccccgacgaggaggacaacaccuucuaccagcgccucaaguccaugaaggagccccucgaggcccagaacauccccgacaacuucggcaacgucucccccgagaugacccucguccuccaccucgccugggucgccugcggcuacaucaucuggcagaacuccaccgaggacaccugguacaagauggucaagauccagaccgucaagcagguccagcgcaacgacgacuucaucgagcucgacuacaccauccuccuccacaacaucgccucccaggagaucauccccuggcagaugcagguccucuggcacccccaguacggcaccaaggucaagcacaacucccgccuccccaaggagguccagcucgaguga

SEQ ID NO: 45587 - RNA, 387 nt, Artificial Sequence
  derived and/or modified sequence opt2 from LY6D__Homo_sapiens__NP_003686
augcgcaccgcccuccuccuccucgccgcccucgccgucgccaccggccccgcccucacccuccgcugccacgucugcaccuccuccuccaacugcaagcacuccgucgucugccccgccuccucccgcuucugcaagaccaccaacaccgucgagccccuccgcggcaaccucgucaagaaggacugcgccgaguccugcacccccuccuacacccuccagggccaggucuccuccggcaccuccuccacccagugcugccaggaggaccucugcaacgagaagcuccacaacgccgcccccacccgcaccgcccucgcccacuccgcccucucccucggccucgcccucucccuccucgccgucauccucgcccccucccucuga

SEQ ID NO: 45588 - RNA, 396 nt, Artificial Sequence
  derived and/or modified sequence opt2 from LY6E__Homo_sapiens__NP_001120685
augaagaucuuccuccccguccuccucgccgcccuccucggcgucgagcgcgccuccucccucaugugcuucuccugccucaaccagaaguccaaccucuacugccucaagcccaccaucugcuccgaccaggacaacuacugcgucaccgucuccgccuccgccggcaucggcaaccucgucaccuucggccacucccucuccaagaccugcucccccgccugccccauccccgagggcgucaacgucggcgucgccuccaugggcaucuccugcugccaguccuuccucugcaacuucuccgccgccgacggcggccuccgcgccuccgucacccuccucggcgccggccuccuccucucccuccuccccgcccuccuccgcuucggccccuga

SEQ ID NO: 45589 - RNA, 606 nt, Artificial Sequence
  derived and/or modified sequence opt2 from LY6G5B__Homo_sapiens__NP_067044
augaagguccacaugcucgucggcguccucgucauggucggcuucaccgucggcaagguccccguccccgacauccgcaccugccacuucugccucgucgaggaccccuccgucggcugcaucuccggcuccgagaagugcaccaucuccuccuccucccucugcauggucaucaccaucuacuacgacgucaagguccgcuucaucguccgcggcugcggccaguacaucuccuaccgcugccaggagaagcgcaacaccuacuucgccgaguacugguaccaggcccagugcugccaguacgacuacugcaacuccugguccuccccccagcuccaguccucccuccccgagccccacgaccgcccccucgcccucccccucuccgacucccagauccagugguucuaccaggcccucaaccucucccucccccuccccaacuuccacgccggcaccgagcccgacggccucgaccccauggucacccucucccucaaccucggccucuccuucgccgagcuccgccgcauguaccucuuccucaacuccuccggccuccucguccucccccaggccggccuccucaccccccaccccuccuga

SEQ ID NO: 45590 - RNA, 453 nt, Artificial Sequence
  derived and/or modified sequence opt2 from LY6G5C__Homo_sapiens__NP_079538
augcgcuucauggccggccccgccggcucccagucccucggcccccucugcuuccacuccuccccccaggcccucuacaccguccuccucaucguccucgucaugaugucccucgucuucggcaaguucguccccgucaacugggagcccccccagccccuccccuuccccaaguaccuccgcugcuaccgcugccuccucgagaccaaggagcucggcugccuccucggcuccgacaucugccucacccccgccggcuccuccugcaucacccuccacaagaagaacuccuccggcuccgacgucauggucuccgacugccgcuccaaggagcagauguccgacugcuccaacacccgcaccucccccgucuccggcuucuggaucuucucccaguacugcuuccucgacuucugcaacgacccccagaaccgcggccucuacacccccuga

SEQ ID NO: 45591 - RNA, 378 nt, Artificial Sequence
  derived and/or modified sequence opt2 from LY6G6C__Homo_sapiens__NP_079537
augaaggcccucaugcuccucacccucuccguccuccucugcugggucuccgccgacauccgcugccacuccugcuacaagguccccguccucggcugcgucgaccgccaguccugccgccucgagcccggccagcagugccucaccacccacgccuaccucggcaagaugugggucuucuccaaccuccgcugcggcacccccgaggagcccugccaggaggccuucaaccagaccaaccgcaagcucggccucaccuacaacaccaccugcugcaacaaggacaacugcaacuccgccggcccccgccccacccccgcccucggccucgucuuccucaccucccucgccggccucggccucuggcuccuccacuga

SEQ ID NO: 45592 - RNA, 894 nt, Artificial Sequence
  derived and/or modified sequence opt2 from LY6G6F__Homo_sapiens__NP_001003693
auggccguccucuuccuccuccucuuccucugcggcaccccccaggccgccgacaacaugcaggccaucuacgucgcccucggcgaggccgucgagcuccccugccccuccccccccacccuccacggcgacgagcaccucuccugguucugcucccccgccgccggcuccuucaccacccucgucgcccagguccaggucggccgccccgcccccgaccccggcaagcccggccgcgagucccgccuccgccuccucggcaacuacucccucuggcucgagggcuccaaggaggaggacgccggccgcuacuggugcgccguccucggccagcaccacaacuaccagaacuggcgcgucuacgacguccucguccucaagggcucccagcucuccgcccgcgccgccgacggcucccccugcaacguccuccucugcuccgucguccccucccgccgcauggacuccgucaccuggcaggagggcaagggccccguccgcggccgcguccaguccuucuggggcuccgaggccgcccuccuccucgucugccccggcgagggccucuccgagccccgcucccgccgcccccgcaucauccgcugccucaugacccacaacaagggcgucuccuucucccucgccgccuccaucgacgccucccccgcccucugcgcccccuccaccggcugggacaugcccuggauccucaugcuccuccucaccaugggccagggcgucgucauccucgcccucuccaucguccucuggcgccagcgcguccgcggcgcccccggccgcgacgccuccaucccccaguucaagcccgagauccaggucuacgagaacauccaccucgcccgccucggcccccccgcccacaagccccgcuga

SEQ ID NO: 45593 - RNA, 498 nt, Artificial Sequence
  derived and/or modified sequence opt2 from LY6K__Homo_sapiens__NP_059997
auggcccuccucgcccuccuccucgucgucgcccucccccgcgucuggaccgacgccaaccucaccgcccgccagcgcgaccccgaggacucccagcgcaccgacgagggcgacaaccgcgucuggugccacgucugcgagcgcgagaacaccuucgagugccagaacccccgccgcugcaaguggaccgagcccuacugcgucaucgccgccgucaagaucuucccccgcuucuucauggucgccaagcagugcuccgccggcugcgccgccauggagcgccccaagcccgaggagaagcgcuuccuccucgaggagcccaugcccuucuucuaccucaagugcugcaagauccgcuacugcaaccucgagggcccccccaucaacuccuccgucuucaaggaguacgccggcuccaugggcgaguccugcggcggccucuggcucgccauccuccuccuccucgccuccaucgccgccggccucucccucuccuga

SEQ ID NO: 45594 - RNA, 5622 nt, Artificial Sequence
  derived and/or modified sequence opt2 from LY75-CD302__Homo_sapiens__NP_001185688
augcgcaccggcugggccaccccccgccgccccgccggccuccucaugcuccucuucugguucuucgaccucgccgagcccuccggccgcgccgccaacgaccccuucaccaucguccacggcaacaccggcaagugcaucaagcccgucuacggcuggaucgucgccgacgacugcgacgagaccgaggacaagcucuggaagugggucucccagcaccgccucuuccaccuccacucccagaagugccucggccucgacaucaccaaguccgucaacgagcuccgcauguucuccugcgacuccuccgccaugcucugguggaagugcgagcaccacucccucuacggcgccgcccgcuaccgccucgcccucaaggacggccacggcaccgccaucuccaacgccuccgacgucuggaagaagggcggcuccgaggagucccucugcgaccagcccuaccacgagaucuacacccgcgacggcaacuccuacggccgccccugcgaguuccccuuccucaucgacggcaccuggcaccacgacugcauccucgacgaggaccacuccggccccuggugcgccaccacccucaacuacgaguacgaccgcaaguggggcaucugccucaagcccgagaacggcugcgaggacaacugggagaagaacgagcaguucggcuccugcuaccaguucaacacccagaccgcccucuccuggaaggaggccuacgucuccugccagaaccagggcgccgaccuccucuccaucaacuccgccgccgagcucaccuaccucaaggagaaggagggcaucgccaagaucuucuggaucggccucaaccagcucuacuccgcccgcggcugggagugguccgaccacaagccccucaacuuccucaacugggaccccgaccgccccuccgcccccaccaucggcggcuccuccugcgcccgcauggacgccgaguccggccucuggcaguccuucuccugcgaggcccagcuccccuacgucugccgcaagccccucaacaacaccgucgagcucaccgacgucuggaccuacuccgacacccgcugcgacgccggcuggcuccccaacaacggcuucugcuaccuccucgucaacgaguccaacuccugggacaaggcccacgccaagugcaaggccuucuccuccgaccucaucuccauccacucccucgccgacgucgaggucgucgucaccaagcuccacaacgaggacaucaaggaggaggucuggaucggccucaagaacaucaacauccccacccucuuccagugguccgacggcaccgaggucacccucaccuacugggacgagaacgagcccaacguccccuacaacaagacccccaacugcgucuccuaccucggcgagcucggccaguggaagguccaguccugcgaggagaagcucaaguacgucugcaagcgcaagggcgagaagcucaacgacgccuccuccgacaagaugugcccccccgacgagggcuggaagcgccacggcgagaccugcuacaagaucuacgaggacgagguccccuucggcaccaacugcaaccucaccaucaccucccgcuucgagcaggaguaccucaacgaccucaugaagaaguacgacaagucccuccgcaaguacuucuggaccggccuccgcgacgucgacuccugcggcgaguacaacugggccaccgucggcggccgccgccgcgccgucaccuucuccaacuggaacuuccucgagcccgccucccccggcggcugcgucgccauguccaccggcaaguccgucggcaagugggaggucaaggacugccgcuccuucaaggcccucuccaucugcaagaagauguccggcccccucggccccgaggaggccucccccaagcccgacgaccccugccccgagggcuggcaguccuuccccgccucccucuccugcuacaaggucuuccacgccgagcgcaucguccgcaagcgcaacugggaggaggccgagcgcuucugccaggcccucggcgcccaccucuccuccuucucccacgucgacgagaucaaggaguuccuccacuuccucaccgaccaguucuccggccagcacuggcucuggaucggccucaacaagcgcucccccgaccuccagggcuccuggcagugguccgaccgcacccccgucuccaccaucaucaugcccaacgaguuccagcaggacuacgacauccgcgacugcgccgccgucaaggucuuccaccgccccuggcgccgcggcuggcacuucuacgacgaccgcgaguucaucuaccuccgccccuucgccugcgacaccaagcucgagugggucugccagauccccaagggccgcacccccaagacccccgacugguacaaccccgaccgcgccggcauccacggccccccccucaucaucgagggcuccgaguacugguucgucgccgaccuccaccucaacuacgaggaggccguccucuacugcgccuccaaccacuccuuccucgccaccaucaccuccuucgucggccucaaggccaucaagaacaagaucgccaacaucuccggcgacggccagaagugguggauccgcaucuccgaguggcccaucgacgaccacuucaccuacucccgcuaccccuggcaccgcuuccccgucaccuucggcgaggagugccucuacauguccgccaagaccuggcucaucgaccucggcaagcccaccgacugcuccaccaagcuccccuucaucugcgagaaguacaacgucuccucccucgagaaguacucccccgacuccgccgccaagguccagugcuccgagcaguggauccccuuccagaacaagugcuuccucaagaucaagcccgucucccucaccuucucccaggccuccgacaccugccacuccuacggcggcacccuccccuccguccucucccagaucgagcaggacuucaucaccucccuccuccccgacauggaggccacccucuggaucggccuccgcuggaccgccuacgagaagaucaacaaguggaccgacaaccgcgagcucaccuacuccaacuuccacccccuccucgucuccggccgccuccgcauccccgagaacuucuucgaggaggagucccgcuaccacugcgcccucauccucaaccuccagaagucccccuucaccggcaccuggaacuucaccuccugcuccgagcgccacuucgucucccucugccagaaguacuccgaggucaagucccgccagacccuccagaacgccuccgagaccgucaaguaccucaacaaccucuacaagaucauccccaagacccucaccuggcacuccgccaagcgcgagugccucaaguccaacaugcagcucgucuccaucaccgaccccuaccagcaggccuuccucuccguccaggcccuccuccacaacuccucccucuggaucggccucuucucccaggacgacgagcucaacuucggcugguccgacggcaagcgccuccacuucucccgcugggccgagaccaacggccagcucgaggacugcgucguccucgacaccgacggcuucuggaagaccgucgacugcaacgacaaccagcccggcgccaucugcuacuacuccggcaacgagaccgagaaggaggucaagcccgucgacuccgucaagugccccucccccguccucaacacccccuggauccccuuccagaacugcugcuacaacuucaucaucaccaagaaccgccacauggccaccacccaggacgagguccacaccaagugccagaagcucaaccccaagucccacauccucuccauccgcgacgagaaggagaacaacuucguccucgagcagcuccucuacuucaacuacauggccuccugggucaugcucggcaucaccuaccgcaacaagucccucaugugguucgacaagaccccccucuccuacacccacuggcgcgccggccgccccaccaucaagaacgagaaguuccucgccggccucuccaccgacggcuucugggacauccagaccuucaaggucaucgaggaggccgucuacuuccaccagcacuccauccucgccugcaagaucgagauggucgacuacaaggaggaguacaacaccacccucccccaguucaugcccuacgaggacggcaucuacuccgucauccagaagaaggucaccugguacgaggcccucaacaugugcucccaguccggcggccaccucgccuccguccacaaccagaacggccagcucuuccucgaggacaucgucaagcgcgacggcuucccccucugggucggccucuccucccacgacggcuccgaguccuccuucgagugguccgacggcuccaccuucgacuacauccccuggaagggccagaccucccccggcaacugcguccuccucgaccccaagggcaccuggaagcacgagaagugcaacuccgucaaggacggcgccaucugcuacaagcccaccaaguccaagaagcucucccgccucaccuacuccucccgcugccccgccgccaaggagaacggcucccgcuggauccaguacaagggccacugcuacaaguccgaccaggcccuccacuccuucuccgaggccaagaagcucugcuccaagcacgaccacuccgccaccaucgucuccaucaaggacgaggacgagaacaaguucgucucccgccucaugcgcgagaacaacaacaucaccaugcgcgucuggcucggccucucccagcacuccgucgaccaguccugguccuggcucgacggcuccgaggucaccuucgucaagugggagaacaaguccaaguccggcgucggccgcugcuccaugcucaucgccuccaacgagaccuggaagaaggucgagugcgagcacggcuucggccgcgucgucugcaaggucccccucgacugccccuccuccaccuggauccaguuccaggacuccugcuacaucuuccuccaggaggccaucaaggucgaguccaucgaggacguccgcaaccagugcaccgaccacggcgccgacaugaucuccauccacaacgaggaggagaacgccuucauccucgacacccucaagaagcaguggaagggccccgacgacauccuccucggcauguucuacgacaccgacgacgccuccuucaagugguucgacaacuccaacaugaccuucgacaaguggaccgaccaggacgacgacgaggaccucgucgacaccugcgccuuccuccacaucaagaccggcgaguggaagaagggcaacugcgaggucuccuccgucgagggcacccucugcaagaccgccauccccuacaagcgcaaguaccucuccgacaaccacauccucaucuccgcccucgucaucgccuccaccgucauccucaccguccucggcgccaucaucugguuccucuacaagaagcacuccgacucccgcuucaccaccgucuucuccaccgccccccagucccccuacaacgaggacugcguccucgucgucggcgaggagaacgaguaccccguccaguucgacuga

SEQ ID NO: 45595 - RNA, 5169 nt, Artificial Sequence
  derived and/or modified sequence opt2 from LY75__Homo_sapiens__NP_002340
augcgcaccggcugggccaccccccgccgccccgccggccuccucaugcuccucuucugguucuucgaccucgccgagcccuccggccgcgccgccaacgaccccuucaccaucguccacggcaacaccggcaagugcaucaagcccgucuacggcuggaucgucgccgacgacugcgacgagaccgaggacaagcucuggaagugggucucccagcaccgccucuuccaccuccacucccagaagugccucggccucgacaucaccaaguccgucaacgagcuccgcauguucuccugcgacuccuccgccaugcucugguggaagugcgagcaccacucccucuacggcgccgcccgcuaccgccucgcccucaaggacggccacggcaccgccaucuccaacgccuccgacgucuggaagaagggcggcuccgaggagucccucugcgaccagcccuaccacgagaucuacacccgcgacggcaacuccuacggccgccccugcgaguuccccuuccucaucgacggcaccuggcaccacgacugcauccucgacgaggaccacuccggccccuggugcgccaccacccucaacuacgaguacgaccgcaaguggggcaucugccucaagcccgagaacggcugcgaggacaacugggagaagaacgagcaguucggcuccugcuaccaguucaacacccagaccgcccucuccuggaaggaggccuacgucuccugccagaaccagggcgccgaccuccucuccaucaacuccgccgccgagcucaccuaccucaaggagaaggagggcaucgccaagaucuucuggaucggccucaaccagcucuacuccgcccgcggcugggagugguccgaccacaagccccucaacuuccucaacugggaccccgaccgccccuccgcccccaccaucggcggcuccuccugcgcccgcauggacgccgaguccggccucuggcaguccuucuccugcgaggcccagcuccccuacgucugccgcaagccccucaacaacaccgucgagcucaccgacgucuggaccuacuccgacacccgcugcgacgccggcuggcuccccaacaacggcuucugcuaccuccucgucaacgaguccaacuccugggacaaggcccacgccaagugcaaggccuucuccuccgaccucaucuccauccacucccucgccgacgucgaggucgucgucaccaagcuccacaacgaggacaucaaggaggaggucuggaucggccucaagaacaucaacauccccacccucuuccagugguccgacggcaccgaggucacccucaccuacugggacgagaacgagcccaacguccccuacaacaagacccccaacugcgucuccuaccucggcgagcucggccaguggaagguccaguccugcgaggagaagcucaaguacgucugcaagcgcaagggcgagaagcucaacgacgccuccuccgacaagaugugcccccccgacgagggcuggaagcgccacggcgagaccugcuacaagaucuacgaggacgagguccccuucggcaccaacugcaaccucaccaucaccucccgcuucgagcaggaguaccucaacgaccucaugaagaaguacgacaagucccuccgcaaguacuucuggaccggccuccgcgacgucgacuccugcggcgaguacaacugggccaccgucggcggccgccgccgcgccgucaccuucuccaacuggaacuuccucgagcccgccucccccggcggcugcgucgccauguccaccggcaaguccgucggcaagugggaggucaaggacugccgcuccuucaaggcccucuccaucugcaagaagauguccggcccccucggccccgaggaggccucccccaagcccgacgaccccugccccgagggcuggcaguccuuccccgccucccucuccugcuacaaggucuuccacgccgagcgcaucguccgcaagcgcaacugggaggaggccgagcgcuucugccaggcccucggcgcccaccucuccuccuucucccacgucgacgagaucaaggaguuccuccacuuccucaccgaccaguucuccggccagcacuggcucuggaucggccucaacaagcgcucccccgaccuccagggcuccuggcagugguccgaccgcacccccgucuccaccaucaucaugcccaacgaguuccagcaggacuacgacauccgcgacugcgccgccgucaaggucuuccaccgccccuggcgccgcggcuggcacuucuacgacgaccgcgaguucaucuaccuccgccccuucgccugcgacaccaagcucgagugggucugccagauccccaagggccgcacccccaagacccccgacugguacaaccccgaccgcgccggcauccacggccccccccucaucaucgagggcuccgaguacugguucgucgccgaccuccaccucaacuacgaggaggccguccucuacugcgccuccaaccacuccuuccucgccaccaucaccuccuucgucggccucaaggccaucaagaacaagaucgccaacaucuccggcgacggccagaagugguggauccgcaucuccgaguggcccaucgacgaccacuucaccuacucccgcuaccccuggcaccgcuuccccgucaccuucggcgaggagugccucuacauguccgccaagaccuggcucaucgaccucggcaagcccaccgacugcuccaccaagcuccccuucaucugcgagaaguacaacgucuccucccucgagaaguacucccccgacuccgccgccaagguccagugcuccgagcaguggauccccuuccagaacaagugcuuccucaagaucaagcccgucucccucaccuucucccaggccuccgacaccugccacuccuacggcggcacccuccccuccguccucucccagaucgagcaggacuucaucaccucccuccuccccgacauggaggccacccucuggaucggccuccgcuggaccgccuacgagaagaucaacaaguggaccgacaaccgcgagcucaccuacuccaacuuccacccccuccucgucuccggccgccuccgcauccccgagaacuucuucgaggaggagucccgcuaccacugcgcccucauccucaaccuccagaagucccccuucaccggcaccuggaacuucaccuccugcuccgagcgccacuucgucucccucugccagaaguacuccgaggucaagucccgccagacccuccagaacgccuccgagaccgucaaguaccucaacaaccucuacaagaucauccccaagacccucaccuggcacuccgccaagcgcgagugccucaaguccaacaugcagcucgucuccaucaccgaccccuaccagcaggccuuccucuccguccaggcccuccuccacaacuccucccucuggaucggccucuucucccaggacgacgagcucaacuucggcugguccgacggcaagcgccuccacuucucccgcugggccgagaccaacggccagcucgaggacugcgucguccucgacaccgacggcuucuggaagaccgucgacugcaacgacaaccagcccggcgccaucugcuacuacuccggcaacgagaccgagaaggaggucaagcccgucgacuccgucaagugccccucccccguccucaacacccccuggauccccuuccagaacugcugcuacaacuucaucaucaccaagaaccgccacauggccaccacccaggacgagguccacaccaagugccagaagcucaaccccaagucccacauccucuccauccgcgacgagaaggagaacaacuucguccucgagcagcuccucuacuucaacuacauggccuccugggucaugcucggcaucaccuaccgcaacaagucccucaugugguucgacaagaccccccucuccuacacccacuggcgcgccggccgccccaccaucaagaacgagaaguuccucgccggccucuccaccgacggcuucugggacauccagaccuucaaggucaucgaggaggccgucuacuuccaccagcacuccauccucgccugcaagaucgagauggucgacuacaaggaggaguacaacaccacccucccccaguucaugcccuacgaggacggcaucuacuccgucauccagaagaaggucaccugguacgaggcccucaacaugugcucccaguccggcggccaccucgccuccguccacaaccagaacggccagcucuuccucgaggacaucgucaagcgcgacggcuucccccucugggucggccucuccucccacgacggcuccgaguccuccuucgagugguccgacggcuccaccuucgacuacauccccuggaagggccagaccucccccggcaacugcguccuccucgaccccaagggcaccuggaagcacgagaagugcaacuccgucaaggacggcgccaucugcuacaagcccaccaaguccaagaagcucucccgccucaccuacuccucccgcugccccgccgccaaggagaacggcucccgcuggauccaguacaagggccacugcuacaaguccgaccaggcccuccacuccuucuccgaggccaagaagcucugcuccaagcacgaccacuccgccaccaucgucuccaucaaggacgaggacgagaacaaguucgucucccgccucaugcgcgagaacaacaacaucaccaugcgcgucuggcucggccucucccagcacuccgucgaccaguccugguccuggcucgacggcuccgaggucaccuucgucaagugggagaacaaguccaaguccggcgucggccgcugcuccaugcucaucgccuccaacgagaccuggaagaaggucgagugcgagcacggcuucggccgcgucgucugcaaggucccccucggccccgacuacaccgccaucgccaucaucgucgccacccucuccauccucguccucaugggcggccucaucugguuccucuuccagcgccaccgccuccaccucgccggcuucuccuccguccgcuacgcccagggcgucaacgaggacgagaucaugcuccccuccuuccacgacuga

SEQ ID NO: 45596 - RNA, 489 nt, Artificial Sequence
  derived and/or modified sequence opt2 from LY86__Homo_sapiens__NP_004262
augaagggcuucaccgccacccucuuccucuggacccucaucuuccccuccugcuccggcggcggcggcggcaaggccuggcccacccacgucgucugcuccgacuccggccucgagguccucuaccaguccugcgacccccuccaggacuucggcuucuccgucgagaagugcuccaagcagcucaaguccaacaucaacauccgcuucggcaucauccuccgcgaggacaucaaggagcucuuccucgaccucgcccucaugucccagggcuccuccguccucaacuucuccuaccccaucugcgaggccgcccuccccaaguucuccuucugcggccgccgcaagggcgagcagaucuacuacgccggccccgucaacaaccccgaguucaccaucccccagggcgaguaccagguccuccucgagcucuacaccgagaagcgcuccaccgucgccugcgccaacgccaccaucaugugcuccuga

SEQ ID NO: 45597 - RNA, 393 nt, Artificial Sequence
  derived and/or modified sequence opt2 from LY96__Homo_sapiens__NP_001182726
augcuccccuuccucuucuucuccacccucuucuccuccaucuucaccgaggcccagaagcaguacugggucugcaacuccuccgacgccuccaucuccuacaccuacugcggccgcgaccucaagcagcucuacuucaaccucuacaucaccgucaacaccaugaaccuccccaagcgcaaggaggucaucugccgcggcuccgacgacgacuacuccuucugccgcgcccucaagggcgagaccgucaacaccaccaucuccuucuccuucaagggcaucaaguucuccaagggcaaguacaagugcgucgucgaggccaucuccggcucccccgaggagaugcucuucugccucgaguucgucauccuccaccagcccaacuccaacuga

SEQ ID NO: 45598 - RNA, 582 nt, Artificial Sequence
  derived and/or modified sequence opt2 from LY9__Homo_sapiens__NP_001028839
auggucgcccccaagucccacaccgacgacugggcccccggccccuucuccuccaagccccagcgcucccagcuccagaucuucuccuccguccuccagaccucccuccucuuccuccucaugggccuccgcgccuccggcaaggacuccgcccccaccgucgucuccggcauccucggcggcuccgucacccucccccucaacaucuccgucgacaccgagaucgagaacgucaucuggaucggccccaagaacgcccucgccuucgcccgccccaaggagaacgucaccaucauggucaaguccuaccucggccgccucgacaucaccaagugguccuacucccucugcaucuccaaccucacccucaacgacgccggcuccuacaaggcccagaucaaccagcgcaacuucgaggucaccaccgaggaggaguucacccucuucgucuacgcccccuucaucgagaagcucuccguccacgucaucgagggcgaccaccgcacccuccucgagggcuccggccucgaguccaucaucuccacccucgccgagccccgcgucuccguccgcgagggcuga

SEQ ID NO: 45599 - RNA, 1056 nt, Artificial Sequence
  derived and/or modified sequence opt2 from LYL1__Homo_sapiens__XP_006722815
augaccggccucgacugggccgucggcuccgucuucggcggccucggcuccgccuucgaggucaucgucuccgucgucggcucccagggcugcuacggcggcugccuccagugggaguggggcucccucaagcagcucugguccaccuuccgcgacuccaacggcaagaaccgccgcgucauccucgaggucuccacccccaccuccggcuccaugugccccccccaggcccaggccgaggucggccccaccaugaccgagaaggccgagauggucugcgcccccucccccgcccccgcccccccccccaagcccgccucccccggccccccccaggucgaggaggucggccaccgcggcggcuccucccccccccgccucccccccggcguccccgucaucucccucggccacucccgcccccccggcgucgccaugcccaccaccgagcucggcacccuccgccccccccuccuccagcucuccacccucggcaccgccccccccacccucgcccuccacuaccacccccaccccuuccucaacuccgucuacaucggccccgccggccccuucuccaucuuccccuccucccgccucaagcgccgccccucccacugcgagcucgaccucgccgagggccaccagccccagaaggucgcccgccgcgucuucaccaacucccgcgagcgcuggcgccagcagaacgucaacggcgccuucgccgagcuccgcaagcuccuccccacccacccccccgaccgcaagcucuccaagaacgagguccuccgccucgccaugaaguacaucggcuuccucguccgccuccuccgcgaccaggccgccgcccucgccgccggccccaccccccccggcccccgcaagcgccccguccaccgcguccccgacgacggcgcccgccgcggcuccggccgccgcgccgaggccgccgcccgcucccagcccgccccccccgccgaccccgacggcucccccggcggcgccgcccgccccaucaagauggagcagaccgcccucucccccgagguccgcuga

SEQ ID NO: 45600 - RNA, 1476 nt, Artificial Sequence
  derived and/or modified sequence opt2 from LYN__Homo_sapiens__NP_001104567
augggcugcaucaaguccaagggcaaggacucccucuccgacgacggcgucgaccucaagacccagcccguccccgagucccagcuccuccccggccagcgcuuccagaccaaggaccccgaggagcagggcgacaucgucgucgcccucuaccccuacgacggcauccaccccgacgaccucuccuucaagaagggcgagaagaugaagguccucgaggagcacggcgagugguggaaggccaagucccuccucaccaagaaggagggcuucauccccuccaacuacgucgccaagcucaacacccucgagaccgaggagugguucuucaaggacaucacccgcaaggacgccgagcgccagcuccucgcccccggcaacuccgccggcgccuuccucauccgcgaguccgagacccucaagggcuccuucucccucuccguccgcgacuucgaccccguccacggcgacgucaucaagcacuacaagauccgcucccucgacaacggcggcuacuacaucuccccccgcaucaccuuccccugcaucuccgacaugaucaagcacuaccagaagcaggccgacggccucugccgccgccucgagaaggccugcaucucccccaagccccagaagcccugggacaaggacgccugggagaucccccgcgaguccaucaagcucgucaagcgccucggcgccggccaguucggcgaggucuggaugggcuacuacaacaacuccaccaaggucgccgucaagacccucaagcccggcaccauguccguccaggccuuccucgaggaggccaaccucaugaagacccuccagcacgacaagcucguccgccucuacgccgucgucacccgcgaggagcccaucuacaucaucaccgaguacauggccaagggcucccuccucgacuuccucaaguccgacgagggcggcaagguccuccuccccaagcucaucgacuucuccgcccagaucgccgagggcauggccuacaucgagcgcaagaacuacauccaccgcgaccuccgcgccgccaacguccucgucuccgagucccucaugugcaagaucgccgacuucggccucgcccgcgucaucgaggacaacgaguacaccgcccgcgagggcgccaaguuccccaucaaguggaccgcccccgaggccaucaacuucggcugcuucaccaucaaguccgacgucugguccuucggcauccuccucuacgagaucgucaccuacggcaagauccccuaccccggccgcaccaacgccgacgucaugaccgcccucucccagggcuaccgcaugccccgcgucgagaacugccccgacgagcucuacgacaucaugaagaugugcuggaaggagaaggccgaggagcgccccaccuucgacuaccuccaguccguccucgacgacuucuacaccgccaccgagggccaguaccagcagcagcccuga

SEQ ID NO: 45601 - RNA, 294 nt, Artificial Sequence
  derived and/or modified sequence opt2 from LYNX1__Homo_sapiens__NP_803253
augcagcucggcaccggccuccuccucgccgccguccucucccuccagcucgccgccgccgaggccaucuggugccaccagugcaccggcuucggcggcugcucccacggcucccgcugccuccgcgacuccacccacugcgucaccaccgccacccgcguccucuccaacaccgaggaccucccccucgucaccaagaugugccacaucggcugccccgacauccccucccucggccucggccccuacgucuccaucgccugcugccagaccucccucugcaaccacgacuga

SEQ ID NO: 45602 - RNA, 426 nt, Artificial Sequence
  derived and/or modified sequence opt2 from LYPD1__Homo_sapiens__NP_653187
auguggguccucggcaucgccgccaccuucugcggccucuuccuccuccccggcuucgcccuccagauccagugcuaccagugcgaggaguuccagcucaacaacgacugcuccucccccgaguucaucgucaacugcaccgucaacguccaggacaugugccagaaggaggucauggagcaguccgccggcaucauguaccgcaaguccugcgccuccuccgccgccugccucaucgccuccgccggcuaccaguccuucugcucccccggcaagcucaacuccgucugcaucuccugcugcaacaccccccucugcaacggcccccgccccaagaagcgcggcuccuccgccuccgcccuccgccccggccuccgcaccaccauccucuuccucaagcucgcccucuucuccgcccacugcuga

SEQ ID NO: 45603 - RNA, 378 nt, Artificial Sequence
  derived and/or modified sequence opt2 from LYPD2__Homo_sapiens__NP_991108
augcgcggcacccgccucgcccuccucgcccucguccucgccgccugcggcgagcucgcccccgcccuccgcugcuacgucugccccgagcccaccggcgucuccgacugcgucaccaucgccaccugcaccaccaacgagaccaugugcaagaccacccucuacucccgcgagaucgucuaccccuuccagggcgacuccaccgucaccaaguccugcgccuccaagugcaagcccuccgacgucgacggcaucggccagacccuccccgucuccugcugcaacaccgagcucugcaacgucgacggcgcccccgcccucaacucccuccacugcggcgcccucacccuccucccccuccucucccuccgccucuga

SEQ ID NO: 45604 - RNA, 1041 nt, Artificial Sequence
  derived and/or modified sequence opt2 from LYPD3__Homo_sapiens__NP_055215
auggaccccgcccgcaaggccggcgcccaggccaugaucuggaccgccggcuggcuccuccuccuccuccuccgcggcggcgcccaggcccucgagugcuacuccugcguccagaaggccgacgacggcugcucccccaacaagaugaagaccgucaagugcgcccccggcgucgacgucugcaccgaggccgucggcgccgucgagaccauccacggccaguucucccucgccguccgcggcugcggcuccggccuccccggcaagaacgaccgcggccucgaccuccacggccuccucgccuucauccagcuccagcagugcgcccaggaccgcugcaacgccaagcucaaccucaccucccgcgcccucgaccccgccggcaacgaguccgccuacccccccaacggcgucgagugcuacuccugcgucggccucucccgcgaggccugccagggcaccuccccccccgucgucuccugcuacaacgccuccgaccacgucuacaagggcugcuucgacggcaacgucacccucaccgccgccaacgucaccgucucccuccccguccgcggcugcguccaggacgaguucugcacccgcgacggcgucaccggccccggcuucacccucuccggcuccugcugccagggcucccgcugcaacuccgaccuccgcaacaagaccuacuucuccccccgcauccccccccucguccgccuccccccccccgagcccaccaccgucgccuccaccaccuccgucaccaccuccaccuccgcccccguccgccccaccuccaccaccaagcccaugcccgcccccaccucccagaccccccgccagggcgucgagcacgaggccucccgcgacgaggagccccgccucaccggcggcgccgccggccaccaggaccgcuccaacuccggccaguaccccgccaagggcggcccccagcagccccacaacaagggcugcgucgcccccaccgccggccucgccgcccuccuccucgccgucgccgccggcguccuccucuga

SEQ ID NO: 45605 - RNA, 636 nt, Artificial Sequence
  derived and/or modified sequence opt2 from LYPD4__Homo_sapiens__NP_001278348
augggcccccagcaccuccgccucguccagcucuucugccuccucggcgccaucuccacccucccccgcauguccugcggcgccggcugcuacaagacccagaagggcaccgcccgcggcgucgucggcuucaagggcugcuccuccuccuccuccuaccccgcccagaucuccuaccucgucuccccccccggcgucuccaucgccuccuacucccgcgucugccgcuccuaccucugcaacaaccucaccaaccucgagcccuucgucaagcucaaggccuccacccccaaguccaucaccuccgccuccugcuccugccccaccugcgucggcgagcacaugaaggacugccuccccaacuucgucaccaccaacuccugcccccucgccgccuccaccugcuacuccuccacccucaaguuccaggccggcuuccucaacaccaccuuccuccucaugggcugcgcccgcgagcacaaccagcuccucgccgacuuccaccacaucggcuccaucaaggucaccgagguccucaacauccucgagaagucccagaucgucggcgccgccuccucccgccaggaccccgccuggggcgucguccucggccuccucuucgccuuccgcgacuga

SEQ ID NO: 45606 - RNA, 756 nt, Artificial Sequence
  derived and/or modified sequence opt2 from LYPD5__Homo_sapiens__NP_001026919
auggccaugggcgucccccgcgucauccuccucugccucuucggcgccgcccucugccucaccggcucccaggcccuccagugcuacuccuucgagcacaccuacuucggccccuucgaccuccgcgccaugaagcuccccuccaucuccugcccccacgagugcuucgaggccauccucucccucgacaccggcuaccgcgcccccgucacccucguccgcaagggcugcuggaccggcccccccgccggccagacccaguccaacgccgacgcccucccccccgacuacuccgucguccgcggcugcaccaccgacaagugcaacgcccaccucaugacccacgacgcccuccccaaccucucccaggcccccgacccccccacccucuccggcgccgagugcuacgccugcaucggcguccaccaggacgacugcgccaucggccgcucccgccgcguccagugccaccaggaccagaccgccugcuuccagggcaacggccgcaugaccgucggcaacuucuccguccccgucuacauccgcaccugccaccgccccuccugcaccaccgagggcaccaccucccccuggaccgccaucgaccuccagggcuccugcugcgagggcuaccucugcaaccgcaaguccaugacccagcccuucaccuccgccuccgccaccacccccccccgcgcccuccagguccucgcccuccuccuccccguccuccuccucgucggccucuccgccuga

SEQ ID NO: 45607 - RNA, 516 nt, Artificial Sequence
  derived and/or modified sequence opt2 from LYPD6__Homo_sapiens__NP_001182614
auggagcccggccccgcccucgccuggcuccuccuccucucccuccucgccgacugccucaaggccgcccagucccgcgacuucaccgucaaggacaucaucuaccuccaccccuccaccacccccuaccccggcggcuucaagugcuucaccugcgagaaggccgccgacaacuacgagugcaaccgcugggcccccgacaucuacugcccccgcgagacccgcuacugcuacacccagcacaccauggaggucaccggcaacuccaucuccgucaccaagcgcugcgucccccucgaggagugccucuccaccggcugccgcgacuccgagcacgagggccacaaggucugcaccuccugcugcgagggcaacaucugcaaccucccccucccccgcaacgagaccgacgccaccuucgccaccaccucccccaucaaccagaccaacggccacccccgcugcauguccgucaucgucuccugccucuggcucuggcucggccucaugcucuga

SEQ ID NO: 45608 - RNA, 714 nt, Artificial Sequence
  derived and/or modified sequence opt2 from LYPD8__Homo_sapiens__NP_001078943
augaagggcauccucgucgccggcaucaccgccguccucgucgccgccgucgagucccucuccugcguccagugcaacuccugggagaaguccugcgucaacuccaucgccuccgagugccccucccacgccaacaccuccugcaucuccuccuccgccuccuccucccucgagacccccguccgccucuaccagaacauguucugcuccgccgagaacugcuccgaggagacccacaucaccgccuucaccguccacgucuccgccgaggagcacuuccacuucgucucccagugcugccagggcaaggagugcuccaacaccuccgacgcccucgaccccccccucaagaacgucuccuccaacgccgagugccccgccugcuacgaguccaacggcaccuccugccgcggcaagcccuggaagugcuacgaggaggagcagugcgucuuccucgucgccgagcucaagaacgacaucgaguccaagucccucguccucaagggcugcuccaacgucuccaacgccaccugccaguuccucuccggcgagaacaagacccucggcggcgucaucuuccgcaaguucgagugcgccaacgucaacucccucacccccaccuccgcccccaccaccucccacaacgucggcuccaaggccucccucuaccuccucgcccucgccucccuccuccuccgcggccuccuccccuga

SEQ ID NO: 45609 - RNA, 645 nt, Artificial Sequence
  derived and/or modified sequence opt2 from LYPLA1__Homo_sapiens__NP_001266286
augugcggcaacaacauguccaccccccuccccgccaucguccccgccgcccgcaaggccaccgccgccgucaucuuccuccacggccucggcgacaccggccacggcugggccgaggccuucgccggcauccgcuccucccacaucaaguacaucugcccccacgccuucgacaucaucggccucucccccgacucccaggaggacgaguccggcaucaagcaggccgccgagaacaucaaggcccucaucgaccaggaggucaagaacggcauccccuccaaccgcaucauccucggcggcuucucccagggcggcgcccucucccucuacaccgcccucaccacccagcagaagcucgccggcgucaccgcccucuccugcuggcucccccuccgcgccuccuucccccagggccccaucggcggcgccaaccgcgacaucuccauccuccagugccacggcgacugcgacccccucgucccccucauguucggcucccucaccgucgagaagcucaagacccucgucaaccccgccaacgucaccuucaagaccuacgagggcaugaugcacuccuccugccagcaggagaugauggacgucaagcaguucaucgacaagcuccucccccccaucgacuga

SEQ ID NO: 45610 - RNA, 666 nt, Artificial Sequence
  derived and/or modified sequence opt2 from LYPLAL1__Homo_sapiens__NP_001287699
auggccgccgccuccggcuccguccuccagcgcugcaucgucucccccgccggccgccacuccgccucccucaucuuccuccacggcuccggcgacuccggccagggccuccgcauguggaucaagcagguccucaaccaggaccucaccuuccagcacaucaagaucaucuaccccaccgcccccccccgcuucaagaucaccaacgacugccccgagcaccucgaguccaucgacgucaugugccagguccucaccgaccucaucgacgaggaggucaaguccggcaucaagaagaaccgcauccucaucggcggcuucuccaugggcggcugcauggccauccaccucgccuaccgcaaccaccaggacgucgccggcgucuucgcccucuccuccuuccucaacaaggccuccgccgucuaccaggcccuccagaaguccaacggcguccuccccgagcucuuccagugccacggcaccgccgacgagcucguccuccacuccugggccgaggagaccaacuccaugcucaagucccucggcgucaccaccaaguuccacuccuuccccaacgucuaccacgagcucuccaagaccgagcucgacauccucaagcucuggauccucaccaagcuccccggcgagauggagaagcagaaguga

SEQ ID NO: 45611 - RNA, 369 nt, Artificial Sequence
  derived and/or modified sequence opt2 from LYRM1__Homo_sapiens__NP_001289765
augaccaccgccacccgccaggagguccucggccucuaccgcuccaucuuccgccucgcccgcaaguggcaggccaccuccggccagauggaggacaccaucaaggagaagcaguacauccucaacgaggcccgcacccucuuccgcaagaacaagaaccucaccgacaccgaccucaucaagcagugcaucgacgagugcaccgcccgcaucgagaucggccuccacuacaagauccccuacccccgccccauccaccucccccccaugggccucaccccccuccgcggccgcggccuccgcucccaggagaagcuccgcaagcucuccaagcccgucuaccuccgcucccacgacgaggucuccuga

SEQ ID NO: 45612 - RNA, 393 nt, Artificial Sequence
  derived and/or modified sequence opt2 from LYRM4__Homo_sapiens__NP_001158312
auggccgccuccucccgcgcccagguccucucccucuaccgcgccaugcuccgcgaguccaagcgcuucuccgccuacaacuaccgcaccuacgccguccgccgcauccgcgacgccuuccgcgagaacaagaacgucaaggaccccgucgagauccagacccucgucaacaaggccaagcgcgaccucggcgucauccgccgccagauggacucccacuccgucgcccaggccggcguccacuggaacgaccucuccucccuccagccccucccccccugguucaagcaguucuccugccucucccuccccuccuccugggacuaccgccgcacccccccccgccucgccaacuucugcauccucucccgcgacgucaucucccucuacuga

SEQ ID NO: 45613 - RNA, 315 nt, Artificial Sequence
  derived and/or modified sequence opt2 from LYRM7__Homo_sapiens__NP_859056
augggccgcgccgucaagguccuccagcucuucaagacccuccaccgcacccgccagcaggucuucaagaacgacgcccgcgcccucgaggccgcccgcaucaagaucaacgaggaguucaagaacaacaaguccgagaccuccuccaagaagaucgaggagcucaugaagaucggcuccgacgucgagcuccuccuccgcaccuccgucauccagggcauccacaccgaccacaacacccucaagcucgucccccgcaaggaccuccucgucgagaacguccccuacugcgacgcccccacccagaagcaguga

SEQ ID NO: 45614 - RNA, 237 nt, Artificial Sequence
  derived and/or modified sequence opt2 from LYRM9__Homo_sapiens__NP_001070148
auggccccccuccccggcgccgagcucguccgccgcccccuccagcucuaccgcuaccuccuccgcugcugccagcagcuccccaccaagggcauccagcagcacuacaagcacgccguccgccaguccuuccgcguccacuccgacgaggacaaccccgagcgcauccagcagaucaucaagcgcgccaucgaggacgccgacuggaucaugaacaaguacaagaagcagaacuga

SEQ ID NO: 45615 - RNA, 11406 nt, Artificial Sequence
  derived and/or modified sequence opt2 from LYST__Homo_sapiens__NP_001288294
auguccaccgacuccaacucccucgcccgcgaguuccucaccgacgucaaccgccucugcaacgccgucguccagcgcgucgaggcccgcgaggaggaggaggaggagacccacauggccacccucggccaguaccucguccacggccgcggcuuccuccuccucaccaagcucaacuccaucaucgaccaggcccucaccugccgcgaggagcuccucacccuccuccucucccuccucccccucgucuggaagauccccguccaggaggagaaggccaccgacuucaaccucccccucuccgccgacaucauccucaccaaggagaagaacuccuccucccagcgcuccacccaggagaagcuccaccucgagggcuccgcccucuccucccaggucuccgccaaggucaacgucuuccgcaagucccgccgccagcgcaagaucacccaccgcuacuccguccgcgacgcccgcaagacccagcucuccaccuccgacuccgaggccaacuccgacgagaagggcaucgccaugaacaagcaccgccgcccccaccuccuccaccacuuccucaccuccuuccccaagcaggaccaccccaaggccaagcucgaccgccucgccaccaaggagcagaccccccccgacgccauggcccucgagaacucccgcgagaucaucccccgccagggcuccaacaccgacauccucuccgagcccgccgcccucuccgucaucuccaacaugaacaacucccccuucgaccucugccacguccuccucucccuccucgagaaggucugcaaguucgacgucacccucaaccacaacuccccccucgccgccuccgucguccccacccucaccgaguuccucgccggcuucggcgacugcugcucccucuccgacaaccucgagucccgcgucgucuccgccggcuggaccgaggagcccgucgcccucauccagcgcaugcucuuccgcaccguccuccaccuccucuccgucgacgucuccaccgccgagaugaugcccgagaaccuccgcaagaaccucaccgagcuccuccgcgccgcccucaagauccgcaucugccucgagaagcagcccgaccccuucgccccccgccagaagaagacccuccaggagguccaggaggacuucgucuucuccaaguaccgccaccgcgcccuccuccuccccgagcuccucgagggcguccuccagauccucaucugcugccuccaguccgccgccuccaaccccuucuacuucucccaggccauggaccucguccaggaguucauccagcaccacggcuucaaccucuucgagaccgccguccuccagauggaguggcucguccuccgcgacggcgucccccccgaggccuccgagcaccucaaggcccucaucaacuccgucaugaagaucauguccaccgucaagaaggucaaguccgagcagcuccaccacuccaugugcacccgcaagcgccaccgccgcugcgaguacucccacuucaugcaccaccaccgcgaccucuccggccuccucgucuccgccuucaagaaccaggucuccaagaaccccuucgaggagaccgccgacggcgacgucuacuaccccgagcgcugcugcugcaucgccgucugcgcccaccagugccuccgccuccuccagcaggccucccucuccuccaccugcguccagauccucuccggcguccacaacaucggcaucugcugcugcauggaccccaaguccgucaucaucccccuccuccacgccuucaagcuccccgcccucaagaacuuccagcagcacauccucaacauccucaacaagcucauccucgaccagcucggcggcgccgagaucucccccaagaucaagaaggccgccugcaacaucugcaccgucgacuccgaccagcucgcccagcucgaggagacccuccagggcaaccucugcgacgccgagcucuccuccucccucuccucccccuccuaccgcuuccagggcauccuccccuccuccggcuccgaggaccuccucuggaagugggacgcccucaaggccuaccagaacuucgucuucgaggaggaccgccuccacuccauccagaucgccaaccacaucugcaaccucauccagaagggcaacaucgucguccaguggaagcucuacaacuacaucuucaaccccguccuccagcgcggcgucgagcucgcccaccacugccagcaccucuccgucaccuccgcccagucccacgucugcucccaccacaaccagugccucccccaggacguccuccagaucuacgucaagacccuccccauccuccucaagucccgcgucauccgcgaccucuuccucuccugcaacggcgucucccagaucaucgagcucaacugccucaacggcauccgcucccacucccucaaggccuucgagacccucaucaucucccucggcgagcagcagaaggacgccuccguccccgacaucgacggcaucgacaucgagcagaaggagcucuccuccguccacgucggcaccuccuuccaccaccagcaggccuacuccgacuccccccagucccucuccaaguucuacgccggccucaaggaggccuaccccaagcgccgcaagaccgucaaccaggacguccacaucaacaccaucaaccucuuccucugcgucgccuuccucugcgucuccaaggaggccgaguccgaccgcgaguccgccaacgacuccgaggacaccuccggcuacgacuccaccgccuccgagccccucucccacaugcuccccugcaucucccucgagucccucguccuccccucccccgagcacaugcaccaggccgccgacaucugguccaugugccgcuggaucuacaugcucuccuccgucuuccagaagcaguucuaccgccucggcggcuuccgcgucugccacaagcucaucuucaugaucauccagaagcucuuccgcucccacaaggaggagcagggcaagaaggagggcgacaccuccgucaacgagaaccaggaccucaaccgcaucucccagcccaagcgcaccaugaaggaggaccuccucucccucgccaucaaguccgaccccauccccuccgagcucggcucccucaagaaguccgccgacucccucggcaagcucgagcuccagcacaucuccuccaucaacgucgaggaggucuccgccaccgaggccgcccccgaggaggccaagcucuucaccucccaggaguccgagaccucccuccaguccauccgccuccucgaggcccuccucgccaucugccuccacggcgcccgcaccucccagcagaagauggagcucgagcuccccaaccagaaccucuccgucgaguccauccucuucgagaugcgcgaccaccucucccaguccaaggucaucgagacccagcucgccaagccccucuucgacgcccuccuccgcgucgcccucggcaacuacuccgccgacuucgagcacaacgacgccaugaccgagaagucccaccaguccgccgaggagcucuccucccagcccggcgacuucuccgaggaggccgaggacucccagugcugcuccuucaagcuccucgucgaggaggagggcuacgaggccgacuccgaguccaaccccgaggacggcgagacccaggacgacggcgucgaccucaaguccgagaccgagggcuucuccgccuccuccucccccaacgaccuccucgagaaccucacccagggcgagaucaucuaccccgagaucugcaugcucgagcucaaccuccucuccgccuccaaggccaagcucgacguccucgcccacgucuucgaguccuuccucaagaucauccgccagaaggagaagaacgucuuccuccucaugcagcagggcaccgucaagaaccuccucggcggcuuccucuccauccucacccaggacgacuccgacuuccaggccugccagcgcguccucgucgaccuccucgucucccucauguccucccgcaccugcuccgaggagcucacccuccuccuccgcaucuuccucgagaagucccccugcaccaagauccuccuccucggcauccucaagaucaucgaguccgacaccaccaugucccccucccaguaccucaccuucccccuccuccacgcccccaaccucuccaacggcgucuccucccagaaguaccccggcauccucaacuccaaggccaugggccuccuccgccgcgcccgcgucucccgcuccaagaaggaggccgaccgcgaguccuucccccaccgccuccucuccuccuggcacaucgcccccguccaccucccccuccucggccagaacugcuggccccaccucuccgagggcuucuccgucucccucugguucaacgucgagugcauccacgaggccgaguccaccaccgagaagggcaagaagaucaagaagcgcaacaagucccucauccuccccgacuccuccuucgacggcaccgaguccgaccgccccgagggcgccgaguacaucaaccccggcgagcgccucaucgaggagggcugcauccacaucaucucccucggcuccaaggcccucaugauccaggucugggccgacccccacaacgccacccucaucuuccgcgucugcauggacuccaacgacgacaugaaggccguccuccucgcccaggucgagucccaggagaacaucuuccuccccuccaaguggcagcaccucguccucaccuaccuccagcagccccagggcaagcgccgcauccacggcaagaucuccaucugggucuccggccagcgcaagcccgacgucacccucgacuucaugcucccccgcaagaccucccucuccuccgacuccaacaagaccuucugcaugaucggccacugccucuccucccaggaggaguuccuccagcucgccggcaagugggaccucggcaaccuccuccucuucaacggcgccaaggucggcucccaggaggccuucuaccucuacgccugcggccccaaccacaccuccgucaugcccugcaaguacggcaagcccgucaacgacuacuccaaguacaucaacaaggagauccuccgcugcgagcagauccgcgagcucuucaugaccaagaaggacgucgacaucggccuccucaucgagucccucuccgucgucuacaccaccuacugccccgcccaguacaccaucuacgagcccgucauccgccucaagggccagaugaagacccagcucucccagcgccccuucuccuccaaggagguccaguccauccuccucgagccccaccaccucaagaaccuccagcccaccgaguacaagaccauccagggcauccuccacgagaucggcggcaccggcaucuucgucuuccucuucgcccgcgucgucgagcucuccuccugcgaggagacccaggcccucgcccuccgcgucauccucucccucaucaaguacaaccagcagcgcguccacgagcucgagaacugcaacggccucuccaugauccaccagguccucaucaagcagaagugcaucgucggcuucuacauccucaagacccuccucgagggcugcugcggcgaggacaucaucuacaugaacgagaacggcgaguucaagcucgacgucgacuccaacgccaucauccaggacgucaagcuccucgaggagcuccuccucgacuggaagaucugguccaaggccgagcagggcgucugggagacccuccucgccgcccucgagguccucauccgcgccgaccaccaccagcagauguucaacaucaagcagcuccucaaggcccaggucguccaccacuuccuccucaccugccagguccuccaggaguacaaggagggccagcucacccccaugccccgcgaggucugccgcuccuucgucaagaucaucgccgagguccucggcuccccccccgaccucgagcuccucaccaucaucuucaacuuccuccucgccguccacccccccaccaacaccuacgucugccacaaccccaccaacuucuacuucucccuccacaucgacggcaagaucuuccaggagaagguccgcuccaucauguaccuccgccacuccuccuccggcggccgcucccucaugucccccggcuucauggucaucucccccuccggcuucaccgccucccccuacgagggcgagaacuccuccaacaucaucccccagcagauggccgcccacaugcuccgcucccgcucccuccccgccuuccccaccuccucccuccucacccagucccagaagcucaccggcucccucggcugcuccaucgaccgccuccagaacaucgccgacaccuacgucgccacccaguccaagaagcagaacucccucggcuccuccgacacccucaagaagggcaaggaggacgccuucaucuccuccugcgaguccgccaagaccgucugcgagauggaggccguccucuccgcccaggucuccgucuccgacguccccaagggcguccucggcuuccccgucgucaaggccgaccacaagcagcucggcgccgagccccgcuccgaggacgacucccccggcgacgaguccugcccccgccgccccgacuaccucaagggccucgccuccuuccagcgcucccacuccaccaucgccucccucggccucgccuuccccucccagaacggcuccgccgccgucggccgcuggcccucccucgucgaccgcaacaccgacgacugggagaacuucgccuacucccucggcuacgagcccaacuacaaccgcaccgccuccgcccacuccgucaccgaggacugccucguccccaucugcugcggccucuacgagcuccucuccggcguccuccucauccuccccgacguccuccucgaggacgucauggacaagcucauccaggccgacacccuccucguccucgucaaccaccccucccccgccauccagcagggcgucaucaagcuccucgacgccuacuucgcccgcgccuccaaggagcagaaggacaaguuccucaagaaccgcggcuucucccuccucgccaaccagcucuaccuccaccgcggcacccaggagcuccucgagugcuucaucgagauguucuucggccgccacaucggccucgacgaggaguucgaccucgaggacguccgcaacaugggccucuuccagaagugguccgucauccccauccucggccucaucgagaccucccucuacgacaacauccuccuccacaacgcccuccuccuccuccuccagauccucaacuccugcuccaaggucgccgacaugcuccucgacaacggccuccucuacguccucugcaacaccgucgccgcccucaacggccucgagaagaacauccccauguccgaguacaagcuccucgccugcgacauccagcagcucuucaucgccgucaccauccacgccugcuccuccuccggcucccaguacuuccgcgucaucgaggaccucaucgucaugcucggcuaccuccagaacuccaagaacaagcgcacccagaacauggccgucgcccuccagcuccgcguccuccaggccgccauggaguucauccgcaccaccgccaaccacgacuccgagaaccucaccgacucccuccagucccccuccgccccccaccacgccgucguccagaagcgcaaguccaucgccggcccccgcaaguucccccucgcccagaccgagucccuccucaugaagaugcgcuccgucgccaacgacgagcuccacgucaugaugcagcgccgcaugucccaggagaaccccucccaggccaccgagaccgagcucgcccagcgccuccagcgccucaccguccucgccgucaaccgcaucaucuaccaggaguucaacuccgacaucaucgacauccuccgcacccccgagaacgucacccaguccaagaccuccgucuuccagaccgagaucuccgaggagaacauccaccacgagcaguccuccgucuucaaccccuuccagaaggagaucuucaccuaccucgucgagggcuucaaggucuccaucggcuccuccaaggccuccggcuccaagcagcaguggaccaagauccucugguccugcaaggagaccuuccgcaugcagcucggccgccuccucguccacauccucucccccgcccacgccgcccaggagcgcaagcagaucuucgagaucguccacgagcccaaccaccaggagauccuccgcgacugccucucccccucccuccagcacggcgccaagcucguccucuaccucuccgagcucauccacaaccaccagggcgagcucaccgaggaggagcucggcaccgccgagcuccucaugaacgcccucaagcucugcggccacaagugcaucccccccuccgccuccaccaaggccgaccucaucaagaugaucaaggaggagcagaagaaguacgagaccgaggagggcgucaacaaggccgccuggcagaagaccgucaacaacaaccagcagucccucuuccagcgccucgacuccaaguccaaggacaucuccaagaucgccgccgacaucacccaggccgucucccucucccagggcaacgagcgcaagaaggucauccagcacauccgcggcauguacaaggucgaccucuccgccucccgccacuggcaggagcucauccagcagcucacccacgaccgcgccgucugguacgaccccaucuacuaccccaccuccuggcagcucgaccccaccgagggccccaaccgcgagcgccgccgccuccagcgcugcuaccucaccauccccaacaaguaccuccuccgcgaccgccagaaguccgaggacgucgucaagcccccccucuccuaccucuucgaggacaagacccacuccuccuucuccuccaccgucaaggacaaggccgccuccgaguccauccgcgucaaccgccgcugcaucuccgucgcccccucccgcgagaccgccggcgagcuccuccucggcaagugcggcauguacuucgucgaggacaacgccuccgacaccgucgaguccuccucccuccagggcgagcucgagcccgccuccuucuccuggaccuacgaggagaucaaggagguccacaagcgcugguggcagcuccgcgacaacgccgucgagaucuuccucaccaacggccgcacccuccuccucgccuucgacaacaccaagguccgcgacgacgucuaccacaacauccucaccaacaaccuccccaaccuccucgaguacggcaacaucaccgcccucaccaaccucugguacaccggccagaucaccaacuucgaguaccucacccaccucaacaagcacgccggccgcuccuucaacgaccucaugcaguaccccgucuuccccuucauccucgccgacuacgucuccgagacccucgaccucaacgaccuccucaucuaccgcaaccucuccaagcccaucgccguccaguacaaggagaaggaggaccgcuacgucgacaccuacaaguaccucgaggaggaguaccgcaagggcgcccgcgaggacgaccccaugccccccguccagcccuaccacuacggcucccacuacuccaacuccggcaccguccuccacuuccucguccgcaugccccccuucaccaagauguuccucgccuaccaggaccaguccuucgacauccccgaccgcaccuuccacuccaccaacaccaccuggcgccucuccuccuucgaguccaugaccgacgucaaggagcucauccccgaguucuucuaccuccccgaguuccucgucaaccgcgagggcuucgacuucggcguccgccagaacggcgagcgcgucaaccacgucaaccucccccccugggcccgcaacgacccccgccucuucauccucauccaccgccaggcccucgaguccgacuacgucucccagaacaucugccaguggaucgaccucgucuucggcuacaagcagaagggcaaggccuccguccaggccaucaacgucuuccaccccgccaccuacuucggcauggacgucuccgccgucgaggaccccguccagcgccgcgcccucgagaccaugaucaagaccuacggccagaccccccgccagcucuuccacauggcccacgucucccgccccggcgccaagcucaacaucgagggcgagcuccccgccgccgucggccuccucguccaguucgccuuccgcgagacccgcgagcaggucaaggagaucaccuaccccuccccccucuccuggaucaagggccucaaguggggcgaguacgucggcucccccuccgcccccguccccgucgucugcuucucccagccccacggcgagcgcuucggcucccuccaggcccuccccacccgcgccaucugcggccucucccgcaacuucugccuccucaugaccuacuccaaggagcagggcguccgcuccaugaacuccaccgacauccagugguccgccauccucuccuggggcuacgccgacaacauccuccgccucaaguccaagcaguccgagccccccgucaacuucauccaguccucccagcaguaccaggucaccuccugcgccuggguccccgacuccugccagcucuucaccggcuccaagugcggcgucaucaccgccuacaccaaccgcuucaccuccuccacccccuccgagaucgagauggagacccagauccaccucuacggccacaccgaggagaucaccucccucuucgucugcaagcccuacuccauccucaucuccgucucccgcgacggcaccugcaucaucugggaccucaaccgccucugcuacguccagucccucgccggccacaagucccccgucaccgccgucuccgccuccgagaccuccggcgacaucgccaccgucugcgacuccgccggcggcggcuccgaccuccgccucuggaccgucaacggcgaccucgucggccacguccacugccgcgagaucaucugcuccgucgccuucuccaaccagcccgagggcgucuccaucaacgucaucgccggcggccucgagaacggcaucguccgccucugguccaccugggaccucaagcccguccgcgagaucaccuuccccaaguccaacaagcccaucaucucccucaccuucuccugcgacggccaccaccucuacaccgccaacuccgacggcaccgucaucgccuggugccgcaaggaccagcagcgccucaagcagcccauguucuacuccuuccucuccuccuacgccgccggcuga

SEQ ID NO: 45616 - RNA, 969 nt, Artificial Sequence
  derived and/or modified sequence opt2 from LYVE1__Homo_sapiens__NP_006682
auggcccgcugcuucucccucguccuccuccucaccuccaucuggaccacccgccuccucguccagggcucccuccgcgccgaggagcucuccauccaggucuccugccgcaucaugggcaucacccucgucuccaagaaggccaaccagcagcucaacuucaccgaggccaaggaggccugccgccuccucggccucucccucgccggcaaggaccaggucgagaccgcccucaaggccuccuucgagaccugcuccuacggcugggucggcgacggcuucgucgucaucucccgcaucucccccaaccccaagugcggcaagaacggcgucggcguccucaucuggaagguccccgucucccgccaguucgccgccuacugcuacaacuccuccgacaccuggaccaacuccugcauccccgagaucaucaccaccaaggaccccaucuucaacacccagaccgccacccagaccaccgaguucaucgucuccgacuccaccuacuccgucgccucccccuacuccaccauccccgcccccaccaccaccccccccgcccccgccuccaccuccaucccccgccgcaagaagcucaucugcgucaccgaggucuucauggagaccuccaccauguccaccgagaccgagcccuucgucgagaacaaggccgccuucaagaacgaggccgccggcuucggcggcguccccaccgcccuccucguccucgcccuccucuucuucggcgccgccgccggccucggcuucugcuacgucaagcgcuacgucaaggccuuccccuucaccaacaagaaccagcagaaggagaugaucgagaccaaggucgucaaggaggagaaggccaacgacuccaaccccaacgaggaguccaagaagaccgacaagaaccccgaggaguccaagucccccuccaagaccaccguccgcugccucgaggccgaggucuga

SEQ ID NO: 45617 - RNA, 447 nt, Artificial Sequence
  derived and/or modified sequence opt2 from LYZ__Homo_sapiens__NP_000230
augaaggcccucaucguccucggccucguccuccucuccgucaccguccagggcaaggucuucgagcgcugcgagcucgcccgcacccucaagcgccucggcauggacggcuaccgcggcaucucccucgccaacuggaugugccucgccaagugggaguccggcuacaacacccgcgccaccaacuacaacgccggcgaccgcuccaccgacuacggcaucuuccagaucaacucccgcuacuggugcaacgacggcaagacccccggcgccgucaacgccugccaccucuccugcuccgcccuccuccaggacaacaucgccgacgccgucgccugcgccaagcgcgucguccgcgacccccagggcauccgcgccugggucgccuggcgcaaccgcugccagaaccgcgacguccgccaguacguccagggcugcggcgucuga

SEQ ID NO: 45618 - RNA, 585 nt, Artificial Sequence
  derived and/or modified sequence opt2 from LYZL1__Homo_sapiens__NP_115906
augcaggacgccccccucuccugccucucccccaccaagugguccuccgucuccuccgccgacuccaccgagaaguccgccuccggcgccggcacccgcaaccuccccuuccaguucugccuccgccaggcccuccgcaugaaggccgccggcauccucacccucaucggcugccucgucaccggcgccgaguccaagaucuacacccgcugcaagcucgccaagaucuucucccgcgccggccucgacaacuacuggggcuucucccucggcaacuggaucugcauggccuacuacgaguccggcuacaacaccaccgcccagaccguccucgacgacggcuccaucgacuacggcaucuuccagaucaacuccuucgccuggugccgccgcggcaagcucaaggagaacaaccacugccacgucgccugcuccgcccucaucaccgacgaccucaccgacgccaucaucugcgcccgcaagaucgucaaggagacccagggcaugaacuacuggcagggcuggaagaagcacugcgagggccgcgaccucuccgaguggaagaagggcugcgaggucuccuga

SEQ ID NO: 45619 - RNA, 585 nt, Artificial Sequence
  derived and/or modified sequence opt2 from LYZL2__Homo_sapiens__NP_898881
augcaggacgccccccucuccugccucucccccaccaagugguccuccgucuccuccgccgacuccaccgagaaguccgccuccgccgccggcacccgcaaccuccccuuccaguucugccuccgccaggcccuccgcaugaaggccgccggcauccucacccucaucggcugccucgucaccggcgccgaguccaagaucuacacccgcugcaagcucgccaagaucuucucccgcgccggccucgacaacuacuggggcuucucccucggcaacuggaucugcauggccuacuacgaguccggcuacaacaccaccgcccagaccguccucgacgacggcuccaucgacuacggcaucuuccagaucaacuccuucgccuggugccgccgcggcaagcucaaggagaacaaccacugccacgucgccugcuccgcccucgucaccgacgaccucaccgacgccaucaucugcgccaagaagaucgucaaggagacccagggcaugaacuacuggcagggcuggaagaagcacugcgagggccgcgaccucuccgacuggaagaaggacugcgaggucuccuga

SEQ ID NO: 45620 - RNA, 447 nt, Artificial Sequence
  derived and/or modified sequence opt2 from LYZL6__Homo_sapiens__NP_001186880
augaccaaggcccuccucaucuaccucgucuccuccuuccucgcccucaaccaggccucccucaucucccgcugcgaccucgcccagguccuccagcucgaggaccucgacggcuucgagggcuacucccucuccgacuggcucugccucgccuucgucgaguccaaguucaacaucuccaagaucaacgagaacgccgacggcuccuucgacuacggccucuuccagaucaacucccacuacuggugcaacgacuacaaguccuacuccgagaaccucugccacgucgacugccaggaccuccucaaccccaaccuccucgccggcauccacugcgccaagcgcaucgucuccggcgcccgcggcaugaacaacugggucgaguggcgccuccacugcuccggccgcccccucuucuacuggcucaccggcugccgccuccgcuga

SEQ ID NO: 45621 - RNA, 849 nt, Artificial Sequence
  derived and/or modified sequence opt2 from LZTFL1__Homo_sapiens__NP_001263307
augcgcuucgcccgcuccaagcgcggccuccgccucaagaccgucgacuccugcuuccaggaccucaaggagucccgccucgucgaggacaccuucaccaucgacgaggucuccgagguccucaacggccuccaggccgucguccacuccgaggucgaguccgagcucaucaacaccgccuacaccaacguccuccuccuccgccagcucuucgcccaggccgagaagugguaccucaagcuccagaccgacaucuccgagcucgagaaccgcgagcuccucgagcaggucgccgaguucgagaaggccgagaucaccuccuccaacaagaagcccauccucgacgucaccaagcccaagcucgccccccucaacgagggcggcaccgccgagcuccucaacaaggagauccuccgccuccaggaggagaacgagaagcucaagucccgccucaagaccaucgagauccaggccaccaacgcccucgacgagaaguccaagcucgagaaggcccuccaggaccuccagcucgaccagggcaaccagaaggacuucaucaaggcccaggaccucuccaaccucgagaacaccgucgccgcccucaaguccgaguuccagaagacccucaacgacaagaccgagaaccagaagucccucgaggagaaccucgccaccgccaagcacgaccuccuccgcguccaggagcagcuccacauggccgagaaggagcucgagaagaaguuccagcagaccgccgccuaccgcaacaugaaggagauccucaccaagaagaacgaccagaucaaggaccuccgcaagcgccucgcccaguacgagcccgaggacuga

SEQ ID NO: 45622 - RNA, 2523 nt, Artificial Sequence
  derived and/or modified sequence opt2 from LZTR1__Homo_sapiens__NP_006758
auggccggccccggcuccaccggcggccagaucggcgccgccgcccucgccggcggcgcccgcuccaaggucgcccccuccgucgacuucgaccacuccugcuccgacuccgucgaguaccucacccucaacuucggccccuucgagaccguccaccgcuggcgccgccucccccccugcgacgaguucgucggcgcccgccgcuccaagcacaccgucgucgccuacaaggacgccaucuacgucuucggcggcgacaacggcaagaccaugcucaacgaccuccuccgcuucgacgucaaggacugcuccuggugccgcgccuucaccaccggcaccccccccgccccccgcuaccaccacuccgccgucgucuacggcuccuccauguucgucuucggcggcuacaccggcgacaucuacuccaacuccaaccucaagaacaagaacgaccucuucgaguacaaguucgccaccggccaguggaccgaguggaagaucgagggccgccuccccgucgcccgcuccgcccacggcgccaccgucuacuccgacaagcucuggaucuucgccggcuacgacggcaacgcccgccucaacgacauguggaccaucggccuccaggaccgcgagcucaccugcugggaggaggucgcccaguccggcgagaucccccccuccugcugcaacuuccccgucgccgucugccgcgacaagauguucgucuucuccggccaguccggcgccaagaucaccaacaaccucuuccaguucgaguucaaggacaagaccuggacccgcauccccaccgagcaccuccuccgcggcucccccccccccccccagcgccgcuacggccacaccauggucgccuucgaccgccaccucuacgucuucggcggcgccgccgacaacacccuccccaacgagcuccacugcuacgacgucgacuuccagaccugggaggucguccagcccuccuccgacuccgaggucggcggcgccgagguccccgagcgcgccugcgccuccgaggagguccccacccucaccuacgaggagcgcgucggcuucaagaagucccgcgacgucuucggccucgacuucggcaccaccuccgccaagcagcccacccagcccgccuccgagcuccccuccggccgccucuuccacgccgccgccgucaucuccgacgccauguacaucuucggcggcaccgucgacaacaacauccgcuccggcgagauguaccgcuuccaguucuccugcuaccccaagugcacccuccacgaggacuacggccgccucugggagucccgccaguucugcgacgucgaguucguccucggcgagaaggaggagugcguccagggccacgucgccaucgucaccgcccgcucccgcuggcuccgccgcaagaucacccaggcccgcgagcgccucgcccagaagcucgagcaggaggccgcccccgucccccgcgaggcccccggcgucgccgccggcggcgcccgccccccccuccuccacgucgccauccgcgaggccgaggcccgccccuucgagguccucaugcaguuccucuacaccgacaagaucaaguacccccgcaagggccacgucgaggacguccuccucaucauggacgucuacaagcucgcccucuccuuccagcucugccgccucgagcagcucugccgccaguacaucgaggccuccgucgaccuccagaacguccucgucgucugcgaguccgccgcccgccuccagcucucccagcucaaggagcacugccucaacuucgucgucaaggagucccacuucaaccaggucaucaugaugaaggaguucgagcgccucuccuccccccucaucgucgagaucguccgccgcaagcagcagccccccccccgcaccccccucgaccagcccgucgacaucggcaccucccucauccaggacaugaaggccuaccucgagggcgccggcgccgaguucugcgacaucacccuccuccucgacggccacccccgccccgcccacaaggccauccucgccgcccgcuccuccuacuucgaggccauguuccgcuccuucaugcccgaggacggccaggucaacaucuccaucggcgagaugguccccucccgccaggccuucgaguccaugcuccgcuacaucuacuacggcgaggucaacaugccccccgaggacucccucuaccucuucgccgcccccuacuacuacggcuucuacaacaaccgccuccaggccuacugcaagcagaaccucgagaugaacgucaccguccagaacguccuccagauccucgaggccgccgacaagacccaggcccucgacaugaagcgccacugccuccacaucaucguccaccaguucaccaaggucuccaagcuccccacccuccgcucccucucccagcagcuccuccucgacaucaucgacucccucgccucccacaucuccgacaagcagugcgccgagcucggcgccgacaucuga

SEQ ID NO: 45623 - RNA, 1791 nt, Artificial Sequence
  derived and/or modified sequence opt2 from LZTS1__Homo_sapiens__XP_011542689
augggcuccgucuccucccucaucuccggccacuccuuccacuccaagcacugccgcgccucccaguacaagcuccgcaaguccucccaccucaagaagcucaaccgcuacuccgacggccuccuccgcuucggcuucucccaggacuccggccacggcaaguccuccuccaagaugggcaaguccgaggacuucuucuacaucaaggucucccagaaggcccgcggcucccaccaccccgacuacaccgcccucuccuccggcgaccucggcggccaggccggcgucgacuucgaccccuccaccccccccaagcucaugcccuucuccaaccagcucgagaugggcuccgagaagggcgccguccgccccaccgccuucaagcccguccucccccgcuccggcgccauccuccacuccucccccgaguccgccucccaccagcuccaccccgccccccccgacaagcccaaggagcaggagcucaagcccggccucugcuccggcgcccucuccgacuccggccgcaacuccauguccucccuccccacccacuccaccuccuccuccuaccagcucgacccccucgucacccccgucggccccaccucccgcuucggcggcuccgcccacaacaucacccagggcaucguccuccaggacuccaacaugaugucccucaaggcccucuccuucuccgacggcggcuccaagcucggccacuccaacaaggccgacaagggccccuccugcguccgcucccccaucuccaccgacgagugcuccauccaggagcucgagcagaagcuccucgagcgcgagggcgcccuccagaagcuccagcgcuccuucgaggagaaggagcucgccuccucccucgccuacgaggagcgcccccgccgcugccgcgacgagcucgagggccccgagcccaagggcggcaacaagcucaagcaggccucccagaagucccagcgcgcccagcagguccuccaccuccagguccuccagcuccagcaggagaagcgccagcuccgccaggagcucgagucccucaugaaggagcaggaccuccucgagaccaagcuccgcuccuacgagcgcgagaagaccuccuucggccccgcccucgaggagacccagugggaggucugccagaaguccggcgagaucucccuccucaagcagcagcucaaggagucccagaccgaggucaacgccaaggccuccgagauccucggccucaaggcccagcucaaggacacccgcggcaagcucgagggccucgagcuccgcacccaggaccucgagggcgcccuccgcaccaagggccucgagcucgaggucugcgagaacgagcuccagcgcaagaagaacgaggccgagcuccuccgcgagaaggucaaccuccucgagcaggagcuccaggagcuccgcgcccaggccgcccucgcccgcgacaugggcccccccaccuuccccgaggacguccccgcccuccagcgcgagcucgagcgccuccgcgccgagcuccgcgaggagcgccagggccacgaccagauguccuccggcuuccagcacgagcgccucgucuggaaggaggagaaggagaaggucauccaguaccagaagcagcuccagcaguccuacgucgccauguaccagcgcaaccagcgccucgagaaggcccuccagcagcucgcccgcggcgacuccgccggcgagccccucgaggucgaccucgagggcgccgacauccccuacgaggacaucaucgccaccgagaucuga

SEQ ID NO: 45624 - RNA, 576 nt, Artificial Sequence
  derived and/or modified sequence opt2 from M6PR__Homo_sapiens__NP_001193953
auguuccccuucuacuccugcuggcgcaccggccuccuccuccuccuccucgccgucgccguccgcgaguccuggcagaccgaggagaagaccugcgaccucgucggcgagaagggcaaggaguccgagaaggagcucgcccucgucaagcgccucaagccccucuucaacaaguccuucgaguccaccgucggccagggcuccgacaccuacaucuacaucuuccgcgucugccgcgaggccggcaaccacaccuccggcgccggccucguccagaucaacaaguccaacggcaaggagaccgucgucggccgccucaacgagacccacaucuucaacggcuccaacuggaucaugcucaucuacaagggcggcgacgaguacgacaaccacugcggcaaggagcagcgccgcgccgucgucaugaucuccugcaaccgccacacccucgccgacggcugcgacuucgucugccgcuccaagccccgcaacguccccgccgccuaccgcggcgucggcgacgaccagcucggcgaggaguccgaggagcgcgacgaccaccuccuccccauguga

SEQ ID NO: 45625 - RNA, 2304 nt, Artificial Sequence
  derived and/or modified sequence opt2 from MAATS1__Homo_sapiens__NP_203528
augucccacgccgucaccaucgaggagccccaggcccagccccaggucucccagacccgcuaccgcgagcgcucccgcgccggcucccacaucuccuccaaccgcgccuacgacuuccucuacgacccccucuucaucgucuccuccgagaaggaccacacccaggccaacauccaggccacccucauccgcucccgccuccgcaaggucccccgcuucaagaccauguucuccaaccucauccacuacccccgcuacucccucuacugguccaaguccgaccccgucccccccuucaucucccgcgaguggaagggccacaaggagaagcaccgcgaggcccuccgccagcucaccaccaccgacgccuccuuccagaugcccaaggaggucuacgaggaccccgaggucaccggcaagaaccgcuacaaguacuucgagcgccccuuccuccccuucuuccagcagaugcccuucaacgucgucuacgccgucuccaaggccgagcccuacaccuucccccccaccuccaccaagcaccucuccauccccuccaaguccaccgucggcacccagaccgacuaccgcgacgccgacguccagaccgaccccuacucccccgaguacgucgucugccaggacuccauccccgagcuccucacccucgccacccucaccuggggccgcggccuccccgccggccaggccgaggucgagaugaucgagcgcgcccgcgagaagcgcgccugggaggccucccuccccgcccucuccgacaccucccaguucgagaagcgccgcaagaugaugaacgagauggagcgcaaggagugggccuuccgcgagcaggagaucgagaagcuccaggagauccgccucgagguccucaaggagcuccuccgcaagcgcgaggagaaccagaacgaggucaacaugaagcaccucaacgcccgcugguccaagcuccaggagggcaaggaggccaagauggccaagauccagcgcacccacgucuccaccauccgcaagcucgucggcaagcgcaagaacaucgagggcaagcucgagcgccgcaacaucaucaaggacuacuccgacuacgccucccaggucuacggcccccucucccgccucggcugcuuccccgacaacaacuccgaggacuucgucgucaagaacuacuaccucaacaccuacgagggccucgucgagcucgaguccugccuccccgacuucgucacccagccccagauccgcgcccccaagcccaaggucaucaccaccaaggccggcuuccucaagcgcgccgcccgccucgacuacgagcucgccgagguccacaaggcccuccucgacaagaagaacaagguccucgaggucaagaagcccccccgcuuccuccagcgcaaccccaucccccagccccgccuccccacccccacccucgagaugaccuccaacgaggaggaggagauggagauggccgucaucuaccuccagaagcuccuccgcggccgcgucguccagaacaugauguucgagggcaaggagaagcgccucgagcucauccaggagcuccgcaccugccacgcccuccaggaggacgagaagcucgucaagaaggccgagaagcaggucacccucgcccuccagcgccagcgcaaccuccacgagcacaaggucucccucgucgagaaccaccucgccggccucgagggccgcgcccucgccgacauguucgacuuccucuccaaggagcucguccgccuccaggaggagcgccgcauccacgccuucgucaugcucgccgagcgccagcgccgcguccgcgaggccgaggaguccggccgccgccaggucgagaagcagcgccuccgcgaggaggacgagaucuucaaggaggucgucaagguccaccacuccaccaucuccuccuaccucgaggacaucauccucaacaccgaggccaacaccgccgaggagcaggcccgcgccgagaucgagaagauggccgagaagaucaacgacaucgccuacgagauggagucccgccgcaccuaccuccaguccgaggagaucgucgccgagcucgucuacuccuuccucauccccgagguccagaaguacuucgucaaggagaagguccgcaacgcccagcgcaagcacauccucgccgcccaccagaucauccacuccuacaccgaguccaugguccagaagaagcucaccgagggcgagcaggacgaggccuccaacgccgccaugcuccucgagaaggagacccagaacgagaacaacuccuga

SEQ ID NO: 45626 - RNA, 1080 nt, Artificial Sequence
  derived and/or modified sequence opt2 from MAB21L1__Homo_sapiens__NP_005575
augaucgccgcccaggccaagcucgucuaccaccucaacaaguacuacaacgagaagugccaggcccgcaaggccgccaucgccaagaccauccgcgaggucugcaaggucgucuccgacguccucaaggaggucgagguccaggagccccgcuucaucuccucccucaacgagauggacaaccgcuacgagggccucgaggucaucucccccaccgaguucgaggucguccucuaccucaaccagaugggcgucuucaacuucgucgacgacggcucccuccccggcugcgccguccucaagcucuccgacggccgcaagcgcuccaugucccucugggucgaguucaucaccgccuccggcuaccucuccgcccgcaagauccgcucccgcuuccagacccucgucgcccaggccgucgacaagugcuccuaccgcgacgucgucaagauggucgccgacaccuccgaggucaagcuccgcauccgcgaccgcuacgucguccagaucacccccgccuucaagugcaccggcaucuggccccgcuccgccgcccacuggccccucccccacauccccuggcccggccccaaccgcgucgccgaggucaaggccgagggcuucaaccuccucuccaaggagugccacucccucgccggcaagcaguccuccgccgaguccgacgccuggguccuccaguucgccgaggccgagaaccgccuccagaugggcggcugccgcaagaagugccucuccauccucaagacccuccgcgaccgccaccucgagcuccccggccagccccucaacaacuaccacaugaagacccucgucuccuacgagugcgagaagcacccccgcgaguccgacugggacgaguccugccucggcgaccgccucaacggcauccuccuccagcucaucuccugccuccagugccgccgcugcccccacuacuuccuccccaaccucgaccucuuccagggcaagccccacuccgcccucgagaacgccgccaagcagaccuggcgccucgcccgcgagauccucaccaaccccaagucccucgagaagcucuga

SEQ ID NO: 45627 - RNA, 1080 nt, Artificial Sequence
  derived and/or modified sequence opt2 from MAB21L2__Homo_sapiens__NP_006430
augaucgccgcccaggccaagcucgucuaccagcucaacaaguacuacaccgagcgcugccaggcccgcaaggccgccaucgccaagaccauccgcgaggucugcaaggucgucuccgacguccucaaggaggucgagguccaggagccccgcuucaucuccucccucuccgagaucgacgcccgcuacgagggccucgaggucaucucccccaccgaguucgaggucguccucuaccucaaccagaugggcgucuucaacuucgucgacgacggcucccuccccggcugcgccguccucaagcucuccgacggccgcaagcgcuccaugucccucugggucgaguucaucaccgccuccggcuaccucuccgcccgcaagauccgcucccgcuuccagacccucgucgcccaggccgucgacaagugcuccuaccgcgacgucgucaagaugaucgccgacaccuccgaggucaagcuccgcauccgcgagcgcuacgucguccagaucacccccgccuucaagugcaccggcaucuggccccgcuccgccgcccaguggcccaugccccacauccccuggcccggccccaaccgcgucgccgaggucaaggccgagggcuucaaccuccucuccaaggagugcuacucccucaccggcaagcaguccuccgccgaguccgacgccuggguccuccaguucggcgaggccgagaaccgccuccucaugggcggcugccgcaacaagugccucuccguccucaagacccuccgcgaccgccaccucgagcuccccggccagccccucaacaacuaccacaugaagacccuccuccucuacgagugcgagaagcacccccgcgagaccgacugggacgaguccugccucggcgaccgccucaacggcauccuccuccagcucaucuccugccuccagugccgccgcugcccccacuacuuccuccccaaccucgaccucuuccagggcaagccccacuccgcccucgaguccgccgccaagcagaccuggcgccucgcccgcgagauccucaccaaccccaagucccucgacaagcucuga

SEQ ID NO: 45628 - RNA, 1089 nt, Artificial Sequence
  derived and/or modified sequence opt2 from MAB21L3__Homo_sapiens__XP_011538928
augaaguaccucaccgucggcgaccucgaggacugccuccucaacaaggucgaccuccgccgccagcagaucucccaggccgucgaggagguccagaaggucguccaccaccucaccaccaacaucuccaaccaggacauccgcuuccaggccguccccuacuccgacaccuacaacgagaacaucaagguccucgcccccucccaguuccucgucaccguccccaucaagggccucgccggcuaccgcgaggcccgcgagcagcacuggcgcuacuacacccuccagggcacccgccuccccugcccccuccgcgaccccgagggccuccagcaguggcucgaggucgagcaguucaugaagucccucuggcaguggcacgagaccgacgucaacaucgacggcgacaucguccccgccaagguccuccucgucuuccgcaagcucgucgagaacgccguccgcaccugccaccucuccggcaaggucucccuccucggcaaccgcuccgccgucugggucgccgucgagaccuccgccuaccaggucgagcucgagcucguccccgccgucgagauccccaccaccugguccaagaaggcccgcuggccccgcugccuccagcgcuggcccucccaggagcgcgucgagugcaucaaguccuucggcuucaaccuccucgccugcuccaacuaccacuggcagcucuccuuccuccgcgccgagcagguccuccucgagcagcucgacgaggacggcggcugccgccgcaagugcuuccaggucaugcgccaccucaaggaggacaucuggugccccggcaaccgccccgucaucaccucccaccaccuccagaccguccucuucuggaccugcgagaaguacccccacuucaaggacuggcaggucuucuccaaggccuuccuccgccucguccgcaagcuccacaagugcgucucccagcacuuccucaagcacuacuucguccgcaacuccaaccucuuccagugcaccaaccccaccgagcucgacaccgucgcccagaagcucgccaccuuccucaagaacccccagaucggcccccccuga

SEQ ID NO: 45629 - RNA, 2559 nt, Artificial Sequence
  derived and/or modified sequence opt2 from MACC1__Homo_sapiens__NP_877439
augcucaucaccgagcgcaagcacuuccgcuccggccgcaucgcccaguccauguccgaggccaaccucaucgacauggaggccggcaagcucuccaaguccugcaacaucaccgagugccaggaccccgaccuccuccacaacuggcccgacgccuucacccuccgcggcaacaacgccuccaaggucgccaaccccuucuggaaccagcucuccgccuccaaccccuuccucgacgacaucacccagcuccgcaacaaccgcaagcgcaacaacaucuccauccucaaggaggaccccuuccucuucugccgcgagaucgagaacggcaacuccuucgacuccuccggcgacgagcucgacguccaccagcuccuccgccagaccuccucccgcaacuccggccgcuccaaguccgucuccgagcuccucgacauccucgacgacaccgcccacgcccaccaguccauccacaacuccgaccagauccuccuccacgaccucgaguggcucaagaacgaccgcgaggccuacaagauggccuggcucucccagcgccagcucgcccgcuccugccucgaccucaacaccaucucccagucccccggcugggcccagacccagcucgccgaggucaccaucgccugcaaggucaaccaccagggcggcuccguccagcuccccgaguccgacaucaccguccacgucccccagggccacgucgccgucggcgaguuccaggaggucucccuccgcgccuuccucgaccccccccacaugcucaaccacgaccucuccugcaccgucuccccccuccucgagaucaugcucggcaaccucaacaccauggaggcccuccuccucgagaugaagaucggcgccgagguccgcaaggaccccuucucccaggucaugaccgagauggucugccuccacucccucggcaaggagggccccuucaagguccucuccaacugcuacaucuacaaggacaccauccaggucaagcucaucgaccucucccaggucauguaccucgucgucgccgcccaggccaaggcccuccccucccccgccgccaccaucugggacuacauccacaagaccaccuccaucggcaucuacggccccaaguacauccaccccuccuucaccgucguccucaccgucugcggccacaacuacaugcccggccagcucaccaucuccgacaucaagaagggcggcaagaacaucucccccgucgucuuccagcucuggggcaagcaguccuuccuccucgacaagccccaggaccucuccaucuccaucuucuccugcgaccccgacuucgaggucaagaccgagggcgagcgcaaggagaucaagcagaagcagcucgaggccggcgaggucguccaccagcaguuccucuucucccucgucgagcaccgcgagaugcaccucuucgacuucugcguccaggucgagccccccaacggcgagcccgucgcccaguucuccaucaccacccccgaccccacccccaaccucaagcgccucuccaaccuccccggcuaccuccagaagaaggaggagaucaaguccgccccccucucccccaagauccucgucaaguaccccaccuuccaggacaagacccucaacuucuccaacuacggcgucacccucaaggccguccuccgccaguccaagaucgacuacuuccucgaguacuucaagggcgacaccaucgcccuccucggcgagggcaaggucaaggccaucggccaguccaaggucaaggagugguacgucggcguccuccgcggcaagaucggccucguccacugcaagaacgucaaggucaucuccaaggagcaggucauguucauguccgacuccgucuucaccacccgcaaccuccucgagcagaucguccucccccucaagaagcucaccuacaucuacuccgucguccucacccucgucuccgagaaggucuacgacuggaagguccucgccgacguccucggcuacucccaccucucccucgaggacuucgaccagauccaggccgacaaggaguccgagaaggucuccuacgucaucaagaagcucaaggaggacugccacaccgagcgcaacacccgcaaguuccucuacgagcucaucgucgcccuccucaagauggacugccaggagcucgucgcccgccucauccaggaggccgccguccucaccuccgccgucaagcucggcaagggcuggcgcgagcucgccgagaagcucguccgccucaccaagcagcagauggaggccuacgagaucccccaccgcggcaacaccggcgacgucgccgucgagaugauguggaagcccgccuacgacuuccucuacaccugguccgcccacuacggcaacaacuaccgcgacguccuccaggaccuccaguccgcccucgaccgcaugaagaaccccgucaccaagcacuggcgcgagcucaccggcguccucauccucgucaacucccucgagguccuccgcgucaccgccuucuccaccuccgaggaggucuga

SEQ ID NO: 45630 - RNA, 978 nt, Artificial Sequence
  derived and/or modified sequence opt2 from MACROD1__Homo_sapiens__NP_054786
augucccuccagucccgccucuccggccgccucgcccagcuccgcgccgccggccagcuccucguccccccccgcccccgccccggccaccucgccggcgccacccgcacccgcuccuccaccugcggcccccccgccuuccucggcgucuucggccgccgcgcccgcaccuccgccggcgucggcgccuggggcgccgccgccgucggccgcaccgccggcguccgcaccugggccccccucgccauggccgccaaggucgaccucuccaccuccaccgacuggaaggaggccaaguccuuccucaagggccucuccgacaagcagcgcgaggagcacuacuucugcaaggacuucguccgccucaagaagauccccaccuggaaggagauggccaagggcgucgccgucaaggucgaggagccccgcuacaagaaggacaagcagcucaacgagaagaucucccuccuccgcuccgacaucaccaagcucgaggucgacgccaucgucaacgccgccaacuccucccuccucggcggcggcggcgucgacggcugcauccaccgcgccgccggcccccuccucaccgacgagugccgcacccuccaguccugcaagaccggcaaggccaagaucaccggcggcuaccgccuccccgccaaguacgucauccacaccgucggccccaucgccuacggcgagcccuccgccucccaggccgccgagcuccgcuccugcuaccucuccucccucgaccuccuccucgagcaccgccuccgcuccgucgccuuccccugcaucuccaccggcgucuucggcuaccccugcgaggccgccgccgagaucguccucgccacccuccgcgaguggcucgagcagcacaaggacaaggucgaccgccucaucaucugcgucuuccucgagaaggacgaggacaucuaccgcucccgccucccccacuacuuccccgucgccuga

SEQ ID NO: 45631 - RNA, 642 nt, Artificial Sequence
  derived and/or modified sequence opt2 from MACROD2__Homo_sapiens__NP_001028259
augaacgaguucuucuccgucgacgacaacaacgaggaggaggaggacgucgagaugaaggaggacuccgacgagaacggccccgaggagaagcaguccgucgaggagauggaggagcagucccaggacgccgacggcgucaacaccgucaccguccccggccccgccuccgaggaggccgucgaggacugcaaggacgaggacuucgccaaggacgagaacaucaccaagggcggcgaggucaccgaccacuccguccgcgaccaggaccaccccgacggccaggagaacgacuccaccaagaacgagaucaagaucgagaccgagucccaguccuccuacauggagaccgaggagcucuccuccaaccaggaggacgccgucaucgucgagcagcccgaggucaucccccucaccgaggaccaggaggagaaggagggcgagaaggcccccggcgaggacaccccccgcaugcccggcaaguccgagggcuccuccgaccucgagaacacccccggccccgacgucgagaugaacucccaggucgacaaggucaacgaccccaccgagucccagcaggaggaccagcucaucgccggcgcccaggacgaggccaaggagcagcgcaacggcaccaaguga

SEQ ID NO: 45632 - RNA, 2157 nt, Artificial Sequence
  derived and/or modified sequence opt2 from MAD1L1__Homo_sapiens__NP_001291452
auggaggaccucggcgagaacaccaugguccucuccacccuccgcucccucaacaacuucaucucccagcgcgucgagggcggcuccggccucgacaucuccaccuccgcccccggcucccuccagaugcaguaccagcaguccaugcagcucgaggagcgcgccgagcagauccgcuccaagucccaccucauccaggucgagcgcgagaagaugcagauggagcucucccacaagcgcgcccgcgucgagcucgagcgcgccgccuccaccuccgcccgcaacuacgagcgcgaggucgaccgcaaccaggagcuccucacccgcauccgccagcuccaggagcgcgaggccggcgccgaggagaagaugcaggagcagcucgagcgcaaccgccagugccagcagaaccucgacgccgccuccaagcgccuccgcgagaaggaggacucccucgcccaggccggcgagaccaucaacgcccucaagggccgcaucuccgagcuccagugguccgucauggaccaggagaugcgcgucaagcgccucgaguccgagaagcaggagcuccaggagcagcucgaccuccagcacaagaagugccaggaggccaaccagaagauccaggagcuccaggccucccaggaggcccgcgccgaccacgagcagcagaucaaggaccucgagcagaagcucucccuccaggagcaggacgccgccaucgucaagaacaugaaguccgagcucguccgccucccccgccucgagcgcgagcucaagcagcuccgcgaggaguccgcccaccuccgcgagaugcgcgagaccaacggccuccuccaggaggagcucgagggccuccagcgcaagcucggccgccaggagaagaugcaggagacccucgucggccucgagcucgagaacgagcgccuccucgccaagcuccaguccugggagcgccucgaccagaccaugggccucuccauccgcacccccgaggaccucucccgcuucgucgucgagcuccagcagcgcgagcucgcccucaaggacaagaacuccgccgucaccuccuccgcccgcggccucgagaaggcccgccagcagcuccaggaggagcuccgccaggucuccggccagcuccucgaggagcgcaagaagcgcgagacccacgaggcccucgcccgccgccuccagaagcgcguccuccuccucaccaaggagcgcgacggcaugcgcgccauccucggcuccuacgacuccgagcucacccccgccgaguacuccccccagcucacccgccgcaugcgcgaggccgaggacaugguccagaagguccacucccacuccgccgagauggaggcccagcucucccaggcccucgaggagcucggcggccagaagcagcgcgccgacaugcucgagauggagcucaagaugcucaagucccaguccuccuccgccgagcaguccuuccucuucucccgcgaggaggccgacacccuccgccucaaggucgaggagcucgagggcgagcgcucccgccucgaggaggagaagcgcaugcucgaggcccagcucgagcgccgcgcccuccagggcgacuacgaccagucccgcaccaagguccuccacaugucccucaaccccaccuccgucgcccgccagcgccuccgcgaggaccacucccagcuccaggccgagugcgagcgccuccgcggccuccuccgcgccauggagcgcggcggcaccguccccgccgaccucgaggccgccgccgccucccuccccuccuccaaggaggucgccgagcucaagaagcaggucgaguccgccgagcucaagaaccagcgccucaaggaggucuuccagaccaagauccaggaguuccgcaaggccugcuacacccucaccggcuaccagaucgacaucaccaccgagaaccaguaccgccucaccucccucuacgccgagcaccccggcgacugccucaucuucaaggccaccucccccuccggcuccaagaugcagcuccucgagaccgaguucucccacaccgucggcgagcucaucgagguccaccuccgccgccaggacuccauccccgccuuccucuccucccucacccucgagcucuucucccgccagaccgucgccuga

SEQ ID NO: 45633 - RNA, 921 nt, Artificial Sequence
  derived and/or modified sequence opt2 from MAD2L1BP__Homo_sapiens__NP_001003690
auggcccgcgucccccucggccgcucccucacccucuccccccgccucgagcacaacggcaugaccuccgcccaccacaacuuccgccuccccggcucccgcgacucccccgccuccgccucccaggucgccgagaucaucgaccucgagugguacgagaaguccgaggagacccacgccucccagaucgagcuccucgagaccuccuccacccaggagccccucaacgccuccgaggccuucugcccccgcgacugcaugguccccgucgucuuccccggccccgucucccaggagggcugcugccaguucaccugcgagcuccucaagcacaucauguaccagcgccagcagcucccccuccccuacgagcagcucaagcacuucuaccgcaagcccuccccccaggccgaggagaugcucaagaagaagccccgcgccaccaccgaggucuccucccgcaagugccagcaggcccucgccgagcucgaguccguccucucccaccucgaggacuucuucgcccgcacccucgucccccgcguccucauccuccucggcggcaacgcccucucccccaaggaguucuacgagcucgaccucucccuccucgcccccuacuccgucgaccagucccucuccaccgccgccugccuccgccgccucuuccgcgccaucuucauggccgacgccuucuccgagcuccaggcccccccccucaugggcaccgucgucauggcccagggccaccgcaacugcggcgaggacugguuccgccccaagcucaacuaccgcguccccucccgcggccacaagcucaccgucacccucuccugcggccgccccuccauccgcaccaccgccugggaggacuacaucugguuccaggcccccgucaccuucaagggcuuccgcgaguga

SEQ ID NO: 45634 - RNA, 618 nt, Artificial Sequence
  derived and/or modified sequence opt2 from MAD2L1__Homo_sapiens__NP_002349
auggcccuccagcucucccgcgagcagggcaucacccuccgcggcuccgccgagaucgucgccgaguucuucuccuucggcaucaacuccauccucuaccagcgcggcaucuaccccuccgagaccuucacccgcguccagaaguacggccucacccuccucgucaccaccgaccucgagcucaucaaguaccucaacaacgucgucgagcagcucaaggacuggcucuacaagugcuccguccagaagcucgucgucgucaucuccaacaucgaguccggcgagguccucgagcgcuggcaguucgacaucgagugcgacaagaccgccaaggacgacuccgccccccgcgagaagucccagaaggccauccaggacgagauccgcuccgucauccgccagaucaccgccaccgucaccuuccucccccuccucgaggucuccugcuccuucgaccuccucaucuacaccgacaaggaccucgucguccccgagaagugggaggaguccggcccccaguucaucaccaacuccgaggagguccgccuccgcuccuucaccaccaccauccacaaggucaacuccauggucgccuacaagauccccgucaacgacuga

SEQ ID NO: 45635 - RNA, 636 nt, Artificial Sequence
  derived and/or modified sequence opt2 from MAD2L2__Homo_sapiens__XP_011538809
augaccacccucacccgccaggaccucaacuucggccaggucgucgccgacguccucugcgaguuccucgaggucgccguccaccucauccucuacguccgcgaggucuaccccgucggcaucuuccagaagcgcaagaaguacaacguccccguccagauguccugccaccccgagcucaaccaguacauccaggacacccuccacugcgucaagccccuccucgagaagaacgacgucgagaaggucgucgucgucauccucgacaaggagcaccgccccgucgagaaguucgucuucgagaucacccagcccccccuccucuccaucuccuccgacucccuccucucccacgucgagcagcuccuccgcgccuucauccucaagaucuccgucugcgacgccguccucgaccacaacccccccggcugcaccuucaccguccucguccacacccgcgaggccgccacccgcaacauggagaagauccaggucaucaaggacuuccccuggauccucgccgacgagcaggacguccacaugcacgacccccgccucaucccccucaagaccaugaccuccgacauccucaagaugcagcucuacgucgaggagcgcgcccacaagggcuccuga

SEQ ID NO: 45636 - RNA, 1149 nt, Artificial Sequence
  derived and/or modified sequence opt2 from MADCAM1__Homo_sapiens__NP_570116
auggacuucggccucgcccuccuccucgccggccuccucggccuccuccucggccagucccuccaggucaagccccuccaggucgagccccccgagcccgucgucgccgucgcccucggcgccucccgccagcucaccugccgccucgccugcgccgaccgcggcgccuccguccaguggcgcggccucgacaccucccucggcgccguccaguccgacaccggccgcuccguccucaccguccgcaacgccucccucuccgccgccggcacccgcgucugcgucggcuccugcggcggccgcaccuuccagcacaccguccagcuccucgucuacgccuuccccgaccagcucaccgucucccccgccgcccucguccccggcgaccccgaggucgccugcaccgcccacaaggucacccccgucgaccccaacgcccucuccuucucccuccucgucggcggccaggagcucgagggcgcccaggcccucggccccgagguccaggaggaggaggaggagccccagggcgacgaggacguccucuuccgcgucaccgagcgcuggcgccuccccccccucggcacccccgucccccccgcccucuacugccaggccaccaugcgccuccccggccucgagcucucccaccgccaggccauccccguccuccacucccccaccucccccgagccccccgacaccaccucccccgagucccccgacaccaccucccccgagucccccgacaccaccucccaggagccccccgacaccaccucccccgagccccccgacaagaccucccccgagcccgccccccagcagggcuccacccacaccccccgcucccccggcuccacccgcacccgccgccccgagaucucccaggccggccccacccagggcgaggucauccccaccggcuccuccaagcccgccggcgaccagcuccccgccgcccucuggaccuccuccgccguccucggccuccuccuccucgcccuccccaccuaccaccucuggaagcgcugccgccaccucgccgaggacgacacccacccccccgccucccuccgccuccucccccaggucuccgccugggccggccuccgcggcaccggccaggucggcaucucccccuccuga

SEQ ID NO: 45637 - RNA, 4746 nt, Artificial Sequence
  derived and/or modified sequence opt2 from MADD__Homo_sapiens__NP_569831
augguccagaagaagaaguucugcccccgccuccucgacuaccucgucaucgucggcgcccgccaccccuccuccgacuccgucgcccagacccccgagcuccuccgccgcuacccccucgaggaccacaccgaguucccccucccccccgacgucgucuucuucugccagcccgagggcugccucuccguccgccagcgccgcaugucccuccgcgacgacaccuccuucgucuucacccucaccgacaaggacaccggcgucacccgcuacggcaucugcgucaacuucuaccgcuccuuccagaagcgcaucuccaaggagaagggcgagggcggcgccggcucccgcggcaaggagggcacccacgccaccugcgccuccgaggagggcggcaccgaguccuccgaguccggcuccucccuccagccccucuccgccgacuccacccccgacgucaaccaguccccccgcggcaagcgccgcgccaaggccggcucccgcucccgcaacuccacccucaccucccucugcguccucucccacuaccccuucuucuccaccuuccgcgagugccucuacacccucaagcgccucgucgacugcugcuccgagcgccuccucggcaagaagcucggcaucccccgcggcguccagcgcgacaccauguggcgcaucuucaccggcucccuccucgucgaggagaaguccuccgcccuccuccacgaccuccgcgagaucgaggccuggaucuaccgccuccuccgcucccccguccccgucuccggccagaagcgcgucgacaucgagguccucccccaggagcuccagcccgcccucaccuucgcccuccccgaccccucccgcuucacccucgucgacuucccccuccaccucccccucgagcuccucggcgucgacgccugccuccagguccucaccugcauccuccucgagcacaaggucguccuccagucccgcgacuacaacgcccucuccauguccgucauggccuucgucgccaugaucuacccccucgaguacauguuccccgucaucccccuccuccccaccugcauggccuccgccgagcagcuccuccucgcccccacccccuacaucaucggcguccccgccuccuucuuccucuacaagcucgacuucaagaugcccgacgacgucuggcucgucgaccucgacuccaaccgcgucaucgcccccaccaacgccgagguccuccccauccuccccgagcccgagucccucgagcucaagaagcaccucaagcaggcccucgccuccaugucccucaacacccagcccauccucaaccucgagaaguuccacgagggccaggagaucccccuccuccucggccgccccuccaacgaccuccaguccacccccuccaccgaguucaacccccucaucuacggcaacgacgucgacuccgucgacgucgccacccgcgucgccaugguccgcuucuucaacuccgccaacguccuccagggcuuccagaugcacacccgcacccuccgccucuucccccgccccgucgucgccuuccaggccggcuccuuccucgccucccgcccccgccagacccccuucgccgagaagcucgcccgcacccaggccgucgaguacuucggcgaguggauccucaaccccaccaacuacgccuuccagcgcauccacaacaacauguucgaccccgcccucaucggcgacaagcccaagugguacgcccaccagcuccagcccauccacuaccgcgucuacgacuccaacucccagcucgccgaggcccucuccgucccccccgagcgcgacuccgacuccgagcccaccgacgacuccggcuccgacuccauggacuacgacgacuccuccuccuccuacuccucccucggcgacuucgucuccgagaugaugaagugcgacaucaacggcgacacccccaacgucgacccccucacccacgccgcccucggcgacgccuccgaggucgagaucgacgagcuccagaaccagaaggaggccgaggagcccggccccgacuccgagaacucccaggagaaccccccccuccgcuccuccuccuccaccaccgccuccuccucccccuccaccgucauccacggcgccaacuccgagcccgccgacuccaccgagauggacgacaaggccgccgucggcgucuccaagccccuccccuccgucccccccuccaucggcaaguccaacgucgaccgccgccaggccgagaucggcgagggcuccguccgccgccgcaucuacgacaaccccuacuucgagccccaguacggcuucccccccgaggaggacgaggacgagcagggcgaguccuacaccccccgcuucucccagcacgucuccggcaaccgcgcccagaagcuccuccgccccaacucccuccgccucgccuccgacuccgacgccgaguccgacucccgcgccuccucccccaacuccaccgucuccaacaccuccaccgagggcuucggcggcaucauguccuucgccuccucccucuaccgcaaccacuccaccuccuucucccucuccaaccucacccuccccaccaagggcgcccgcgagaaggccacccccuuccccucccucaaggucuucggccucaacacccucauggagaucgucaccgaggccggccccggcuccggcgagggcaaccgccgcgcccucgucgaccagaaguccuccgucaucaagcacucccccaccgucaagcgcgagccccccuccccccagggccgcuccuccaacuccuccgagaaccagcaguuccucaaggaggucguccacuccguccucgacggccagggcgucggcuggcucaacaugaagaagguccgccgccuccucgaguccgagcagcuccgcgucuucguccucuccaagcucaaccgcaugguccaguccgaggacgacgcccgccaggacaucauccccgacgucgagaucucccgcaaggucuacaagggcaugcucgaccuccucaagugcaccguccucucccucgagcaguccuacgcccacgccggccucggcggcauggccuccaucuucggccuccucgagaucgcccagacccacuacuacuccaaggagcccgacaagcgcaagcgcucccccaccgaguccgucaacacccccgucggcaaggaccccggccucgccggccgcggcgaccccaaggccauggcccagcuccgcgucccccagcucggcccccgcgcccccuccgccaccggcaagggccccaaggagcucgacacccgcucccucaaggaggagaacuucaucgccuccaucgagcucuggaacaagcaccaggaggucaagaagcagaaggcccucgagaagcagcgccccgaggucaucaagcccgucuucgaccucggcgagaccgaggagaagaagucccagaucuccgccgacuccggcgucucccucaccuccuccucccagcgcaccgaccaggacuccgucaucggcgucucccccgccgucaugauccgcuccuccucccaggacuccgaggucuccaccgucgucuccaacuccuccggcgagacccucggcgccgacuccgaccucuccuccaacgccggcgacggccccggcggcgagggcuccguccaccucgccuccucccgcggcacccucuccgacuccgagaucgagaccaacuccgccaccuccaccaucuucggcaaggcccacucccucaagcccuccaucaaggagaagcucgccggcucccccauccgcaccuccgaggacgucucccagcgcgucuaccucuacgagggccuccucggccgcgacaagggcuccaugugggaccagcucgaggacgccgccauggagaccuucuccaucuccaaggagcgcuccacccucugggaccagaugcaguucugggaggacgccuuccucgacgccgucaugcucgagcgcgagggcaugggcauggaccagggcccccaggagaugaucgaccgcuaccucucccucggcgagcacgaccgcaagcgccucgaggacgacgaggaccgccuccucgccacccuccuccacaaccucaucuccuacaugcuccucaugaaggucaacaagaacgacauccgcaagaagguccgccgccucaugggcaagucccacaucggccucgucuacucccagcagaucaacgagguccucgaccagcucgccaaccucaacggccgcgaccucuccaucugguccuccggcucccgccacaugaagaagcagaccuucgucguccacgccggcaccgacaccaacggcgacaucuucuucauggaggucugcgacgacugcgucguccuccgcuccaacaucggcaccgucuacgagcgcuggugguacgagaagcucaucaacaugaccuacugccccaagaccaagguccucugccucuggcgccgcaacggcuccgagacccagcucaacaaguucuacaccaagaagugccgcgagcucuacuacugcgucaaggacuccauggagcgcgccgccgcccgccagcaguccaucaagcccggccccgagcucggcggcgaguuccccguccaggaccucaagaccggcgagggcggccuccuccaggucacccucgagggcaucaaccucaaguucaugcacaaccaguuccucaagcucaagaagugguga

SEQ ID NO: 45638 - RNA, 1191 nt, Artificial Sequence
  derived and/or modified sequence opt2 from MAEA__Homo_sapiens__NP_001017405
auggccguccaggaguccgccgcccagcucuccaugacccucaagguccaggaguaccccacccucaagguccccuacgagacccucaacaagcgcuuccgcgccgcccagaagaacaucgaccgcgagaccucccacgucaccauggucgucgccgagcucgagaagacccucuccggcugccccgccgucgacuccgucgucucccuccucgacggcgucgucgagaagcucuccguccucaagcgcaaggccgucgaguccauccaggccgaggacgaguccgccaagcucugcaagcgccgcaucgagcaccucaaggagcacuccuccgaccagcccgccgccgccuccgucuggaagcgcaagcgcauggaccgcaugauggucgagcaccuccuccgcugcggcuacuacaacaccgccgucaagcucgcccgccaguccggcaucgaggaccucgucaacaucgagauguuccucaccgccaaggaggucgaggagucccucgagcgccgcgagaccgccaccugccucgccuggugccacgacaacaagucccgccuccgcaagaugaaguccugccucgaguucucccuccgcauccaggaguucaucgagcucauccgccagaacaagcgccucgacgccguccgccacgcccgcaagcacuucucccaggccgagggcucccagcucgacgagguccgccaggccaugggcaugcucgccuucccccccgacacccacaucucccccuacaaggaccuccucgaccccgcccgcuggcgcaugcucauccagcaguuccgcuacgacaacuaccgccuccaccagcucggcaacaacuccgucuucacccucacccuccaggccggccucuccgccaucaagaccccccagugcuacaaggaggacggcuccuccaagucccccgacugccccgucugcucccgcucccucaacaagcucgcccagccccuccccauggcccacugcgccaacucccgccucgucugcaagaucuccggcgacgucaugaacgagaacaacccccccaugaugcuccccaacggcuacgucuacggcuacaacucccuccucuccauccgccaggacgacaaggucgucugcccccgcaccaaggaggucuuccacuucucccaggccgagaaggucuacaucauguga

SEQ ID NO: 45639 - RNA, 1212 nt, Artificial Sequence
  derived and/or modified sequence opt2 from MAEL__Homo_sapiens__NP_001273306
augcccaaccgcaaggccucccgcaacgccuacuacuucuucguccaggagaagauccccgagcuccgccgccgcggccuccccgucgcccgcgucgccgacgccauccccuacugcuccuccgacugggccaagcccgucuucaccccccuccgccgccccggcaugcucguccccaagcagaacgucuccccccccgacauguccgcccucucccucaagggcgaccaggcccuccucggcggcaucuucuacuuccucaacaucuucucccacggcgagcuccccccccacugcgagcagcgcuuccuccccugcgagaucggcugcgucaaguacucccuccaggagggcaucauggccgacuuccacuccuucaucaaccccggcgagaucccccgcggcuuccgcuuccacugccaggccgccuccgacuccucccacaagauccccaucuccaacuucgagcgcggccacaaccaggccaccguccuccagaaccucuaccgcuucauccaccccaaccccggcaacuggccccccaucuacugcaaguccgacgaccgcacccgcgucaacuggugccucaagcacauggccaaggccuccgagauccgccaggaccuccagcuccucaccgucgaggaccucgucgucggcaucuaccagcagaaguuccucaaggagcccuccaagaccuggauccgcucccuccucgacgucgccaugugggacuacuccuccaacacccgcugcaaguggcacgaggagaacgacauccucuucugcgcccucgccgucugcaagaagaucgccuacugcaucuccaacucccucgccacccucuucggcauccagcucaccgaggcccacgucccccuccaggacuacgaggccuccaacuccgucacccccaagauggucguccucgacgccggccgcuaccagaagcuccgcgucggcuccuccggcuucucccacuucaacuccuccaacgaggagcagcgcuccaacacccccaucggcgacuaccccucccgcgccaagaucuccggccagaacuccuccguccgcggccgcggcaucacccgccuccucgaguccaucuccaacuccuccuccaacauccacaaguucuccaacugcgacaccucccucucccccuacaugucccagaaggacggcuacaaguccuucuccucccucuccuga

SEQ ID NO: 45640 - RNA, 771 nt, Artificial Sequence
  derived and/or modified sequence opt2 from MAF1__Homo_sapiens__NP_115648
augaagcuccucgagaacuccuccuucgaggccaucaacucccagcucaccgucgagaccggcgacgcccacaucaucggccgcaucgaguccuacuccugcaagauggccggcgacgacaagcacauguucaagcaguucugccaggagggccagccccacguccucgaggcccucucccccccccagaccuccggccucucccccucccgccucuccaagucccagggcggcgaggaggagggcccccucuccgacaagugcucccgcaagacccucuucuaccucaucgccacccucaacgaguccuuccgccccgacuacgacuucuccaccgcccgcucccacgaguucucccgcgagcccucccucuccugggucgucaacgccgucaacugcucccucuucuccgccguccgcgaggacuucaaggaccucaagccccagcucuggaacgccgucgacgaggagaucugccucgccgagugcgacaucuacuccuacaaccccgaccucgacuccgaccccuucggcgaggacggcucccucugguccuucaacuacuucuucuacaacaagcgccucaagcgcaucgucuucuucuccugccgcuccaucuccggcuccaccuacacccccuccgaggccggcaacgagcucgacauggagcucggcgaggaggaggucgaggaggagucccgcuccggcggcuccggcgccgaggagaccuccaccauggaggaggaccgcguccccgucaucugcaucuga

SEQ ID NO: 45641 - RNA, 1062 nt, Artificial Sequence
  derived and/or modified sequence opt2 from MAFA__Homo_sapiens__NP_963883
auggccgccgagcucgccaugggcgccgagcuccccuccuccccccucgccaucgaguacgucaacgacuucgaccucaugaaguucgaggucaagaaggagccccccgaggccgagcgcuucugccaccgccucccccccggcucccucuccuccaccccccucuccacccccugcuccuccguccccuccucccccuccuucugcgcccccucccccggcaccggcggcggcggcggcgccggcggcggcggcggcuccucccaggccggcggcgcccccggcccccccuccggcggccccggcgccgucggcggcaccuccggcaagcccgcccucgaggaccucuacuggauguccggcuaccagcaccaccucaaccccgaggcccucaaccucacccccgaggacgccgucgaggcccucaucggcuccggccaccacggcgcccaccacggcgcccaccaccccgccgccgccgccgccuacgaggccuuccgcggccccggcuucgccggcggcggcggcgccgacgacaugggcgccggccaccaccacggcgcccaccacgccgcccaccaccaccacgccgcccaccaccaccaccaccaccaccaccaccacggcggcgccggccacggcggcggcgccggccaccacguccgccucgaggagcgcuucuccgacgaccagcucgucuccauguccguccgcgagcucaaccgccagcuccgcggcuucuccaaggaggaggucauccgccucaagcagaagcgccgcacccucaagaaccgcggcuacgcccaguccugccgcuucaagcgcguccagcagcgccacauccucgaguccgagaagugccagcuccagucccaggucgagcagcucaagcucgaggucggccgccucgccaaggagcgcgaccucuacaaggagaaguacgagaagcucgccggccgcggcggccccggcuccgccggcggcgccggcuucccccgcgagcccucccccccccaggccggccccggcggcgccaagggcaccgccgacuucuuccucuga

SEQ ID NO: 45642 - RNA, 972 nt, Artificial Sequence
  derived and/or modified sequence opt2 from MAFB__Homo_sapiens__NP_005452
auggccgccgagcucuccaugggccccgagcuccccaccuccccccucgccauggaguacgucaacgacuucgaccuccucaaguucgacgucaagaaggagccccucggccgcgccgagcgccccggccgccccugcacccgccuccagcccgccggcuccgucuccuccaccccccucuccacccccugcuccuccguccccuccucccccuccuucucccccaccgagcagaagacccaccucgaggaccucuacuggauggccuccaacuaccagcagaugaaccccgaggcccucaaccucacccccgaggacgccgucgaggcccucaucggcucccaccccgucccccagccccuccaguccuucgacuccuuccgcggcgcccaccaccaccaccaccaccaccacccccacccccaccacgccuaccccggcgccggcgucgcccacgacgagcucggcccccacgcccacccccaccaccaccaccaccaccaggccucccccccccccuccuccgccgccucccccgcccagcagcuccccaccucccaccccggccccggcccccacgccaccgccuccgccaccgccgccggcggcaacggcuccgucgaggaccgcuucuccgacgaccagcucgucuccauguccguccgcgagcucaaccgccaccuccgcggcuucaccaaggacgaggucauccgccucaagcagaagcgccgcacccucaagaaccgcggcuacgcccaguccugccgcuacaagcgcguccagcagaagcaccaccucgagaacgagaagacccagcucauccagcaggucgagcagcucaagcaggaggucucccgccucgcccgcgagcgcgacgccuacaaggucaagugcgagaagcucgccaacuccggcuuccgcgaggccggcuccaccuccgacucccccuccucccccgaguucuuccucuga

SEQ ID NO: 45643 - RNA, 495 nt, Artificial Sequence
  derived and/or modified sequence opt2 from MAFF__Homo_sapiens__NP_001155045
auguccgucgacccccucuccuccaaggcccucaagaucaagcgcgagcucuccgagaacaccccccaccucuccgacgaggcccucaugggccucuccguccgcgagcucaaccgccaccuccgcggccucuccgccgaggaggucacccgccucaagcagcgccgccgcacccucaagaaccgcggcuacgccgccuccugccgcgucaagcgcgucugccagaaggaggagcuccagaagcagaaguccgagcucgagcgcgaggucgacaagcucgcccgcgagaacgccgccaugcgccucgagcucgacgcccuccgcggcaagugcgaggcccuccagggcuucgcccgcuccgucgccgccgcccgcggccccgccacccucgucgcccccgccuccgucaucaccaucgucaaguccacccccggcuccggcuccggccccgcccacggccccgaccccgcccacggccccgccuccugcuccuga

SEQ ID NO: 45644 - RNA, 489 nt, Artificial Sequence
  derived and/or modified sequence opt2 from MAFG__Homo_sapiens__XP_011521881
augaccacccccaacaagggcaacaaggcccucaaggucaagcgcgagcccggcgagaacggcaccucccucaccgacgaggagcucgucaccauguccguccgcgagcucaaccagcaccuccgcggccucuccaaggaggagaucguccagcucaagcagcgccgccgcacccucaagaaccgcggcuacgccgccuccugccgcgucaagcgcgucacccagaaggaggagcucgagaagcagaaggccgagcuccagcaggaggucgagaagcucgccuccgagaacgccuccaugaagcucgagcucgacgcccuccgcuccaaguacgaggcccuccagaccuucgcccgcaccgucgcccgcucccccgucgcccccgcccgcggcccccucgccgccggccucggcccccucguccccggcaaggucgccgccaccuccgucaucaccaucgucaaguccaagaccgacgcccgcuccuga

SEQ ID NO: 45645 - RNA, 1122 nt, Artificial Sequence
  derived and/or modified sequence opt2 from MAF__Homo_sapiens__NP_001026974
auggccuccgagcucgccauguccaacuccgaccuccccaccuccccccucgccauggaguacgucaacgacuucgaccucaugaaguucgaggucaagaaggagcccgucgagaccgaccgcaucaucucccagugcggccgccucaucgccggcggcucccucuccuccacccccauguccacccccugcuccuccgucccccccucccccuccuucuccgcccccucccccggcuccggcuccgagcagaaggcccaccucgaggacuacuacuggaugaccggcuacccccagcagcucaaccccgaggcccucggcuucucccccgaggacgccgucgaggcccucaucuccaacucccaccagcuccagggcggcuucgacggcuacgcccgcggcgcccagcagcucgccgccgccgccggcgccggcgccggcgccucccucggcggcuccggcgaggagaugggccccgccgccgccgucgucuccgccgucaucgccgccgccgccgcccaguccggcgccggcccccacuaccaccaccaccaccaccacgccgccggccaccaccaccaccccaccgccggcgcccccggcgccgccggcuccgccgccgccuccgccggcggcgccggcggcgccggcggcggcggccccgccuccgccggcggcggcggcggcggcggcggcggcggcggcggcggcggcgccgccggcgccggcggcgcccuccacccccaccacgccgccggcggccuccacuucgacgaccgcuucuccgacgagcagcucgucaccauguccguccgcgagcucaaccgccagcuccgcggcgucuccaaggaggaggucauccgccucaagcagaagcgccgcacccucaagaaccgcggcuacgcccaguccugccgcuucaagcgcguccagcagcgccacguccucgaguccgagaagaaccagcuccuccagcaggucgaccaccucaagcaggagaucucccgccucguccgcgagcgcgacgccuacaaggagaaguacgagaagcucgucuccuccggcuuccgcgagaacggcuccuccuccgacaaccccuccucccccgaguucuucauguga

SEQ ID NO: 45646 - RNA, 471 nt, Artificial Sequence
  derived and/or modified sequence opt2 from MAFK__Homo_sapiens__XP_006715836
augaccaccaaccccaagcccaacaaggcccucaaggucaagaaggaggccggcgagaacgcccccguccucuccgacgacgagcucgucuccauguccguccgcgagcucaaccagcaccuccgcggccucaccaaggaggaggucacccgccucaagcagcgccgccgcacccucaagaaccgcggcuacgccgccuccugccgcaucaagcgcgucacccagaaggaggagcucgagcgccagcgcgucgagcuccagcaggaggucgagaagcucgcccgcgagaacuccuccaugcgccucgagcucgacgcccuccgcuccaaguacgaggcccuccagaccuucgcccgcaccgucgcccgcggccccgucgcccccuccaaggucgccaccaccuccgucaucaccaucgucaaguccaccgagcucuccuccaccuccguccccuucuccgccgccuccuga

SEQ ID NO: 45647 - RNA, 1110 nt, Artificial Sequence
  derived and/or modified sequence opt2 from MAGEA10__Homo_sapiens__NP_001011543
augccccgcgcccccaagcgccagcgcugcaugcccgaggaggaccuccagucccaguccgagacccagggccucgagggcgcccaggccccccucgccgucgaggaggacgccuccuccuccaccuccaccuccuccuccuuccccuccuccuuccccuccuccuccuccuccuccuccuccuccugcuacccccucauccccuccacccccgaggaggucuccgccgacgacgagacccccaaccccccccaguccgcccagaucgccugcuccucccccuccgucgucgccucccucccccucgaccaguccgacgagggcuccuccucccagaaggaggagucccccuccacccuccagguccuccccgacuccgagucccucccccgcuccgagaucgacgagaaggucaccgaccucguccaguuccuccucuucaaguaccagaugaaggagcccaucaccaaggccgagauccucgaguccgucauccgcaacuacgaggaccacuucccccuccucuucuccgaggccuccgagugcaugcuccucgucuucggcaucgacgucaaggaggucgaccccaccggccacuccuucguccucgucaccucccucggccucaccuacgacggcaugcucuccgacguccaguccaugcccaagaccggcauccucauccucauccucuccaucaucuucaucgagggcuacugcacccccgaggaggucaucugggaggcccucaacaugaugggccucuacgacggcauggagcaccucaucuacggcgagccccgcaagcuccucacccaggacuggguccaggagaacuaccucgaguaccgccagguccccggcuccgaccccgcccgcuacgaguuccucuggggcccccgcgcccacgccgagauccgcaagaugucccuccucaaguuccucgccaaggucaacggcuccgacccccgcuccuucccccucugguacgaggaggcccucaaggacgaggaggagcgcgcccaggaccgcaucgccaccaccgacgacaccaccgccauggccuccgccuccuccuccgccaccggcuccuucuccuaccccgaguga

SEQ ID NO: 45648 - RNA, 1203 nt, Artificial Sequence
  derived and/or modified sequence opt2 from MAGEA11__Homo_sapiens__NP_001011544
auguccaaggucuccaccauguucuccgaggacgacuuccaguccaccgagcgcgcccccuacggcccccagcuccaguggucccaggaccucccccgcguccaggucuuccgcgagcaggccaaccucgaggaccgcuccccccgccgcacccagcgcaucaccggcggcgagcagguccucuggggccccaucacccagaucuuccccaccguccgccccgccgaccucacccgcgucaucaugccccucgagcagcgcucccagcacugcaagcccgaggagggccuccaggcccaggaggaggaccucggccucgucggcgcccaggcccuccaggccgaggagcaggaggccgccuucuucuccuccacccucaacgucggcacccucgaggagcuccccgccgccgagucccccucccccccccaguccccccaggaggaguccuucucccccaccgccauggacgccaucuucggcucccucuccgacgagggcuccggcucccaggagaaggagggccccuccaccucccccgaccucaucgaccccgaguccuucucccaggacauccuccacgacaagaucaucgaccucguccaccuccuccuccgcaaguaccgcgucaagggccucaucaccaaggccgagaugcucggcuccgucaucaagaacuacgaggacuacuuccccgagaucuuccgcgaggccuccgucugcaugcagcuccucuucggcaucgacgucaaggaggucgaccccaccucccacuccuacguccucgucaccucccucaaccucuccuacgacggcauccagugcaacgagcaguccaugcccaaguccggccuccucaucaucguccucggcgucaucuucauggagggcaacugcauccccgaggaggucaugugggagguccucuccaucaugggcgucuacgccggccgcgagcacuuccucuucggcgagcccaagcgccuccucacccagaacuggguccaggagaaguaccucgucuaccgccagguccccggcaccgaccccgccugcuacgaguuccucuggggcccccgcgcccacgccgagaccuccaagaugaagguccucgaguacaucgccaacgccaacggccgcgaccccaccuccuaccccucccucuacgaggacgcccuccgcgaggagggcgagggcgucuga

SEQ ID NO: 45649 - RNA, 945 nt, Artificial Sequence
  derived and/or modified sequence opt2 from MAGEA12__Homo_sapiens__NP_001159858
augccccucgagcagcgcucccagcacugcaagcccgaggagggccucgaggcccagggcgaggcccucggccucgucggcgcccaggcccccgccaccgaggagcaggagaccgccuccuccuccuccacccucgucgaggucacccuccgcgagguccccgccgccgagucccccucccccccccacuccccccagggcgccuccacccuccccaccaccaucaacuacacccucuggucccaguccgacgagggcuccuccaacgaggagcaggagggccccuccaccuuccccgaccucgagaccuccuuccaggucgcccucucccgcaagauggccgagcucguccacuuccuccuccucaaguaccgcgcccgcgagcccuucaccaaggccgagaugcucggcuccgucauccgcaacuuccaggacuucuuccccgucaucuucuccaaggccuccgaguaccuccagcucgucuucggcaucgaggucgucgaggucguccgcaucggccaccucuacauccucgucaccugccucggccucuccuacgacggccuccucggcgacaaccagaucguccccaagaccggccuccucaucaucguccucgccaucaucgccaaggagggcgacugcgcccccgaggagaagaucugggaggagcucuccguccucgaggccuccgacggccgcgaggacuccgucuucgcccacccccgcaagcuccucacccaggaccucguccaggagaacuaccucgaguaccgccagguccccggcuccgaccccgccugcuacgaguuccucuggggcccccgcgcccucgucgagaccuccuacgucaagguccuccaccaccuccucaagaucuccggcggcccccacaucuccuaccccccccuccacgagugggccuuccgcgagggcgaggaguga

SEQ ID NO: 45650 - RNA, 930 nt, Artificial Sequence
  derived and/or modified sequence opt2 from MAGEA1__Homo_sapiens__NP_004979
augucccucgagcagcgcucccuccacugcaagcccgaggaggcccucgaggcccagcaggaggcccucggccucgucugcguccaggccgccaccuccuccuccuccccccucguccucggcacccucgaggagguccccaccgccggcuccaccgaccccccccaguccccccagggcgccuccgccuuccccaccaccaucaacuucacccgccagcgccagcccuccgagggcuccuccucccgcgaggaggagggccccuccaccuccugcauccucgagucccucuuccgcgccgucaucaccaagaaggucgccgaccucgucggcuuccuccuccucaaguaccgcgcccgcgagcccgucaccaaggccgagaugcucgaguccgucaucaagaacuacaagcacugcuuccccgagaucuucggcaaggccuccgagucccuccagcucgucuucggcaucgacgucaaggaggccgaccccaccggccacuccuacguccucgucaccugccucggccucuccuacgacggccuccucggcgacaaccagaucaugcccaagaccggcuuccucaucaucguccucgucaugaucgccauggagggcggccacgcccccgaggaggagaucugggaggagcucuccgucauggaggucuacgacggccgcgagcacuccgccuacggcgagccccgcaagcuccucacccaggaccucguccaggagaaguaccucgaguaccgccagguccccgacuccgaccccgcccgcuacgaguuccucuggggcccccgcgcccucgccgagaccuccuacgucaagguccucgaguacgucaucaaggucuccgcccgcguccgcuucuucuuccccucccuccgcgaggccgcccuccgcgaggaggaggagggcgucuga

SEQ ID NO: 45651 - RNA, 945 nt, Artificial Sequence
  derived and/or modified sequence opt2 from MAGEA2B__Homo_sapiens__NP_705692
augccccucgagcagcgcucccagcacugcaagcccgaggagggccucgaggcccgcggcgaggcccucggccucgucggcgcccaggcccccgccaccgaggagcagcagaccgccuccuccuccuccacccucgucgaggucacccucggcgagguccccgccgccgacucccccucccccccccacuccccccagggcgccuccuccuucuccaccaccaucaacuacacccucuggcgccaguccgacgagggcuccuccaaccaggaggaggagggcccccgcauguuccccgaccucgaguccgaguuccaggccgccaucucccgcaagauggucgagcucguccacuuccuccuccucaaguaccgcgcccgcgagcccgucaccaaggccgagaugcucgaguccguccuccgcaacugccaggacuucuuccccgucaucuucuccaaggccuccgaguaccuccagcucgucuucggcaucgaggucgucgaggucguccccaucucccaccucuacauccucgucaccugccucggccucuccuacgacggccuccucggcgacaaccaggucaugcccaagaccggccuccucaucaucguccucgccaucaucgccaucgagggcgacugcgcccccgaggagaagaucugggaggagcucuccaugcucgaggucuucgagggccgcgaggacuccgucuucgcccacccccgcaagcuccucaugcaggaccucguccaggagaacuaccucgaguaccgccagguccccggcuccgaccccgccugcuacgaguuccucuggggcccccgcgcccucaucgagaccuccuacgucaagguccuccaccacacccucaagaucggcggcgagccccacaucuccuaccccccccuccacgagcgcgcccuccgcgagggcgaggaguga

SEQ ID NO: 45652 - RNA, 945 nt, Artificial Sequence
  derived and/or modified sequence opt2 from MAGEA3__Homo_sapiens__NP_005353
augccccucgagcagcgcucccagcacugcaagcccgaggagggccucgaggcccgcggcgaggcccucggccucgucggcgcccaggcccccgccaccgaggagcaggaggccgccuccuccuccuccacccucgucgaggucacccucggcgagguccccgccgccgagucccccgaccccccccaguccccccagggcgccuccucccuccccaccaccaugaacuacccccucuggucccaguccuacgaggacuccuccaaccaggaggaggagggccccuccaccuuccccgaccucgaguccgaguuccaggccgcccucucccgcaaggucgccgagcucguccacuuccuccuccucaaguaccgcgcccgcgagcccgucaccaaggccgagaugcucggcuccgucgucggcaacuggcaguacuucuuccccgucaucuucuccaaggccuccuccucccuccagcucgucuucggcaucgagcucauggaggucgaccccaucggccaccucuacaucuucgccaccugccucggccucuccuacgacggccuccucggcgacaaccagaucaugcccaaggccggccuccucaucaucguccucgccaucaucgcccgcgagggcgacugcgcccccgaggagaagaucugggaggagcucuccguccucgaggucuucgagggccgcgaggacuccauccucggcgaccccaagaagcuccucacccagcacuucguccaggagaacuaccucgaguaccgccagguccccggcuccgaccccgccugcuacgaguuccucuggggcccccgcgcccucgucgagaccuccuacgucaagguccuccaccacauggucaagaucuccggcggcccccacaucuccuaccccccccuccacgaguggguccuccgcgagggcgaggaguga

SEQ ID NO: 45653 - RNA, 954 nt, Artificial Sequence
  derived and/or modified sequence opt2 from MAGEA4__Homo_sapiens__NP_001011549
auguccuccgagcagaagucccagcacugcaagcccgaggagggcgucgaggcccaggaggaggcccucggccucgucggcgcccaggcccccaccaccgaggagcaggaggccgccgucuccuccuccuccccccucguccccggcacccucgaggagguccccgccgccgaguccgccggccccccccaguccccccagggcgccuccgcccuccccaccaccaucuccuucaccugcuggcgccagcccaacgagggcuccuccucccaggaggaggagggccccuccaccucccccgacgccgagucccucuuccgcgaggcccucuccaacaaggucgacgagcucgcccacuuccuccuccgcaaguaccgcgccaaggagcucgucaccaaggccgagaugcucgagcgcgucaucaagaacuacaagcgcugcuuccccgucaucuucggcaaggccuccgagucccucaagaugaucuucggcaucgacgucaaggaggucgaccccgccuccaacaccuacacccucgucaccugccucggccucuccuacgacggccuccucggcaacaaccagaucuuccccaagaccggccuccucaucaucguccucggcaccaucgccauggagggcgacuccgccuccgaggaggagaucugggaggagcucggcgucaugggcgucuacgacggccgcgagcacaccgucuacggcgagccccgcaagcuccucacccaggacuggguccaggagaacuaccucgaguaccgccagguccccggcuccaaccccgcccgcuacgaguuccucuggggcccccgcgcccucgccgagaccuccuacgucaagguccucgagcacgucguccgcgucaacgcccgcguccgcaucgccuaccccucccuccgcgaggccgcccuccucgaggaggaggagggcgucuga

SEQ ID NO: 45654 - RNA, 945 nt, Artificial Sequence
  derived and/or modified sequence opt2 from MAGEA6__Homo_sapiens__NP_005354
augccccucgagcagcgcucccagcacugcaagcccgaggagggccucgaggcccgcggcgaggcccucggccucgucggcgcccaggcccccgccaccgaggagcaggaggccgccuccuccuccuccacccucgucgaggucacccucggcgagguccccgccgccgagucccccgaccccccccaguccccccagggcgccuccucccuccccaccaccaugaacuacccccucuggucccaguccuacgaggacuccuccaaccaggaggaggagggccccuccaccuuccccgaccucgaguccgaguuccaggccgcccucucccgcaaggucgccaagcucguccacuuccuccuccucaaguaccgcgcccgcgagcccgucaccaaggccgagaugcucggcuccgucgucggcaacuggcaguacuucuuccccgucaucuucuccaaggccuccgacucccuccagcucgucuucggcaucgagcucauggaggucgaccccaucggccacgucuacaucuucgccaccugccucggccucuccuacgacggccuccucggcgacaaccagaucaugcccaagaccggcuuccucaucaucauccucgccaucaucgccaaggagggcgacugcgcccccgaggagaagaucugggaggagcucuccguccucgaggucuucgagggccgcgaggacuccaucuucggcgaccccaagaagcuccucacccaguacuucguccaggagaacuaccucgaguaccgccagguccccggcuccgaccccgccugcuacgaguuccucuggggcccccgcgcccucaucgagaccuccuacgucaagguccuccaccacauggucaagaucuccggcggcccccgcaucuccuacccccuccuccacgagugggcccuccgcgagggcgaggaguga

SEQ ID NO: 45655 - RNA, 948 nt, Artificial Sequence
  derived and/or modified sequence opt2 from MAGEA9__Homo_sapiens__NP_005356
augucccucgagcagcgcuccccccacugcaagcccgacgaggaccucgaggcccagggcgaggaccucggccucaugggcgcccaggagcccaccggcgaggaggaggagaccaccuccuccuccgacuccaaggaggaggaggucuccgccgccggcuccuccucccccccccaguccccccagggcggcgccuccuccuccaucuccgucuacuacacccucuggucccaguucgacgagggcuccuccucccaggaggaggaggagcccuccuccuccgucgaccccgcccagcucgaguucauguuccaggaggcccucaagcucaaggucgccgagcucguccacuuccuccuccacaaguaccgcgucaaggagcccgucaccaaggccgagaugcucgaguccgucaucaagaacuacaagcgcuacuuccccgucaucuucggcaaggccuccgaguucaugcaggucaucuucggcaccgacgucaaggaggucgaccccgccggccacuccuacauccucgucaccgcccucggccucuccugcgacuccaugcucggcgacggccacuccaugcccaaggccgcccuccucaucaucguccucggcgucauccucaccaaggacaacugcgcccccgaggaggucaucugggaggcccucuccgucaugggcgucuacgucggcaaggagcacauguucuacggcgagccccgcaagcuccucacccaggacuggguccaggagaacuaccucgaguaccgccagguccccggcuccgaccccgcccacuacgaguuccucuggggcuccaaggcccacgccgagaccuccuacgagaaggucaucaacuaccucgucaugcucaacgcccgcgagcccaucugcuaccccucccucuacgaggagguccucggcgaggagcaggagggcgucuga

SEQ ID NO: 45656 - RNA, 1011 nt, Artificial Sequence
  derived and/or modified sequence opt2 from MAGEB17__Homo_sapiens__NP_001264236
augccccgcggccaggccuccaagcgccgcgcccgcgagaagcgccgccaggcccgcggcgaggaccagugccucggcggcgcccaggccaccgccgccgagaaggagaagcuccccuccuccuccucccccgccugccagucccccccccaguccuuccccaacgccggcaucccccaggagucccagcgcgccuccuaccccuccucccccgccuccgccgucucccucaccuccuccgacgagggcgccaagggccagaagggcgagucccccaacuccuuccacggccccuccuccuccgaguccaccggccgcgaccuccucaacaccaagaccggcgagcucguccaguuccuccucaacaaguacauccgcaaggagcccaucacccgcgaggccaugcucaaggucaucaaccgcaaguacaagcagcacuuccccgagauccuccgccgcuccaccgagaacgucgaggucgucuucggccucuaccucaaggagauggaccccucccgccaguccuacguccucgucggcaagcucgacuuccccaaccagggcucccucuccgacggcggcggcuucccccucuccggccuccucaugguccuccucuccaccaucuucaugcacggcaaccgcgccaccgaggaggagaugugggagugccucaacgcccucggcauguacaagggccgcaagcacuucaucuacggcgagccccaggagcucgucaccaaggaccucguccgcgagggcuaccucgaguaccagcagguccccuccuccgaccccccccgcuacgaguuccucuggggcccccgcgcccgcgccgagaccuccaagaugaagguccucgaguucgucgccaagcucaacgacaccgucgccuccaccuacaagucccgcuacgaggaggcccuccgcgaggaggaggagcaggcccgcgcccgcgccgucgcccgcgacuccgcccgcgcccgcgccucccgcuccuuccagcccuga

SEQ ID NO: 45657 - RNA, 1044 nt, Artificial Sequence
  derived and/or modified sequence opt2 from MAGEB1__Homo_sapiens__NP_803134
augccccgcggccagaaguccaagcuccgcgcccgcgagaagcgccgcaaggcccgcgaggagacccagggccucaaggucgcccacgccaccgccgccgagaaggaggagugccccuccuccucccccguccucggcgacacccccaccuccucccccgccgccggcaucccccagaagccccagggcgccccccccaccaccaccgccgccgccgccgucuccugcaccgaguccgacgagggcgccaagugccagggcgaggagaacgccuccuucucccaggccaccaccuccaccgaguccuccgucaaggaccccgucgccugggaggccggcaugcucaugcacuucauccuccgcaaguacaagaugcgcgagcccaucaugaaggccgacaugcucaaggucgucgacgagaaguacaaggaccacuucaccgagauccucaacggcgccucccgccgccucgagcucgucuucggccucgaccucaaggaggacaaccccuccggccacaccuacacccucgucuccaagcucaaccucaccaacgacggcaaccucuccaacgacugggacuucccccgcaacggccuccucaugccccuccucggcgucaucuuccucaagggcaacuccgccaccgaggaggagaucuggaaguucaugaacguccucggcgccuacgacggcgaggagcaccucaucuacggcgagccccgcaaguucaucacccaggaccucguccaggagaaguaccucaaguacgagcagguccccaacuccgaccccccccgcuaccaguuccucuggggcccccgcgccuacgccgagaccaccaagaugaagguccucgaguuccucgccaagaugaacggcgccaccccccgcgacuuccccucccacuacgaggaggcccuccgcgacgaggaggagcgcgcccagguccgcuccuccguccgcgcccgccgccgcaccaccgccaccaccuuccgcgcccgcucccgcgcccccuucucccgcuccucccaccccauguga

SEQ ID NO: 45658 - RNA, 960 nt, Artificial Sequence
  derived and/or modified sequence opt2 from MAGEB2__Homo_sapiens__NP_002355
augccccgcggccagaaguccaagcuccgcgcccgcgagaagcgccgcaaggcccgcgacgagacccgcggccucaacgucccccaggucaccgaggccgaggaggaggaggcccccugcugcuccuccuccgucuccggcggcgccgccuccuccucccccgccgccggcaucccccaggagccccagcgcgcccccaccaccgccgccgccgccgccgccggcgucuccuccaccaaguccaagaagggcgccaagucccaccagggcgagaagaacgccuccuccucccaggccuccaccuccaccaagucccccuccgaggacccccucacccgcaaguccggcucccucguccaguuccuccucuacaaguacaagaucaagaaguccgucaccaagggcgagaugcucaagaucgucggcaagcgcuuccgcgagcacuuccccgagauccucaagaaggccuccgagggccucuccgucgucuucggccucgagcucaacaaggucaaccccaacggccacaccuacaccuucaucgacaaggucgaccucaccgacgaggagucccuccucuccuccugggacuucccccgccgcaagcuccucaugccccuccucggcgucaucuuccucaacggcaacuccgccaccgaggaggagaucugggaguuccucaacaugcucggcgucuacgacggcgaggagcacuccgucuucggcgagcccuggaagcucaucaccaaggaccucguccaggagaaguaccucgaguacaagcagguccccuccuccgaccccccccgcuuccaguuccucuggggcccccgcgccuacgccgagaccuccaagaugaagguccucgaguuccucgccaaggucaacggcaccacccccugcgccuuccccacccacuacgaggaggcccucaaggacgaggagaaggccggcgucuga

SEQ ID NO: 45659 - RNA, 1224 nt, Artificial Sequence
  derived and/or modified sequence opt2 from MAGEB6__Homo_sapiens__NP_775794
augccccgcggccacaaguccaagcuccgcaccugcgagaagcgccaggagaccaacggccagccccagggccucaccggcccccaggccaccgccgagaagcaggaggagucccacuccuccuccuccuccucccgcgccugccucggcgacugccgccgcuccuccgacgccuccaucccccaggagucccagggcgucucccccaccggcucccccgacgccgucgucuccuacuccaaguccgacgucgccgccaacggccaggacgagaagucccccuccaccucccgcgacgccuccgucccccaggagucccagggcgccucccccaccggcucccccgacgccggcgucuccggcuccaaguacgacgucgccgccaacggccaggacgagaagucccccuccaccucccacgacgucuccgucccccaggagucccagggcgccucccccaccggcucccccgacgccggcgucuccggcuccaaguacgacgucgccgccgagggcgaggacgaggaguccgucuccgccucccagaaggccaucaucuucaagcgccucuccaaggacgccgucaagaagaaggccugcacccucgcccaguuccuccagaagaaguucgagaagaaggaguccauccucaaggccgacaugcucaagugcguccgccgcgaguacaagcccuacuucccccagauccucaaccgcaccucccagcaccucgucgucgccuucggcgucgagcucaaggagauggacuccuccggcgaguccuacacccucgucuccaagcucggccuccccuccgagggcauccucuccggcgacaacgcccuccccaaguccggccuccucaugucccuccucgucgucaucuucaugaacggcaacugcgccaccgaggaggaggucugggaguuccucggccuccucggcaucuacgacggcauccuccacuccaucuacggcgacgcccgcaagaucaucaccgaggaccucguccaggacaaguacgucgucuaccgccaggucugcaacuccgacccccccugcuacgaguuccucuggggcccccgcgccuacgccgagaccaccaagaugcgcguccuccgcguccucgccgacuccuccaacaccucccccggccucuacccccaccucuacgaggacgcccucaucgacgaggucgagcgcgcccuccgccuccgcgccuga

SEQ ID NO: 45660 - RNA, 3429 nt, Artificial Sequence
  derived and/or modified sequence opt2 from MAGEC1__Homo_sapiens__NP_005453
augggcgacaaggacaugcccaccgccggcaugcccucccuccuccaguccuccuccgaguccccccaguccugccccgagggcgaggacucccaguccccccuccagaucccccaguccucccccgaguccgacgacacccucuacccccuccaguccccccagucccgcuccgagggcgaggacuccuccgacccccuccagcgcccccccgagggcaaggacucccaguccccccuccagaucccccaguccucccccgagggcgacgacacccaguccccccuccagaacucccaguccucccccgagggcaaggacucccucuccccccucgagaucucccaguccccccccgagggcgaggacguccaguccccccuccagaaccccgccuccuccuucuucuccuccgcccuccucuccaucuuccaguccucccccgaguccacccagucccccuucgagggcuucccccaguccguccuccagauccccgucuccgccgccuccuccuccacccucgucuccaucuuccaguccucccccgaguccacccagucccccuucgagggcuucccccaguccccccuccagauccccgucucccgcuccuucuccuccacccuccucuccaucuuccaguccucccccgagcgcacccaguccaccuucgagggcuucgcccaguccccccuccagauccccgucucccccuccuccuccuccacccuccucucccucuuccaguccuucuccgagcgcacccaguccaccuucgagggcuucgcccaguccucccuccagauccccgucucccccuccuucuccuccacccucgucucccucuuccaguccucccccgagcgcacccaguccaccuucgagggcuucccccaguccccccuccagauccccgucuccuccuccuccuccuccacccuccucucccucuuccaguccucccccgagcgcacccacuccaccuucgagggcuucccccagucccuccuccagauccccaugaccuccuccuucuccuccacccuccucuccaucuuccaguccucccccgaguccgcccaguccaccuucgagggcuucccccaguccccccuccagauccccggcucccccuccuucuccuccacccuccucucccucuuccaguccucccccgagcgcacccacuccaccuucgagggcuucccccaguccccccuccagauccccaugaccuccuccuucuccuccacccuccucuccauccuccaguccucccccgaguccgcccaguccgccuucgagggcuucccccaguccccccuccagauccccgucuccuccuccuucuccuacacccuccucucccucuuccaguccucccccgagcgcacccacuccaccuucgagggcuucccccaguccccccuccagauccccgucuccuccuccuccuccuccuccacccuccucucccucuuccaguccucccccgagugcacccaguccaccuucgagggcuucccccaguccccccuccagaucccccaguccccccccgagggcgagaacacccacuccccccuccagaucguccccucccuccccgagugggaggacucccucuccccccacuacuucccccagucccccccccagggcgaggacucccucuccccccacuacuucccccagucccccccccagggcgaggacucccucuccccccacuacuucccccaguccccccagggcgaggacucccucuccccccacuacuucccccagucccccccccagggcgaggacuccauguccccccucuacuucccccaguccccccuccagggcgaggaguuccaguccucccuccagucccccgucuccaucugcuccuccuccacccccuccucccucccccaguccuuccccgaguccucccaguccccccccgagggccccguccaguccccccuccacuccccccaguccccccccgagggcaugcacucccaguccccccuccagucccccgaguccgcccccgagggcgaggacucccucuccccccuccagaucccccaguccccccucgagggcgaggacucccucuccucccuccacuucccccaguccccccccgagugggaggacucccucuccccccuccacuucccccaguuccccccccagggcgaggacuuccaguccucccuccagucccccgucuccaucugcuccuccuccaccucccucucccucccccaguccuuccccgaguccccccaguccccccccgagggccccgcccaguccccccuccagcgccccgucuccuccuucuucuccuacacccucgccucccuccuccaguccucccacgaguccccccaguccccccccgagggccccgcccaguccccccuccagucccccgucuccuccuuccccuccuccaccuccuccucccucucccaguccucccccgucuccuccuuccccuccuccaccuccuccucccucuccaaguccucccccgaguccccccuccagucccccgucaucuccuucuccuccuccaccucccucucccccuucuccgaggaguccuccucccccgucgacgaguacaccuccuccuccgacacccuccucgaguccgacucccucaccgacuccgagucccucaucgaguccgagccccucuucaccuacacccucgacgagaaggucgacgagcucgcccgcuuccuccuccucaaguaccaggucaagcagcccaucaccaaggccgagaugcucaccaacgucaucucccgcuacaccggcuacuuccccgucaucuuccgcaaggcccgcgaguucaucgagauccucuucggcaucucccuccgcgaggucgaccccgacgacuccuacgucuucgucaacacccucgaccucaccuccgagggcugccucuccgacgagcagggcaugucccagaaccgccuccucauccucauccucuccaucaucuucaucaagggcaccuacgccuccgaggaggucaucugggacguccucuccggcaucggcguccgcgccggccgcgagcacuucgccuucggcgagccccgcgagcuccucaccaaggucuggguccaggagcacuaccucgaguaccgcgagguccccaacuccucccccccccgcuacgaguuccucuggggcccccgcgcccacuccgaggucaucaagcgcaaggucgucgaguuccucgccaugcucaagaacaccguccccaucaccuuccccuccuccuacaaggacgcccucaaggacgucgaggagcgcgcccaggccaucaucgacaccaccgacgacuccaccgccaccgaguccgccuccuccuccgucaugucccccuccuucuccuccgaguga

SEQ ID NO: 45661 - RNA, 1122 nt, Artificial Sequence
  derived and/or modified sequence opt2 from MAGEC2__Homo_sapiens__NP_057333
augccccccguccccggcguccccuuccgcaacgucgacaacgacucccccaccuccgucgagcucgaggacugggucgacgcccagcaccccaccgacgaggaggaggaggaggccuccuccgccuccuccacccucuaccucgucuucucccccuccuccuucuccaccuccuccucccucauccucggcggccccgaggaggaggagguccccuccggcgucauccccaaccucaccgaguccauccccuccucccccccccagggccccccccagggccccucccaguccccccucuccuccugcugcuccuccuucuccugguccuccuucuccgaggaguccuccucccagaagggcgaggacaccggcaccugccagggccuccccgacuccgaguccuccuucaccuacacccucgacgagaaggucgccgagcucgucgaguuccuccuccucaaguacgaggccgaggagcccgucaccgaggccgagaugcucaugaucgucaucaaguacaaggacuacuuccccgucauccucaagcgcgcccgcgaguucauggagcuccucuucggccucgcccucaucgaggucggccccgaccacuucugcgucuucgccaacaccgucggccucaccgacgagggcuccgacgacgagggcaugcccgagaacucccuccucaucaucauccucuccgucaucuucaucaagggcaacugcgccuccgaggaggucaucugggagguccucaacgccgucggcgucuacgccggccgcgagcacuucgucuacggcgagccccgcgagcuccucaccaaggucuggguccagggccacuaccucgaguaccgcgaggucccccacuccuccccccccuacuacgaguuccucuggggcccccgcgcccacuccgaguccaucaagaagaagguccucgaguuccucgccaagcucaacaacaccguccccuccuccuuccccuccugguacaaggacgcccucaaggacgucgaggagcgcguccaggccaccaucgacaccgccgacgacgccaccgucauggccuccgagucccucuccgucauguccuccaacgucuccuucuccgaguga

SEQ ID NO: 45662 - RNA, 1932 nt, Artificial Sequence
  derived and/or modified sequence opt2 from MAGEC3__Homo_sapiens__NP_619647
augcuccuccccugccacuggguccucgacgccaccuucuccgacggcucccucggccagugggucaagaacaccugcgccaccuacgcccucucccccgucguccuccccccccagccccagccccgcaagaaggccaccgacaaggacuacuccgccuuccaccucggccaccuccgcgagguccgccucuuccuccgcggcggcaccuccgaccagcgcauggacucccucguccucugccccaccuacuucaagcucuggcgcacccucuccggcucccccggccuccagcucuccgaccuccacuucggcucccagcccgagggcaaguucucccuccgccgcgccgucuccgucaagcagcgcgaggagccccaggacuggccccucaacgagaagcgcacccucuggaaggacuccgaccuccccaccuggcgccgcggcaccggcuacacccucucccuccccgccgucucccccggcaagcgccucuggggcgagaaggccggcucccuccccgaguccgagccccucuucaccuacacccucgacgagaaggucgacaagcucguccaguuccuccuccucaaguaccaggccaaggagccccucacccgcgccgagaugcagaugaacgucaucaacaccuacaccggcuacuuccccaugaucuuccgcaaggcccgcgaguucaucgagauccucuucggcaucucccucaccgaggucgaccccgaccacuucuacgucuucgucaacacccucgaccucaccugcgagggcucccucuccgacgagcagggcaugccccagaaccgccuccucauccucauccucuccgucaucuucaucaagggcaacugcgccuccgaggaggucaucugggagguccucaacgccaucggccccugguccgcccucgccggcuucgccgacguccucucccgccucgcccucugggaguccgagggccccgaggccuucugcgaggaguccggccuccgcuccgccgagggcuccguccucgaccucgccaacccccagggccucgccggccaccgccaggaggacggccgccgcggccucaccgaggccuccccccagcagaagaagggcggcgaggacgaggacaugcccgccgccggcaugcccccccucccccaguccccccccgagauccccccccagggcccccccaagaucuccccccagggccccccccagucccccccccaguccccccucgacuccugcuccuccccccuccucuggacccgccucgacgaggaguccuccuccgaggaggaggacaccgccaccuggcacgcccuccccgaguccgagucccucccccgcuacgcccucgacgagaaggucgccgagcucguccaguuccuccuccucaaguaccagaccaaggagcccgucaccaaggccgagaugcucaccaccgucaucaagaaguacaaggacuacuuccccaugaucuucggcaaggcccacgaguucaucgagcucaucuucggcaucgcccucaccgacauggaccccgacaaccacuccuacuucuucgaggacacccucgaccucaccuacgagggcucccucaucgacgaccagggcaugcccaagaacugccuccucauccucauccucuccaugaucuucaucaagggcuccugcguccccgaggaggucaucugggagguccucuccgccaucggccccauccagcgccccgcccgcgagguccucgaguuccucuccaagcucuccuccaucauccccuccgccuuccccuccugguacauggacgcccucaaggacauggaggaccgcgcccaggccaucaucgacaccaccgacgacgccaccgccauggccuccgccucccccuccgucauguccaccaacuucugccccgaguga

SEQ ID NO: 45663 - RNA, 2337 nt, Artificial Sequence
  derived and/or modified sequence opt2 from MAGED1__Homo_sapiens__NP_001005332
auggcccagaagauggacugcggcgccggccuccucggcuuccaggccgaggccuccgucgaggacuccgcccuccucaugcagacccucauggaggccauccagaucuccgaggccccccccaccaaccaggccaccgccgccgccuccccccaguccucccagccccccaccgccaacgagauggccgacauccaggucuccgccgccgccgcccgccccaaguccgccuucaagguccagaacgccaccaccaagggccccaacggcgucuacgacuucucccaggcccacaacgccaaggacguccccaacacccagcccaaggccgccuucaagucccagaacgccacccccaagggccccaacgccgccuacgacuucucccaggccgccaccaccggcgagcucgccgccaacaaguccgagauggccuucaaggcccagaacgccaccaccaaggucggccccaacgccaccuacaacuucucccagucccucaacgccaacgaccucgccaacucccgccccaagacccccuucaaggccuggaacgacaccaccaaggcccccaccgccgacacccagacccagaacgucaaccaggccaagauggccaccucccaggccgacaucgagaccgaccccggcaucuccgagcccgacggcgccaccgcccagaccuccgccgacggcucccaggcccagaaccucgagucccgcaccaucauccgcggcaagcgcacccgcaagaucaacaaccucaacgucgaggagaacuccuccggcgaccagcgccgcgccccccucgccgccggcaccuggcgcuccgcccccguccccgucaccacccagaacccccccggcgccccccccaacguccucuggcagaccccccucgccuggcagaaccccuccggcuggcagaaccagaccgcccgccagaccccccccgcccgccaguccccccccgcccgccagaccccccccgccuggcagaaccccgucgccuggcagaaccccgucaucuggcccaaccccgucaucuggcagaaccccgucaucuggcccaaccccaucgucuggcccggccccgucgucuggcccaacccccucgccuggcagaacccccccggcuggcagaccccccccggcuggcagaccccccccggcuggcagggcccccccgacuggcagggcccccccgacuggccccucccccccgacuggccccucccccccgacuggccccuccccaccgacuggccccucccccccgacuggauccccgccgacuggcccaucccccccgacuggcagaaccuccgccccucccccaaccuccgccccucccccaacucccgcgccucccagaaccccggcgccgcccagccccgcgacgucgcccuccuccaggagcgcgccaacaagcucgucaaguaccucaugcucaaggacuacaccaagguccccaucaagcgcuccgagaugcuccgcgacaucauccgcgaguacaccgacgucuaccccgagaucaucgagcgcgccugcuucguccucgagaagaaguucggcauccagcucaaggagaucgacaaggaggagcaccucuacauccucaucuccacccccgagucccucgccggcauccucggcaccaccaaggacacccccaagcucggccuccuccucgucauccucggcgucaucuucaugaacggcaaccgcgccuccgaggccguccucugggaggcccuccgcaagaugggccuccgccccggcguccgccacccccuccucggcgaccuccgcaagcuccucaccuacgaguucgucaagcagaaguaccucgacuaccgccgcguccccaacuccaacccccccgaguacgaguuccucuggggccuccgcuccuaccacgagaccuccaagaugaagguccuccgcuucaucgccgagguccagaagcgcgacccccgcgacuggaccgcccaguucauggaggccgccgacgaggcccucgacgcccucgacgccgccgccgccgaggccgaggcccgcgccgaggcccgcacccgcaugggcaucggcgacgaggccgucuccggccccugguccugggacgacaucgaguucgagcuccucaccugggacgaggagggcgacuucggcgaccccuggucccgcauccccuucaccuucugggcccgcuaccaccagaacgcccgcucccgcuucccccagaccuucgccggccccaucaucggccccggcggcaccgccuccgccaacuucgccgccaacuucggcgccaucggcuucuucugggucgaguga

SEQ ID NO: 45664 - RNA, 1821 nt, Artificial Sequence
  derived and/or modified sequence opt2 from MAGED2__Homo_sapiens__NP_055414
auguccgacaccuccgaguccggcgccggccucacccgcuuccaggccgaggccuccgagaaggacuccuccuccaugaugcagacccuccucaccgucacccagaacgucgagguccccgagacccccaaggccuccaaggcccucgaggucuccgaggacgucaaggucuccaaggccuccggcgucuccaaggccaccgaggucuccaagacccccgaggcccgcgaggcccccgccacccaggccuccuccaccacccagcucaccgacacccagguccucgccgccgagaacaagucccucgccgccgacaccaagaagcagaacgccgacccccaggccgucaccaugcccgccaccgagaccaagaaggucucccacgucgccgacaccaaggucaacaccaaggcccaggagaccgaggccgcccccucccaggcccccgccgacgagcccgagcccgaguccgccgccgcccagucccaggagaaccaggacacccgccccaaggucaaggccaagaaggcccgcaaggucaagcaccucgacggcgaggaggacggcuccuccgaccagucccaggccuccggcaccaccggcggccgccgcgucuccaaggcccucauggccuccauggcccgccgcgccucccgcggccccaucgccuucugggcccgccgcgccucccgcacccgccucgccgccugggcccgccgcgcccuccucucccuccgcucccccaaggcccgccgcggcaaggcccgccgccgcgccgccaagcuccaguccucccaggagcccgaggccccccccccccgcgacgucgcccuccuccagggccgcgccaacgaccucgucaaguaccuccucgccaaggaccagaccaagauccccaucaagcgcuccgacaugcucaaggacaucaucaaggaguacaccgacgucuaccccgagaucaucgagcgcgccggcuacucccucgagaaggucuucggcauccagcucaaggagaucgacaagaacgaccaccucuacauccuccucuccacccucgagcccaccgacgccggcauccucggcaccaccaaggacucccccaagcucggccuccucaugguccuccucuccaucaucuucaugaacggcaaccgcuccuccgaggccgucaucugggagguccuccgcaagcucggccuccgccccggcauccaccacucccucuucggcgacgucaagaagcucaucaccgacgaguucgucaagcagaaguaccucgacuacgcccgcguccccaacuccaacccccccgaguacgaguucuucuggggccuccgcuccuacuacgagaccuccaagaugaagguccucaaguucgccugcaagguccagaagaaggaccccaaggagugggccgcccaguaccgcgaggccauggaggccgaccucaaggccgccgccgaggccgccgccgaggccaaggcccgcgccgagauccgcgcccgcaugggcaucggccucggcuccgagaacgccgccggccccugcaacugggacgaggccgacaucggccccugggccaaggcccgcauccaggccggcgccgaggccaaggccaaggcccaggaguccggcuccgccuccaccggcgccuccaccuccaccaacaacuccgccuccgccuccgccuccaccuccggcggcuucuccgccggcgccucccucaccgccacccucaccuucggccucuucgccggccucggcggcgccggcgccuccaccuccggcuccuccggcgccugcggcuucuccuacaaguga

SEQ ID NO: 45665 - RNA, 2226 nt, Artificial Sequence
  derived and/or modified sequence opt2 from MAGED4B__Homo_sapiens__NP_110428
auggccgagggcuccuucuccguccaguccgaguccuacuccgucgaggacauggacgagggcuccgacgaggucggcgaggaggagauggucgagggcaacgacuacgaggaguucggcgccuucggcggcuacggcacccucaccuccuucgacauccacauccuccgcgccuucggcucccucggccccggccuccgcauccucuccaacgagcccugggagcucgagaaccccguccucgcccagacccucgucgaggcccuccagcucgaccccgagacccucgccaacgagaccgccgcccgcgccgccaacgucgcccgcgccgccgccuccaaccgcgccgcccgcgccgccgccgccgccgcccgcaccgccuucucccaggucgucgccucccaccgcgucgccaccccccaggucuccggcgaggacacccagcccaccaccuacgccgccgaggcccagggccccacccccgagcccccccucgccuccccccagaccucccagaugcucgucaccuccaagauggccgcccccgaggcccccgccaccuccgcccagucccagaccggcucccccgcccaggaggccgccaccgagggccccuccuccgccugcgccuucucccaggcccccugcgcccgcgaggucgacgccaaccgccccuccaccgccuuccucggccagaacgacgucuucgacuucacccagcccgccggcgucuccggcauggccuucccccgccccaagcgccccgcccccgcccaggaggccgccaccgagggccccuccgccgccuccggcgucccccagaccggccccggccgcgaggucgccgccacccgccccaagaccaccaaguccggcaaggcccucgccaagacccgcugggucgagccccagaacgucgucgccgccgccgccgccaaggccaagauggccaccuccauccccgagcccgagggcgccgccgccgccaccgcccagcacuccgccgagcccugggcccgcaugggcggcaagcgcaccaagaaguccaagcaccucgacgacgaguacgaguccuccgaggaggagcgcgagacccccgccgucccccccaccuggcgcgccucccagcccucccucaccguccgcgcccagcucgccccccgcccccccauggccccccgcucccagauccccucccgccacguccucugccuccccccccgcaacgucacccuccuccaggagcgcgccaacaagcucgucaaguaccucaugaucaaggacuacaagaagauccccaucaagcgcgccgacaugcucaaggacgucauccgcgaguacgacgagcacuuccccgagaucaucgagcgcgccaccuacacccucgagaagaaguucggcauccaccucaaggagaucgacaaggaggagcaccucuacauccucgucugcacccgcgacuccuccgcccgccuccucggcaagaccaaggacaccccccgccucucccuccuccucgucauccucggcgucaucuucaugaacggcaaccgcgccuccgaggccguccucugggaggcccuccgcaagaugggccuccgccccggcguccgccaccccuuccucggcgaccuccgcaagcucaucaccgacgacuucgucaagcagaaguaccucgaguacaagaagauccccaacuccaacccccccgaguacgaguuccucuggggccuccgcgcccgccacgagaccuccaagaugcgcguccuccgcuucaucgcccagaaccagaaccgcgacccccgcgaguggaaggcccacuuccucgaggccgucgacgacgccuucaagaccauggacgucgacauggccgaggagcacgcccgcgcccagaugcgcgcccagaugaacaucggcgacgaggcccucaucggccgcugguccugggacgacauccaggucgagcuccucaccugggacgaggacggcgacuucggcgacgccugggcccgcauccccuucgccuucugggcccgcuaccaccaguacauccucaacuccaaccgcgccaaccgccgcgccaccuggcgcgccggcgucuccuccggcaccaacggcggcgccuccaccuccguccucgacggccccuccaccuccuccaccauccgcacccgcaacgccgcccgcgccggcgccuccuucuucuccuggauccagcaccgcuga

SEQ ID NO: 45666 - RNA, 2220 nt, Artificial Sequence
  derived and/or modified sequence opt2 from MAGED4__Homo_sapiens__NP_001092270
auggccgagggcuccuucuccguccaguccgaguccuacuccgucgaggacauggacgagggcuccgacgaggucggcgaggaggagauggucgagggcaacgacuacgaggaguucggcgccuucggcggcuacggcacccucaccuccuucgacauccacauccuccgcgccuucggcucccucggccccggccuccgcauccucuccaacgagcccugggagcucgagaaccccguccucgcccagacccucgucgaggcccuccagcucgaccccgagacccucgccaacgagaccgccgcccgcgccgccaacgucgcccgcgccgccgccuccaaccgcgccgcccgcgccgccgccgccgccgcccgcaccgccuucucccaggucgucgccucccaccgcgucgccaccccccaggucuccggcgaggacacccagcccaccaccuacgccgccgaggcccagggccccacccccgagcccccccucgccuccccccagaccucccagaugcucgucaccuccaagauggccgcccccgaggcccccgccaccuccgcccagucccagaccggcucccccgcccaggaggccgccaccgagggccccuccuccgccugcgccuucucccaggcccccugcgcccgcgaggucgacgccaaccgccccuccaccgccuuccucggccagaacgacgucuucgacuucacccagcccgccggcgucuccggcauggccuucccccgccccaagcgccccgcccccgcccaggaggccgccaccgagggccccuccgccgccuccggcgucccccagaccggccccggccgcgaggucgccgccacccgccccaagaccaccaaguccggcaaggcccucgccaagacccgcugggucgagccccagaacgucgucgccgccgccgccgccaaggccaagauggccaccuccauccccgagcccgagggcgccgccgccgccaccgcccagcacuccgccgagcccugggcccgcaugggcggcaagcgcaccaagaaguccaagcaccucgacgacgaguacgaguccuccgaggaggagcgcgagacccccgccgucccccccaccuggcgcgccucccagcccucccucaccguccgcgcccagcucgccccccgcccccccauggccccccgcucccagauccccucccgccacguccucugccuccccccccgcaacgucacccuccuccaggagcgcgccaacaagcucgucaaguaccucaugaucaaggacuacaagaagauccccaucaagcgcgccgacaugcucaaggacgucauccgcgaguacgacgagcacuuccccgagaucaucgagcgcgccaccuacacccucgagaagaaguucggcauccaccucaaggagaucgacaaggaggagcaccucuacauccucgucugcacccgcgacuccuccgcccgccuccucggcaagaccaaggacaccccccgccucucccuccuccucgucauccucggcgucaucuucaugaacggcaaccgcgccuccgaggccguccucugggaggcccuccgcaagaugggccuccgccccggcguccgccaccccuuccucggcgaccuccgcaagcucaucaccgacgacuucgucaagcagaaguaccucgaguacaagaagauccccaacuccaacccccccgaguacgaguuccucuggggccuccgcgcccgccacgagaccuccaagaugcgcguccuccgcuucaucgcccagaaccagaaccgcgacccccgcgaguggaaggcccacuuccucgaggccgucgacgacgccuucaagaccauggacgucgacauggccgaggagcacgcccgcgcccagaugcgcgcccagaugaacaucggcgacgaggcccucaucggccgcugguccugggacgacauccaggucgagcuccucaccugggacgaggacggcgacuucggcgacgccugggcccgcauccccuucgccuucugggcccgcuaccaccaguacauccucaacuccaaccgcgccaaccgccgcgccaccuggcgcgccggcgucuccuccggcaccaacggcggcgccuccaccuccguccucgacggccccuccaccuccuccaccauccgcacccgcaacgccgcccgcgccggcgccuccuucuucuccuggauccaguga

SEQ ID NO: 45667 - RNA, 2874 nt, Artificial Sequence
  derived and/or modified sequence opt2 from MAGEE1__Homo_sapiens__NP_065983
augucccucgucucccagaacucccgccgccgccgccgccgcgucgccaaggccaccgcccacaacuccuccuggggcgagaugcaggcccccaacgcccccggccuccccgccgacguccccggcuccgacgucccccagggccccuccgacucccagauccuccagggccucugcgccuccgagggccccuccaccuccguccuccccaccuccgccgagggccccuccaccuucgucccccccaccaucuccgaggccuccuccgccuccggccagcccaccaucuccgagggccccggcaccuccguccuccccacccccuccgagggccucuccaccuccggcccccccaccaucuccaagggccucugcaccuccgucacccucgccgccuccgagggccgcaacaccucccgcccccccaccuccuccgaggagcccuccaccuccgucccccccaccgccuccgagguccccuccaccucccucccccccacccccggcgagggcaccuccaccuccgucccccccaccgccuacgagggccccuccaccuccgucguccccacccccgacgagggccccuccaccuccguccuccccacccccggcgagggccccggcaccuccgucccccucgccgccaccgagggccucuccaccuccguccaggccacccccgacgagggccccuccaccuccgucccccccaccgccaccgagggccucuccacccccgucccccccacccgcgacgagggccccuccaccuccguccccgccacccccggcgagggccccuccaccuccguccuccccgccgccuccgacggccaguccaucucccucguccccacccgcggcaagggcuccuccaccuccgucccccccaccgccaccgagggccucuccaccuccguccagcccaccgccggcgagggcuccuccaccuccgucccccccacccccggcggcggccucuccaccuccgucccccccaccgccaccgaggagcucuccaccuccgucccccccacccccggcgagggccccuccaccuccguccuccccauccccggcgagggccucuccaccuccgucccccccaccgccuccgacggcuccgacaccuccgucccccccacccccggcgagggcgccuccacccucguccagcccaccgcccccgacggccccggcuccuccguccuccccaaccccggcgagggccccuccacccucuucuccuccuccgccuccgucgaccgcaaccccuccaagugcucccucguccuccccuccccccgcgucaccaaggccuccgucgacuccgacuccgagggccccaagggcgccgagggccccaucgaguucgagguccuccgcgacugcgagucccccaacuccaucuccaucaugggccucaacaccucccgcgucgccaucacccucaagccccaggaccccauggagcagaacgucgccgagcuccuccaguuccuccucgucaaggaccaguccaaguaccccauccgcgaguccgagaugcgcgaguacaucgucaaggaguaccgcaaccaguuccccgagauccuccgccgcgccgccgcccaccucgagugcaucuuccgcuucgagcuccgcgagcucgaccccgaggcccacaccuacauccuccucaacaagcucggccccguccccuucgagggccucgaggagucccccaacggccccaagaugggccuccucaugaugauccucggccagaucuuccucaacggcaaccaggccaaggaggccgagaucugggagaugcucuggcgcaugggcguccagcgcgagcgccgccucuccaucuucggcaaccccaagcgccuccucuccgucgaguucgucuggcagcgcuaccucgacuaccgccccgucaccgacugcaagcccgucgaguacgaguucuucuggggcccccgcucccaccucgagaccaccaagaugaagauccucaaguucauggccaagaucuacaacaaggaccccauggacuggcccgagaaguacaacgaggcccucgaggaggacgccgcccgcgccuucgccgagggcuggcaggcccucccccacuuccgccgccccuucuucgaggaggccgccgccgagguccccucccccgacuccgaggucuccuccuacuccuccaaguacgccccccacuccuggcccgagucccgccucgaguccaaggcccgcaagcucguccagcucuuccuccucauggacuccaccaagcuccccauccccaagaagggcauccucuacuacaucggccgcgagugcuccaaggucuuccccgaccuccucaaccgcgccgcccgcacccucaaccacgucuacggcaccgagcucgucguccucgacccccgcaaccacuccuacacccucuacaaccgccgcgagauggaggagaccgaggagaucgucgacucccccaaccgccccggcaacaacuuccucaugcagguccucuccuucaucuucaucaugggcaaccacgcccgcgaguccgccgucugggccuuccuccgcggccucggcguccaggccggccgcaagcacgucaucaccugccgcuaccucucccagcgcuacaucgacucccuccgcguccccgacuccgaccccguccaguacgaguucgucuggggcccccgcgcccgccucgagaccuccaagaugaaggcccuccgcuacgucgcccgcauccaccgcaaggagccccaggacuggccccagcaguaccgcgaggccauggaggacgaggccaaccgcgccgacgucggccaccgccagaucuucguccacaacuuccgcuga

SEQ ID NO: 45668 - RNA, 660 nt, Artificial Sequence
  derived and/or modified sequence opt2 from MAGEH1__Homo_sapiens__NP_054780
augccccgcggccgcaagucccgccgccgccgcaacgcccgcgccgccgaggagaaccgcaacaaccgcaagauccaggccuccgaggccuccgagacccccauggccgccuccgucgucgccuccacccccgaggacgaccucuccggccccgaggaggaccccuccacccccgaggaggccuccaccacccccgaggaggccuccuccaccgcccaggcccagaagcccuccgucccccgcuccaacuuccagggcaccaagaagucccuccucauguccauccucgcccucaucuucaucaugggcaacuccgccaaggaggcccucgucuggaagguccucggcaagcucggcaugcagcccggccgccagcacuccaucuucggcgaccccaagaagaucgucaccgaggaguucguccgccgcggcuaccucaucuacaagcccgucccccgcuccucccccgucgaguacgaguucuucuggggcccccgcgcccacgucgaguccuccaagcucaaggucaugcacuucgucgcccgcguccgcaaccgcugcuccaaggacuggcccugcaacuacgacugggacuccgacgacgacgccgaggucgaggccauccucaacuccggcgcccgcggcuacuccgcccccuga

SEQ ID NO: 45669 - RNA, 3750 nt, Artificial Sequence
  derived and/or modified sequence opt2 from MAGEL2__Homo_sapiens__NP_061939
augucccagcucuccaagaaccucggcgacuccuccccccccgccgaggcccccaagccccccgucuacucccgccccaccguccucaugcgcgccccccccgccuccucccgcgccccccccguccccugggaccccccccccaucgaccuccaggccucccucgccgccuggcaggccccccagcccgccugggaggccccccagggccagcuccccgcccccgucguccccaugacccagccccccgcccucggcggccccaucguccccgcccccccccucggcggccccaugggcaagccccccacccccggcguccucaugguccacccccccccccccggcgcccccauggcccagccccccacccccggcguccucaugguccaccccuccgcccccggcgcccccauggcccacccccccccccccggcacccccaugucccacccccccccccccggcacccccauggcccacccccccccccccggcacccccauggcccacccccccccccccggcacccccaugguccacccccccccccccggcacccccauggcccacccccccccccccggcacccccauggcccacccccccccccccggcacccccauggcccacccccccccccccggcacccccauggcccacccccccccccccggcacccccauggcccagccccccgcccccggcguccucauggcccagccccucacccccggcguccucaugguccagcccgccgcccccggcgcccccaugguccagcccccccccgccgccaugaugacccagccccagcccuccggcgcccccauggccaagccccccggccccggcguccucaugauccacccccccggcgcccgcgcccccaugacccagccccccgccuccggcgcccccauggcccagcccgccgccccccccgcccagcccauggccccccccgcccagcccauggccuccugggccccccaggcccagccccucauccuccagauccagucccaggucauccgcgcccccccccaggucccccagggcccccaggccccccccgcccagcucgccaccccccccggcuggcaggccaccucccccggcuggcaggccacccagcagggcuggcaggccaccccccucaccuggcagaccacccaggucaccuggcaggcccccgccgucaccuggcagguccccccccccaugcgccagggccccccccccauccgccccggccccccccccauccgccccggccccccccccguccgccaggcccccccccucauccgccaggccccccccgucauccgccaggccccccccgucauccgccaggccccccccgucauccgccaggcccccgccgucauccgccaggccccccccgucauccgccaggccccccccgucauccgccaggccccccccgucauccgccaggcccccccccucauccgccaggcccccccccccauccgccccgccccccagguccucgccacccagcccccccucuggcaggcccucccccccccccccccccuccgccaggccccccaggcccgccuccccgccccccagguccaggccgccccccagguccccaccgccccccccgccacccagguccccgccgccccccccgccggcccccaggucccccagcccguccuccccgccccccucuccgccccccucuccgccccccaggccguccacugccccuccaucaucuggcaggcccccaagggccagccccccgucccccacgagauccccaccuccauggaguuccaggagguccagcagacccaggcccucgccuggcaggcccagaaggcccccacccacaucuggcagccccuccccgcccaggaggcccagcgccaggcccccccccucguccagcucgagcagcccuuccagggcgccccccccucccagaaggccguccagauccagcuccccccccagcaggcccaggccuccggcccccaggccgagguccccacccucccccuccagcccuccuggcaggccccccccgccguccuccaggcccagcccggcccccccgucgccgccgccaacuucccccucggcuccgccaagucccucaugacccccuccggcgagugccgcgccuccuccaucgaccgccgcggcuccuccaaggagcgccgcaccuccuccaaggagcgccgcgcccccuccaaggaccgcaugaucuucgccgccaccuucugcgcccccaaggccgucuccgccgcccgcgcccaccuccccgccgccuggaagaaccuccccgccacccccgagaccuucgcccccuccuccuccgucuuccccgccaccucccaguuccagcccgccucccucaacgccuucaagggccccuccgccgccuccgagacccccaagucccuccccuacgcccuccaggaccccuucgccugcgucgaggcccuccccgccguccccugggucccccagcccaacaugaacgccuccaaggccucccaggccguccccaccuuccucauggccaccgccgccgccccccaggccaccgccaccacccaggaggccuccaagaccuccgucgagcccccccgccgcuccggcaaggccacccgcaagaagaagcaccucgaggcccaggaggacucccgcggccacacccucgccuuccacgacuggcagggcccccgccccugggagaaccucaaccucuccgacugggagguccagucccccauccaggucuccggcgacugggagcaccccaacaccccccgcggccucuccggcugggagggccccuccaccucccgcauccucuccggcugggagggccccuccgccuccugggcccucuccgccugggagggccccuccaccucccgcgcccucggccucuccgagucccccggcuccucccuccccgucgucgucuccgaggucgccuccgucucccccggcuccuccgccacccaggacaacuccaaggucgaggcccagccccucuccccccucgacgagcgcgccaacgcccucguccaguuccuccucgucaaggaccaggccaagguccccguccagcgcuccgagauggucaaggucauccuccgcgaguacaaggacgagugccucgacaucaucaaccgcgccaacaacaagcucgagugcgccuucggcuaccagcucaaggagaucgacaccaagaaccacgccuacaucaucaucaacaagcucggcuaccacaccggcaaccucgucgccuccuaccucgaccgccccaaguucggccuccucauggucguccucucccucaucuucaugaagggcaacugcguccgcgaggaccucaucuucaacuuccucuucaagcucggccucgacguccgcgagaccaacggccucuucggcaacaccaagaagcucaucaccgaggucuucguccgccagaaguaccucgaguaccgccgcauccccuacaccgagcccgccgaguacgaguuccucuggggcccccgcgccuuccucgagaccuccaagaugcucguccuccgcuuccucgccaagcuccacaagaaggacccccaguccuggcccuuccacuaccucgaggcccucgccgagugcgagugggaggacaccgacgaggacgagcccgacaccggcgacuccgcccacggccccaccucccgcccccccccccgcuga

SEQ ID NO: 45670 - RNA, 1806 nt, Artificial Sequence
  derived and/or modified sequence opt2 from MAG__Homo_sapiens__NP_001186145
augcccuccuccaucuccgccuucgagggcaccugcgucuccauccccugccgcuucgacuuccccgacgagcuccgccccgccgucguccacggcgucugguacuucaacucccccuaccccaagaacuacccccccgucgucuucaagucccgcacccaggucguccacgaguccuuccagggccgcucccgccuccucggcgaccucggccuccgcaacugcacccuccuccucuccaacgucucccccgagcucggcggcaaguacuacuuccgcggcgaccucggcggcuacaaccaguacaccuucuccgagcacuccguccucgacaucgucaacacccccaacaucgucgucccccccgaggucgucgccggcaccgaggucgaggucuccugcaugguccccgacaacugccccgagcuccgccccgagcucuccuggcucggccacgagggccucggcgagcccgccguccucggccgccuccgcgaggacgagggcaccuggguccaggucucccuccuccacuucguccccacccgcgaggccaacggccaccgccucggcugccaggccuccuuccccaacaccacccuccaguucgagggcuacgccuccauggacgucaaguacccccccgucaucgucgagaugaacuccuccgucgaggccaucgagggcucccacgucucccuccucugcggcgccgacuccaacccccccccccuccucaccuggaugcgcgacggcaccguccuccgcgaggccgucgccgagucccuccuccucgagcucgaggaggucacccccgccgaggacggcgucuacgccugccucgccgagaacgccuacggccaggacaaccgcaccgucggccucuccgucauguacgcccccuggaagcccaccgucaacggcaccauggucgccgucgagggcgagaccgucuccauccucugcuccacccaguccaaccccgaccccauccucaccaucuucaaggagaagcagauccucuccaccgucaucuacgaguccgagcuccagcucgagcuccccgccgucucccccgaggacgacggcgaguacuggugcgucgccgagaaccaguacggccagcgcgccaccgccuucaaccucuccgucgaguucgcccccguccuccuccucgagucccacugcgccgccgcccgcgacaccguccagugccucugcgucgucaaguccaaccccgagcccuccgucgccuucgagcuccccucccgcaacgucaccgucaacgaguccgagcgcgaguucgucuacuccgagcgcuccggccucguccucaccuccauccucacccuccgcggccaggcccaggcccccccccgcgucaucugcaccgcccgcaaccucuacggcgccaagucccucgagcuccccuuccagggcgcccaccgccucaugugggccaagaucggccccgucggcgccgucgucgccuucgccauccucaucgccaucgucugcuacaucacccagacccgccgcaagaagaacgucaccgagucccccuccuucuccgccggcgacaacccccccguccucuucuccuccgacuuccgcaucuccggcgcccccgagaaguacgaguccgagcgccgccucggcuccgagcgccgccuccucggccuccgcggcgagccccccgagcucgaccucuccuacucccacuccgaccucggcaagcgccccaccaaggacuccuacacccucaccgaggagcucgccgaguacgccgagauccgcgucaaguga

SEQ ID NO: 45671 - RNA, 4389 nt, Artificial Sequence
  derived and/or modified sequence opt2 from MAGI1__Homo_sapiens__NP_001028229
auguccaaggucauccagaagaagaaccacuggaccucccgcguccacgagugcaccgucaagcgcggcccccagggcgagcucggcgucaccguccucggcggcgccgagcacggcgaguuccccuacgucggcgccgucgccgccgucgaggccgccggccuccccggcggcggcgagggcccccgccucggcgagggcgagcuccuccucgagguccagggcguccgcgucuccggccucccccgcuacgacguccucggcgucaucgacuccugcaaggaggccgucaccuucaaggccguccgccagggcggccgccucaacaaggaccuccgccacuuccucaaccagcgcuuccagaagggcucccccgaccacgagcuccagcagaccauccgcgacaaccucuaccgccacgccguccccugcaccacccgcuccccccgcgagggcgagguccccggcgucgacuacaacuuccucaccgucaaggaguuccucgaccucgagcaguccggcacccuccucgaggucggcaccuacgagggcaacuacuacggcacccccaagccccccucccagcccgucuccggcaaggucaucaccaccgacgcccuccacucccuccaguccggcuccaagcaguccacccccaagcgcaccaaguccuacaacgacaugcagaacgccggcaucguccacgccgagaacgaggaggaggacgacguccccgagaugaacuccuccuucaccgccgacuccggcgagcaggaggagcacacccuccaggagaccgcccucccccccgucaacuccuccaucaucgccgcccccaucaccgaccccucccagaaguucccccaguaccucccccucuccgccgaggacaaccucggcccccuccccgagaacugggagauggccuacaccgagaacggcgaggucuacuucaucgaccacaacaccaagaccaccuccuggcucgacccccgcugccucaacaagcagcagaagccccucgaggagugcgaggacgacgagggcguccacaccgaggagcucgacuccgagcucgagcuccccgccggcugggagaagaucgaggaccccgucuacggcaucuacuacgucgaccacaucaaccgcaagacccaguacgagaaccccguccucgaggccaagcgcaagaagcagcucgagcagcagcagcagcagcagcagcagcagcagcagcagcagcagcagcagcagcagcagcagaccgaggaguggaccgaggaccacuccgcccucgucccccccgucauccccaaccacccccccuccaaccccgagcccgcccgcgaggucccccuccagggcaagcccuucuucacccgcaaccccuccgagcucaagggcaaguucauccacaccaagcuccgcaaguccucccgcggcuucggcuucaccgucgucggcggcgacgagcccgacgaguuccuccagaucaagucccucguccucgacggccccgccgcccucgacggcaagauggagaccggcgacgucaucgucuccgucaacgacaccugcguccucggccacacccacgcccaggucgucaagaucuuccaguccauccccaucggcgccuccgucgaccucgagcucugccgcggcuacccccuccccuucgaccccgacgaccccaacaccucccucgucaccuccgucgccauccucgacaaggagcccaucaucgucaacggccaggagaccuacgacucccccgccucccacuccuccaagaccggcaaggucaacggcaugaaggacgcccgccccuccucccccgccgacgucgccuccaacuccucccacggcuaccccaacgacaccgucucccucgccuccuccaucgccacccagcccgagcucaucaccguccacaucgucaagggccccaugggcuucggcuucaccaucgccgacucccccggcggcggcggccagcgcgucaagcagaucgucgacuccccccgcugccgcggccucaaggagggcgaccucaucgucgaggucaacaagaagaacguccaggcccucacccacaaccaggucgucgacaugcucgucgagugccccaagggcuccgaggucacccuccucguccagcgcggcggccuccccguccccaagaagucccccaagucccagccccucgagcgcaaggacucccagaacuccucccagcacuccgucuccucccaccgcucccuccacaccgccucccccucccacuccacccagguccuccccgaguucccccccgccgaggcccaggcccccgaccagaccgacuccuccggccagaagaagcccgaccccuucaagaucugggcccagucccgcuccauguacgagaaccgccuccccgacuaccaggagcaggacaucuuccucuggcgcaaggagaccggcuucggcuuccgcauccucggcggcaacgagcccggcgagcccaucuacaucggccacaucgucccccucggcgccgccgacaccgacggccgccuccgcuccggcgacgagcucaucugcgucgacggcacccccgucaucggcaagucccaccagcucgucguccagcucaugcagcaggccgccaagcagggccacgucaaccucaccguccgccgcaaggucgucuucgccguccccaagaccgagaacgagguccccucccccgccuccucccaccacuccuccaaccagcccgccucccucaccgaggagaagcgcaccccccagggcucccagaacucccucaacaccgucuccuccggcuccggcuccaccuccggcaucggcuccggcggcggcggcggcuccggcgucgucuccaccgucguccagcccuacgacgucgagauccgccgcggcgagaacgagggcuucggcuucgucaucgucuccuccgucucccgccccgaggccggcaccaccuucggcaacgccugcgucgccaugccccacaagaucggccgcaucaucgagggcucccccgccgaccgcugcggcaagcucaaggucggcgaccgcauccucgccgucaacggcugcuccaucaccaacaagucccacuccgacaucgucaaccucaucaaggaggccggcaacaccgucacccuccgcaucauccccggcgacgaguccuccaacgccacccuccucaccaacgccgagaagaucgccaccaucaccaccacccacacccccucccagcagggcacccaggagacccgcaacaccaccaagcccaagcaggagucccaguucgaguucaaggccccccaggccacccaggagcaggacuucuacaccgucgagcucgagcgcggcgccaagggcuucggcuucucccuccgcggcggccgcgaguacaacauggaccucuacguccuccgccucgccgaggacggccccgccgagcgcugcggcaagaugcgcaucggcgacgagauccucgagaucaacggcgagaccaccaagaacaugaagcacucccgcgccaucgagcucaucaagaacggcggccgccgcguccgccucuuccucaagcgcggcgacggcuccguccccgaguacgaccccuccuccgaccgccacggccccgccaccggcccccagggcguccccgagguccgcgccggccccgaccgccgccagcaccccucccucgaguccuccuacccccccgaccuccacaaguccuccccccacggcgagaagcgcgcccacgcccgcgaccccaagggcucccgcgaguacucccgccagcccaacgagcaccacaccuggaacggcaccucccgcaagcccgacuccggcgccugccgccccaaggaccgcgcccccgagggccgccgcgacgcccaggccgagcgcgccgccgccgccaacggccccaagcgccgcucccccgagaagcgccgcgagggcacccgcuccgccgacaacacccucgagcgccgcgagaagcacgagaagcgccgcgacgucucccccgagcgccgccgcgagcgcucccccacccgccgccgcgacggcucccccucccgccgccgccgcucccucgagcgccuccucgagcagcgccgcucccccgagcgccgccgcggcggcucccccgagcgccgcgccaaguccaccgaccgccgccgcgcccgcucccccgagcgccgccgcgagcgcucccucgacaagcgcaaccgcgaggaccgcgccucccaccgcgagcgcgaggaggccaaccucaagcaggacgccggccgcuccucccgccacccccccgagcagcgccgccgccccuacaaggagugcuccaccgaccucuccaucuga

SEQ ID NO: 45672 - RNA, 4326 nt, Artificial Sequence
  derived and/or modified sequence opt2 from MAGI2__Homo_sapiens__NP_001288057
auguccaagucccucaagaagaagucccacuggaccuccaagguccacgaguccgucaucggccgcaaccccgagggccagcucggcuucgagcucaagggcggcgccgagaacggccaguuccccuaccucggcgaggucaagcccggcaaggucgccuacgaguccggcuccaagcucgucuccgaggagcuccuccucgaggucaacgagacccccgucgccggccucaccauccgcgacguccucgccgucaucaagcacugcaaggacccccuccgccucaagugcgucaagcagggcggcaucgucgacaaggaccuccgccacuaccucaaccuccgcuuccagaagggcuccgucgaccacgagcuccagcagaucauccgcgacaaccucuaccuccgcaccguccccugcaccacccgcccccacaaggagggcgagguccccggcgucgacuacaucuucaucaccgucgaggacuucauggagcucgagaaguccggcgcccuccucgaguccggcaccuacgaggacaacuacuacggcacccccaagccccccgccgagcccgccccccuccuccucaacgucaccgaccagauccuccccggcgccacccccuccgccgagggcaagcgcaagcgcaacaaguccgucuccaacauggagaaggccuccaucgagccccccgaggaggaggaggaggagcgccccgucgucaacggcaacggcgucgucgucacccccgaguccuccgagcacgaggacaaguccgccggcgccuccggcgagaugcccucccagcccuaccccgcccccgucuacucccagcccgaggagcucaaggagcagauggacgacaccaagcccaccaagcccgaggacaacgaggagcccgacccccuccccgacaacugggagauggccuacaccgagaagggcgaggucuacuucaucgaccacaacaccaagaccaccuccuggcucgacccccgccucgccaagaaggccaagccccccgaggagugcaaggagaacgagcuccccuacggcugggagaagaucgacgaccccaucuacggcaccuacuacgucgaccacaucaaccgccgcacccaguucgagaaccccguccucgaggccaagcgcaagcuccagcagcacaacaugccccacaccgagcucggcaccaagccccuccaggcccccggcuuccgcgagaagccccucuucacccgcgacgccucccagcucaagggcaccuuccucuccaccacccucaagaaguccaacaugggcuucggcuucaccaucaucggcggcgacgagcccgacgaguuccuccaggucaaguccgucauccccgacggccccgccgcccaggacggcaagauggagaccggcgacgucaucgucuacaucaacgaggucugcguccucggccacacccacgccgacgucgucaagcucuuccaguccguccccaucggccaguccgucaaccucguccucugccgcggcuacccccuccccuucgaccccgaggaccccgccaacuccaugguccccccccucgccaucauggagcgccccccccccgucauggucaacggccgccacaacuacgagaccuaccucgaguacaucucccgcaccucccaguccguccccgacaucaccgaccgccccccccacucccuccacuccaugcccaccgacggccagcucgacggcaccuaccccccccccguccacgacgacaacgucuccauggccuccuccggcgccacccaggccgagcucaugacccucaccaucgucaagggcgcccagggcuucggcuucaccaucgccgacucccccaccggccagcgcgucaagcagauccucgacauccagggcugccccggccucugcgagggcgaccucaucgucgagaucaaccagcagaacguccagaaccucucccacaccgaggucgucgacauccucaaggacugccccaucggcuccgagaccucccucaucauccaccgcggcggcuucuucucccccuggaagacccccaagcccaucauggaccgcugggagaaccagggcuccccccagaccucccucuccgcccccgccaucccccagaaccuccccuucccccccgcccuccaccgcuccuccuuccccgacuccaccgaggccuucgacccccgcaagcccgaccccuacgagcucuacgagaagucccgcgccaucuacgagucccgccgccccgacuacaaggagcucgacguccaccuccgccgcauggaguccggcuucggcuuccgcauccucggcggcgacgagcccggccagcccauccucaucggcgccgucaucgccaugggcuccgccgaccgcgacggccgccuccaccccggcgacgagcucgucuacgucgacggcauccccgucgccggcaagacccaccgcuacgucaucgaccucaugcaccacgccgcccgcaacggccaggucaaccucaccguccgccgcaagguccucugcggcggcgagcccugccccgagaacggccgcucccccggcuccgucuccacccaccacuccuccccccgcuccgacuacgccaccuacaccaacuccaaccacgccgcccccuccuccaacgccuccccccccgagggcuucgccucccacucccuccagaccuccgacgucgucauccaccgcaaggagaacgagggcuucggcuucgucaucaucuccucccucaaccgccccgaguccggcuccaccaucaccgucccccacaagaucggccgcaucaucgacggcucccccgccgaccgcugcgccaagcucaaggucggcgaccgcauccucgccgucaacggccaguccaucaucaacaugccccacgccgacaucgucaagcucaucaaggacgccggccucuccgucacccuccgcaucaucccccaggaggagcucaacucccccaccuccgcccccuccuccgagaagcagucccccauggcccagcaguccccccucgcccagcaguccccccucgcccagcccucccccgccacccccaacucccccaucgcccagcccgcccccccccagccccuccagcuccagggccacgagaacuccuaccgcuccgaggucaaggcccgccaggacgucaagcccgacauccgccagccccccuucaccgacuaccgccagcccccccucgacuaccgccagccccccggcggcgacuaccagcagccccccccccucgacuaccgccagcccccccuccucgacuaccgccagcacucccccgacacccgccaguacccccucuccgacuaccgccagccccaggacuucgacuacuucaccgucgacauggagaagggcgccaagggcuucggcuucuccauccgcggcggccgcgaguacaagauggaccucuacguccuccgccucgccgaggacggccccgccauccgcaacggccgcaugcgcgucggcgaccagaucaucgagaucaacggcgaguccacccgcgacaugacccacgcccgcgccaucgagcucaucaaguccggcggccgccgcguccgccuccuccucaagcgcggcaccggccagguccccgaguacgacgagcccgcccccugguccucccccgccgccgccgcccccggccuccccgaggucggcgucucccucgacgacggccucgcccccuucucccccucccaccccgccccccccuccgaccccucccaccagaucucccccggccccaccugggacaucaagcgcgagcacgacguccgcaagcccaaggagcucuccgccugcggccagaagaagcagcgccucggcgagcagcgcgagcgcuccgccuccccccagcgcgccgcccgcccccgccucgaggaggcccccggcggccagggccgccccgaggccggccgccccgccuccgaggcccgcgcccccggccucgccgccgccgacgccgccgacgccgcccgcgccggcggcaaggaggccccccgcgccgccgccggcuccgagcucugccgccgcgagggccccggcgccgcccccgccuucgccggccccggcggcggcggcuccggcgcccucgaggccgagggccgcgccggcgcccgcgccggcccccgccccggcccccgcccccccggcggcgcccccgcccgcaaggccgccgucgcccccggccccuggaagguccccggcuccgacaagcuccccuccguccucaagcccggcgccuccgccgccucccgcuga

SEQ ID NO: 45673 - RNA, 3762 nt, Artificial Sequence
  derived and/or modified sequence opt2 from MAGI3__Homo_sapiens__XP_011539510
auggagcgcauggacuccucccuccccgaggaggaggaggacgaggacaaggaggccaucaacggcuccggcaacgccgagaaccgcgagcgccacuccgaguccuccgacuggaugaagaccguccccuccuacaaccagaccaacuccuccauggacuuccgcaacuacaugaugcgcgacgagacccucgagccccuccccaagaacugggagauggccuacaccgacaccggcaugaucuacuucaucgaccacaacaccaagaccaccaccuggcucgacccccgccucugcaagaaggccaaggcccccgaggacugcgaggacggcgagcuccccuacggcugggagaagaucgaggacccccaguacggcaccuacuacgucgaccaccucaaccagaagacccaguucgagaaccccgucgaggaggccaagcgcaagaagcagcucggccaggucgagaucggcuccuccaagcccgacauggagaagucccacuucacccgcgaccccucccagcucaagggcguccucguccgcgccucccucaagaaguccaccaugggcuucggcuucaccaucaucggcggcgaccgccccgacgaguuccuccaggucaagaacguccucaaggacggccccgccgcccaggacggcaagaucgcccccggcgacgucaucgucgacaucaacggcaacugcguccucggccacacccacgccgacgucguccagauguuccagcucguccccgucaaccaguacgucaaccucacccucugccgcggcuacccccuccccgacgacuccgaggaccccgucgucgacaucgucgccgccacccccgucaucaacggccagucccucaccaagggcgagaccugcaugaacccccaggacuucaagcccggcgccaugguccucgagcagaacggcaaguccggccacacccucaccggcgacggccucaacggccccuccgacgccuccgagcagcgcgucuccauggccuccuccggcuccucccagcccgagcucgucaccaucccccucaucaagggccccaagggcuucggcuucgccaucgccgacucccccaccggccagaaggucaagaugauccucgacucccaguggugccagggccuccagaagggcgacaucaucaaggagaucuaccaccagaacguccagaaccucacccaccuccaggucgucgagguccucaagcaguuccccgucggcgccgacgucccccuccucauccuccgcggcggcccccccucccccaccaagaccgccaagaugaagaccgacaagaaggagaacgccggcucccucgaggccaucaacgagcccaucccccagcccaugcccuucccccccuccaucauccgcuccggcucccccaagcucgaccccuccgaggucuaccucaaguccaagacccucuacgaggacaagccccccaacaccaaggaccucgacgucuuccuccgcaagcaggaguccggcuucggcuuccgcguccucggcggcgacggccccgaccaguccaucuacaucggcgccaucaucccccucggcgccgccgagaaggacggccgccuccgcgccgccgacgagcucaugugcaucgacggcauccccgucaagggcaagucccacaagcagguccucgaccucaugaccaccgccgcccgcaacggccacguccuccucaccguccgccgcaagaucuucuacggcgagaagcagcccgaggacgacuccucccaggccuucaucuccacccagaacggcuccccccgccucaaccgcgccgagguccccgcccgccccgccccccaggagcccuacgacgucguccuccagcgcaaggagaacgagggcuucggcuucgucauccucaccuccaagaacaagcccccccccggcgucaucccccacaagaucggccgcgucaucgagggcucccccgccgaccgcugcggcaagcucaaggucggcgaccacaucuccgccgucaacggccaguccaucgucgagcucucccacgacaacaucguccagcucaucaaggacgccggcgucaccgucacccucaccgucaucgccgaggaggagcaccacggcccccccuccggcaccaacuccgcccgccagucccccgcccuccagcaccgccccaugggccagucccaggccaaccacauccccggcgaccgcuccgcccucgagggcgagaucggcaaggacgucuccaccuccuaccgccacuccugguccgaccacaagcaccucgcccagcccgacaccgccgucaucuccgucgucggcucccgccacaaccagaaccucggcugcuaccccgucgagcucgagcgcggcccccgcggcuucggcuucucccuccgcggcggcaaggaguacaacaugggccucuucauccuccgccucgccgaggacggccccgccaucaaggacggccgcauccacgucggcgaccagaucgucgagaucaacggcgagcccacccagggcaucacccacacccgcgccaucgagcucauccaggccggcggcaacaagguccuccuccuccuccgccccggcaccggccucauccccgaccacggcgacugggacaucaacaaccccuccuccuccaacgucaucuacgacgagcaguccccccucccccccuccucccacuucgccuccaucuucgaggagucccacguccccgucaucgaggagucccuccgcguccagaucugcgagaaggccgaggagcucaaggacaucguccccgagaagaaguccacccucaacgagaaccagcccgagaucaagcaccagucccuccuccagaagaacgucuccaagcgcgacccccccuccucccacggccacuccaacaagaagaaccuccucaaggucgagaacggcgucacccgccgcggccgcuccgucucccccaagaagcccgccucccagcacuccgaggagcaccucgacaagauccccuccccccucaagaacaaccccaagcgccgcccccgcgaccagucccucucccccuccaagggcgagaacaaguccugccaggucuccacccgcgccggcuccggccaggaccagugccgcaagucccgcggccgcuccgccucccccaagaagcagcagaagaucgagggcuccaaggcccccuccaacgccgaggccaagcuccucgagggcaagucccgccgcaucgccggcuacaccggcuccaacgccgagcagauccccgacggcaaggagaaguccgacgucauccgcaaggacgccaagcagaaccagcucgagaagucccgcacccgcucccccgagaagaagaucaagcgcauggucgagaagucccuccccuccaagaugaccaacaagaccaccuccaaggaggucuccgagaacgagaagggcaagaaggucaccaccggcgagaccuccuccuccaacgacaagaucggcgagaacguccagcucuccgagaagcgccucaagcaggagcccgaggagaaggucgucuccaacaagaccgaggaccacaagggcaaggagcucgaggccgccgacaagaacaaggagaccggccgcuucaagcccgaguccuccucccccgucaagaagacccucaucacccccggccccuggaagguccccuccggcaacaaggucaccggcaccaucggcauggccgagaagcgccaguga

SEQ ID NO: 45674 - RNA, 1104 nt, Artificial Sequence
  derived and/or modified sequence opt2 from MAGT1__Homo_sapiens__NP_115497
augcgcaagggcaagggccccaucugccucuucucccgccccacccuccgccccucccgcuccaaggucucccucaucgagggccgcggcgccaacauggccgcccgcuggcgcuucuggugcgucuccgucaccauggucgucgcccuccucaucgucugcgacguccccuccgccuccgcccagcgcaagaaggagaugguccucuccgagaaggucucccagcucauggaguggaccaacaagcgccccgucauccgcaugaacggcgacaaguuccgccgccucgucaaggcccccccccgcaacuacuccgucaucgucauguucaccgcccuccagcuccaccgccagugcgucgucugcaagcaggccgacgaggaguuccagauccucgccaacuccuggcgcuacuccuccgccuucaccaaccgcaucuucuucgccauggucgacuucgacgagggcuccgacgucuuccagaugcucaacaugaacuccgcccccaccuucaucaacuuccccgccaagggcaagcccaagcgcggcgacaccuacgagcuccagguccgcggcuucuccgccgagcagaucgcccgcuggaucgccgaccgcaccgacgucaacauccgcgucauccgcccccccaacuacgccggcccccucaugcucggccuccuccucgccgucaucggcggccucgucuaccuccgccgcuccaacauggaguuccucuucaacaagaccggcugggccuucgccgcccucugcuucguccucgccaugaccuccggccagauguggaaccacauccgcggcccccccuacgcccacaagaacccccacaccggccacgucaacuacauccacggcuccucccaggcccaguucgucgccgagacccacaucguccuccucuucaacggcggcgucacccucggcaugguccuccucugcgaggccgccaccuccgacauggacaucggcaagcgcaagaucaugugcgucgccggcaucggccucgucguccucuucuucuccuggaugcucuccaucuuccgcuccaaguaccacggcuaccccuacuccuuccucauguccuga

SEQ ID NO: 45675 - RNA, 903 nt, Artificial Sequence
  derived and/or modified sequence opt2 from MAK16__Homo_sapiens__NP_115898
augcaguccgacgacgucaucugggacacccucggcaacaagcaguucugcuccuucaagauccgcaccaagacccaguccuucugccgcaacgaguacucccucaccggccucugcaaccgcuccuccugcccccucgccaacucccaguacgccaccaucaaggaggagaagggccagugcuaccucuacaugaaggucaucgagcgcgccgccuucccccgccgccucugggagcgcguccgccucuccaagaacuacgagaaggcccucgagcagaucgacgagaaccucaucuacuggccccgcuucauccgccacaagugcaagcagcgcuucaccaagaucacccaguaccucauccgcauccgcaagcucacccucaagcgccagcgcaagcucgucccccucuccaagaaggucgagcgccgcgagaagcgccgcgaggagaaggcccucaucgccgcccagcucgacaacgccaucgagaaggagcuccucgagcgccucaagcaggacaccuacggcgacaucuacaacuuccccauccacgccuucgacaaggcccucgagcagcaggaggccgaguccgacuccuccgacaccgaggagaaggacgacgacgacgacgacgaggaggacgucggcaagcgcgaguucgucgaggacggcgaggucgacgaguccgacaucuccgacuucgaggacauggacaagcucgacgccuccuccgacgaggaccaggacggcaaguccuccuccgaggaggaggaggagaaggcccucuccgccaagcacaagggcaagaugccccuccgcggcccccuccagcgcaagcgcgccuacgucgagaucgaguacgagcaggagaccgagcccgucgccaaggccaagaccaccuga

SEQ ID NO: 45676 - RNA, 1872 nt, Artificial Sequence
  derived and/or modified sequence opt2 from MAK__Homo_sapiens__NP_005897
augaaccgcuacaccaccaugcgccagcucggcgacggcaccuacggcuccguccucaugggcaaguccaacgaguccggcgagcucgucgccaucaagcgcaugaagcgcaaguucuacuccugggacgagugcaugaaccuccgcgaggucaagucccucaagaagcucaaccacgccaacgucaucaagcucaaggaggucauccgcgagaacgaccaccucuacuucaucuucgaguacaugaaggagaaccucuaccagcucaugaaggaccgcaacaagcucuuccccgaguccgucauccgcaacaucauguaccagauccuccagggccucgccuucauccacaagcacggcuucuuccaccgcgacaugaagcccgagaaccuccucugcaugggccccgagcucgucaagaucgccgacuucggccucgcccgcgagcuccgcucccagccccccuacaccgacuacgucuccacccgcugguaccgcgcccccgagguccuccuccgcuccuccgucuacuccucccccaucgacgucugggccgucggcuccaucauggccgagcucuacaugcuccgcccccucuuccccggcaccuccgaggucgacgagaucuucaagaucugccagguccucggcacccccaagaaguccgacuggcccgagggcuaccagcucgccuccuccaugaacuuccgcuucccccagugcguccccaucaaccucaagacccucauccccaacgccuccaacgaggccauccagcucaugaccgagaugcucaacugggaccccaagaagcgccccaccgccucccaggcccucaagcaccccuacuuccaggucggccagguccucggccccuccuccaaccaccucgaguccaagcagucccucaacaagcagcuccagccccucgaguccaagcccucccucgucgaggucgagcccaagccccuccccgacaucaucgaccaggucgucggccagccccagcccaagaccucccagcagccccuccagcccauccagcccccccagaaccucuccguccagcagccccccaagcagcagucccaggagaagcccccccagacccucuuccccuccaucgucaagaacaugcccaccaagcccaacggcacccucucccacaaguccggccgccgccgcuggggccagaccaucuucaaguccggcgacuccugggaggagcucgaggacuacgacuucggcgccucccacuccaagaagcccuccaugggcgucuucaaggagaagcgcaagaaggacucccccuuccgccuccccgagcccguccccuccggcuccaaccacuccaccggcgagaacaagucccuccccgccgucaccucccucaaguccgacuccgagcucuccaccgcccccaccuccaagcaguacuaccucaagcagucccgcuaccuccccggcgucaaccccaagaaggucucccucaucgccuccggcaaggagaucaacccccacaccugguccaaccagcucuuccccaagucccucggccccgucggcgccgagcucgccuucaagcgcuccaacgccggcaaccucggcuccuacgccaccuacaaccaguccggcuacauccccuccuuccucaagaaggagguccaguccgccggccagcgcauccaccucgccccccucaacgccaccgccuccgaguacaccuggaacaccaagaccggccgcggccaguucuccggccgcaccuacaaccccaccgccaagaaccucaacaucgucaaccgcgcccagcccauccccuccguccacggccgcaccgacugggucgccaaguacggcggccaccgcuga

SEQ ID NO: 45677 - RNA, 462 nt, Artificial Sequence
  derived and/or modified sequence opt2 from MAL__Homo_sapiens__NP_002362
auggcccccgccgccgccaccggcggcuccacccuccccuccggcuucuccgucuucaccacccuccccgaccuccucuucaucuucgaguucaucuucggcggccucgucuggauccucgucgccuccucccucguccccuggccccucguccagggcugggucauguucgucuccgucuucugcuucgucgccaccaccacccucaucauccucuacaucaucggcgcccacggcggcgagaccuccugggucacccucgacgccgccuaccacugcaccgccgcccucuucuaccucuccgccuccguccucgaggcccucgccaccaucaccaugcaggacggcuucaccuaccgccacuaccacgagaacaucgccgccgucgucuucuccuacaucgccacccuccucuacgucguccacgccgucuucucccucauccgcuggaaguccuccuga

SEQ ID NO: 45678 - RNA, 462 nt, Artificial Sequence
  derived and/or modified sequence opt2 from MALL__Homo_sapiens__NP_005425
auggccucccccgacccccccgccaccuccuacgcccccuccgacguccccuccggcgucgcccucuuccucaccauccccuucgccuucuuccuccccgagcucaucuucggcuuccucgucuggaccauggucgccgccacccacaucgucuacccccuccuccagggcugggucauguacgucucccucaccuccuuccucaucucccucauguuccuccucuccuaccucuucggcuucuacaagcgcuucgaguccuggcgcguccucgacucccucuaccacggcaccaccggcauccucuacauguccgccgccguccuccagguccacgccaccaucgucuccgagaagcuccucgacccccgcaucuacuacaucaacuccgccgccuccuucuucgccuucaucgccacccuccucuacauccuccacgccuucuccaucuacuaccacuga

SEQ ID NO: 45679 - RNA, 6471 nt, Artificial Sequence
  derived and/or modified sequence opt2 from MALRD1__Homo_sapiens__NP_001135780
augcucuucuuccucgaccgcaugcucgccuuccccaugaacgagaccuucugcugccucuggaucgccugcgucuucaacuccacccucgcccagcagggcaccgaguccuuccagugcgacaacggcgucucccucccccccgacuccaucugcgacuucaccgaccagugcggcgacuccuccgacgagcgccacugccucaacuacgagcgcugcgacuucgaggacggccucugccacaugacccaggaccagucccuccagcccuccuggaccaagcgcuccggcaugaucggccucuccccccccuucuacgaccacaacggcgacgucuccgcccacuuccucucccucgucucccgcgucgacuccaucuccuccucccuccgcucccgcgucuuccuccccaccaacgaccagcacgacugccagaucaccuucuacuacuucuccugccaggucuccggcaagcucauggucggccuccagaccgccugcggcggccccauccagcaccucuggcagaacaccgccgcccuccccaaccagugggagcgcaacgucaucaagauccaguccucccagcgcuuccaggucgucuucgagggccagauggccuccaccuacgagcaggacgaggucaucgccaucgacgacaucuccuucuccuccggcugccuccccgccaacgacggcauccuccucugccaggaggcccucaacgccgagcgcgagcucugccaccccgacaccgaccucugccgcuucgacgccaccgacgaggagcuccgccucugccaggccugcggcuucgaguucgacaugugcgaguggaccuccgaggccuccgccggccagaucuccuggaugcgcaccaaggcccgcgagauccccgccuucgaguccaccccccagcaggaccagggcggcgacgacgagggcuacuacgucugggucggcgccaagcacggcuucacccucaaccaccucgacucccgcgccuaccucaacuccuccgucugccacugccucggcaaguccugccaccuccaguucuacuacgccauggaguccuccguccuccgcguccgccucuacaacaacaaggaggaggagaucuucuggaccuacaacaucuccacccacucccagugggucaaggccgacguccucauccccgaggaccucaagaccuucaagaucaucuucgagggcacccuccucucccagcgcuccuucaucgcccucgaccaccucugggucuacgccugcggccagacccagucccgcaagcucugcuccgccgacgaguuccccugcaccuccggccagugcaucgccaaggaguccgucugcgacucccgccaggacugcuccgacgaguccgacgaggaccccgccaccugcuccaagcaccucaccugcgacuucgaguccggcuucugcggcugggagcccuuccucaccgaggacucccacuggaagcucaugaagggccucaacaacggcgagcaccacuuccccgccgccgaccacaccgccaacaucaaccacggcuccuucaucuaccucgaggcccagcgcucccccggcgucgccaagcucggcucccccguccucaccaagcuccucaccgccuccacccccugccagguccaguucugguaccaccucucccagcacuccaaccucuccgucuucacccgcaccucccucgacggcaaccuccagaagcagggcaagaucauccgcuucuccgagucccaguggucccacgccaagaucgaccucaucgccgaggccggcgaguccacccuccccuuccagcucauccucgaggccaccguccucuccuccaacgccaccgucgcccucgacgacaucuccgucucccaggagugcgagaucuccuacaagucccucccccgcaccuccacccaguccaaguucuccaagugcgacuucgaggccaacuccugcgacugguucgaggccaucuccggcgaccacuucgacuggauccgcuccucccaguccgagcucuccgccgacuucgagcaccaggcccccccccgcgaccacucccucaacgccucccagggccacuucauguucauccucaagaaguccuccucccucuggcaggucgccaagcuccagucccccaccuucucccagaccggccccggcugcauccucuccuucugguucuacaacuacggccucuccgucggcgccgccgagcuccagcuccacauggagaacucccacgacuccaccgucaucuggcgcguccucuacaaccagggcaagcaguggcucgaggccaccauccagcucggccgccucucccagcccuuccaccucucccucgacaaggucucccucggcaucuacgacggcgucuccgccaucgacgacauccgcuucgagaacugcacccucccccuccccgccgaguccugcgagggccucgaccacuucuggugccgccacacccgcgccugcaucgagaagcuccgccucugcgaccucgucgacgacugcggcgaccgcaccgacgaggucaacugcgcccccgagcuccagugcaacuucgagaccggcaucugcaacugggagcaggacgccaaggacgacuucgacuggacccgcucccagggccccacccccacccucaacaccggccccaugaaggacaacacccucggcaccgccaagggccacuaccucuacaucgaguccuccgagccccaggccuuccaggacuccgccgcccuccucucccccauccucaacgccaccgacaccaagggcugcaccuuccgcuucuacuaccacauguucggcaagcgcaucuaccgccucgccaucuaccagcgcaucugguccgacucccgcggccagcuccucuggcagaucuucggcaaccagggcaaccgcuggauccgcaagcaccucaacaucuccucccgccagcccuuccagauccucgucgaggccuccgucggcgacggcuucaccggcgacaucgccaucgacgaccucuccuucauggacugcacccucuaccccggcaaccuccccgccgaccuccccaccccccccgagaccuccguccccgucacccuccccccccacaacugcaccgacaacgaguucaucugccgcuccgacggccacugcaucgagaagaugcagaagugcgacuucaaguacgacugccccgacaaguccgacgaggccuccugcgucauggaggucugcuccuucgagaagcgcucccucugcaagugguaccagcccauccccguccaccuccuccaggacuccaacaccuuccgcuggggccucggcaacggcaucuccauccaccacggcgaggagaaccaccgccccuccgucgaccacacccagaacaccaccgacggcugguaccucuacgccgacuccuccaacggcaaguucggcgacaccgccgacauccucacccccaucaucucccucaccggccccaagugcacccucgucuucuggacccacaugaacggcgccaccgucggcucccuccagguccucaucaagaaggacaacgucaccuccaagcucugggcccagaccggccagcagggcgcccaguggaagcgcgccgaggucuuccucggcauccgcucccacacccagaucgucuuccgcgccaagcgcggcaucuccuacaucggcgacgucgccgucgacgacaucuccuuccaggacugcuccccccuccucucccccgagcgcaagugcaccgaccacgaguucaugugcgccaacaagcacugcaucgccaaggacaagcucugcgacuucgucaacgacugcgccgacaacuccgacgagaccaccuucaucugccgcaccuccuccggccgcugcgacuucgaguucgaccucugcuccuggaagcaggagaaggacgaggacuucgacuggaaccucaaggccuccuccauccccgccgccggcaccgagcccgccgccgaccacacccucggcaacuccuccggccacuacaucuucaucaagucccucuucccccagcagcccaugcgcgccgcccgcaucuccucccccgucaucuccaagcgcuccaagaacugcaagaucaucuuccacuaccacauguacggcaacggcaucggcgcccucacccucaugcaggucuccgucaccaaccagaccaagguccuccucaaccucaccgucgagcagggcaacuucuggcgccgcgaggagcucucccucuucggcgacgaggacuuccagcucaaguucgagggccgcgucggcaagggccagcgcggcgacaucgcccucgacgacaucguccucaccgagaacugccucucccuccacgacuccguccaggaggagcucgccgucccccuccccaccggcuucugcccccucggcuaccgcgagugccacaacggcaagugcuaccgccucgagcaguccugcaacuucgucgacaacugcggcgacaacaccgacgagaacgagugcggcuccuccugcaccuucgagaagggcuggugcggcuggcagaacucccaggccgacaacuucgacuggguccucggcgucggcucccaccagucccuccgcccccccaaggaccacacccucggcaacgagaacggccacuucauguaccucgaggccaccgccgucggccuccgcggcgacaaggcccacuuccgcuccaccauguggcgcgaguccuccgccgccugcaccauguccuucugguacuucgucuccgccaaggccaccggcuccauccagauccucaucaagaccgagaagggccucuccaaggucuggcaggaguccaagcagaaccccggcaaccacuggcagaaggccgacauccuccucggcaagcuccgcaacuucgaggucaucuuccagggcauccgcacccgcgaccucggcggcggcgccgccaucgacgacaucgaguucaagaacugcaccaccgucggcgagaucuccgagcucugccccgagaucaccgacuuccucugccgcgacaagaagugcaucgccucccaccuccucugcgacuacaagcccgacugcuccgaccgcuccgacgaggcccacugcgcccacuacaccuccaccaccggcuccugcaacuucgagaccuccuccggcaacuggaccaccgccugcucccucacccaggacuccgaggacgaccucgacugggccaucggcucccgcauccccgccaaggcccucauccccgacuccgaccacacccccggcuccggccagcacuuccucuacgucaacuccuccggcuccaaggagggcuccgucgcccgcaucaccaccuccaaguccuuccccgccucccucggcaugugcaccguccgcuucugguucuacaugaucgacccccgcuccaugggcauccucaaggucuacaccaucgaggaguccggccucaacauccucgucugguccgucaucggcaacaagcgcaccggcuggaccuacggcuccgucccccucuccuccaacucccccuucaaggucgccuucgaggccgaccucgacggcaacgaggacaucuucaucgcccucgacgacaucuccuucacccccgagugcgucaccggcggccccguccccguccagcccucccccugcgaggccgaccaguucuccugcaucuacacccuccagugcgucccccucuccggcaagugcgacggccacgaggacugcaucgacggcuccgacgagauggacugcccccucucccccacccccccccucugcuccaacauggaguuccccugcuccaccgacgagugcauccccucccuccuccucugcgacggcguccccgacugccacuucaacgaggacgagcucaucugcuccaacaaguccugcuccaacggcgcccucgucugcgccuccuccaacuccugcauccccgcccaccagcgcugcgacggcuucgccgacugcauggacuuccagcucgacgaguccuccugcuccgagugcccccucaacuacugccgcaacggcggcaccugcgucgucgagaagaacggccccaugugccgcugccgccagggcuggaagggcaaccgcugccacaucaaguucaacccccccgccaccgacuucaccuacgcccagaacaacaccuggacccuccucggcaucggccucgccuuccucaugacccacaucaccgucgccguccucugcuuccucgccaaccgcaagguccccauccgcaagaccgagggcuccggcaacugcgccuucgucaaccccgucuacggcaacugguccaaccccgagaagaccgaguccuccgucuacuccuucuccaacccccucuacggcaccaccuccggcucccucgagacccucucccaccaccucaaguga

SEQ ID NO: 45680 - RNA, 2475 nt, Artificial Sequence
  derived and/or modified sequence opt2 from MALT1__Homo_sapiens__NP_006776
augucccuccucggcgacccccuccaggcccucccccccuccgccgcccccaccggcccccuccucgccccccccgccggcgccacccucaaccgccuccgcgagccccuccuccgccgccucuccgagcuccucgaccaggcccccgagggccgcggcuggcgccgccucgccgagcucgccggcucccgcggccgccuccgccucuccugccucgaccucgagcagugcucccucaagguccucgagcccgagggcucccccucccucugccuccucaagcucaugggcgagaagggcugcaccgucaccgagcucuccgacuuccuccaggccauggagcacaccgagguccuccagcuccucuccccccccggcaucaagaucaccgucaaccccgaguccaaggccguccucgccggccaguucgucaagcucugcugccgcgccaccggccaccccuucguccaguaccagugguucaagaugaacaaggagauccccaacggcaacaccuccgagcucaucuucaacgccguccacgucaaggacgccggcuucuacgucugccgcgucaacaacaacuucaccuucgaguucucccaguggucccagcucgacgucugcgacauccccgaguccuuccagcgcuccgucgacggcgucuccgaguccaagcuccagaucugcgucgagcccaccucccagaagcucaugcccggcuccacccucguccuccagugcgucgccgucggcucccccaucccccacuaccagugguucaagaacgagcucccccucacccacgagaccaagaagcucuacaugguccccuacgucgaccucgagcaccagggcaccuacuggugccacgucuacaacgaccgcgacucccaggacuccaagaaggucgagaucaucaucggccgcaccgacgaggccgucgagugcaccgaggacgagcucaacaaccucggccaccccgacaacaaggagcagaccaccgaccagccccucgccaaggacaaggucgcccuccucaucggcaacaugaacuaccgcgagcaccccaagcucaaggccccccucgucgacgucuacgagcucaccaaccuccuccgccagcucgacuucaaggucgucucccuccucgaccucaccgaguacgagaugcgcaacgccgucgacgaguuccuccuccuccucgacaagggcgucuacggccuccucuacuacgccggccacggcuacgagaacuucggcaacuccuucaugguccccgucgacgcccccaaccccuaccgcuccgagaacugccucugcguccagaacauccucaagcucaugcaggagaaggagaccggccucaacgucuuccuccucgacaugugccgcaagcgcaacgacuacgacgacaccauccccauccucgacgcccucaaggucaccgccaacaucgucuucggcuacgccaccugccagggcgccgaggccuucgagauccagcacuccggccucgccaacggcaucuucaugaaguuccucaaggaccgccuccucgaggacaagaagaucaccguccuccucgacgaggucgccgaggacaugggcaagugccaccucaccaagggcaagcaggcccucgagauccgcuccucccucuccgagaagcgcgcccucaccgaccccauccagggcaccgaguacuccgccgagucccucguccgcaaccuccagugggccaaggcccacgagcuccccgaguccaugugccucaaguucgacugcggcguccagauccagcucggcuucgccgccgaguucuccaacgucaugaucaucuacaccuccaucgucuacaagccccccgagaucaucaugugcgacgccuacgucaccgacuucccccucgaccucgacaucgaccccaaggacgccaacaagggcacccccgaggagaccggcuccuaccucgucuccaaggaccuccccaagcacugccucuacacccgccucuccucccuccagaagcucaaggagcaccucgucuucaccgucugccucuccuaccaguacuccggccucgaggacaccgucgaggacaagcaggaggucaacgucggcaagccccucaucgccaagcucgacaugcaccgcggccucggccgcaagaccugcuuccagaccugccucauguccaacggccccuaccaguccuccgccgccaccuccggcggcgccggccacuaccacucccuccaggaccccuuccacggcgucuaccacucccaccccggcaaccccuccaacgucacccccgccgacuccugccacugcucccgcacccccgacgccuucaucuccuccuucgcccaccacgccuccugccacuucucccgcuccaacguccccgucgagaccaccgacgagauccccuucuccuucuccgaccgccuccgcaucuccgagaaguga

SEQ ID NO: 45681 - RNA, 3051 nt, Artificial Sequence
  derived and/or modified sequence opt2 from MAML1__Homo_sapiens__NP_055572
augguccuccccaccugccccauggccgaguucgcccucccccgccacuccgccgucauggagcgccuccgccgccgcaucgagcucugccgccgccaccacuccaccugcgaggcccgcuacgaggccgucucccccgagcgccucgagcucgagcgccagcacaccuucgcccuccaccagcgcugcauccaggccaaggccaagcgcgccggcaagcaccgccagccccccgccgccaccgcccccgcccccgccgcccccgccccccgccucgacgccgccgacggccccgagcacggccgccccgccacccaccuccacgacaccgucaagcgcaaccucgacuccgccaccuccccccagaacggcgaccagcagaacggcuacggcgaccucuuccccggccacaagaagacccgccgcgaggccccccucggcgucgccaucuccuccaacggccucccccccgccuccccccucggccaguccgacaagcccuccggcgccgacgcccuccaguccuccggcaagcacucccucggccucgacucccucaacaagaagcgccucgccgacuccucccuccaccucaacggcggcuccaaccccuccgaguccuucccccucucccucaacaaggagcucaagcaggagcccgucgaggaccuccccugcaugaucaccggcaccgucggcuccaucucccaguccaaccucaugcccgaccucaaccucaacgagcaggaguggaaggagcucaucgaggagcucaaccgcuccguccccgacgaggacaugaaggaccucuucaacgaggacuucgaggagaagaaggaccccgaguccuccggcuccgccacccagaccccccucgcccaggacaucaacaucaagaccgaguucucccccgccgccuucgagcaggagcagcucggcuccccccagguccgcgccggcuccgccggccagaccuuccucggccccuccuccgcccccgucuccaccgacucccccucccucggcggcucccagacccucuuccacaccuccggccagccccgcgccgacaaccccucccccaaccucaugcccgccuccgcccaggcccagaacgcccagcgcgcccucgccggcgucguccuccccucccagggccccggcggcgccuccgagcucuccuccgcccaccagcuccagcagaucgccgccaagcagaagcgcgagcagaugcuccagaacccccagcaggccacccccgcccccgcccccggccagauguccaccuggcagcagaccggccccucccacuccucccucgacguccccuaccccauggagaagcccgccucccccuccuccuacaagcaggacuucaccaacuccaagcuccucaugaugcccuccgucaacaaguccuccccccgccccggcggccccuaccuccagcccucccacgucaaccuccucucccaccagccccccuccaaccucaaccagaacuccgccaacaaccagggcuccguccucgacuacggcaacaccaagccccucucccacuacaaggccgacugcggccagggcucccccggcuccggccaguccaagcccgcccucauggccuaccucccccagcagcucucccacaucucccacgagcagaacucccucuuccucaugaagcccaagcccggcaacaugcccuuccgcucccucgucccccccggccaggagcagaaccccuccuccguccccguccaggcccaggccaccuccgucggcacccagccccccgccgucuccgucgccuccucccacaacuccucccccuaccucuccucccagcagcaggccgccgucaugaagcagcaccagcuccuccucgaccagcagaagcagcgcgagcagcagcagaagcaccuccagcagcagcaguuccuccagcgccagcagcaccuccucgccgagcaggagaagcagcaguuccagcgccaccucacccgcccccccccccaguaccaggaccccacccagggcuccuucccccagcaggucggccaguucaccggcuccuccgccgccguccccggcaugaacacccucggccccuccaacuccuccugcccccgcgucuucccccaggccggcaaccucaugcccaugggccccggccacgccuccgucuccucccuccccaccaacuccggccagcaggaccgcggcgucgcccaguuccccggcucccagaacaugccccaguccucccucuacggcauggccuccggcaucacccagaucgucgcccagccccccccccaggccaccaacggccacgcccacaucccccgccagaccaacgucggccagaacaccuccgucuccgccgccuacggccagaacucccucggcuccuccggccucucccagcagcacaacaagggcacccucaaccccggccucaccaagccccccgucccccgcgucucccccgccaugggcggccagaacuccuccuggcagcaccagggcaugcccaaccucuccggccagacccccggcaacuccaacgucucccccuucaccgccgccuccuccuuccacaugcagcagcaggcccaccucaagauguccuccccccaguucucccaggccguccccaaccgccccauggcccccauguccuccgccgccgccgucggcucccuccucccccccgucuccgcccagcagcgcaccuccgcccccgcccccgcccccccccccaccgccccccagcagggccuccccggccucucccccgccggccccgagcucggcgccuucucccagucccccgccucccagaugggcggccgcgccggccuccacugcacccaggccuaccccguccgcaccgccggccaggagcuccccuucgccuacuccggccagcccggcggcuccggccucuccuccgucgccggccacaccgaccucaucgacucccuccucaagaaccgcaccuccgaggaguggauguccgaccucgacgaccuccucggcucccaguga

SEQ ID NO: 45682 - RNA, 3471 nt, Artificial Sequence
  derived and/or modified sequence opt2 from MAML2__Homo_sapiens__NP_115803
augggcgacaccgcccccccccaggcccccgccggcggccucggcggcgccuccggcgccggccuccucggcggcggcuccgucaccccccgcguccacuccgccaucgucgagcgccuccgcgcccgcaucgccgucugccgccagcaccaccucuccugcgagggccgcuacgagcgcggccgcgccgaguccuccgaccgcgagcgcgaguccacccuccagcuccucucccucguccagcacggccagggcgcccgcaaggccggcaagcacaccaaggccaccgccaccgccgccaccaccaccgcccccccccccccccccgccgccccccccgccgccucccaggccgccgccaccgccgcccccccccccccccccgacuaccaccaccaccaccagcagcaccuccucaacuccuccaacaacggcggcuccggcggcaucaacggcgagcagcagccccccgccuccacccccggcgaccagcgcaacuccgcccucaucgcccuccagggcucccucaagcgcaagcaggucgucaaccucucccccgccaacuccaagcgccccaacggcuucgucgacaacuccuuccucgacaucaagcgcauccgcgucggcgagaaccucuccgccggccagggcggccuccagaucaacaacggccagucccagaucauguccggcacccuccccaugucccaggccccccuccgcaagaccaacacccuccccucccacacccacucccccggcaacggccucuucaacaugggccucaaggaggucaagaaggagcccggcgagacccucuccugcuccaagcacauggacggccagaugacccaggagaacaucuuccccaaccgcuacggcgacgaccccggcgagcagcucauggaccccgagcuccaggagcucuucaacgagcucaccaacaucuccgucccccccauguccgaccucgagcucgagaacaugaucaacgccaccaucaagcaggacgaccccuucaacaucgaccucggccagcagucccagcgcuccaccccccgccccucccuccccauggagaagaucgucaucaaguccgaguacucccccggccucacccagggccccuccggcuccccccagcuccgcccccccuccgccggccccgccuucuccauggccaacuccgcccucuccaccuccucccccauccccuccgucccccagucccaggcccagccccagaccggcuccggcgccucccgcgcccuccccuccuggcaggaggucucccacgcccagcagcucaagcagaucgccgccaaccgccagcagcacgcccgcaugcagcagcaccagcagcagcaccagcccaccaacugguccgcccuccccuccuccgccggccccucccccggccccuucggccaggagaagauccccucccccuccuucggccagcagaccuucuccccccaguccucccccaugcccggcgucgccggcggcuccggccaguccaaggucauggccaacuacauguacaaggccggccccuccgcccagggcggccaccucgacguccucaugcagcagaagccccaggaccucucccgcuccuucaucaacaacccccaccccgccauggagccccgccagggcaacaccaagccccucuuccacuucaacuccgaccaggccaaccagcagaugcccuccguccuccccucccagaacaagcccucccuccuccacuacacccagcagcagcagcagcagcagcagcagcagcagcagcagcagcagcagcagcagcagcagcagcagcagcagcagcagcagcagcagcagcagcagcagcaguccuccaucuccgcccagcagcagcagcagcagcaguccuccaucuccgcccagcagcagcagcagcagcagcagcagcagcagcagcagcagcagcagcagcagcagcagcagcagcagcagcagcagcagcccuccucccagcccgcccagucccuccccucccagccccuccuccgcuccccccucccccuccagcagaagcuccuccuccagcagaugcagaaccagcccaucgccggcaugggcuaccaggucucccagcagcagcgccaggaccagcacuccgucgucggccagaacaccggccccucccccucccccaaccccugcuccaaccccaacaccggcuccggcuacaugaacucccagcagucccuccucaaccagcagcucaugggcaagaagcagacccuccagcgccagaucauggagcagaagcagcagcuccuccuccagcagcagaugcucgccgacgccgagaagaucgccccccaggaccagaucaaccgccaccucucccgccccccccccgacuacaaggaccagcgccgcaacgucggcaacaugcagcccaccgcccaguacuccggcggcuccuccaccaucucccucaacuccaaccaggcccucgccaaccccgucuccacccacaccauccucacccccaacuccucccuccucuccaccucccacggcacccgcaugcccucccucuccaccgccguccagaacaugggcauguacggcaaccuccccugcaaccagcccaacaccuacuccgucaccuccggcaugaaccagcucacccagcagcgcaaccccaagcagcuccucgccaaccagaacaaccccaugaugccccgcccccccacccucggccccuccaacaacaacaacgucgccaccuucggcgccggcuccgucggcaacucccagcagcuccgccccaaccucacccacuccauggccuccaugcccccccagcgcaccuccaacgucaugaucaccuccaacaccaccgcccccaacugggccucccaggagggcaccuccaagcagcaggaggcccucaccuccgccggcguccgcuuccccaccggcacccccgccgccuacacccccaaccagucccuccagcaggccgucggcucccagcaguucucccagcgcgccgucgccccccccaaccagcucacccccgccguccagaugcgccccaugaaccagaugucccagacccucaacggccagaccaugggcccccuccgcggccucaaccuccgccccaaccagcucuccacccagauccuccccaaccucaaccaguccggcaccggccucaaccagucccgcaccggcaucaaccagccccccucccucacccccuccaacuuccccucccccaaccaguccucccgcgccuuccagggcaccgaccacuccuccgaccucgccuucgacuuccucucccagcagaacgacaacaugggccccgcccucaacuccgacgccgacuucaucgacucccuccucaagaccgagcccggcaacgacgacuggaugaaggacaucaaccucgacgagauccucggcaacaacuccuga

SEQ ID NO: 45683 - RNA, 3402 nt, Artificial Sequence
  derived and/or modified sequence opt2 from MAML3__Homo_sapiens__NP_061187
augggcgacuucgccgcccccgccgccgccgccaacggcuccuccaucugcaucaacuccucccucaacuccucccucggcggcgccggcaucggcgucaacaacacccccaacuccacccccgccgcccccuccuccaaccaccccgccgccggcggcugcggcggcuccggcggccccggcggcggcuccgccgccguccccaagcacuccaccgucgucgagcgccuccgccagcgcaucgagggcugccgccgccaccacgucaacugcgagaaccgcuaccagcaggcccaggucgagcagcucgagcucgagcgccgcgacaccgucucccucuaccagcgcacccucgagcagcgcgccaagaaguccggcgccggcaccggcaagcagcagcaccccuccaagccccagcaggacgccgaggccgccuccgccgagcagcgcaaccacacccucaucaugcuccaggagaccgucaagcgcaagcucgagggcgcccgcuccccccucaacggcgaccagcagaacggcgccugcgacggcaacuucucccccaccuccaagcgcauccgcaaggacaucuccgccggcauggaggccaucaacaaccuccccuccaacaugccccuccccuccgccuccccccuccaccagcucgaccucaagcccucccucccccuccagaacuccggcacccacacccccggccuccucgaggaccucuccaagaacggccgccuccccgagaucaagcuccccgucaacggcugcuccgaccucgaggacuccuucaccauccuccaguccaaggaccucaagcaggagccccucgacgaccccaccugcaucgacaccuccgagaccucccucuccaaccagaacaagcucuucuccgacaucaaccucaacgaccaggaguggcaggagcucaucgacgagcucgccaacaccguccccgaggacgacauccaggaccucuucaacgaggacuucgaggagaagaaggagcccgaguucucccagcccgccaccgagaccccccucucccaggaguccgccuccgucaaguccgaccccucccacucccccuucgcccacgucuccaugggcuccccccaggcccgccccuccuccuccggcccccccuucuccaccgucuccaccgccaccucccuccccuccgucgccuccacccccgccgcccccaaccccgccuccucccccgccaacugcgccguccaguccccccagacccccaaccaggcccacacccccggccaggcccccccccgccccggcaacggcuaccuccucaaccccgccgccgucaccgucgccggcuccgccuccggccccgucgccguccccuccuccgacaugucccccgccgagcagcucaagcagauggccgcccagcagcagcagcgcgccaagcucaugcagcagaagcagcagcagcagcagcagcagcagcagcagcagcagcagcagcagcagcagcagcagcagcagcacuccaaccagaccuccaacugguccccccucggcccccccuccucccccuacggcgccgccuucaccgccgagaagcccaacucccccaugauguacccccaggccuucaacaaccagaaccccaucgucccccccauggccaacaaccuccagaagaccaccaugaacaacuaccucccccagaaccacaugaacaugaucaaccagcagcccaacaaccucggcaccaacucccucaacaagcagcacaacauccucaccuacggcaacaccaagccccucacccacuucaacgccgaccucucccagcgcaugaccccccccgucgccaaccccaacaagaacccccucaugcccuacauccagcagcagcagcagcagcagcagcagcagcagcagcagcagcagcagcagcagcccccccccccccagcuccaggccccccgcgcccaccucuccgaggaccagaagcgccuccuccucaugaagcagaagggcgucaugaaccagcccauggccuacgccgcccuccccucccacggccaggagcagcaccccgucggccucccccgcaccaccggccccaugcaguccuccgucccccccggcuccggcggcauggucuccggcgccucccccgccggccccggcuuccucggcucccagccccaggccgccaucaugaagcagaugcucaucgaccagcgcgcccagcucaucgagcagcagaagcagcaguuccuccgcgagcagcgccagcagcagcagcagcagcagcagauccucgccgagcagcagcuccagcagucccaccucccccgccagcaccuccagccccagcgcaaccccuaccccguccagcaggucaaccaguuccagggcuccccccaggacaucgccgccguccgcucccaggccgcccuccaguccaugcgcaccucccgccucauggcccagaacgccggcaugaugggcaucggccccucccagaaccccggcaccauggccaccgccgccgcccaguccgagaugggccucgcccccuacuccaccacccccaccucccagcccggcauguacaacauguccaccggcaugacccagaugcuccagcaccccaaccaguccggcauguccaucacccacaaccaggcccagggcccccgccagcccgccuccggccagggcgucggcauggucuccggcuucggccaguccaugcucgucaacuccgccaucacccagcagcacccccagaugaagggccccgucggccaggcccucccccgcccccaggcccccccccgccuccagucccucaugggcaccguccagcagggcgcccaguccuggcagcagcgcucccuccagggcaugcccggccgcaccuccggcgagcucggccccuucaacaacggcgccuccuacccccuccaggccggccagccccgccucaccaagcagcacuucccccagggccucucccaguccgucgucgacgccaacaccggcaccguccgcacccucaaccccgccgccaugggccgccagaugaugcccucccuccccggccagcagggcaccucccaggcccgccccauggucauguccggccucucccagggcguccccggcaugcccgccuucucccagccccccgcccagcagcagauccccuccggcuccuucgcccccuccucccagucccaggccuacgagcgcaacgccccccaggacgucuccuacaacuacuccggcgacggcgccggcggcuccuuccccggccuccccgacggcgccgaccucgucgacuccaucaucaagggcggccccggcgacgaguggaugcaggagcucgacgagcucuucggcaaccccuga

SEQ ID NO: 45684 - RNA, 2997 nt, Artificial Sequence
  derived and/or modified sequence opt2 from MAMLD1__Homo_sapiens__NP_001170936
auggacgacuggaagucccgccucgucaucaaguccaugcucccccacuucgccauggucggcaaccgccaggagccccgcaagcuccaggaguccggcaccgucaagcgccgccaggaggaggaccacuuccaguuccccgacauggccgacggcggcuaccccaacaagaucaagcgccccugccucgaggacgucacccucgccaugggccccggcgcccaccccuccaccgccugcgccgagcuccagguccccccccucaccaucaaccccucccccgccgccaugggcgucgccggccagucccuccuccucgagaacaaccccaugaacggcaacaucaugggcucccccuucgucgucccccagaccaccgaggucggccucaagggccccaccguccccuacuacgagaagaucaacuccguccccgccgucgaccaggagcuccaggagcuccucgaggagcucaccaagauccaggaccccucccccaacgagcucgaccucgagaagauccucggcaccaagcccgaggagccccucguccucgaccacccccaggccacccucuccaccacccccaagcccuccguccagaugucccaccucgagucccucgccuccuccaaggaguucgccuccuccugcucccaggucaccggcaugucccuccagauccccuccuccuccaccggcaucuccuacuccauccccuccaccuccaagcagaucgucucccccuccuccuccauggcccaguccaagucccagguccaggccaugcuccccgucgcccuccccccccuccccgucccccaguggcaccacgcccaccagcucaaggcccucgccgccuccaagcagggcuccgccaccaagcagcagggccccacccccuccugguccggccuccccccccccggccucuccccccccuaccgccccguccccuccccccacccccccccccucccccucccccccccccccccccccuucuccccccagucccucauggucuccugcauguccuccaacacccucuccggcuccacccuccgcggcucccccaacgcccuccucuccuccaugaccuccuccuccaacgccgcccucggccccgccaugcccuacgcccccgagaagcuccccucccccgcccucacccagcagccccaguucggcccccaguccuccauccucgccaaccucauguccuccaccaucaagaccccccagggccaccucauguccgcccuccccgccuccaaccccggccccuccccccccuaccgccccgagaagcucuccucccccggccucccccagcaguccuucaccccccagugcucccucauccgcucccucacccccaccuccaaccuccucucccagcagcagcagcagcagcagcagcagcagcaggccaacgucaucuucaagcccaucuccuccaacuccuccaagacccucuccaugaucaugcagcagggcauggccuccuccucccccggcgccaccgagcccuucaccuucggcaacaccaagccccucucccacuucgucuccgagcccggcccccagaagaugcccuccaugcccaccaccucccgccagcccucccuccuccacuaccuccagcagcccacccccacccaggccuccuccgccaccgccuccuccaccgccaccgccacccuccagcuccagcagcagcagcagcagcagcagcagcagcccgaccacuccuccuuccuccuccagcagaugaugcagcagccccagcgcuuccagcgcuccgucgccuccgacuccaugcccgcccucccccgccagcaggaggagcagcgcuccggccucauggccaugacccccgagcgccagaacgccuacaucucccagcagaugucccccuucgaggccguccaggagcaggucaccuccaagugcucccgcaucaaggccuccccccccuccuccaagcaccucaugcccccccgcaccggccuccuccagaacaaccucucccccggcaugaucccccucacccgccaccaguccugcgagggcaugggcgucaucucccccacccucggcaagcgccagggcaucuucaccuccuccccccagugccccauccucucccacuccggccagaccccccucggccgccucgacuccgucugccagcacaugcagucccccaaggccaccccccccgaggucccccuccccggcuucugccccuccucccucggcacccagucccucuccccccaccagcuccgccgccccuccgucccccgcaugcccaccgccuucaacaacgccgccugggucaccgccgccgccgccgucaccaccgccgucuccggcaagaccccccucucccaggucgacaacuccguccagcagcacucccccuccggccaggccugccuccagcgccccuccgacugggaggcccagguccccgccgccaugggcacccaggucccccucgccaacaaccccuccuucucccuccucggcucccagucccuccgccagucccccguccagggccccguccccgucgccaacaccaccaaguuccuccagcagggcauggccuccuucuccccccucucccccauccagggcaucgagccccccuccuacgucgccgccgccgccaccgccgccgccgccuccgccgucgccgccucccaguuccccggccccuucgaccgcaccgacaucccccccgagcucccccccgccgacuuccuccgccagccccagcccccccucaacgaccucaucuccucccccgacugcaacgaggucgacuucaucgaggcccuccucaagggcuccugcgucucccccgacgaggacugggucugcaaccuccgccucaucgacgacauccucgagcagcacgccgccgcccagaacgccaccgcccagaacuccggccaggucacccaggacgccggcgcccucuga

SEQ ID NO: 45685 - RNA, 1962 nt, Artificial Sequence
  derived and/or modified sequence opt2 from MAN1A1__Homo_sapiens__NP_005898
augcccgucggcggccuccucccccucuucuccucccccgccggcggcguccucggcggcggccucggcggcggcggcggccgcaagggcuccggccccgccgcccuccgccucaccgagaaguucguccuccuccucgucuucuccgccuucaucacccucugcuucggcgccaucuucuuccuccccgacuccuccaagcuccucuccggcguccucuuccacuccucccccgcccuccagcccgccgccgaccacaagcccggccccggcgcccgcgccgaggacgccgccgagggccgcgcccgccgccgcgaggagggcgcccccggcgaccccgaggccgcccucgaggacaaccucgcccgcauccgcgagaaccacgagcgcgcccuccgcgaggccaaggagacccuccagaagcuccccgaggagauccagcgcgacauccuccucgagaagaagaaggucgcccaggaccagcuccgcgacaaggcccccuuccgcggccucccccccgucgacuucgucccccccaucggcgucgagucccgcgagcccgccgacgccgccauccgcgagaagcgcgccaagaucaaggagaugaugaagcacgccuggaacaacuacaagggcuacgccuggggccucaacgagcucaagcccaucuccaagggcggccacuccuccucccucuucggcaacaucaagggcgccaccaucgucgacgcccucgacacccucuucaucauggagaugaagcacgaguucgaggaggccaaguccugggucgaggagaaccucgacuucaacgucaacgccgagaucuccgucuucgaggucaacauccgcuucgucggcggccuccucuccgccuacuaccucuccggcgaggagaucuuccgcaagaaggccgucgagcucggcgucaagcuccuccccgccuuccacacccccuccggcauccccugggcccuccucaacaugaaguccggcaucggccgcaacuggcccugggccuccggcggcuccuccauccucgccgaguucggcacccuccaccucgaguucaugcaccucucccaccucuccggcaaccccaucuucgccgagaaggucaugaacauccgcaccguccucaacaagcucgagaagccccagggccucuaccccaacuaccucaaccccuccuccggccaguggggccagcaccacgucuccgucggcggccucggcgacuccuucuacgaguaccuccucaaggccuggcucauguccgacaagaccgaccucgaggccaagaagauguacuucgacgccguccaggccaucgagacccaccucauccgcaaguccuccuccggccucaccuacaucgccgaguggaagggcggccuccucgagcacaagaugggccaccucaccugcuucgccggcggcauguucgcccucggcgccgacgccgcccccgagggcauggcccagcacuaccucgagcucggcgccgagaucgcccgcaccugccacgaguccuacaaccgcaccuucaugaagcucggccccgaggccuuccgcuucgacggcggcgucgaggccaucgccacccgccagaacgagaaguacuacauccuccgccccgaggucauggagaccuacauguacauguggcgccucacccacgaccccaaguaccgcaagugggccugggaggccgucgaggcccucgagaaccacugccgcgucaacggcggcuacuccggccuccgcgacgucuaccuccuccacgaguccuacgacgacguccagcaguccuucuuccucgccgagacccucaaguaccucuaccucaucuucuccgacgacgaccuccucccccucgagcacuggaucuucaacuccgaggcccaccuccuccccauccuccccaaggacaagaaggaggucgagauccgcgaggaguga

SEQ ID NO: 45686 - RNA, 2100 nt, Artificial Sequence
  derived and/or modified sequence opt2 from MAN1B1__Homo_sapiens__NP_057303
auggccgccugcgagggccgccgcuccggcgcccucggcuccucccaguccgacuuccucaccccccccgucggcggcgcccccugggccgucgccaccaccgucgucauguacccccccccccccccccccccccaccgcgacuucaucuccgucacccucuccuucggcgagaacuacgacaacuccaaguccuggcgccgccgcuccugcuggcgcaaguggaagcagcucucccgccuccagcgcaacaugauccucuuccuccucgccuuccuccucuucugcggccuccucuucuacaucaaccucgccgaccacuggaaggcccucgccuuccgccucgaggaggagcagaagaugcgccccgagaucgccggccucaagcccgccaacccccccguccuccccgccccccagaaggccgacaccgaccccgagaaccuccccgagaucuccucccagaagacccagcgccacauccagcgcggccccccccaccuccagauccgcccccccucccaggaccucaaggacggcacccaggaggaggccaccaagcgccaggaggcccccgucgacccccgccccgagggcgacccccagcgcaccgucaucuccuggcgcggcgccgucaucgagcccgagcagggcaccgagcuccccucccgccgcgccgagguccccaccaagcccccccucccccccgcccgcacccagggcacccccguccaccucaacuaccgccagaagggcgucaucgacgucuuccuccacgccuggaagggcuaccgcaaguucgccuggggccacgacgagcucaagcccgucucccgcuccuucuccgagugguucggccucggccucacccucaucgacgcccucgacaccauguggauccucggccuccgcaaggaguucgaggaggcccgcaagugggucuccaagaagcuccacuucgagaaggacgucgacgucaaccucuucgaguccaccauccgcauccucggcggccuccucuccgccuaccaccucuccggcgacucccucuuccuccgcaaggccgaggacuucggcaaccgccucaugcccgccuuccgcacccccuccaagauccccuacuccgacgucaacaucggcaccggcgucgcccaccccccccgcuggaccuccgacuccaccgucgccgaggucaccuccauccagcucgaguuccgcgagcucucccgccucaccggcgacaagaaguuccaggaggccgucgagaaggucacccagcacauccacggccucuccggcaagaaggacggccucguccccauguucaucaacacccacuccggccucuucacccaccucggcgucuucacccucggcgcccgcgccgacuccuacuacgaguaccuccucaagcaguggauccagggcggcaagcaggagacccagcuccucgaggacuacgucgaggccaucgagggcguccgcacccaccuccuccgccacuccgagcccuccaagcucaccuucgucggcgagcucgcccacggccgcuucuccgccaagauggaccaccucgucugcuuccuccccggcacccucgcccucggcgucuaccacggccuccccgccucccacauggagcucgcccaggagcucauggagaccugcuaccagaugaaccgccagauggagaccggccucucccccgagaucguccacuucaaccucuacccccagcccggccgccgcgacgucgaggucaagcccgccgaccgccacaaccuccuccgccccgagaccgucgagucccucuucuaccucuaccgcgucaccggcgaccgcaaguaccaggacuggggcugggagauccuccaguccuucucccgcuucacccgcguccccuccggcggcuacuccuccaucaacaacguccaggacccccagaagcccgagccccgcgacaagauggaguccuucuuccucggcgagacccucaaguaccucuuccuccucuucuccgacgaccccaaccuccucucccucgacgccuacgucuucaacaccgaggcccacccccuccccaucuggacccccgccuga

SEQ ID NO: 45687 - RNA, 3435 nt, Artificial Sequence
  derived and/or modified sequence opt2 from MAN2A1__Homo_sapiens__NP_002363
augaagcucucccgccaguucaccgucuucggcuccgccaucuucugcgucgucaucuucucccucuaccucaugcucgaccgcggccaccucgacuacccccgcaacccccgccgcgagggcuccuucccccagggccagcucuccaugcuccaggagaagaucgaccaccucgagcgccuccucgccgagaacaacgagaucaucuccaacauccgcgacuccgucaucaaccucuccgaguccgucgaggacggccccaaguccucccaguccaacuucucccagggcgccggcucccaccuccuccccucccagcucucccucuccgucgacaccgccgacugccucuucgccucccaguccggcucccacaacuccgacguccagaugcucgacgucuacucccucaucuccuucgacaaccccgacggcggcgucuggaagcagggcuucgacaucaccuacgaguccaacgagugggacaccgagccccuccaggucuucgucgucccccacucccacaacgaccccggcuggcucaagaccuucaacgacuacuuccgcgacaagacccaguacaucuucaacaacaugguccucaagcucaaggaggacucccgccgcaaguucaucugguccgagaucuccuaccucuccaaguggugggacaucaucgacauccagaagaaggacgccgucaagucccucaucgagaacggccagcucgagaucgucaccggcggcugggucaugcccgacgaggccaccccccacuacuucgcccucaucgaccagcucaucgagggccaccaguggcucgagaacaacaucggcgucaagccccgcuccggcugggccaucgaccccuucggccacucccccaccauggccuaccuccucaaccgcgccggccucucccacaugcucauccagcgcguccacuacgccgucaagaagcacuucgcccuccacaagacccucgaguucuucuggcgccagaacugggaccucggcuccgucaccgacauccucugccacaugaugcccuucuacuccuacgacaucccccacaccugcggccccgaccccaagaucugcugccaguucgacuucaagcgccuccccggcggccgcuucggcugccccuggggcgucccccccgagaccauccaccccggcaacguccagucccgcgcccgcaugcuccucgaccaguaccgcaagaaguccaagcucuuccgcaccaagguccuccucgccccccucggcgacgacuuccgcuacugcgaguacaccgagugggaccuccaguucaagaacuaccagcagcucuucgacuacaugaacucccaguccaaguucaaggucaagauccaguucggcacccucuccgacuucuucgacgcccucgacaaggccgacgagacccagcgcgacaagggccaguccauguuccccguccucuccggcgacuucuucaccuacgccgaccgcgacgaccacuacugguccggcuacuucaccucccgccccuucuacaagcgcauggaccgcaucauggagucccaccuccgcgccgccgagauccucuacuacuucgcccuccgccaggcccacaaguacaagaucaacaaguuccucuccuccucccucuacaccgcccucaccgaggcccgccgcaaccucggccucuuccagcaccacgacgccaucaccggcaccgccaaggacugggucgucgucgacuacggcacccgccucuuccacucccucaugguccucgagaagaucaucggcaacuccgccuuccuccucauccucaaggacaagcucaccuacgacuccuacucccccgacaccuuccucgagauggaccucaagcagaagucccaggacucccucccccagaagaacaucauccgccucuccgccgagccccgcuaccucgucgucuacaacccccucgagcaggaccgcaucucccucgucuccgucuacgucuccucccccaccguccaggucuucuccgccuccggcaagcccgucgagguccaggucuccgccgucugggacaccgccaacaccaucuccgagaccgccuacgagaucuccuuccgcgcccacauccccccccucggccucaaggucuacaagauccucgaguccgccuccuccaacucccaccucgccgacuacguccucuacaagaacaaggucgaggacuccggcaucuucaccaucaagaacaugaucaacaccgaggagggcaucacccucgagaacuccuucguccuccuccgcuucgaccagaccggccucaugaagcagaugaugaccaaggaggacggcaagcaccacgaggucaacguccaguucuccugguacggcaccaccaucaagcgcgacaaguccggcgccuaccucuuccuccccgacggcaacgccaagcccuacgucuacaccaccccccccuucguccgcgucacccacggccgcaucuacuccgaggucaccugcuucuucgaccacgucacccaccgcguccgccucuaccacauccagggcaucgagggccaguccgucgaggucuccaacaucgucgacauccgcaaggucuacaaccgcgagaucgccaugaagaucuccuccgacaucaagucccagaaccgcuucuacaccgaccucaacggcuaccagauccagccccgcaugacccucuccaagcucccccuccaggccaacgucuaccccaugaccaccauggccuacauccaggacgccaagcaccgccucacccuccucuccgcccagucccucggcgucuccucccucaacuccggccagaucgaggucaucauggaccgccgccucaugcaggacgacaaccgcggccucgagcagggcauccaggacaacaagaucaccgccaaccucuuccgcauccuccucgagaagcgcuccgccgucaacaccgaggaggagaagaaguccgucuccuaccccucccuccucucccacaucaccuccucccucaugaaccaccccgucauccccauggccaacaaguucuccucccccacccucgagcuccagggcgaguucuccccccuccaguccucccuccccugcgacauccaccucgucaaccuccgcaccauccaguccaaggucggcaacggccacuccaacgaggccgcccucauccuccaccgcaagggcuucgacugccgcuucuccuccaagggcaccggccucuucugcuccaccacccagggcaagauccucguccagaagcuccucaacaaguucaucgucgagucccucacccccuccucccucucccucaugcacuccccccccggcacccagaacaucuccgagaucaaccucucccccauggagaucuccaccuuccgcauccagcuccgcuga

SEQ ID NO: 45688 - RNA, 3453 nt, Artificial Sequence
  derived and/or modified sequence opt2 from MAN2A2__Homo_sapiens__NP_006113
augaagcucaagaagcaggucaccgucugcggcgccgccaucuucugcgucgccgucuucucccucuaccucaugcucgaccgcguccagcacgaccccacccgccaccagaacggcggcaacuucccccgcucccagaucuccguccuccagaaccgcaucgagcagcucgagcagcuccucgaggagaaccacgagaucaucucccacaucaaggacuccguccucgagcucaccgccaacgccgagggcccccccgccaugcuccccuacuacaccgucaacggcuccugggucgucccccccgagccccgccccuccuucuucuccaucuccccccaggacugccaguucgcccucggcggccgcggccagaagcccgagcuccagaugcucaccgucuccgaggagcuccccuucgacaacgucgacggcggcgucuggcgccagggcuucgacaucuccuacgacccccacgacugggacgccgaggaccuccaggucuucgucgucccccacucccacaacgaccccggcuggaucaagaccuucgacaaguacuacaccgagcagacccagcacauccucaacuccauggucuccaagcuccaggaggacccccgccgccgcuuccucugggccgaggucuccuucuucgccaaguggugggacaacaucaacguccagaagcgcgccgccguccgccgccucgucggcaacggccagcucgagaucgccaccggcggcugggucaugcccgacgaggccaacucccacuacuucgcccucaucgaccagcucaucgagggccaccaguggcucgagcgcaaccucggcgccaccccccgcuccggcugggccgucgaccccuucggcuacuccuccaccaugcccuaccuccuccgccgcgccaaccucaccuccaugcucauccagcgcguccacuacgccaucaagaagcacuucgccgccacccacucccucgaguucauguggcgccagaccugggacuccgacuccuccaccgacaucuucugccacaugaugcccuucuacuccuacgacgucccccacaccugcggccccgaccccaagaucugcugccaguucgacuucaagcgccuccccggcggccgcaucaacugccccuggaagguccccccccgcgccaucaccgaggccaacgucgccgagcgcgccgcccuccuccucgaccaguaccgcaagaagucccagcucuuccgcuccaacguccuccucgucccccucggcgacgacuuccgcuacgacaagccccaggagugggacgcccaguucuucaacuaccagcgccucuucgacuucuucaacucccgccccaaccuccacguccaggcccaguucggcacccucuccgacuacuucgacgcccucuacaagcgcaccggcgucgagcccggcgcccgcccccccggcuuccccguccucuccggcgacuucuucuccuacgccgaccgcgaggaccacuacuggaccggcuacuacaccucccgccccuucuacaagucccucgaccgcguccucgaggcccaccuccgcggcgccgagguccucuacucccucgccgccgcccacgcccgccgcuccggccucgccggccgcuacccccucuccgacuucacccuccucaccgaggcccgccgcacccucggccucuuccagcaccacgacgccaucaccggcaccgccaaggaggccgucgucgucgacuacggcguccgccuccuccgcucccucgucaaccucaagcaggucaucauccacgccgcccacuaccucguccucggcgacaaggagaccuaccacuucgaccccgaggcccccuuccuccaggucgacgacacccgccucucccacgacgcccuccccgagcgcaccgucauccagcucgacuccuccccccgcuucgucguccucuucaacccccucgagcaggagcgcuucuccauggucucccuccucgucaacuccccccgcguccgcguccucuccgaggagggccagccccucgccguccagaucuccgcccacugguccuccgccaccgaggccguccccgacgucuaccaggucuccguccccguccgccuccccgcccucggccucggcguccuccagcuccagcucggccucgacggccaccgcacccuccccuccuccguccgcaucuaccuccacggccgccagcucuccgucucccgccacgaggccuucccccuccgcgucaucgacuccggcaccuccgacuucgcccucuccaaccgcuacaugcaggucugguucuccggccucaccggccuccucaaguccauccgccgcgucgacgaggagcacgagcagcaggucgacaugcagguccucgucuacggcacccgcaccuccaaggacaaguccggcgccuaccucuuccuccccgacggcgaggccaagcccuacguccccaaggagccccccguccuccgcgucaccgagggccccuucuucuccgaggucgucgccuacuacgagcacauccaccaggccguccgccucuacaaccuccccggcgucgagggccucucccucgacaucuccucccucgucgacauccgcgacuacgucaacaaggagcucgcccuccacauccacaccgacaucgacucccagggcaucuucuucaccgaccucaacggcuuccagguccagccccgccgcuaccucaagaagcucccccuccaggccaacuucuaccccaugcccgucauggccuacauccaggacgcccagaagcgccucacccuccacaccgcccaggcccucggcgucuccucccucaaggacggccagcucgaggucauccucgaccgccgccucaugcaggacgacaaccgcggccucggccagggccucaaggacaacaagcgcaccugcaaccgcuuccgccuccuccucgagcgccgcaccgucggcuccgagguccaggacucccacuccaccuccuaccccucccuccucucccaccucaccuccauguaccucaacgcccccgcccucgcccuccccgucgcccgcaugcagcuccccggccccggccuccgcuccuuccacccccucgccuccucccuccccugcgacuuccaccuccucaaccuccgcacccuccaggccgaggaggacacccuccccuccgccgagaccgcccucauccuccaccgcaagggcuucgacugcggccucgaggccaagaaccucggcuucaacugcaccaccucccagggcaaggucgcccucggcucccucuuccacggccucgacgucgucuuccuccagcccaccucccucacccuccucuacccccucgccucccccuccaacuccaccgacgucuaccucgagcccauggagaucgccaccuuccgccuccgccucggcuga

SEQ ID NO: 45689 - RNA, 3036 nt, Artificial Sequence
  derived and/or modified sequence opt2 from MAN2B1__Homo_sapiens__NP_000519
augggcgccuacgcccgcgccuccggcgucugcgcccgcggcugccucgacuccgccggccccuggaccaugucccgcgcccuccgccccccccuccccccccucugcuucuuccuccuccuccucgccgccgccggcgcccgcgccggcggcuacgagaccugccccaccguccagcccaacaugcucaacguccaccuccucccccacacccacgacgacgucggcuggcucaagaccgucgaccaguacuucuacggcaucaagaacgacauccagcacgccggcguccaguacauccucgacuccgucaucuccgcccuccucgccgaccccacccgccgcuucaucuacgucgagaucgccuucuucucccgcugguggcaccagcagaccaacgccacccaggaggucguccgcgaccucguccgccagggccgccucgaguucgccaacggcggcugggucaugaacgacgaggccgccacccacuacggcgccaucgucgaccagaugacccucggccuccgcuuccucgaggacaccuucggcaacgacggccgcccccgcgucgccuggcacaucgaccccuucggccacucccgcgagcaggccucccucuucgcccagaugggcuucgacggcuucuucuucggccgccucgacuaccaggacaaguggguccgcaugcagaagcucgagauggagcaggucuggcgcgccuccaccucccucaagccccccaccgccgaccucuucaccggcguccuccccaacggcuacaaccccccccgcaaccucugcugggacguccucugcgucgaccagccccucgucgaggacccccgcucccccgaguacaacgccaaggagcucgucgacuacuuccucaacgucgccaccgcccagggccgcuacuaccgcaccaaccacaccgucaugaccaugggcuccgacuuccaguacgagaacgccaacaugugguucaagaaccucgacaagcucauccgccucgucaacgcccagcaggccaagggcuccuccguccacguccucuacuccacccccgccugcuaccucugggagcucaacaaggccaaccucaccugguccgucaagcacgacgacuucuuccccuacgccgacggcccccaccaguucuggaccggcuacuucuccucccgccccgcccucaagcgcuacgagcgccucuccuacaacuuccuccaggucugcaaccagcucgaggcccucgucggccucgccgccaacgucggccccuacggcuccggcgacuccgccccccucaacgaggccauggccguccuccagcaccacgacgccgucuccggcaccucccgccagcacgucgccaacgacuacgcccgccagcucgccgccggcuggggccccugcgagguccuccucuccaacgcccucgcccgccuccgcggcuucaaggaccacuucaccuucugccagcagcucaacaucuccaucugcccccucucccagaccgccgcccgcuuccaggucaucgucuacaacccccucggccgcaaggucaacuggaugguccgccuccccgucuccgagggcgucuucgucgucaaggaccccaacggccgcaccguccccuccgacgucgucaucuuccccuccuccgacucccaggcccacccccccgagcuccucuucuccgccucccuccccgcccucggcuucuccaccuacuccgucgcccaggucccccgcuggaagccccaggcccgcgccccccagcccaucccccgccgcuccuggucccccgcccucaccaucgagaacgagcacauccgcgccaccuucgaccccgacaccggccuccucauggagaucaugaacaugaaccagcagcuccuccuccccguccgccagaccuucuucugguacaacgccuccaucggcgacaacgaguccgaccaggccuccggcgccuacaucuuccgccccaaccagcagaagccccuccccgucucccgcugggcccagauccaccucgucaagaccccccucguccaggagguccaccagaacuucuccgccuggugcucccaggucguccgccucuaccccggccagcgccaccucgagcucgagugguccgucggccccauccccgucggcgacaccuggggcaaggaggucaucucccgcuucgacaccccccucgagaccaagggccgcuucuacaccgacuccaacggccgcgagauccucgagcgccgccgcgacuaccgccccaccuggaagcucaaccagaccgagcccgucgccggcaacuacuaccccgucaacacccgcaucuacaucaccgacggcaacaugcagcucaccguccucaccgaccgcucccagggcggcuccucccuccgcgacggcucccucgagcucaugguccaccgccgccuccucaaggacgacggccgcggcgucuccgagccccucauggagaacggcuccggcgccuggguccgcggccgccaccucguccuccucgacaccgcccaggccgccgccgccggccaccgccuccucgccgagcaggagguccucgccccccaggucguccucgcccccggcggcggcgccgccuacaaccucggcgcccccccccgcacccaguucuccggccuccgccgcgaccucccccccuccguccaccuccucacccucgccuccuggggccccgagaugguccuccuccgccucgagcaccaguucgccgucggcgaggacuccggccgcaaccucuccgcccccgucacccucaaccuccgcgaccucuucuccaccuucaccaucacccgccuccaggagaccacccucgucgccaaccagcuccgcgaggccgccucccgccucaaguggaccaccaacaccggccccaccccccaccagacccccuaccagcucgaccccgccaacaucacccucgagcccauggagauccgcaccuuccucgccuccguccaguggaaggaggucgacggcuga

SEQ ID NO: 45690 - RNA, 3174 nt, Artificial Sequence
  derived and/or modified sequence opt2 from MAN2C1__Homo_sapiens__NP_001243423
auggccgccgcccccgcccucaagcacuggcgcaccacccucgagcgcgucgagaaguucgucuccccccucuacuucaccgacugcaaccuccgcggccgccucuucggcgccuccugccccgucgccguccucuccuccuuccucacccccgagcgccuccccuaccaggaggccguccagcgcgacuuccgccccgcccaggucggcgacuccuucggccccaccugguggaccugcugguuccgcgucgagcucaccauccccgaggccugggucggccaggagguccaccucugcugggaguccgacggcgagggccucgucuggcgcgacggcgagcccguccagggccucaccaaggagggcgagaagaccuccuacguccucaccgaccgccucggcgagcgcgacccccgcucccucacccucuacgucgaggucgccugcaacggccuccucggcgccggcaagggcuccaugaucgccgcccccgaccccgagaagauguuccagcucucccgcgccgagcucgccgucuuccaccgcgacguccacaugcuccucgucgaccucgagcuccuccucggcaucgccaagggccucggcaaggacaaccagcgcuccuuccaggcccucuacaccgccaaccagauggucaacgucugcgaccccgcccagcccgagaccuuccccgucgcccaggcccucgccucccgcuucuucggccagcacggcggcgagucccagcacaccauccacgccaccggccacugccacaucgacaccgccuggcucuggcccuucaaggagaccguccgcaagugcgcccgcuccugggucaccgcccuccagcucauggagcgcaaccccgaguucaucuucgccugcucccaggcccagcagcucgagugggucaagucccgcuaccccggccucuacucccgcauccaggaguucgccugccgcggccaguucguccccgucggcggcaccugggucgagauggacggcaaccuccccuccggcgaggccaugguccgccaguuccuccagggccagaacuucuuccuccaggaguucggcaagaugugcuccgaguucuggcuccccgacaccuucggcuacuccgcccagcucccccagaucaugcacggcugcggcauccgccgcuuccucacccagaagcucuccuggaaccucgucaacuccuucccccaccacaccuucuucugggagggccucgacggcucccgcguccucguccacuucccccccggcgacuccuacggcaugcagggcuccgucgaggagguccucaagaccgucgccaacaaccgcgacaagggccgcgccaaccacuccgccuuccucuucggcuucggcgacggcggcggcggccccacccagaccaugcucgaccgccucaagcgccucuccaacaccgacggccucccccgcguccagcucuccuccccccgccagcucuucuccgcccucgaguccgacuccgagcagcucugcaccugggucggcgagcucuuccucgagcuccacaacggcaccuacaccacccacgcccagaucaagaagggcaaccgcgagugcgagcgcauccuccacgacgucgagcuccucuccucccucgcccucgcccgcuccgcccaguuccucuaccccgccgcccagcuccagcaccucuggcgccuccuccuccucaaccaguuccacgacgucgucaccggcuccugcauccagauggucgccgaggaggccaugugccacuacgaggacauccgcucccacggcaacacccuccucuccgccgccgccgccgcccucugcgccggcgagcccggccccgagggccuccucaucgucaacacccuccccuggaagcgcaucgaggucauggcccuccccaagcccggcggcgcccacucccucggccucacccccucccccggcgacuccgcccagcacggccucugcuccugcuccuccccccaccucaccgccgcccccgccgcccccgccgccugcguccgcuccgcccgcgcccccaccgacuccgccucccgccccccccccaccaagaccgacggcuccgucacccucgacaacggcaucauccgcgucaagcucgaccccaccggccgccucaccucccucguccucgucgccuccggccgcgaggccaucgccgagggcgccgucggcaaccaguucguccucuucgacgacgucccccucuacugggacgccugggacgucauggacuaccaccucgagacccgcaagcccguccucggccaggccggcacccucgccgucggcaccgagggcggccuccgcggcuccgccugguuccuccuccagaucucccccaacucccgccucucccaggaggucguccucgacgucggcugccccuacguccgcuuccacaccgagguccacuggcacgaggcccacaaguuccucaaggucgaguuccccgcccgcguccgcuccucccaggccaccuacgagauccaguucggccaccuccagcgccccacccacuacaacaccuccugggacugggcccgcuucgaggucugggcccaccgcuggauggaccucuccgagcacggcuucggccucgcccuccucaacgacugcaaguacggcgccuccguccgcggcuccauccucucccucucccuccuccgcgcccccaaggcccccgacgccaccgccgacaccggccgccacgaguucaccuacgcccucaugccccacaagggcuccuuccaggacgccggcgucauccaggccgccuacucccucaacuucccccuccucgcccuccccgcccccucccccgcccccgccaccuccugguccgccuucuccgucuccucccccgccgucguccucgagaccgucaagcaggccgaguccuccccccagcgccgcucccucguccuccgccucuacgaggcccacggcucccacgucgacugcuggcuccaccucucccuccccguccaggaggccauccucugcgaccuccucgagcgccccgaccccgccggccaccucacccuccgcgacaaccgccucaagcucaccuucucccccuuccagguccucucccuccuccucguccuccagccccccccccacuga

SEQ ID NO: 45691 - RNA, 2640 nt, Artificial Sequence
  derived and/or modified sequence opt2 from MANBA__Homo_sapiens__NP_005899
augcgccuccaccuccuccuccuccucgcccucugcggcgccggcaccaccgccgccgagcucuccuacucccuccgcggcaacugguccaucugcaacggcaacggcucccucgagcuccccggcgccguccccggcugcguccacuccgcccucuuccagcagggccucauccaggacuccuacuaccgcuucaacgaccucaacuaccgcugggucucccucgacaacuggaccuacuccaaggaguucaagauccccuucgagaucuccaaguggcagaaggucaaccucauccucgagggcgucgacaccgucuccaagauccucuucaacgaggucaccaucggcgagaccgacaacauguucaaccgcuacuccuucgacaucaccaacgucguccgcgacgucaacuccaucgagcuccgcuuccaguccgccguccucuacgccgcccagcaguccaaggcccacacccgcuaccaggucccccccgacugccccccccucguccagaagggcgagugccacgucaacuucguccgcaaggagcagugcuccuucuccugggacuggggccccuccuuccccacccagggcaucuggaaggacguccgcaucgaggccuacaacaucugccaccucaacuacuucaccuucucccccaucuacgacaaguccgcccaggaguggaaccucgagaucgaguccaccuucgacgucgucuccuccaagcccgucggcggccaggucaucgucgccauccccaagcuccagacccagcagaccuacuccaucgagcuccagcccggcaagcgcaucgucgagcucuucgucaacaucuccaagaacaucaccgucgagaccugguggccccacggccacggcaaccagaccggcuacaacaugaccguccucuucgagcucgacggcggccucaacaucgagaaguccgccaaggucuacuuccgcaccgucgagcucaucgaggagcccaucaagggcucccccggccucuccuucuacuucaagaucaacggcuuccccaucuuccucaagggcuccaacuggauccccgccgacuccuuccaggaccgcgucaccuccgagcuccuccgccuccuccuccaguccgucgucgacgccaacaugaacacccuccgcgucuggggcggcggcaucuacgagcaggacgaguucuacgagcucugcgacgagcucggcaucauggucuggcaggacuucauguucgccugcgcccucuaccccaccgaccagggcuuccucgacuccgucaccgccgaggucgccuaccagaucaagcgccucaagucccaccccuccaucaucaucugguccggcaacaacgagaacgaggaggcccucaugaugaacugguaccacaucuccuucaccgaccgccccaucuacaucaaggacuacgucacccucuacgucaagaacauccgcgagcucguccucgccggcgacaagucccgccccuucaucaccuccucccccaccaacggcgccgagaccgucgccgaggccugggucucccagaaccccaacuccaacuacuucggcgacguccacuucuacgacuacaucuccgacugcuggaacuggaaggucuuccccaaggcccgcuucgccuccgaguacggcuaccaguccuggcccuccuucuccacccucgagaaggucuccuccaccgaggacugguccuucaacuccaaguucucccuccaccgccagcaccacgagggcggcaacaagcagaugcucuaccaggccggccuccacuucaagcucccccaguccaccgacccccuccgcaccuucaaggacaccaucuaccucacccaggucaugcaggcccagugcgucaagaccgagaccgaguucuaccgccgcucccgcuccgagaucgucgaccagcagggccacaccaugggcgcccucuacuggcagcucaacgacaucuggcaggcccccuccugggccucccucgaguacggcggcaaguggaagaugcuccacuacuucgcccagaacuucuucgccccccuccuccccgucggcuucgagaacgagaacaccuucuacaucuacggcgucuccgaccuccacuccgacuacuccaugacccucuccguccgcguccacaccugguccucccucgagcccgucugcucccgcgucaccgagcgcuucgucaugaagggcggcgaggccgucugccucuacgaggagcccgucuccgagcuccuccgccgcugcggcaacugcacccgcgaguccugcgucgucuccuucuaccucuccgccgaccacgagcuccucucccccaccaacuaccacuuccucuccucccccaaggaggccgucggccucugcaaggcccagaucaccgccaucaucucccagcagggcgacaucuucgucuucgaccucgagaccuccgccgucgcccccuucgucuggcucgacgucggcuccauccccggccgcuucuccgacaacggcuuccucaugaccgagaagacccgcaccauccucuucuaccccugggagcccaccuccaagaacgagcucgagcaguccuuccacgucaccucccucaccgacaucuacuga

SEQ ID NO: 45692 - RNA, 1389 nt, Artificial Sequence
  derived and/or modified sequence opt2 from MANEA__Homo_sapiens__NP_078917
auggccaaguuccgccgccgcaccugcaucauccucgcccucuucauccucuucaucuucucccucaugaugggccucaagaugcuccgccccaacaccgccaccuucggcgcccccuucggccucgaccuccuccccgagcuccaccagcgcaccauccaccucggcaagaacuucgacuuccagaaguccgaccgcaucaacuccgagaccaacaccaagaaccucaaguccgucgagaucaccaugaagcccuccaaggccuccgagcucaaccucgacgagcuccccccccucaacaacuaccuccacgucuucuacuacuccugguacggcaacccccaguucgacggcaaguacauccacuggaaccaccccguccucgagcacugggacccccgcaucgccaagaacuacccccagggccgccacaacccccccgacgacaucggcuccuccuucuaccccgagcucggcuccuacuccucccgcgaccccuccgucaucgagacccacaugcgccagaugcgcuccgccuccaucggcguccucgcccucuccugguacccccccgacgucaacgacgagaacggcgagcccaccgacaaccucguccccaccauccucgacaaggcccacaaguacaaccucaaggucaccuuccacaucgagcccuacuccaaccgcgacgaccagaacauguacaagaacgucaaguacaucaucgacaaguacggcaaccaccccgccuucuaccgcuacaagaccaagaccggcaacgcccuccccauguucuacgucuacgacuccuacaucaccaagcccgagaagugggccaaccuccucaccaccuccggcucccgcuccauccgcaacucccccuacgacggccucuucaucgcccuccucgucgaggagaagcacaaguacgacauccuccaguccggcuucgacggcaucuacaccuacuucgccaccaacggcuucaccuacggcuccucccaccagaacugggccucccucaagcucuucugcgacaaguacaaccucaucuucauccccuccgucggccccggcuacaucgacaccuccauccgccccuggaacacccagaacacccgcaaccgcaucaacggcaaguacuacgagaucggccucuccgccgcccuccagacccgccccucccucaucuccaucaccuccuucaacgaguggcacgagggcacccagaucgagaaggccguccccaagcgcaccuccaacaccgucuaccucgacuaccgcccccacaagcccggccucuaccucgagcucacccgcaagugguccgagaaguacuccaaggagcgcgccaccuacgcccucgaccgccagcuccccgucuccuga

SEQ ID NO: 45693 - RNA, 558 nt, Artificial Sequence
  derived and/or modified sequence opt2 from MANF__Homo_sapiens__NP_006001
augcgccgcaugcgccgcaugugggccacccagggccucgccgucgcccucgcccucuccguccuccccggcucccgcgcccuccgccccggcgacugcgaggucugcaucuccuaccucggccgcuucuaccaggaccucaaggaccgcgacgucaccuucucccccgccaccaucgagaacgagcucaucaaguucugccgcgaggcccgcggcaaggagaaccgccucugcuacuacaucggcgccaccgacgacgccgccaccaagaucaucaacgaggucuccaagccccucgcccaccacauccccgucgagaagaucugcgagaagcucaagaagaaggacucccagaucugcgagcucaaguacgacaagcagaucgaccucuccaccgucgaccucaagaagcuccgcgucaaggagcucaagaagauccucgacgacuggggcgagaccugcaagggcugcgccgagaaguccgacuacauccgcaagaucaacgagcucaugcccaaguacgcccccaaggccgccuccgcccgcaccgaccucuga

SEQ ID NO: 45694 - RNA, 1296 nt, Artificial Sequence
  derived and/or modified sequence opt2 from MANSC1__Homo_sapiens__NP_060520
auguucuucggcggcgagggcucccucaccuacacccucgucaucaucugcuuccucacccuccgccucuccgccucccagaacugccucaagaagucccucgaggacgucgucaucgacauccaguccucccucuccaagggcauccgcggcaacgagcccgucuacaccuccacccaggaggacugcaucaacuccugcugcuccaccaagaacaucuccggcgacaaggccugcaaccucaugaucuucgacacccgcaagaccgcccgccagcccaacugcuaccucuucuucugccccaacgaggaggccugcccccucaagcccgccaagggccucauguccuaccgcaucaucaccgacuuccccucccucacccgcaaccuccccucccaggagcucccccaggaggacucccuccuccacggccaguucucccaggccgucaccccccucgcccaccaccacaccgacuacuccaagcccaccgacaucuccuggcgcgacacccucucccagaaguucggcuccuccgaccaccucgagaagcucuucaagauggacgaggccuccgcccagcuccucgccuacaaggagaagggccacucccaguccucccaguucuccuccgaccaggagaucgcccaccuccuccccgagaacgucuccgcccuccccgccaccgucgccgucgccuccccccacaccaccuccgccacccccaagcccgccacccuccuccccaccaacgccuccgucacccccuccggcaccucccagccccagcucgccaccaccgccccccccgucaccaccgucaccucccagccccccaccacccucaucuccaccgucuucacccgcgccgccgccacccuccaggccauggccaccaccgccguccucaccaccaccuuccaggcccccaccgacuccaagggcucccucgagaccauccccuucaccgagaucuccaaccucacccucaacaccggcaacgucuacaaccccaccgcccucuccauguccaacgucgaguccuccaccaugaacaagaccgccuccugggagggccgcgaggccucccccggcuccuccucccagggcuccguccccgagaaccaguacggccuccccuucgagaaguggcuccucaucggcucccuccucuucggcguccucuuccucgucaucggccucguccuccucggccgcauccucuccgagucccuccgccgcaagcgcuacucccgccucgacuaccucaucaacggcaucuacgucgacaucuga

SEQ ID NO: 45695 - RNA, 1584 nt, Artificial Sequence
  derived and/or modified sequence opt2 from MAOA__Homo_sapiens__NP_000231
auggagaaccaggagaaggccuccaucgccggccacauguucgacgucgucgucaucggcggcggcaucuccggccucuccgccgccaagcuccucaccgaguacggcgucuccguccucguccucgaggcccgcgaccgcgucggcggccgcaccuacaccauccgcaacgagcacgucgacuacgucgacgucggcggcgccuacgucggccccacccagaaccgcauccuccgccucuccaaggagcucggcaucgagaccuacaaggucaacgucuccgagcgccucguccaguacgucaagggcaagaccuaccccuuccgcggcgccuucccccccgucuggaaccccaucgccuaccucgacuacaacaaccucuggcgcaccaucgacaacaugggcaaggagauccccaccgacgcccccugggaggcccagcacgccgacaagugggacaagaugaccaugaaggagcucaucgacaagaucugcuggaccaagaccgcccgccgcuucgccuaccucuucgucaacaucaacgucaccuccgagccccacgaggucuccgcccucugguuccucugguacgucaagcagugcggcggcaccacccgcaucuucuccgucaccaacggcggccaggagcgcaaguucgucggcggcuccggccaggucuccgagcgcaucauggaccuccucggcgaccaggucaagcucaaccaccccgucacccacgucgaccaguccuccgacaacaucaucaucgagacccucaaccacgagcacuacgagugcaaguacgucaucaacgccaucccccccacccucaccgccaagauccacuuccgccccgagcuccccgccgagcgcaaccagcucauccagcgccuccccaugggcgccgucaucaagugcaugauguacuacaaggaggccuucuggaagaagaaggacuacugcggcugcaugaucaucgaggacgaggacgcccccaucuccaucacccucgacgacaccaagcccgacggcucccuccccgccaucaugggcuucauccucgcccgcaaggccgaccgccucgccaagcuccacaaggagauccgcaagaagaagaucugcgagcucuacgccaagguccucggcucccaggaggcccuccaccccguccacuacgaggagaagaacuggugcgaggagcaguacuccggcggcugcuacaccgccuacuucccccccggcaucaugacccaguacggccgcgucauccgccagcccgucggccgcaucuucuucgccggcaccgagaccgccaccaagugguccggcuacauggagggcgccgucgaggccggcgagcgcgccgcccgcgagguccucaacggccucggcaaggucaccgagaaggacaucuggguccaggagcccgaguccaaggacguccccgccgucgagaucacccacaccuucugggagcgcaaccuccccuccgucuccggccuccucaagaucaucggcuucuccaccuccgucaccgcccucggcuucguccucuacaaguacaagcuccucccccgcuccuga

SEQ ID NO: 45696 - RNA, 1563 nt, Artificial Sequence
  derived and/or modified sequence opt2 from MAOB__Homo_sapiens__NP_000889
auguccaacaagugcgacgucgucgucgucggcggcggcaucuccggcauggccgccgccaagcuccuccacgacuccggccucaacgucgucguccucgaggcccgcgaccgcgucggcggccgcaccuacacccuccgcaaccagaaggucaaguacgucgaccucggcggcuccuacgucggccccacccagaaccgcauccuccgccucgccaaggagcucggccucgagaccuacaaggucaacgaggucgagcgccucauccaccacgucaagggcaaguccuaccccuuccgcggccccuucccccccgucuggaaccccaucaccuaccucgaccacaacaacuucuggcgcaccauggacgacaugggccgcgagauccccuccgacgcccccuggaaggccccccucgccgaggagugggacaacaugaccaugaaggagcuccucgacaagcucugcuggaccgaguccgccaagcagcucgccacccucuucgucaaccucugcgucaccgccgagacccacgaggucuccgcccucugguuccucugguacgucaagcagugcggcggcaccacccgcaucaucuccaccaccaacggcggccaggagcgcaaguucgucggcggcuccggccaggucuccgagcgcaucauggaccuccucggcgaccgcgucaagcucgagcgccccgucaucuacaucgaccagacccgcgagaacguccucgucgagacccucaaccacgagauguacgaggccaaguacgucaucuccgccaucccccccacccucggcaugaagauccacuucaaccccccccuccccaugaugcgcaaccagaugaucacccgcgucccccucggcuccgucaucaagugcaucgucuacuacaaggagcccuucuggcgcaagaaggacuacugcggcaccaugaucaucgacggcgaggaggcccccgucgccuacacccucgacgacaccaagcccgagggcaacuacgccgccaucaugggcuucauccucgcccacaaggcccgcaagcucgcccgccucaccaaggaggagcgccucaagaagcucugcgagcucuacgccaagguccucggcucccucgaggcccucgagcccguccacuacgaggagaagaacuggugcgaggagcaguacuccggcggcugcuacaccaccuacuucccccccggcauccucacccaguacggccgcguccuccgccagcccgucgaccgcaucuacuucgccggcaccgagaccgccacccacugguccggcuacauggagggcgccgucgaggccggcgagcgcgccgcccgcgagauccuccacgccaugggcaagauccccgaggacgagaucuggcaguccgagcccgaguccgucgacguccccgcccagcccaucaccaccaccuuccucgagcgccaccuccccuccguccccggccuccuccgccucaucggccucaccaccaucuucuccgccaccgcccucggcuuccucgcccacaagcgcggccuccucguccgcgucuga

SEQ ID NO: 45697 - RNA, 3144 nt, Artificial Sequence
  derived and/or modified sequence opt2 from MAP10__Homo_sapiens__NP_061963
auggcccacugcggccagcucaccaacuggcucugccucgccugggagcgcaaggagucccccgacuuccucuccaucuuccuccgcuacaucgaccucacccccaagcuccacaagaucugcuccgacaagaccaucacccagaagacccacugccuccucccccucaucuccuccgcccucuccuccaucguccucauccagggcugguggcagaagaccgcccacaaguacgccuacaagggcgccaagcacaucgagcagcagaacccccagucccgccaccgcccccgccccgccggcgcccucccccagaucucccgcgacucccgccagcgcugccuccuccuccgcuuccucguccgcccccgcggcuucuccuucuccuucgccgagcccgccgccgccuuccccggcgccaccgccauggccgccucccucuccgagcgccucuucucccucgagcuccucgucgacuggguccgccucgaggcccgccuccuccccucccccgccgccgccgucgagcaggaggaggaggaggaggagaaggagcagggcgaggccuccuccccccgcggccucugccccgccgucgccuuccgccuccucgacuuccccacccuccucgucuacccccccgacggccccggcgcccccgccgccgagcccuggcccggcgucauccgcuucggccgcggcaaguccugccucuuccgccuccagcccgccacccuccacugccgccuccuccgcaccccccucgccacccuccuccuccagcucccccccggccgccccacccccaccccccagcuccucggcgccugcgacaucucccucgccaccgccgcccaccgcgucgucggccccgccgccuccggcugcucccaccgccaccgcggccgcuucccccuccacaaccgcgucggcgagcgcaccggcgacaucgcccucgccuaccgccucaccgaccucggcucccgccuccucucccagcucgagcgcccccucaccuucacccgcaccggcggcggcgccgaggucuccccccagacccagcaggagcgccagcagcuccagcagcccgccucccagcccucccccaaggaggccgacaagccccucggcgagcucgagauccccgaggcccagaaggaccucaaggagauggucaaguccaaggccgagugcgacaacgucggcuccgucgagaacggcaagaccaacuccgucgucaccugcuccggcgccggcaacggccgcaacgucuccucccucaacgaggaggucaccgagcucgacauggagaccaacaucuucugcccccccccccucuacuacaccaaccucacccaggagaagcccccccccgcccaggccaagaucaccaucgagccccagaugaacgcccccgaggagauggacgacgccucccccgagaagaagcgcgucaacccccccgcccaccgcuccugccucaagcaccccuccuccgccgcccacgagcacccccccaugcucgucaaccccccccacauccagaacaucggcgccaccaaccagaccugccagaccgagcagaaccgcaucaacaccauccgccagcucccccuccucaacgcccuccucgucgagcucucccuccucuacgaccagcccgucaccucccccgcccacauccacccccaccucgccuggcucuaccgcaccgaggacaagaagucccccgaguccuccgccaaguccaccugccgcuccgaggccaagaaggacaagcgcuccgucggcggcugcgagaaguccgucucccuccaguacaagaagaaccagaucgagaacuacaaggaggacaaguacuccgagaaguccuccggcgcccuccacaagcgcguccccaagggccgccuccucuacggccucaccaacacccuccgccuccgccucaagcucaccaaccccgacaugcucgucguccacgagaagcgcgagcucuaccgcaagcgccagucccagaugcucggcaccaaguuccgcauccccuccuccaaggucaagcuccucuccuccgccgagcagucccagaagccccagcuccccgaggacaaguaccucgacuccgacgccuccuucaccgagaacuccgacaccucccgccagaucuccggcgucuucgacgagcccuccaccuccaaggagaccaagcucaaguacgccaccgagaagaagaccgucgacugcuccaagaaccgcaucaacaacgucucccucgaggaggucgucucccccgccaacuccaucauccccgagcgccucacccccaccaacauccucggcggcaacgucgagaugaagauccagucccccugcgucuuccagcaggacgccgucgucgaccgcaucgucgacaaggagaucgacauccgccaggucaagaccaccgacaacgacauccucauggccgacaucuccgacaagcgcaccggcaagaacuccugcuacgagaacaucuccgagcucaaguacuccgacgaccucuccucccccugcuacuccgaggacuucugcaccuccgaggacaccucccgcuccuucaaggcccacgacuccuccucccgcaccgagaaccccaagcacucccaguacaccuccaaguccuccgacaccggcgucuccaagaagaagaacuccuccgaccgcuccuccauccucuccccccccuucuccgccggcucccccguccacuccuaccgcaaguuccacaucuccaagacccaggacaagucccucgaggaggccuccuccaucuccgccuccgaccucuccuccacccacuggaccgagcagaaggagaaccagaucgaccagaacuccaugcacaacuccgagaucaccaagcgcgcccaggacaucuccgucaagacccgcuccuccuggaagucccucgagaagucccaguccccccagaccucccaggucuccuccuaccuccccuccaacgucuccgagcucaacguccucgacuccuccaccuccgaccacuucgaggagggcaacgacgacgucggcucccucaacaucuccaagcagugcaaggacaucugcgagcucgucaucaacaagcuccccggcuacaccauguga

SEQ ID NO: 45698 - RNA, 8412 nt, Artificial Sequence
  derived and/or modified sequence opt2 from MAP1A__Homo_sapiens__NP_002364
auggacggcgucgccgaguucuccgaguacgucuccgagaccgucgacguccccucccccuucgaccuccucgagccccccaccuccggcggcuuccucaagcucuccaagcccugcugcuacaucuuccccggcggccgcggcgacuccgcccucuucgccgucaacggcuucaacauccucgucgacggcggcuccgaccgcaaguccugcuucuggaagcucguccgccaccucgaccgcaucgacuccguccuccucacccacaucggcgccgacaaccuccccggcaucaacggccuccuccagcgcaaggucgccgagcucgaggaggagcagucccagggcuccuccuccuacuccgacugggucaagaaccucaucucccccgagcucggcgucgucuucuucaacguccccgagaagcuccgccuccccgacgccucccgcaaggccaagcgcuccaucgaggaggccugccucacccuccagcaccucaaccgccucggcauccaggccgagccccucuaccgcgucgucuccaacaccaucgagccccucacccucuuccacaagaugggcgucggccgccucgacauguacguccucaaccccgucaaggacuccaaggagaugcaguuccucaugcagaagugggccggcaacuccaaggccaagaccggcaucguccuccccaacggcaaggaggccgagaucuccguccccuaccucaccuccaucaccgcccucgucgucuggcuccccgccaaccccaccgagaagaucguccgcguccucuuccccggcaacgccccccagaacaagauccucgagggccucgagaagcuccgccaccucgacuuccuccgcuaccccgucgccacccagaaggaccucgccuccggcgccguccccaccaaccucaagcccuccaagaucaagcagcgcgccgacuccaaggagucccucaaggccaccaccaagaccgccgucuccaagcucgccaagcgcgaggaggucgucgaggagggcgccaaggaggcccgcuccgagcucgccaaggagcucgccaagaccgagaagaaggccaaggaguccuccgagaagccccccgagaagcccgccaagcccgagcgcgucaagaccgaguccuccgaggcccucaaggccgagaagcgcaagcucaucaaggacaaggucggcaagaagcaccucaaggagaagaucuccaagcucgaggagaagaaggacaaggagaagaaggagaucaagaaggagcgcaaggagcucaagaaggacgagggccgcaaggaggagaagaaggacgccaagaaggaggagaagcgcaaggacaccaagcccgagcucaagaagaucuccaagcccgaccucaagcccuucacccccgagguccgcaagacccucuacaaggccaagguccccggccgcgucaagaucgaccgcucccgcgccauccgcggcgagaaggagcucuccuccgagccccagaccccccccgcccagaagggcaccgucccccuccccaccaucuccggccaccgcgagcucguccucuccucccccgaggaccucacccaggacuucgaggagaugaagcgcgaggagcgcgcccuccucgccgagcagcgcgacaccggccucggcgacaagcccuucccccucgacaccgccgaggagggcccccccuccaccgccauccagggcaccccccccuccguccccggccucggccaggaggagcacgucaugaaggagaaggagcucguccccgagguccccgaggagcagggcuccaaggaccgcggccucgacuccggcgccgagaccgaggaggagaaggacaccugggaggagaagaagcagcgcgaggccgagcgccuccccgaccgcaccgaggcccgcgaggaguccgagcccgaggucaaggaggacgucaucgagaaggccgagcucgaggagauggaggagguccaccccuccgacgaggaggaggaggacgccaccaaggccgagggcuucuaccagaagcacaugcaggagccccucaaggucaccccccgcucccgcgaggccuucggcggccgcgagcucggccuccagggcaaggcccccgagaaggagaccucccucuuccucuccucccucaccacccccgccggcgccaccgagcacgucuccuacauccaggacgagaccauccccggcuacuccgagaccgagcagaccaucuccgacgaggagauccacgacgagcccgaggagcgccccgcccccccccgcuuccacaccuccaccuacgaccuccccggccccgagggcgccggccccuucgaggccucccagcccgccgacuccgccguccccgccaccuccggcaaggucuacggcacccccgagaccgagcucaccuaccccaccaacaucgucgccgccccccucgccgaggaggagcacgucuccuccgccaccuccaucaccgagugcgacaagcucuccuccuucgccaccuccgucgccgaggaccaguccgucgccucccucaccgccccccagaccgaggagaccggcaaguccucccuccuccucgacaccgucaccuccauccccuccucccgcaccgaggccacccagggccucgacuacguccccuccgccggcaccaucucccccaccuccucccucgaggaggacaagggcuucaaguccccccccugcgaggacuucuccgucaccggcgaguccgagaagcgcggcgagaucaucggcaagggccucuccggcgagcgcgccgucgaggaggaggaggaggagaccgccaacgucgagauguccgagaagcucugcucccaguacggcacccccgucuucuccgcccccggccacgcccuccaccccggcgagcccgcccucggcgaggccgaggagcgcugccucucccccgacgacuccaccgucaagauggccucccccccccccuccggcccccccuccgccacccacacccccuuccaccagucccccgucgaggagaaguccgagccccaggacuuccaggaggccgacuccuggggcgacaccaagcgcacccccggcgucggcaaggaggacgccgccgaggagaccgucaagcccggccccgaggagggcacccucgagaaggaggagaaggucccccccccccgcuccccccaggcccaggaggcccccgucaacaucgacgagggccucaccggcugcaccauccagcuccuccccgcccaggacaaggccaucgucuucgagaucauggaggccggcgagcccaccggccccauccucggcgccgaggcccuccccggcggccuccgcacccucccccaggagcccggcaagccccagaaggacgagguccuccgcuaccccgaccgcucccucucccccgaggacgccgagucccucuccguccucuccguccccucccccgacaccgccaaccaggagcccacccccaagucccccugcggccucaccgagcaguaccuccacaaggaccgcuggcccgaggucucccccgaggacacccagucccucucccucuccgaggagucccccuccaaggagaccucccucgacgucuccuccaagcagcucucccccgagucccucggcacccuccaguucggcgagcucaaccucggcaaggaggagaugggccaccucaugcaggccgaggacaccucccaccacaccgcccccauguccguccccgagccccacgccgccaccgccuccccccccaccgacggcaccacccgcuacuccgcccagaccgacaucaccgacgacucccucgaccgcaagucccccgccuccuccuucucccacuccacccccuccggcaacggcaaguaccuccccggcgccaucaccucccccgacgagcacauccucacccccgacuccuccuucuccaagucccccgagucccuccccggccccgcccucgaggacaucgccaucaagugggaggacaagguccccggccucaaggaccgcaccuccgagcagaagaaggagcccgagcccaaggacgagguccuccagcagaaggacaagacccucgagcacaaggaggucgucgagcccaaggacaccgccaucuaccagaaggacgaggcccuccacgucaagaacgaggccgucaagcagcaggacaaggcccucgagcagaagggccgcgaccucgagcagaaggacaccgcccucgagcagaaggacaaggcccucgagcccaaggacaaggaccucgaggagaaggacaaggcccucgagcagaaggacaagauccccgaggagaaggacaaggcccucgagcagaaggacaccgcccucgagcagaaggacaaggcccucgagcccaaggacaaggaccucgagcagaaggaccgcguccucgagcagaaggagaagauccccgaggagaaggacaaggcccucgaccagaagguccgcuccgucgagcacaaggcccccgaggacaccgucgccgagaugaaggaccgcgaccucgagcagaccgacaaggcccccgagcagaagcaccaggcccaggagcagaaggacaaggucuccgagaagaaggaccaggcccucgagcagaaguacugggcccucggccagaaggacgaggcccucgagcagaacauccaggcccucgaggagaaccaccagacccaggagcaggagucccucguccaggaggacaagacccgcaagcccaagaugcucgaggagaagucccccgagaaggucaaggccauggaggagaagcucgaggcccuccucgagaagaccaaggcccucggccucgaggagucccucguccaggagggccgcgcccgcgagcaggaggagaaguacuggcgcggccaggacgucguccaggaguggcaggagaccucccccacccgcgaggagcccgccggcgagcagaaggagcucgcccccgccugggaggacaccucccccgagcaggacaaccgcuacuggcgcggccgcgaggacgucgcccucgagcaggacaccuacuggcgcgagcucuccugcgagcgcaaggucugguucccccacgagcucgacggccagggcgcccgcccccacuacaccgaggagcgcgaguccaccuuccucgacgagggccccgacgacgagcaggaggucccccuccgcgagcacgccacccgcucccccugggccuccgacuucaaggacuuccaggaguccuccccccagaagggccucgaggucgagcgcuggcucgccgagucccccgucggccucccccccgaggaggaggacaagcucacccgcucccccuucgagaucaucuccccccccgccuccccccccgagauggucggccagcgcguccccuccgcccccggccaggagucccccauccccgaccccaagcucaugccccacaugaagaacgagcccaccacccccuccuggcucgccgacaucccccccuggguccccaaggaccgcccccucccccccgccccccucucccccgcccccggcccccccacccccgcccccgagucccacacccccgcccccuucuccuggggcaccgccgaguacgacuccgucgucgccgccguccaggagggcgccgccgagcucgagggcggccccuacuccccccucggcaaggacuaccgcaaggccgagggcgagcgcgaggaggagggccgcgccgaggcccccgacaaguccucccacuccuccaagguccccgaggccuccaagucccacgccaccaccgagcccgagcagaccgagcccgagcagcgcgagcccacccccuaccccgacgagcgcuccuuccaguacgccgacaucuacgagcagaugaugcucaccggccucggccccgccugccccacccgcgagcccccccucggcgccgccggcgacuggccccccugccucuccaccaaggaggccgccgccggccgcaacaccuccgccgagaaggagcucuccucccccaucucccccaagucccuccaguccgacacccccaccuucuccuacgccgcccucgccggccccaccguccccccccgccccgagcccggccccuccauggagcccucccucaccccccccgccguccccccccgcgcccccauccucuccaagggccccucccccccccucaacggcaacauccucuccugcucccccgaccgccgcucccccucccccaaggaguccggccgcucccacugggacgacuccaccuccgacuccgagcucgagaagggcgcccgcgagcagcccgagaaggaggcccagucccccucccccccccaccccauccccaugggcucccccacccucuggcccgagaccgaggcccacgucucccccccccucgacucccaccucggccccgcccgccccucccucgacuuccccgccuccgccuucggcuucuccucccuccagcccgcccccccccagcuccccucccccgccgagccccgcuccgcccccugcggcucccucgccuucuccggcgaccgcgcccucgcccucgcccccggcccccccacccgcacccgccacgacgaguaccucgaggucaccaaggcccccucccucgacuccucccucccccagcuccccucccccuccucccccggcgccccccuccucuccaaccucccccgccccgccucccccgcccucuccgagggcuccuccuccgaggccaccacccccgucaucuccuccgucgccgagcgcuucucccccucccucgaggccgccgagcaggaguccggcgagcucgaccccggcauggagcccgccgcccacucccucugggaccucaccccccucucccccgccccccccgccucccucgaccucgcccucgcccccgcccccucccuccccggcgacaugggcgacggcauccuccccugccaccucgagugcuccgaggccgccaccgagaagcccucccccuuccagguccccuccgaggacugcgccgccaacggccccaccgagaccucccccaacccccccggccccgcccccgccaaggccgagaacgaggaggccgccgccugccccgccugggagcgcggcgccuggcccgagggcgccgagcgcuccucccgccccgacacccuccucucccccgagcagcccgucugccccgccggcggcuccggcggcccccccuccuccgccucccccgaggucgaggccggcccccagggcugcgccaccgagccccgcccccaccgcggcgagcucucccccuccuuccucaaccccccccucccccccuccaucgacgaccgcgaccucuccaccgaggagguccgccucgucggccgcggcggccgccgccgcgucggcggccccggcaccaccggcggccccugccccgucaccgacgagaccccccccaccuccgccuccgacuccggcuccucccaguccgacuccgacgucccccccgagaccgaggagugccccuccaucaccgccgaggccgcccucgacuccgacgaggacggcgacuuccuccccgucgacaaggccggcggcgucuccggcacccaccacccccgccccggccacgacccccccccccucccccagcccgacccccgccccucccccccccgccccgacgucugcauggccgaccccgagggccucuccuccgaguccggccgcgucgagcgccuccgcgagaaggagaagguccagggccgcgucggccgccgcgcccccggcaaggccaagcccgccucccccgcccgccgccucgaccuccgcggcaagcgcucccccacccccggcaagggccccgccgaccgcgccucccgcgcccccccccgcccccgcuccaccaccucccaggucacccccgccgaggagaaggacggccacucccccauguccaagggccucgucaacggccucaaggccggccccauggcccucuccuccaagggcuccuccggcgcccccgucuacgucgaccucgccuacauccccaaccacugcuccggcaagaccgccgaccucgacuucuuccgccgcguccgcgccuccuacuacgucgucuccggcaacgaccccgccaacggcgagcccucccgcgccguccucgacgcccuccucgagggcaaggcccaguggggcgagaaccuccaggucacccucauccccacccacgacaccgaggucacccgcgagugguaccagcagacccacgagcagcagcagcagcucaacguccucguccucgccuccuccuccaccgucgucaugcaggacgaguccuuccccgccugcaagaucgaguucuga

SEQ ID NO: 45699 - RNA, 7407 nt, Artificial Sequence
  derived and/or modified sequence opt2 from MAP1B__Homo_sapiens__NP_005900
auggccaccgucgucgucgaggccaccgagcccgagcccuccggcuccaucgccaaccccgccgccuccaccucccccucccucucccaccgcuuccucgacuccaaguucuaccuccucgucgucgucggcgagaucgucaccgaggagcaccuccgccgcgccaucggcaacaucgagcucggcauccgcuccugggacaccaaccucaucgagugcaaccucgaccaggagcucaagcucuucgucucccgccacuccgcccgcuucucccccgagguccccggccagaagauccuccaccaccgcuccgacguccucgagaccgucguccucaucaaccccuccgacgaggccgucuccaccgagguccgccucaugaucaccgacgccgcccgccacaagcuccucguccucaccggccagugcuucgagaacaccggcgagcucauccuccaguccggcuccuucuccuuccagaacuucaucgagaucuucaccgaccaggagaucggcgagcuccucuccaccacccaccccgccaacaaggccucccucacccucuucugccccgaggagggcgacuggaagaacuccaaccucgaccgccacaaccuccaggacuucaucaacaucaagcucaacuccgccuccauccuccccgagauggagggccucuccgaguucaccgaguaccucuccgaguccgucgagguccccucccccuucgacauccucgagccccccaccuccggcggcuuccucaagcucuccaagcccugcugcuacaucuuccccggcggccgcggcgacuccgcccucuucgccgucaacggcuucaacaugcucaucaacggcggcuccgagcgcaaguccugcuucuggaagcucauccgccaccucgaccgcgucgacuccauccuccucacccacaucggcgacgacaaccuccccggcaucaacuccaugcuccagcgcaagaucgccgagcucgaggaggagcagucccagggcuccaccaccaacuccgacuggaugaagaaccucaucucccccgaccucggcgucgucuuccucaacguccccgagaaccucaagaaccccgagcccaacaucaagaugaagcgcuccaucgaggaggccugcuucacccuccaguaccucaacaagcucuccaugaagcccgagccccucuuccgcuccgucggcaacaccaucgaccccgucauccucuuccagaagaugggcgucggcaagcucgagauguacguccucaaccccgucaaguccuccaaggagaugcaguacuucaugcagcaguggaccggcaccaacaaggacaaggccgaguucauccuccccaacggccaggaggucgaccuccccaucuccuaccucaccuccgucuccucccucaucgucuggcaccccgccaaccccgccgagaagaucauccgcguccucuuccccggcaacuccacccaguacaacauccucgagggccucgagaagcucaagcaccucgacuuccucaagcagccccucgccacccagaaggaccucaccggccagguccccacccccgucgucaagcagaccaagcucaagcagcgcgccgacucccgcgagucccucaagcccgccgccaagccccuccccuccaaguccguccgcaaggaguccaaggaggagacccccgaggucaccaaggucaaccacgucgagaagccccccaaggucgaguccaaggagaaggucauggucaagaaggacaagcccaucaagaccgagaccaagcccuccgucaccgagaaggagguccccuccaaggaggagcccucccccgucaaggccgaggucgccgagaagcaggccaccgacgucaagcccaaggccgccaaggagaagaccgucaagaaggagaccaaggucaagcccgaggacaagaaggaggagaaggagaagcccaagaaggaggucgccaagaaggaggacaagacccccaucaagaaggaggagaagcccaagaaggaggaggucaagaaggaggucaagaaggagaucaagaaggaggagaagaaggagcccaagaaggaggucaagaaggagaccccccccaaggaggucaagaaggaggucaagaaggaggagaagaaggaggucaagaaggaggagaaggagcccaagaaggagaucaagaagcuccccaaggacgccaagaaguccuccaccccccucuccgaggccaagaagcccgccgcccucaagcccaagguccccaagaaggaggaguccgucaagaaggacuccgucgccgccggcaagcccaaggagaagggcaagaucaaggucaucaagaaggagggcaaggccgccgaggccgucgccgccgccgucggcaccggcgccaccaccgccgccgucauggccgccgccggcaucgccgccaucggccccgccaaggagcucgaggccgagcgcucccucauguccucccccgaggaccucaccaaggacuucgaggagcucaaggccgaggaggucgacgucaccaaggacaucaagccccagcucgagcucaucgaggacgaggagaagcucaaggagaccgagcccgucgaggccuacgucauccagaaggagcgcgaggucaccaagggccccgccgagucccccgacgagggcaucaccaccaccgagggcgagggcgagugcgagcagacccccgaggagcucgagcccgucgagaagcagggcgucgacgacaucgagaaguucgaggacgagggcgccggcuucgaggaguccuccgagaccggcgacuacgaggagaaggccgagaccgaggaggccgaggagcccgaggaggacggcgaggagcacgucugcgucuccgccuccaagcacucccccaccgaggacgaggaguccgccaaggccgaggccgacgccuacauccgcgagaagcgcgaguccgucgccuccggcgacgaccgcgccgaggaggacauggacgaggccaucgagaagggcgaggccgagcaguccgaggaggaggccgacgaggaggacaaggccgaggacgcccgcgaggaggaguacgagcccgagaagauggaggccgaggacuacgucauggccgucgucgacaaggccgccgaggccggcggcgccgaggagcaguacggcuuccucaccacccccaccaagcagcucggcgcccagucccccggccgcgagcccgccuccuccauccacgacgagacccuccccggcggcuccgaguccgaggccaccgccuccgacgaggagaaccgcgaggaccagcccgaggaguucaccgccaccuccggcuacacccaguccaccaucgagaucuccuccgagcccacccccauggacgagauguccaccccccgcgacgucauguccgacgagaccaacaacgaggagaccgagucccccucccaggaguucgucaacaucaccaaguacgaguccucccucuacucccaggaguacuccaagcccgccgacgucaccccccucaacggcuucuccgagggcuccaagaccgacgccaccgacggcaaggacuacaacgccuccgccuccaccaucuccccccccuccuccauggaggaggacaaguucucccgcuccgcccuccgcgacgccuacugcuccgaggucaaggccuccaccacccucgacaucaaggacuccaucuccgccgucuccuccgagaaggucucccccuccaagucccccucccucucccccuccccccccuccccccucgagaagaccccccucggcgagcgcuccgucaacuucucccucacccccaacgagaucaaggucuccgccgaggccgaggucgcccccgucucccccgaggucacccaggaggucgucgaggagcacugcgccucccccgaggacaagacccucgaggucgucucccccucccaguccgucaccggcuccgccggccacacccccuacuaccagucccccaccgacgagaaguccucccaccuccccaccgaggucaucgagaagccccccgccguccccgucuccuucgaguucuccgacgccaaggacgagaacgagcgcgccuccgucucccccauggacgagcccguccccgacuccgagucccccaucgagaagguccucuccccccuccgcucccccccccucaucggcuccgaguccgccuacgaguccuuccucuccgccgacgacaaggccuccggccgcggcgccgagucccccuucgaggagaaguccggcaagcagggcucccccgaccaggucucccccgucuccgagaugaccuccaccucccucuaccaggacaagcaggagggcaaguccaccgacuucgcccccaucaaggaggacuucggccaggagaagaagaccgacgacgucgaggccauguccucccagcccgcccucgcccucgacgagcgcaagcucggcgacgucucccccacccagaucgacgucucccaguucggcuccuucaaggaggacaccaagauguccaucuccgagggcaccgucuccgacaaguccgccacccccgucgacgagggcgucgccgaggacaccuacucccacauggagggcgucgccuccgucuccaccgccuccgucgccaccuccuccuuccccgagcccaccaccgacgacgucucccccucccuccacgccgaggucggcuccccccacuccaccgaggucgacgacucccucuccgucuccgucguccagacccccaccaccuuccaggagaccgagaugucccccuccaaggaggagugcccccgccccauguccaucuccccccccgacuucucccccaagaccgccaagucccgcacccccguccaggaccaccgcuccgagcaguccuccauguccaucgaguucggccaggagucccccgagcagucccucgccauggacuucucccgccagucccccgaccaccccaccgucggcgccggcguccuccacaucaccgagaacggccccaccgaggucgacuacucccccuccgacaugcaggacuccucccucucccacaagaucccccccauggaggagcccuccuacacccaggacaacgaccucuccgagcucaucuccgucucccaggucgaggccucccccuccaccuccuccgcccacacccccucccagaucgccuccccccuccaggaggacacccucuccgacgucgcccccccccgcgacaugucccucuacgccucccucaccuccgagaagguccagucccucgagggcgagaagcucucccccaaguccgacaucuccccccucaccccccgcgaguccuccccccucuacucccccaccuucuccgacuccaccuccgccgucaaggagaagaccgccaccugccacuccuccuccuccccccccaucgacgccgccuccgccgagcccuacggcuuccgcgccuccguccucuucgacaccaugcagcaccaccucgcccucaaccgcgaccucuccacccccggccucgagaaggacuccggcggcaagacccccggcgacuucuccuacgccuaccagaagcccgaggagaccacccgcucccccgacgaggaggacuacgacuacgaguccuacgagaagaccacccgcaccuccgacgucggcggcuacuacuacgagaagaucgagcgcaccaccaagucccccuccgacuccggcuacuccuacgagaccaucggcaagaccaccaagacccccgaggacggcgacuacuccuacgagaucaucgagaagaccacccgcacccccgaggagggcggcuacuccuacgacaucuccgagaagaccaccuccccccccgaggucuccggcuacuccuacgagaagaccgagcgcucccgccgccuccucgacgacaucuccaacggcuacgacgacuccgaggacggcggccacacccucggcgaccccuccuacuccuacgagaccaccgagaagaucaccuccuuccccgaguccgagggcuacuccuacgagaccuccaccaagaccacccgcacccccgacaccuccaccuacugcuacgagaccgccgagaagaucacccgcaccccccaggccuccaccuacuccuacgagaccuccgaccucugcuacaccgccgagaagaagucccccuccgaggcccgccaggacgucgaccucugccucgucuccuccugcgaguacaagcaccccaagaccgagcucucccccuccuucaucaaccccaacccccucgagugguucgccuccgaggagcccaccgaggaguccgagaagccccucacccaguccggcggcgccccccccccccccggcggcaagcagcagggccgccagugcgacgagaccccccccaccuccgucuccgaguccgcccccucccagaccgacuccgacgucccccccgagaccgaggagugccccuccaucaccgccgacgccaacaucgacuccgaggacgaguccgagaccauccccaccgacaagaccgucaccuacaagcacauggaccccccccccgcccccguccaggaccgcucccccuccccccgccaccccgacgucuccauggucgaccccgaggcccucgccaucgagcagaaccucggcaaggcccucaagaaggaccucaaggagaagaccaagaccaagaagcccggcaccaagaccaaguccuccucccccgucaagaaguccgacggcaaguccaagccccucgccgccucccccaagcccgccggccucaaggaguccuccgacaaggucucccgcgucgccucccccaagaagaaggaguccgucgagaaggccgccaagcccaccaccacccccgaggucaaggccgcccgcggcgaggagaaggacaaggagaccaagaacgccgccaacgccuccgccuccaaguccgccaagaccgccaccgccggccccggcaccaccaagaccaccaaguccuccgccgucccccccggccuccccgucuaccucgaccucugcuacauccccaaccacuccaacuccaagaacgucgacgucgaguucuucaagcgcguccgcuccuccuacuacgucgucuccggcaacgaccccgccgccgaggagcccucccgcgccguccucgacgcccuccucgagggcaaggcccaguggggcuccaacaugcaggucacccucauccccacccacgacuccgaggucaugcgcgagugguaccaggagacccacgagaagcagcaggaccucaacaucaugguccucgccuccuccuccaccgucgucaugcaggacgaguccuuccccgccugcaagaucgagcucuga

SEQ ID NO: 45700 - RNA, 366 nt, Artificial Sequence
  derived and/or modified sequence opt2 from MAP1LC3A__Homo_sapiens__NP_115903
augcccuccgaccgccccuucaagcagcgccgcuccuucgccgaccgcugcaaggagguccagcagauccgcgaccagcaccccuccaagauccccgucaucaucgagcgcuacaagggcgagaagcagcuccccguccucgacaagaccaaguuccucguccccgaccacgucaacauguccgagcucgucaagaucauccgccgccgccuccagcucaaccccacccaggccuucuuccuccucgucaaccagcacuccauggucuccgucuccacccccaucgccgacaucuacgagcaggagaaggacgaggacggcuuccucuacauggucuacgccucccaggagaccuucggcuucuga

SEQ ID NO: 45701 - RNA, 378 nt, Artificial Sequence
  derived and/or modified sequence opt2 from MAP1LC3B2__Homo_sapiens__NP_001078950
augcccuccgagaagaccuucaagcagcgccgcaccuucgagcagcgcgucgaggacguccgccucauccgcgagcagcaccccaccaagauccccgucaucaucgagcgcuacaagggcgagaagcagcuccccguccucgacaagaccaaguuccucguccccgaccacgucaacauguccgagcucaucaagaucauccgccgccgccuccagcucaacgccaaccaggccuucuuccuccucgucaacggccacuccauggucuccgucuccacccccaucuccgaggucuacgaguccgagaaggacgaggacggcuuccucuacauggucugcgccucccaggagaccuucggcaugaagcucuccgucuga

SEQ ID NO: 45702 - RNA, 378 nt, Artificial Sequence
  derived and/or modified sequence opt2 from MAP1LC3B__Homo_sapiens__NP_073729
augcccuccgagaagaccuucaagcagcgccgcaccuucgagcagcgcgucgaggacguccgccucauccgcgagcagcaccccaccaagauccccgucaucaucgagcgcuacaagggcgagaagcagcuccccguccucgacaagaccaaguuccucguccccgaccacgucaacauguccgagcucaucaagaucauccgccgccgccuccagcucaacgccaaccaggccuucuuccuccucgucaacggccacuccauggucuccgucuccacccccaucuccgaggucuacgaguccgagaaggacgaggacggcuuccucuacauggucuacgccucccaggagaccuucggcaugaagcucuccgucuga

SEQ ID NO: 45703 - RNA, 3180 nt, Artificial Sequence
  derived and/or modified sequence opt2 from MAP1S__Homo_sapiens__NP_060644
auggccgccgucgccggcuccggcgccgccgccgcccccuccucccuccuccucgucgucggcuccgaguucggcucccccggccuccucaccuacguccucgaggagcucgagcgcggcauccgcuccugggacgucgaccccggcgucugcaaccucgacgagcagcucaaggucuucgucucccgccacuccgccaccuucuccuccaucgucaagggccagcgcucccuccaccaccgcggcgacaaccucgagacccucguccuccucaaccccuccgacaagucccucuacgacgagcuccgcaaccuccuccucgaccccgccucccacaagcuccucguccucgccggccccugccucgaggagaccggcgagcuccuccuccagaccggcggcuucuccccccaccacuuccuccagguccucaaggaccgcgagauccgcgacauccucgccaccacccccccccccguccagccccccauccucaccaucaccugccccaccuucggcgacugggcccagcucgcccccgccguccccggccuccagggcgcccuccgccuccagcuccgccucaacccccccgcccagcuccccaacuccgagggccucugcgaguuccucgaguacgucgccgagucccucgagccccccucccccuucgagcuccucgagccccccaccuccggcggcuuccuccgccucggccgccccugcugcuacaucuuccccggcggccucggcgacgccgccuucuucgccgucaacggcuucaccguccucgucaacggcggcuccaaccccaaguccuccuucuggaagcucguccgccaccucgaccgcgucgacgccguccucgucacccaccccggcgccgacucccuccccggccucaacucccuccuccgccgcaagcucgccgagcgcuccgaggucgccgccggcggcggcuccugggacgaccgccuccgccgccucaucucccccaaccucggcgucgucuucuucaacgccugcgaggccgccucccgccucgcccgcggcgaggacgaggccgagcucgcccucucccuccucgcccagcucggcaucaccccccucccccucucccgcggccccguccccgccaagcccaccguccucuucgagaagaugggcgucggccgccucgacauguacguccuccacccccccuccgccggcgccgagcgcacccucgccuccgucugcgcccuccucgucuggcaccccgccggccccggcgagaaggucguccgcguccucuuccccggcugcaccccccccgccugccuccucgacggccucguccgccuccagcaccuccgcuuccuccgcgagcccgucgucaccccccaggaccucgagggccccggccgcgccgaguccaaggaguccgucggcucccgcgacuccuccaagcgcgagggccuccucgccacccacccccgccccggccaggagcgccccggcgucgcccgcaaggagcccgcccgcgccgaggccccccgcaagaccgagaaggaggccaagaccccccgcgagcucaagaaggaccccaagcccuccgucucccgcacccagccccgcgagguccgccgcgccgccuccuccguccccaaccucaagaagaccaacgcccaggccgcccccaagccccgcaaggcccccuccaccucccacuccggcuucccccccgucgccaacggcccccgcuccccccccucccuccgcugcggcgaggccuccccccccuccgccgccugcggcucccccgccucccagcucgucgccacccccucccucgagcucggccccauccccgccggcgaggagaaggcccucgagcucccccucgccgccuccuccaucccccgcccccgcacccccucccccgagucccaccgcucccccgccgagggcuccgagcgccucucccucuccccccuccgcggcggcgaggccggccccgacgccucccccaccgucaccacccccaccgucaccacccccucccuccccgccgaggucggcuccccccacuccaccgaggucgacgagucccucuccgucuccuucgagcagguccucccccccuccgcccccaccuccgaggccggccucucccucccccuccgcggcccccgcgcccgccgcuccgccuccccccacgacgucgaccucugccucgucucccccugcgaguucgagcaccgcaaggccguccccauggcccccgcccccgccucccccggcuccuccaacgacuccuccgcccgcucccaggagcgcgccggcggccucggcgccgaggagaccccccccaccuccgucuccgagucccuccccacccucuccgacuccgaccccgucccccucgcccccggcgccgccgacuccgacgaggacaccgagggcuucggcgucccccgccacgacccccuccccgacccccucaaggucccccccccccuccccgaccccuccuccaucugcauggucgaccccgagaugcucccccccaagaccgcccgccagaccgagaacgucucccgcacccgcaagccccucgcccgccccaacucccgcgccgccgcccccaaggccacccccgucgccgccgccaagaccaagggccucgccggcggcgaccgcgccucccgcccccucuccgcccgcuccgagcccuccgagaagggcggccgcgccccccucucccgcaaguccuccacccccaagaccgccacccgcggccccuccggcuccgccuccucccgccccggcgucuccgccaccccccccaagucccccgucuaccucgaccucgccuaccuccccuccggcuccuccgcccaccucgucgacgaggaguucuuccagcgcguccgcgcccucugcuacgucaucuccggccaggaccagcgcaaggaggagggcaugcgcgccguccucgacgcccuccucgccuccaagcagcacugggaccgcgaccuccaggucacccucauccccaccuucgacuccgucgccaugcacaccugguacgccgagacccacgcccgccaccaggcccucggcaucaccguccucggcuccaacuccauggucuccaugcaggacgacgccuuccccgccugcaaggucgaguucuga

SEQ ID NO: 45704 - RNA, 1680 nt, Artificial Sequence
  derived and/or modified sequence opt2 from MAP2__Homo_sapiens__NP_001034627
auggccgacgagcgcaaggacgaggccaaggccccccacuggaccuccgccccccucaccgaggccuccgcccacucccacccccccgagaucaaggaccagggcggcgccggcgagggccucguccgcuccgccaacggcuuccccuaccgcgaggacgaggagggcgccuucggcgagcacggcucccagggcaccuacuccaacaccaaggagaacggcaucaacggcgagcucaccuccgccgaccgcgagaccgccgaggaggucuccgcccgcaucguccaggucgucaccgccgaggccgucgccguccucaagggcgagcaggagaaggaggcccagcacaaggaccagaccgccgcccucccccucgccgccgaggagaccgccaaccucccccccucccccccccccucccccgccuccgagcagaccgucaccgucgaggaggccgccggcggcgaguccgcccucgcccccuccgucuucaagcaggccaaggacaaggucuccaacuccacccucuccaagauccccgcccuccagggcuccaccaaguccccccgcuacuccuccgccugccccuccaccaccaagcgcgccaccuucuccgacucccuccucauccagcccaccuccgccggcuccaccgaccgccuccccuacuccaaguccggcaacaaggacggcgucaccaagucccccgagaagcgcuccucccucccccgccccuccuccauccuccccccccgccgcggcgucuccggcgaccgcgacgagaacuccuucucccucaacuccuccaucuccuccuccgcccgccgcaccacccgcuccgagcccauccgccgcgccggcaaguccggcaccuccacccccaccacccccggcuccaccgccaucacccccggcaccccccccuccuacuccucccgcacccccggcacccccggcacccccuccuacccccgcaccccccacacccccggcacccccaaguccgccauccucguccccuccgagaagaaggucgccaucauccgcaccccccccaagucccccgccacccccaagcagcuccgccucaucaaccagccccuccccgaccucaagaacgucaaguccaagaucggcuccaccgacaacaucaaguaccagcccaagggcggccagguccgcauccucaacaagaagaucgacuucuccaagguccagucccgcugcggcuccaaggacaacaucaagcacuccgccggcggcggcaacguccagaucgucaccaagaagaucgaccucucccacgucaccuccaagugcggcucccucaagaacauccgccaccgccccggcggcggccgcgucaagaucgaguccgucaagcucgacuucaaggagaaggcccaggccaaggucggcucccucgacaacgcccaccacguccccggcggcggcaacgucaagaucgacucccagaagcucaacuuccgcgagcacgccaaggcccgcgucgaccacggcgccgagaucaucacccagucccccggccgcuccuccgucgccuccccccgccgccucuccaacgucuccuccuccggcuccaucaaccuccucgaguccccccagcucgccacccucgccgaggacgucaccgccgcccucgccaagcagggccucuga

SEQ ID NO: 45705 - RNA, 1182 nt, Artificial Sequence
  derived and/or modified sequence opt2 from MAP2K1__Homo_sapiens__NP_002746
augcccaagaagaagcccacccccauccagcucaaccccgcccccgacggcuccgccgucaacggcaccuccuccgccgagaccaaccucgaggcccuccagaagaagcucgaggagcucgagcucgacgagcagcagcgcaagcgccucgaggccuuccucacccagaagcagaaggucggcgagcucaaggacgacgacuucgagaagaucuccgagcucggcgccggcaacggcggcgucgucuucaaggucucccacaagcccuccggccucgucauggcccgcaagcucauccaccucgagaucaagcccgccauccgcaaccagaucauccgcgagcuccagguccuccacgagugcaacucccccuacaucgucggcuucuacggcgccuucuacuccgacggcgagaucuccaucugcauggagcacauggacggcggcucccucgaccagguccucaagaaggccggccgcauccccgagcagauccucggcaaggucuccaucgccgucaucaagggccucaccuaccuccgcgagaagcacaagaucaugcaccgcgacgucaagcccuccaacauccucgucaacucccgcggcgagaucaagcucugcgacuucggcgucuccggccagcucaucgacuccauggccaacuccuucgucggcacccgcuccuacaugucccccgagcgccuccagggcacccacuacuccguccaguccgacaucugguccaugggccucucccucgucgagauggccgucggccgcuaccccauccccccccccgacgccaaggagcucgagcucauguucggcugccaggucgagggcgacgccgccgagacccccccccgcccccgcacccccggccgcccccucuccuccuacggcauggacucccgcccccccauggccaucuucgagcuccucgacuacaucgucaacgagcccccccccaagcuccccuccggcgucuucucccucgaguuccaggacuucgucaacaagugccucaucaagaaccccgccgagcgcgccgaccucaagcagcucaugguccacgccuucaucaagcgcuccgacgccgaggaggucgacuucgccggcuggcucugcuccaccaucggccucaaccagcccuccacccccacccacgccgccggcgucuga

SEQ ID NO: 45706 - RNA, 1203 nt, Artificial Sequence
  derived and/or modified sequence opt2 from MAP2K2__Homo_sapiens__NP_109587
augcucgcccgccgcaagcccguccuccccgcccucaccaucaaccccaccaucgccgagggccccucccccaccuccgagggcgccuccgaggccaaccucgucgaccuccagaagaagcucgaggagcucgagcucgacgagcagcagaagaagcgccucgaggccuuccucacccagaaggccaaggucggcgagcucaaggacgacgacuucgagcgcaucuccgagcucggcgccggcaacggcggcgucgucaccaagguccagcaccgccccuccggccucaucauggcccgcaagcucauccaccucgagaucaagcccgccauccgcaaccagaucauccgcgagcuccagguccuccacgagugcaacucccccuacaucgucggcuucuacggcgccuucuacuccgacggcgagaucuccaucugcauggagcacauggacggcggcucccucgaccagguccucaaggaggccaagcgcauccccgaggagauccucggcaaggucuccaucgccguccuccgcggccucgccuaccuccgcgagaagcaccagaucaugcaccgcgacgucaagcccuccaacauccucgucaacucccgcggcgagaucaagcucugcgacuucggcgucuccggccagcucaucgacuccauggccaacuccuucgucggcacccgcuccuacauggcccccgagcgccuccagggcacccacuacuccguccaguccgacaucugguccaugggccucucccucgucgagcucgccgucggccgcuaccccauccccccccccgacgccaaggagcucgaggccaucuucggccgccccgucgucgacggcgaggagggcgagccccacuccaucuccccccgcccccgcccccccggccgccccgucuccggccacggcauggacucccgccccgccauggccaucuucgagcuccucgacuacaucgucaacgagcccccccccaagcuccccaacggcgucuucacccccgacuuccaggaguucgucaacaagugccucaucaagaaccccgccgagcgcgccgaccucaagaugcucaccaaccacaccuucaucaagcgcuccgaggucgaggaggucgacuucgccggcuggcucugcaagacccuccgccucaaccagcccggcacccccacccgcaccgccgucuga

SEQ ID NO: 45707 - RNA, 957 nt, Artificial Sequence
  derived and/or modified sequence opt2 from MAP2K3__Homo_sapiens__NP_002747
auguccaagccccccgcccccaaccccacccccccccgcaaccucgacucccgcaccuucaucaccaucggcgaccgcaacuucgaggucgaggccgacgaccucgucaccaucuccgagcucggccgcggcgccuacggcgucgucgagaagguccgccacgcccaguccggcaccaucauggccgucaagcgcauccgcgccaccgucaacucccaggagcagaagcgccuccucauggaccucgacaucaacaugcgcaccgucgacugcuucuacaccgucaccuucuacggcgcccucuuccgcgagggcgacgucuggaucugcauggagcucauggacaccucccucgacaaguucuaccgcaagguccucgacaagaacaugaccauccccgaggacauccucggcgagaucgccgucuccaucguccgcgcccucgagcaccuccacuccaagcucuccgucauccaccgcgacgucaagcccuccaacguccucaucaacaaggagggccacgucaagaugugcgacuucggcaucuccggcuaccucgucgacuccgucgccaagaccauggacgccggcugcaagcccuacauggcccccgagcgcaucaaccccgagcucaaccagaagggcuacaacgucaaguccgacgucuggucccucggcaucaccaugaucgagauggccauccuccgcuuccccuacgaguccuggggcacccccuuccagcagcucaagcaggucgucgaggagcccuccccccagcuccccgccgaccgcuucucccccgaguucgucgacuucaccgcccagugccuccgcaagaaccccgccgagcgcauguccuaccucgagcucauggagcaccccuucuucacccuccacaagaccaagaagaccgacaucgccgccuucgucaaggagauccucggcgaggacuccuga

SEQ ID NO: 45708 - RNA, 1233 nt, Artificial Sequence
  derived and/or modified sequence opt2 from MAP2K4__Homo_sapiens__NP_001268364
auggccgcccccucccccuccggcggcggcggcuccggcggcggcuccggcuccggcacccccggccccgucggcucccccgcccccggccaccccgccgucuccuccaugcagggcuuccagaucaacuucugcgagaaggcccaguccaagcgcaaggcccucaagcucaacuucgccaacccccccuucaaguccaccgcccgcuucacccucaaccccaaccccaccggcguccagaacccccacaucgagcgccuccgcacccacuccaucgaguccuccggcaagcucaagaucucccccgagcagcacugggacuucaccgccgaggaccucaaggaccucggcgagaucggccgcggcgccuacggcuccgucaacaagaugguccacaagcccuccggccagaucauggccgucaagcgcauccgcuccaccgucgacgagaaggagcagaagcagcuccucauggaccucgacgucgucaugcgcuccuccgacugccccuacaucguccaguucuacggcgcccucuuccgcgagggcgacugcuggaucugcauggagcucauguccaccuccuucgacaaguucuacaaguacgucuacuccguccucgacgacgucauccccgaggagauccucggcaagaucacccucgccaccgucaaggcccucaaccaccucaaggagaaccucaagaucauccaccgcgacaucaagcccuccaacauccuccucgaccgcuccggcaacaucaagcucugcgacuucggcaucuccggccagcucgucgacuccaucgccaagacccgcgacgccggcugccgccccuacauggcccccgagcgcaucgaccccuccgccucccgccagggcuacgacguccgcuccgacgucuggucccucggcaucacccucuacgagcucgccaccggccgcuuccccuaccccaaguggaacuccgucuucgaccagcucacccaggucgucaagggcgaccccccccagcucuccaacuccgaggagcgcgaguucucccccuccuucaucaacuucgucaaccucugccucaccaaggacgaguccaagcgccccaaguacaaggagcuccucaagcaccccuucauccucauguacgaggagcgcgccgucgaggucgccugcuacgucugcaagauccucgaccagaugcccgccacccccuccucccccauguacgucgacuga

SEQ ID NO: 45709 - RNA, 1239 nt, Artificial Sequence
  derived and/or modified sequence opt2 from MAP2K5__Homo_sapiens__NP_001193733
augauggagggccacuucccccaguccgacgucaucggccagguccuccccgaggccaccaccaccgccuucgaguacgaggacgaggacggcgaccgcaucaccguccgcuccgacgaggagaugaaggccaugcucuccuacuacuacuccaccgucauggagcagcaggucaacggccagcucaucgagccccuccagaucuucccccgcgccugcaagccccccggcgagcgcaacauccacggccucaaggucaacacccgcgccggccccucccagcacuccucccccgccgucuccgacucccuccccuccaacucccucaagaaguccuccgccgagcucaagaagauccucgccaacggccagaugaacgagcaggacauccgcuaccgcgacacccucggccacggcaacggcggcaccgucuacaaggccuaccacguccccuccggcaagauccucgccgucaaggucauccuccucgacaucacccucgagcuccagaagcagaucauguccgagcucgagauccucuacaagugcgacuccuccuacaucaucggcuucuacggcgccuucuucgucgagaaccgcaucuccaucugcaccgaguucauggacggcggcucccucgacgucuaccgcaagaugcccgagcacguccucggccgcaucgccgucgccgucgucaagggccucaccuaccucuggucccucaagauccuccaccgcgacgucaagcccuccaacaugcucgucaacacccgcggccaggucaagcucugcgacuucggcgucuccacccagcucgucaacuccaucgccaagaccuacgucggcaccaacgccuacauggcccccgagcgcaucuccggcgagcaguacggcauccacuccgacgucuggucccucggcaucuccuucauggagcucgcccucggccgcuuccccuacccccagauccagaagaaccagggcucccucaugccccuccagcuccuccagugcaucgucgacgaggacucccccguccuccccgucggcgaguucuccgagcccuucguccacuucaucacccagugcaugcgcaagcagcccaaggagcgccccgcccccgaggagcucaugggccaccccuucaucguccaguucaacgacggcaacgccgccgucgucuccaugugggucugccgcgcccucgaggagcgccgcucccagcagggcccccccuga

SEQ ID NO: 45710 - RNA, 1005 nt, Artificial Sequence
  derived and/or modified sequence opt2 from MAP2K6__Homo_sapiens__NP_002749
augucccaguccaagggcaagaagcgcaaccccggccucaagauccccaaggaggccuucgagcagccccagaccuccuccacccccccccgcgaccucgacuccaaggccugcaucuccaucggcaaccagaacuucgaggucaaggccgacgaccucgagcccaucauggagcucggccgcggcgccuacggcgucgucgagaagaugcgccacguccccuccggccagaucauggccgucaagcgcauccgcgccaccgucaacucccaggagcagaagcgccuccucauggaccucgacaucuccaugcgcaccgucgacugccccuucaccgucaccuucuacggcgcccucuuccgcgagggcgacgucuggaucugcauggagcucauggacaccucccucgacaaguucuacaagcaggucaucgacaagggccagaccauccccgaggacauccucggcaagaucgccgucuccaucgucaaggcccucgagcaccuccacuccaagcucuccgucauccaccgcgacgucaagcccuccaacguccucaucaacgcccucggccaggucaagaugugcgacuucggcaucuccggcuaccucgucgacuccgucgccaagaccaucgacgccggcugcaagcccuacauggcccccgagcgcaucaaccccgagcucaaccagaagggcuacuccgucaaguccgacaucuggucccucggcaucaccaugaucgagcucgccauccuccgcuuccccuacgacuccuggggcacccccuuccagcagcucaagcaggucgucgaggagcccuccccccagcuccccgccgacaaguucuccgccgaguucgucgacuucaccucccagugccucaagaagaacuccaaggagcgccccaccuaccccgagcucaugcagcaccccuucuucacccuccacgaguccaagggcaccgacgucgccuccuucgucaagcucauccucggcgacuga

SEQ ID NO: 45711 - RNA, 1308 nt, Artificial Sequence
  derived and/or modified sequence opt2 from MAP2K7__Homo_sapiens__NP_001284484
auggccgccuccucccucgagcagaagcucucccgccucgaggccaagcucaagcaggagaaccgcgaggcccgccgccgcaucgaccucaaccucgacaucuccccccagcgcccccgccccaucaucgucaucacccucucccccgcccccgcccccucccagcgcgccgcccuccagcucccccucgccaacgacggcggcucccgcucccccuccuccgaguccuccccccagcaccccaccccccccgcccgcccccgccacaugcucggccuccccuccacccucuucaccccccgcuccauggaguccaucgagaucgaccagaagcuccaggagaucaugaagcagaccggcuaccucaccaucggcggccagcgcuaccaggccgagaucaacgaccucgagaaccucggcgagaugggcuccggcaccugcggccaggucuggaagaugcgcuuccgcaagaccggccacgucaucgccgucaagcagaugcgccgcuccggcaacaaggaggagaacaagcgcauccucauggaccucgacgucguccucaagucccacgacugccccuacaucguccagugcuucggcaccuucaucaccaacaccgacgucuucaucgccauggagcucaugggcaccugcgccgagaagcucaagaagcgcaugcagggccccauccccgagcgcauccucggcaagaugaccgucgccaucgucaaggcccucuacuaccucaaggagaagcacggcgucauccaccgcgacgucaagcccuccaacauccuccucgacgagcgcggccagaucaagcucugcgacuucggcaucuccggccgccucgucgacuccaaggccaagacccgcuccgccggcugcgccgccuacauggcccccgagcgcaucgacccccccgaccccaccaagcccgacuacgacauccgcgccgacgucuggucccucggcaucucccucgucgagcucgccaccggccaguuccccuacaagaacugcaagaccgacuucgagguccucaccaagguccuccaggaggagcccccccuccuccccggccacaugggcuucuccggcgacuuccaguccuucgucaaggacugccucaccaaggaccaccgcaagcgccccaaguacaacaagcuccucgagcacuccuucaucaagcgcuacgagacccucgaggucgacgucgccuccugguucaaggacgucauggccaagaccgaguccccccgcaccuccggcguccucucccagccccaccuccccuucuuccgcuga

SEQ ID NO: 45712 - RNA, 2865 nt, Artificial Sequence
  derived and/or modified sequence opt2 from MAP3K10__Homo_sapiens__NP_002437
auggaggaggaggagggcgccgucgccaaggaguggggcaccacccccgccggccccgucuggaccgccgucuucgacuacgaggccgccggcgacgaggagcucacccuccgccgcggcgaccgcguccagguccucucccaggacugcgccgucuccggcgacgagggcugguggaccggccagcuccccuccggccgcgucggcgucuuccccuccaacuacgucgcccccggcgcccccgccgcccccgccggccuccagcucccccaggagauccccuuccacgagcuccagcucgaggagaucaucggcgucggcggcuucggcaaggucuaccgcgcccucuggcgcggcgaggaggucgccgucaaggccgcccgccucgaccccgagaaggaccccgccgucaccgccgagcaggucugccaggaggcccgccucuucggcgcccuccagcaccccaacaucaucgcccuccgcggcgccugccucaaccccccccaccucugccucgucauggaguacgcccgcggcggcgcccucucccgcguccucgccggccgccgcguccccccccacguccucgucaacugggccguccaggucgcccgcggcaugaacuaccuccacaacgacgcccccguccccaucauccaccgcgaccucaaguccaucaacauccucauccucgaggccaucgagaaccacaaccucgccgacaccguccucaagaucaccgacuucggccucgcccgcgaguggcacaagaccaccaagauguccgccgccggcaccuacgccuggauggcccccgaggucauccgccucucccucuucuccaaguccuccgacgucugguccuucggcguccuccucugggagcuccucaccggcgagguccccuaccgcgagaucgacgcccucgccgucgccuacggcgucgccaugaacaagcucacccuccccauccccuccaccugccccgagcccuucgcccgccuccucgaggagugcugggaccccgacccccacggccgccccgacuucggcuccauccucaagcgccucgaggucaucgagcaguccgcccucuuccagaugccccucgaguccuuccacucccuccaggaggacuggaagcucgagauccagcacauguucgacgaccuccgcaccaaggagaaggagcuccgcucccgcgaggaggagcuccuccgcgccgcccaggagcagcgcuuccaggaggagcagcuccgccgccgcgagcaggagcucgccgagcgcgagauggacaucgucgagcgcgagcuccaccuccucaugugccagcucucccaggagaagccccgcguccgcaagcgcaagggcaacuucaagcgcucccgccuccucaagcuccgcgagggcggcucccacaucucccuccccuccggcuucgagcacaagaucaccguccaggccucccccacccucgacaagcgcaagggcuccgacggcgccuccccccccgccucccccuccaucaucccccgccuccgcgccauccgccucacccccgucgacugcggcggcuccuccuccggcuccuccuccggcggcuccggcaccuggucccgcggcggcccccccaagaaggaggagcucgucggcggcaagaagaagggccgcaccuggggccccuccuccacccuccagaaggagcgcgucggcggcgaggagcgccucaagggccucggcgagggcuccaagcagugguccuccuccgcccccaaccucggcaagucccccaagcacacccccaucgcccccggcuucgccucccucaacgagauggaggaguucgccgaggccgaggacggcggcuccuccgucccccccucccccuacuccacccccuccuaccucuccgucccccuccccgccgagcccucccccggcgcccgcgcccccugggagcccacccccuccgccccccccgcccgcuggggccacggcgcccgccgccgcugcgaccucgcccuccucggcugcgccacccuccucggcgccgucggccucggcgccgacgucgccgaggcccgcgccgccgacggcgaggagcagcgccgcuggcucgacggccucuucuucccccgcgccggccgcuucccccgcggccucuccccccccgcccgcccccacggccgccgcgaggacgucggccccggccucggccucgcccccuccgccacccucgucucccucuccuccgucuccgacugcaacuccacccgcucccuccuccgcuccgacuccgacgaggccgcccccgccgcccccucccccccccccuccccccccgcccccacccccacccccucccccuccaccaacccccucgucgaccucgagcucgaguccuucaagaaggacccccgccagucccucacccccacccacgucaccgccgccugcgccgucucccgcggccaccgccgcacccccuccgacggcgcccucggccagcgcggcccccccgagcccgccggccacggccccggcccccgcgaccuccucgacuucccccgccuccccgacccccaggcccucuuccccgcccgccgccgcccccccgaguuccccggccgccccaccacccucaccuucgccccccgcccccgccccgccgccucccgcccccgccucgaccccuggaagcucgucuccuucggccgcacccucaccaucuccccccccucccgccccgacacccccgagucccccggcccccccuccguccagcccacccuccucgacauggacauggagggccagaaccaggacuccaccgucccccucugcggcgcccacggcucccacuga

SEQ ID NO: 45713 - RNA, 2544 nt, Artificial Sequence
  derived and/or modified sequence opt2 from MAP3K11__Homo_sapiens__NP_002410
auggagccccucaagucccucuuccucaaguccccccucggcuccuggaacggcuccggcuccggcggcggcggcggcggcggcggcggccgccccgagggcucccccaaggccgccggcuacgccaaccccgucuggaccgcccucuucgacuacgagcccuccggccaggacgagcucgcccuccgcaagggcgaccgcgucgagguccucucccgcgacgccgccaucuccggcgacgagggcuggugggccggccaggucggcggccaggucggcaucuuccccuccaacuacgucucccgcggcggcggccccccccccugcgaggucgccuccuuccaggagcuccgccucgaggaggucaucggcaucggcggcuucggcaaggucuaccgcggcuccuggcgcggcgagcucgucgccgucaaggccgcccgccaggaccccgacgaggacaucuccgucaccgccgaguccguccgccaggaggcccgccucuucgccaugcucgcccaccccaacaucaucgcccucaaggccgucugccucgaggagcccaaccucugccucgucauggaguacgccgccggcggcccccucucccgcgcccucgccggccgccgcguccccccccacguccucgucaacugggccguccagaucgcccgcggcaugcacuaccuccacugcgaggcccucguccccgucauccaccgcgaccucaaguccaacaacauccuccuccuccagcccaucgaguccgacgacauggagcacaagacccucaagaucaccgacuucggccucgcccgcgaguggcacaagaccacccagauguccgccgccggcaccuacgccuggauggcccccgaggucaucaaggccuccaccuucuccaagggcuccgacgucugguccuucggcguccuccucugggagcuccucaccggcgagguccccuaccgcggcaucgacugccucgccgucgccuacggcgucgccgucaacaagcucacccuccccauccccuccaccugccccgagcccuucgcccagcucauggccgacugcugggcccaggacccccaccgccgccccgacuucgccuccauccuccagcagcucgaggcccucgaggcccagguccuccgcgagaugccccgcgacuccuuccacuccaugcaggagggcuggaagcgcgagauccagggccucuucgacgagcuccgcgccaaggagaaggagcuccucucccgcgaggaggagcucacccgcgccgcccgcgagcagcgcucccaggccgagcagcuccgccgccgcgagcaccuccucgcccagugggagcucgaggucuucgagcgcgagcucacccuccuccuccagcaggucgaccgcgagcgcccccacguccgccgccgccgcggcaccuucaagcgcuccaagcuccgcgcccgcgacggcggcgagcgcaucuccaugccccucgacuucaagcaccgcaucaccguccaggccucccccggccucgaccgccgccgcaacgucuucgaggucggccccggcgacucccccaccuucccccgcuuccgcgccauccagcucgagcccgccgagcccggccaggccuggggccgccaguccccccgccgccucgaggacuccuccaacggcgagcgccgcgccugcugggccuggggccccuccucccccaagcccggcgaggcccagaacggccgccgccgcucccgcauggacgaggccaccugguaccucgacuccgacgacuccuccccccucggcucccccuccaccccccccgcccucaacggcaaccccccccgccccucccucgagcccgaggagcccaagcgccccguccccgccgagcgcggcuccuccuccggcacccccaagcucauccagcgcgcccuccuccgcggcaccgcccuccucgccucccucggccucggccgcgaccuccagccccccggcggccccggccgcgagcgcggcgagucccccaccaccccccccacccccacccccgcccccugccccaccgagcccccccccuccccccucaucugcuucucccucaagacccccgacuccccccccacccccgccccccuccuccucgaccucggcauccccgucggccagcgcuccgccaaguccccccgccgcgaggaggagccccgcggcggcaccgucucccccccccccggcaccucccgcuccgcccccggcacccccggcaccccccgcucccccccccucggccucaucucccgcccccgccccuccccccuccgcucccgcaucgaccccugguccuucgucuccgccggcccccgccccuccccccuccccuccccccagcccgccccccgccgcgcccccuggacccucuuccccgacuccgaccccuucugggacuccccccccgccaaccccuuccagggcggcccccaggacugccgcgcccagaccaaggacaugggcgcccaggcccccuggguccccgaggccggccccuga

SEQ ID NO: 45714 - RNA, 2580 nt, Artificial Sequence
  derived and/or modified sequence opt2 from MAP3K12__Homo_sapiens__NP_006292
auggccugccuccacgagacccgcacccccucccccuccuucggcggcuucgucuccacccucuccgaggccuccaugcgcaagcucgaccccgacaccuccgacugcacccccgagaaggaccucacccccacccacguccuccagcuccacgagcaggacgccggcggccccggcggcgccgccggcucccccgagucccgcgccucccgcguccgcgccgacgagguccgccuccagugccaguccggcuccggcuuccucgagggccucuucggcugccuccgccccgucuggaccaugaucggcaaggccuacuccaccgagcacaagcagcagcaggaggaccucugggagguccccuucgaggagauccucgaccuccagugggucggcuccggcgcccagggcgccgucuuccucggccgcuuccacggcgaggaggucgccgucaagaagguccgcgaccucaaggagaccgacaucaagcaccuccgcaagcucaagcaccccaacaucaucaccuucaagggcgucugcacccaggcccccugcuacugcauccucauggaguucugcgcccagggccagcucuacgagguccuccgcgccggccgccccgucacccccucccuccucgucgacugguccaugggcaucgccggcggcaugaacuaccuccaccuccacaagaucauccaccgcgaccucaagucccccaacaugcucaucaccuacgacgacgucgucaagaucuccgacuucggcaccuccaaggagcucuccgacaaguccaccaagauguccuucgccggcaccgucgccuggauggcccccgaggucauccgcaacgagcccgucuccgagaaggucgacaucugguccuucggcgucguccucugggagcuccucaccggcgagauccccuacaaggacgucgacuccuccgccaucaucuggggcgucggcuccaacucccuccaccuccccguccccuccuccugccccgacggcuucaagauccuccuccgccagugcuggaacuccaagccccgcaaccgccccuccuuccgccagauccuccuccaccucgacaucgccuccgccgacguccucuccaccccccaggagaccuacuucaagucccaggccgaguggcgcgaggaggucaagcuccacuucgagaagaucaaguccgagggcaccugccuccaccgccucgaggaggagcucgucaugcgccgccgcgaggagcuccgccacgcccucgacauccgcgagcacuacgagcgcaagcucgagcgcgccaacaaccucuacauggagcucaacgcccucaugcuccagcucgagcucaaggagcgcgagcuccuccgccgcgagcaggcccucgagcgccgcugccccggccuccucaagccccaccccucccgcggccuccuccacggcaacaccauggagaagcucaucaagaagcgcaacgucccccagaagcucuccccccacuccaagcgccccgacauccucaagaccgagucccuccuccccaagcucgacgccgcccucuccggcgucggccuccccggcugccccaagggcccccccucccccggccgcucccgccgcggcaagacccgccaccgcaaggccuccgccaagggcuccugcggcgaccuccccggccuccgcaccgccguccccccccacgagcccggcggccccggcucccccggcggccucggcggcggccccuccgccugggaggccugcccccccgcccuccgcggccuccaccacgaccuccuccuccgcaagauguccuccuccucccccgaccuccucuccgccgcccucggcucccgcggccgcggcgccaccggcggcgccggcgaccccggcucccccccccccgcccgcggcgacaccccccccuccgagggcuccgcccccggcuccaccucccccgacucccccggcggcgccaagggcgagccccccccccccgucggccccggcgagggcgucggccuccucggcaccggccgcgagggcaccuccggccgcggcggcucccgcgccggcucccagcaccucacccccgccgcccuccucuaccgcgccgccgucacccgcucccagaagcgcggcaucuccuccgaggaggaggagggcgaggucgacuccgaggucgagcucaccuccucccagcgcuggccccagucccucaacaugcgccagucccucuccaccuucuccuccgagaaccccuccgacggcgaggagggcaccgccuccgagcccucccccuccggcacccccgaggucggcuccaccaacaccgacgagcgccccgacgagcgcuccgacgacaugugcucccagggcuccgagaucccccucgaccccccccccuccgaggucauccccggccccgagcccuccucccuccccaucccccaccaggagcuccuccgcgagcgcggcccccccaacuccgaggacuccgacugcgacuccaccgagcucgacaacuccaacuccgucgacgcccuccgcccccccgccucccucccccccuga

SEQ ID NO: 45715 - RNA, 2280 nt, Artificial Sequence
  derived and/or modified sequence opt2 from MAP3K13__Homo_sapiens__NP_001229246
auguacugcggcauccagauccucgcccucugggagcgcggcgucugcacccaggcccccugcuacugcaucaucauggaguacugcgcccacggccagcucuacgagguccuccgcgccggccgcaagaucaccccccgccuccucgucgacugguccaccggcaucgccuccggcaugaacuaccuccaccuccacaagaucauccaccgcgaccucaagucccccaacguccucgucacccacaccgacgccgucaagaucuccgacuucggcaccuccaaggagcucuccgacaaguccaccaagauguccuucgccggcaccgucgccuggauggcccccgaggucauccgcaacgagcccgucuccgagaaggucgacaucugguccuucggcgucguccucugggagcuccucaccggcgagauccccuacaaggacgucgacuccuccgccaucaucuggggcgucggcuccaacucccuccaccuccccguccccuccaccugccccgacggcuucaagauccucaugaagcagaccuggcaguccaagccccgcaaccgccccuccuuccgccagacccucaugcaccucgacaucgccuccgccgacguccucgccaccccccaggagaccuacuucaagucccaggccgaguggcgcgaggaggucaagaagcacuucgagaagaucaaguccgagggcaccugcauccaccgccucgacgaggagcucauccgccgccgccgcgaggagcuccgccacgcccucgacauccgcgagcacuacgagcgcaagcucgagcgcgccaacaaccucuacauggagcucuccgccaucaugcuccagcucgagaugcgcgagaaggagcucaucaagcgcgagcaggccgucgagaagaaguaccccggcaccuacaagcgccaccccguccgccccaucauccaccccaacgccauggagaagcucaugaagcgcaagggcgucccccacaaguccggcaugcagaccaagcgccccgaccuccuccgcuccgagggcauccccaccaccgaggucgcccccaccgccuccccccucuccggcucccccaagauguccaccuccuccuccaagucccgcuaccgcuccaagccccgccaccgccgcggcaacucccgcggcucccacuccgacuucgccgccauccucaagaaccagcccgcccaggagaacuccccccaccccaccuaccuccaccaggcccagucccaguaccccucccuccaccaccacaacucccuccagcagcaguaccagcagcccccccccgccaugucccagucccaccacccccgccucaacaugcacggccaggacaucgccaccugcgccaacaaccuccgcuacuucggccccgccgccgcccuccgcuccccccucuccaaccacgcccagcgccagcuccccggcuccucccccgaccucaucuccaccgccauggccgccgacugcuggcgcuccuccgagcccgacaagggccaggccggccccuggggcugcugccaggccgacgccuacgaccccugccuccagugccgccccgagcaguacggcucccucgacauccccuccgccgagcccgucggccgcucccccgaccucuccaagucccccgcccacaacccccuccucgagaacgcccaguccuccgagaagaccgaggagaacgaguucuccggcugccgcuccgaguccucccucggcaccucccaccucggcaccccccccgcccucccccgcaagacccgcccccuccagaaguccggcgacgacuccuccgaggaggaggagggcgaggucgacuccgaggucgaguucccccgccgccagcgcccccaccgcugcaucuccuccugccaguccuacuccaccuucuccuccgagaacuucuccgucuccgacggcgaggagggcaacaccuccgaccacuccaacucccccgacgagcucgccgacaagcucgaggaccgccucgccgagaagcucgacgaccuccucucccagacccccgagauccccaucgacaucuccucccacuccgacggccucuccgacaaggagugcgccguccgccgcgucaagacccagaugucccucggcaagcucugcgucgaggagcgcggcuacgagaaccccaugcaguucgaggaguccgacugcgacuccuccgacggcgagugcuccgacgccaccguccgcaccaacaagcacuacuccuccgccaccugguga

SEQ ID NO: 45716 - RNA, 2844 nt, Artificial Sequence
  derived and/or modified sequence opt2 from MAP3K14__Homo_sapiens__XP_011523743
auggccgucauggagauggccugccccggcgcccccggcuccgccgucggccagcagaaggagcuccccaaggccaaggagaagacccccccccucggcaagaagcaguccuccgucuacaagcucgaggccgucgagaagucccccgucuucugcggcaagugggagauccucaacgacgucaucaccaagggcaccgccaaggagggcuccgaggccggccccgccgccaucuccaucaucgcccaggccgagugcgagaacucccaggaguucucccccaccuucuccgagcgcaucuucaucgccggcuccaagcaguacucccaguccgagucccucgaccagauccccaacaacgucgcccacgccaccgagggcaagauggcccgcgucugcuggaagggcaagcgccgcuccaaggcccgcaagaagcgcaagaagaaguccuccaagucccucgcccacgccggcgucgcccucgccaagccccucccccgcacccccgagcaggaguccugcaccauccccguccaggaggacgaguccccccucggcgcccccuacguccgcaacaccccccaguucaccaagccccucaaggagcccggccucggccagcucugcuucaagcagcucggcgagggccuccgccccgcccucccccgcuccgagcuccacaagcucaucuccccccuccagugccucaaccacgucuggaagcuccaccacccccaggacggcggcccccucccccuccccacccaccccuuccccuacucccgccucccccaccccuuccccuuccacccccuccagcccuggaagccccacccccucgaguccuuccucggcaagcucgccugcgucgacucccagaagccccuccccgacccccaccucuccaagcucgccugcgucgacucccccaagccccuccccggcccccaccucgagcccuccugccucucccgcggcgcccacgagaaguucuccgucgaggaguaccucguccacgcccuccagggcuccgucuccuccggccaggcccacucccucaccucccucgccaagaccugggccgcccgcggcucccgcucccgcgagcccucccccaagaccgaggacaacgagggcguccuccucaccgagaagcucaagcccgucgacuacgaguaccgcgaggagguccacugggccacccaccagcuccgccucggccgcggcuccuucggcgagguccaccgcauggaggacaagcagaccggcuuccagugcgccgucaagaagguccgccucgaggucuuccgcgccgaggagcucauggccugcgccggccucaccuccccccgcaucgucccccucuacggcgccguccgcgagggccccugggucaacaucuucauggagcuccucgagggcggcucccucggccagcucgucaaggagcagggcugccuccccgaggaccgcgcccucuacuaccucggccaggcccucgagggccucgaguaccuccacucccgccgcauccuccacggcgacgucaaggccgacaacguccuccucuccuccgacggcucccacgccgcccucugcgacuucggccacgccgucugccuccagcccgacggccucggcaagucccuccucaccggcgacuacauccccggcaccgagacccacauggcccccgaggucguccucggccgcuccugcgacgccaaggucgacgucugguccuccugcugcaugaugcuccacaugcucaacggcugccaccccuggacccaguucuuccgcggcccccucugccucaagaucgccuccgagcccccccccguccgcgagaucccccccuccugcgccccccucaccgcccaggccauccaggagggccuccgcaaggagcccauccaccgcgucuccgccgccgagcucggcggcaaggucaaccgcgcccuccagcaggucggcggccucaagucccccuggcgcggcgaguacaaggagccccgccaccccccccccaaccaggccaacuaccaccagacccuccacgcccagccccgcgagcucuccccccgcgcccccggcccccgccccgccgaggagaccaccggccgcgcccccaagcuccagcccccccucccccccgagccccccgagcccaacaagucccccccccucacccucuccaaggaggaguccggcaugugggagccccucccccucuccucccucgagcccgcccccgcccgcaaccccuccucccccgagcgcaaggccaccguccccgagcaggagcuccagcagcucgagaucgagcucuuccucaacucccucucccagcccuucucccucgaggagcaggagcagauccucuccugccucuccaucgacucccucucccucuccgacgacuccgagaagaaccccuccaaggccucccaguccucccgcgacacccucuccuccggcguccacuccugguccucccaggccgaggcccgcuccuccuccuggaacaugguccucgcccgcggccgccccaccgacacccccuccuacuucaacggcgucaagguccagauccagucccucaacggcgagcaccuccacauccgcgaguuccaccgcgucaaggucggcgacaucgccaccggcaucuccucccagauccccgccgccgccuucucccucgucaccaaggacggccagcccguccgcuacgacauggagguccccgacuccggcaucgaccuccagugcacccucgcccccgacggcuccuucgccugguccuggcgcgucaagcacggccagcucgagaaccgccccuga

SEQ ID NO: 45717 - RNA, 3648 nt, Artificial Sequence
  derived and/or modified sequence opt2 from MAP3K19__Homo_sapiens__NP_001018054
auguccuccaugcccaagcccgagcgccacgccgagucccuccucgacaucugccacgacaccaacuccucccccaccgaccucaugaccgucaccaagaaccagaacaucauccuccaguccaucucccgcuccgaggaguucgaccaggacggcgacugcucccacuccacccucgucaacgaggaggaggaccccuccggcggccgccaggacuggcagccccgcaccgaggaguucuccaccucccacaugaaguacuccggccgcuccaucaaguuccuccuccccccccucucccuccuccccacccgcuccggcguccucaccaucccccagaaccacaaguuccccaaggagaaggagcgcaacauccccucccucaccuccuucguccccaagcucuccgucuccguccgccaguccgacgagcucucccccuccaacgagccccccggcgcccucgucaagucccucauggaccccacccuccgcuccuccgacggcuucaucuggucccgcaacaugugcuccuuccccaagaccaaccaccaccgccagugccucgagaaggaggagaacuggaaguccaaggagaucgaggagugcaacaagaucgagaucacccacuucgagaagggccagucccucgucuccuucgagaaccucaaggagggcaacauccccgccguccgcgaggaggacaucgacugccacggcuccaagacccgcaagcccgaggaggagaacucccaguaccucuccucccgcaagaacgaguccuccgucgccaagaacuacgagcaggaccccgagaucgucugcaccauccccuccaaguuccaggagacccagcacuccgagaucacccccucccaggacgaggagaugcgcaacaacaaggccgccuccaagcgcgucucccuccacaagaacgaggccauggagcccaacaacauccucgaggagugcaccguccucaagucccucuccuccgucgucuucgacgaccccaucgacaagcuccccgagggcugcuccuccauggagaccaacaucaagaucuccaucgccgagcgcgccaagcccgagaugucccgcauggucccccucauccacaucaccuuccccgucgacggcucccccaaggagcccgucaucgccaagcccucccuccagacccgcaagggcaccauccacaacaaccacuccgucaacauccccguccaccaggagaacgacaagcacaagaugaacucccaccgcuccaagcucgacuccaagaccaagaccuccaagaagaccccccagaacuucgucaucuccaccgagggccccaucaagcccaccaugcacaagaccuccaucaagacccagaucuuccccgcccucggccucgucgacccccgccccuggcagcucccccgcuuccagaagaagaugccccagaucgccaagaagcaguccacccaccgcacccagaagcccaagaagcaguccuuccccugcaucugcaagaaccccggcacccagaaguccugcgucccccucuccguccagcccaccgagccccgccucaacuaccucgaccucaaguacuccgacauguucaaggagaucaacuccaccgccaacggccccggcaucuacgagauguucggcacccccgucuacugccacguccgcgagaccgagcgcgacgagaacaccuacuaccgcgagaucugcuccgcccccuccggccgccgcaucaccaacaagugccgcuccucccacuccgagcgcaaguccaacauccgcacccgccucucccagaagaagacccacaugaagugccccaagaccuccuucggcaucaagcaggagcacaagguccucaucuccaaggagaaguccuccaaggccguccacuccaaccuccacgacaucgagaacggcgacggcaucuccgagcccgacuggcagaucaaguccuccggcaacgaguuccucuccuccaaggacgagauccaccccaugaaccucgcccagacccccgagcaguccaugaagcagaacgaguucccccccgucuccgaccucuccaucgucgaggaggucuccauggaggaguccaccggcgaccgcgacaucuccaacaaccagauccucaccaccucccuccgcgaccuccaggagcucgaggagcuccaccaccagauccccuucauccccuccgaggacuccugggccguccccuccgagaagaacuccaacaaguacguccagcaggagaagcagaacaccgccucccucuccaaggucaacgccucccgcauccucaccaacgaccucgaguucgacuccgucuccgaccacuccaagacccucaccaacuucuccuuccaggccaagcaggaguccgccuccucccagaccuaccaguacuggguccacuaccucgaccacgacucccucgccaacaaguccaucaccuaccagauguucggcaagacccucuccggcaccaacuccaucucccaggagaucauggacuccgucaacaacgaggagcucaccgacgagcuccucggcugccucgccgccgagcuccucgcccucgacgagaaggacaacaacuccugccagaagauggccaacgagaccgaccccgagaaccucaaccucguccuccgcuggcgcggcuccacccccaaggagaugggccgcgagaccaccaaggucaagauccagcgccacuccuccggccuccgcaucuacgaccgcgaggagaaguuccucaucuccaacgagaagaagaucuucuccgagaacucccucaaguccgaggagcccauccucuggaccaagggcgagauccucggcaagggcgccuacggcaccgucuacugcggccucaccucccagggccagcucaucgccgucaagcaggucgcccucgacaccuccaacaagcucgccgccgagaaggaguaccgcaagcuccaggaggaggucgaccuccucaaggcccucaagcacgucaacaucgucgccuaccucggcaccugccuccaggagaacaccgucuccaucuucauggaguucguccccggcggcuccaucuccuccaucaucaaccgcuucggcccccuccccgagauggucuucugcaaguacaccaagcagauccuccagggcgucgccuaccuccacgagaacugcgucguccaccgcgacaucaagggcaacaacgucaugcucaugcccaccggcaucaucaagcucaucgacuucggcugcgcccgccgccucgccugggccggccucaacggcacccacuccgacaugcucaaguccaugcacggcacccccuacuggauggcccccgaggucaucaacgaguccggcuacggccgcaaguccgacaucugguccaucggcugcaccgucuucgagauggccaccggcaagcccccccucgccuccauggaccgcauggccgccauguucuacaucggcgcccaccgcggccucaugcccccccuccccgaccacuucuccgagaacgccgccgacuucguccgcaugugccucacccgcgaccagcacgagcgccccuccgcccuccagcuccucaagcacuccuuccucgagcgcucccacuga

SEQ ID NO: 45718 - RNA, 4539 nt, Artificial Sequence
  derived and/or modified sequence opt2 from MAP3K1__Homo_sapiens__NP_005912
auggccgccgccgccggcaaccgcgccuccuccuccggcuuccccggcgcccgcgccaccucccccgaggccggcggcggcggcggcgcccucaaggccuccuccgcccccgccgccgccgccggccuccuccgcgaggccggcuccggcggccgcgagcgcgccgacuggcgccgccgccagcuccgcaagguccgcuccgucgagcucgaccagcuccccgagcagccccucuuccucgccgccuccccccccgccuccuccaccucccccucccccgagcccgccgacgccgccggcuccggcaccggcuuccagcccgucgccgucccccccccccacggcgccgccucccgcggcggcgcccaccucaccgaguccgucgccgcccccgacuccggcgccuccucccccgccgccgccgagcccggcgagaagcgcgcccccgccgccgagcccucccccgccgccgcccccgccggccgcgagauggagaacaaggagacccucaagggccuccacaagauggacgaccgccccgaggagcgcaugauccgcgagaagcucaaggccaccugcaugcccgccuggaagcacgaguggcucgagcgccgcaaccgccgcggccccgucgucgucaagcccauccccgucaagggcgacggcuccgagaugaaccaccucgccgccgagucccccggcgagguccaggccuccgccgccucccccgccuccaagggccgccgcucccccucccccggcaacucccccuccggccgcaccgucaaguccgagucccccggcguccgccgcaagcgcgucucccccguccccuuccaguccggccgcaucacccccccccgccgcgcccccucccccgacggcuucucccccuacucccccgaggagaccaaccgccgcgucaacaaggucaugcgcgcccgccucuaccuccuccagcagaucggccccaacuccuuccucaucggcggcgacucccccgacaacaaguaccgcgucuucaucggcccccagaacugcuccugcgcccgcggcaccuucugcauccaccuccucuucgucaugcuccgcgucuuccagcucgagcccuccgaccccaugcucuggcgcaagacccucaagaacuucgaggucgagucccucuuccagaaguaccacucccgccgcuccucccgcaucaaggcccccucccgcaacaccauccagaaguucgucucccgcauguccaacucccacacccucuccuccuccuccaccuccaccuccuccuccgagaacuccaucaaggacgaggaggagcagaugugccccaucugccuccucggcaugcucgacgaggagucccucaccgucugcgaggacggcugccgcaacaagcuccaccaccacugcauguccaucugggccgaggagugccgccgcaaccgcgagccccucaucugcccccucugccgcuccaaguggcgcucccacgacuucuacucccacgagcucuccucccccgucgacucccccuccucccuccgcgccgcccagcagcagaccguccagcagcagccccucgccggcucccgccgcaaccaggaguccaacuucaaccucacccacuacggcacccagcagaucccccccgccuacaaggaccucgccgagcccuggauccaggucuucggcauggagcucgucggcugccucuucucccgcaacuggaacguccgcgagauggcccuccgccgccucucccacgacgucuccggcgcccuccuccucgccaacggcgaguccaccggcaacuccggcggcuccuccggcuccucccccuccggcggcgccaccuccggcuccucccagaccuccaucuccggcgacgucgucgaggccugcugcuccguccucuccauggucugcgccgaccccgucuacaaggucuacgucgccgcccucaagacccuccgcgccaugcucgucuacacccccugccacucccucgccgagcgcaucaagcuccagcgccuccuccagcccgucgucgacaccauccucgucaagugcgccgacgccaacucccgcaccucccagcucuccaucuccacccuccucgagcucugcaagggccaggccggcgagcucgccgucggccgcgagauccucaaggccggcuccaucggcaucggcggcgucgacuacguccucaacugcauccucggcaaccagaccgaguccaacaacuggcaggagcuccucggccgccucugccucaucgaccgccuccuccucgaguuccccgccgaguucuacccccacaucgucuccaccgacgucucccaggccgagcccgucgagauccgcuacaagaagcuccucucccuccucaccuucgcccuccaguccaucgacaacucccacuccauggucggcaagcucucccgccgcaucuaccucuccuccgcccgcauggucaccaccgucccccacgucuucuccaagcuccucgagaugcucuccgucuccuccuccacccacuucacccgcaugcgccgccgccucauggccaucgccgacgaggucgagaucgccgaggccauccagcucggcgucgaggacacccucgacggccagcaggacuccuuccuccaggccuccguccccaacaacuaccucgagaccaccgagaacuccucccccgagugcaccguccaccucgagaagaccggcaagggccucugcgccaccaagcucuccgccuccuccgaggacaucuccgagcgccucgccuccaucuccgucggccccuccuccuccaccaccaccaccaccaccaccaccgagcagcccaagcccaugguccagaccaagggccgcccccacucccagugccucaacuccuccccccucucccaccacucccagcucauguuccccgcccucuccacccccuccuccuccacccccuccguccccgccggcaccgccaccgacgucuccaagcaccgccuccagggcuucauccccugccgcauccccuccgccuccccccagacccagcgcaaguucucccuccaguuccaccgcaacugccccgagaacaaggacuccgacaagcucucccccgucuucacccagucccgcccccuccccuccuccaacauccaccgccccaagcccucccgccccacccccggcaacaccuccaagcagggcgaccccuccaagaacuccaugacccucgaccucaacuccuccuccaagugcgacgacuccuucggcugcuccuccaacuccuccaacgccgucauccccuccgacgagaccgucuucacccccgucgaggagaagugccgccucgacgucaacaccgagcucaacuccuccaucgaggaccuccucgaggccuccaugcccuccuccgacaccaccgucaccuucaaguccgaggucgccguccucucccccgagaaggccgagaacgacgacaccuacaaggacgacgucaaccacaaccagaagugcaaggagaagauggaggccgaggaggaggaggcccucgccaucgccauggccauguccgccucccaggacgcccuccccaucgucccccagcuccaggucgagaacggcgaggacaucaucaucauccagcaggacacccccgagacccuccccggccacaccaaggccaagcagcccuaccgcgaggacaccgaguggcucaagggccagcagaucggccucggcgccuucuccuccugcuaccaggcccaggacgucggcaccggcacccucauggccgucaagcaggucaccuacguccgcaacaccuccuccgagcaggaggaggucgucgaggcccuccgcgaggagauccgcaugaugucccaccucaaccaccccaacaucauccgcaugcucggcgccaccugcgagaaguccaacuacaaccucuucaucgaguggauggccggcggcuccgucgcccaccuccucuccaaguacggcgccuucaaggaguccgucgucaucaacuacaccgagcagcuccuccgcggccucuccuaccuccacgagaaccagaucauccaccgcgacgucaagggcgccaaccuccucaucgacuccaccggccagcgccuccgcaucgccgacuucggcgccgccgcccgccucgccuccaagggcaccggcgccggcgaguuccagggccagcuccucggcaccaucgccuucauggcccccgagguccuccgcggccagcaguacggccgcuccugcgacgucugguccgucggcugcgccaucaucgagauggccugcgccaagccccccuggaacgccgagaagcacuccaaccaccucgcccucaucuucaagaucgccuccgccaccaccgcccccuccauccccucccaccucucccccggccuccgcgacgucgcccuccgcugccucgagcuccagccccaggaccgcccccccucccgcgagcuccucaagcaccccgucuuccgcaccaccugguga

SEQ ID NO: 45719 - RNA, 1860 nt, Artificial Sequence
  derived and/or modified sequence opt2 from MAP3K2__Homo_sapiens__NP_006600
auggacgaccagcaggcccucaacuccaucaugcaggaccucgccguccuccacaaggccucccgccccgcccucucccuccaggagacccgcaaggccaaguccuccucccccaagaagcagaacgacguccgcgucaaguucgagcaccgcggcgagaagcgcauccuccaguucccccgccccgucaagcucgaggaccuccgcuccaaggccaagaucgccuucggccaguccauggaccuccacuacaccaacaacgagcucgucaucccccucaccacccaggacgaccucgacaaggccgucgagcuccucgaccgcuccauccacaugaagucccucaagauccuccucgucaucaacggcuccacccaggccaccaaccucgagccccuccccucccucgaggaccucgacaacaccgucuucggcgccgagcgcaagaagcgccucuccaucaucggccccaccucccgcgaccgcuccucccccccccccggcuacauccccgacgagcuccaccaggucgcccgcaacggcuccuucaccuccaucaacuccgagggcgaguucauccccgaguccauggaccagaugcucgacccccucucccucuccucccccgagaacuccggcuccggcuccugccccucccucgacuccccccucgacggcgaguccuaccccaagucccgcaugccccgcgcccaguccuaccccgacaaccaccaggaguucuccgacuacgacaaccccaucuucgagaaguucggcaagggcggcaccuacccccgccgcuaccacgucuccuaccaccaccaggaguacaacgacggccgcaagaccuucccccgcgcccgccgcacccagggcaccucccuccgcucccccgucuccuucucccccaccgaccacucccucuccaccuccuccggcuccuccaucuucacccccgaguacgacgacucccgcauccgccgccgcggcuccgacaucgacaaccccacccucaccgucauggacaucuccccccccucccgcuccccccgcgcccccaccaacuggcgccucggcaagcuccucggccagggcgccuucggccgcgucuaccucugcuacgacgucgacaccggccgcgagcucgccgucaagcagguccaguucgaccccgacucccccgagaccuccaaggaggucaacgcccucgagugcgagauccagcuccucaagaaccuccuccacgagcgcaucguccaguacuacggcugccuccgcgacccccaggagaagacccucuccaucuucauggaguacaugcccggcggcuccaucaaggaccagcucaaggccuacggcgcccucaccgagaacgucacccgcaaguacacccgccagauccucgagggcguccacuaccuccacuccaacaugaucguccaccgcgacaucaagggcgccaacauccuccgcgacuccaccggcaacgucaagcucggcgacuucggcgccuccaagcgccuccagaccaucugccucuccggcaccggcaugaaguccgucaccggcacccccuacuggaugucccccgaggucaucuccggcgagggcuacggccgcaaggccgacaucugguccgucgccugcaccgucgucgagaugcucaccgagaagccccccugggccgaguucgaggccauggccgccaucuucaagaucgccacccagcccaccaaccccaagcuccccccccacgucuccgacuacacccgcgacuuccucaagcgcaucuucgucgaggccaagcuccgccccuccgccgacgagcuccuccgccacauguucguccacuaccacuga

SEQ ID NO: 45720 - RNA, 1881 nt, Artificial Sequence
  derived and/or modified sequence opt2 from MAP3K3__Homo_sapiens__NP_002392
auggacgagcaggaggcccucaacuccaucaugaacgaccucgucgcccuccagaugaaccgccgccaccgcaugcccggcuacgagaccaugaagaacaaggacaccggccacuccaaccgccaguccgacguccgcaucaaguucgagcacaacggcgagcgccgcaucaucgccuucucccgccccgucaaguacgaggacgucgagcacaaggucaccaccgucuucggccagccccucgaccuccacuacaugaacaacgagcucuccauccuccucaagaaccaggacgaccucgacaaggccaucgacauccucgaccgcuccuccuccaugaagucccuccgcauccuccuccucucccaggaccgcaaccacaacuccuccuccccccacuccggcgucucccgccagguccgcaucaaggccucccaguccgccggcgacaucaacaccaucuaccagccccccgagccccgcucccgccaccucuccgucuccucccagaaccccggccgcuccucccccccccccggcuacguccccgagcgccagcagcacaucgcccgccagggcuccuacaccuccaucaacuccgagggcgaguucauccccgagaccuccgagcagugcaugcucgacccccucuccuccgccgagaacucccucuccggcuccugccagucccucgaccgcuccgccgacucccccuccuuccgcaagucccgcaugucccgcgcccaguccuuccccgacaaccgccaggaguacuccgaccgcgagacccagcucuacgacaagggcgucaagggcggcaccuacccccgccgcuaccacgucuccguccaccacaaggacuacuccgacggccgccgcaccuucccccgcauccgccgccaccagggcaaccucuucacccucguccccuccucccgcucccucuccaccaacggcgagaacaugggccucgccguccaguaccucgacccccgcggccgccuccgcuccgccgacuccgagaacgcccucuccguccaggagcgcaacguccccaccaagucccccuccgcccccaucaacuggcgccgcggcaagcuccucggccagggcgccuucggccgcgucuaccucugcuacgacgucgacaccggccgcgagcucgccuccaagcagguccaguucgaccccgacucccccgagaccuccaaggaggucuccgcccucgagugcgagauccagcuccucaagaaccuccagcacgagcgcaucguccaguacuacggcugccuccgcgaccgcgccgagaagacccucaccaucuucauggaguacaugcccggcggcuccgucaaggaccagcucaaggccuacggcgcccucaccgaguccgucacccgcaaguacacccgccagauccucgagggcauguccuaccuccacuccaacaugaucguccaccgcgacaucaagggcgccaacauccuccgcgacuccgccggcaacgucaagcucggcgacuucggcgccuccaagcgccuccagaccaucugcauguccggcaccggcaugcgcuccgucaccggcacccccuacuggaugucccccgaggucaucuccggcgagggcuacggccgcaaggccgacgucuggucccucggcugcaccgucgucgagaugcucaccgagaagccccccugggccgaguacgaggccauggccgccaucuucaagaucgccacccagcccaccaacccccagcuccccucccacaucuccgagcacggccgcgacuuccuccgccgcaucuucgucgaggcccgccagcgccccuccgccgaggagcuccucacccaccacuucgcccagcucauguacuga

SEQ ID NO: 45721 - RNA, 4827 nt, Artificial Sequence
  derived and/or modified sequence opt2 from MAP3K4__Homo_sapiens__NP_005913
augcgcgaggccgccgccgcccucguccccccccccgccuucgccgucacccccgccgccgccauggaggagccccccccccccccccccccccccccccccccccccgagcccgagaccgaguccgagcccgagugcugccucgccgcccgccaggagggcacccucggcgacuccgccugcaagucccccgaguccgaccucgaggacuucuccgacgagaccaacaccgagaaccucuacggcaccuccccccccuccaccccccgccagaugaagcgcauguccaccaagcaccagcgcaacaacgucggccgccccgccucccgcuccaaccucaaggagaagaugaacgcccccaaccagcccccccacaaggacaccggcaagaccgucgagaacgucgaggaguacuccuacaagcaggagaagaagauccgcgccgcccuccgcaccaccgagcgcgaccacaagaagaacguccagugcuccuucaugcucgacuccgucggcggcucccuccccaagaaguccauccccgacgucgaccucaacaagcccuaccucucccucggcugcuccaacgccaagcuccccgucuccguccccaugcccaucgcccgccccgcccgccagaccucccgcaccgacugccccgccgaccgccucaaguucuucgagacccuccgccuccuccucaagcucaccuccgucuccaagaagaaggaccgcgagcagcgcggccaggagaacaccuccggcuucuggcucaaccgcuccaacgagcucaucuggcucgagcuccaggccuggcacgccggccgcaccaucaacgaccaggacuucuuccucuacaccgcccgccaggccauccccgacaucaucaacgagauccucaccuucaaggucgacuacggcuccuucgccuucguccgcgaccgcgccggcuucaacggcaccuccgucgagggccagugcaaggccacccccggcaccaagaucgucggcuacuccacccaccacgagcaccuccagcgccagcgcgucuccuucgagcaggucaagcgcaucauggagcuccucgaguacaucgaggcccucuaccccucccuccaggcccuccagaaggacuacgagaaguacgccgccaaggacuuccaggaccgcguccaggcccucugccucuggcucaacaucaccaaggaccucaaccagaagcuccgcaucaugggcaccguccucggcaucaagaaccucuccgacaucggcuggcccgucuucgagauccccuccccccgccccuccaagggcaacgagcccgaguacgagggcgacgacaccgagggcgagcucaaggagcucgaguccuccaccgacgaguccgaggaggagcagaucuccgacccccgcguccccgagauccgccagcccaucgacaacuccuucgacauccagucccgcgacugcaucuccaagaagcucgagcgccucgaguccgaggacgacucccucggcuggggcgcccccgacugguccaccgaggccggcuucucccgccacugccucaccuccaucuaccgccccuucgucgacaaggcccucaagcagaugggccuccgcaagcucauccuccgccuccacaagcucauggacggcucccuccagcgcgcccgcaucgcccucgucaagaacgaccgccccgucgaguucuccgaguuccccgaccccauguggggcuccgacuacguccagcucucccgcaccccccccuccuccgaggagaagugcuccgccgucuccugggaggagcucaaggccauggaccuccccuccuucgagcccgccuuccucguccucugccgcguccuccucaacgucauccacgagugccucaagcuccgccucgagcagcgccccgccggcgagcccucccuccucuccaucaagcagcucguccgcgagugcaaggagguccucaagggcggccuccucaugaagcaguacuaccaguucaugcuccaggagguccucgaggaccucgagaagcccgacugcaacaucgacgccuucgaggaggaccuccacaagaugcucauggucuacuucgacuacaugcgcuccuggauccagaugcuccagcagcucccccaggccucccacucccucaagaaccuccucgaggaggaguggaacuucaccaaggagaucacccacuacauccgcggcggcgaggcccaggccggcaagcucuucugcgacaucgccggcaugcuccucaaguccaccggcuccuuccucgaguucggccuccaggaguccugcgccgaguucuggaccuccgccgacgacuccuccgccuccgacgagauccgccgcuccgucaucgagaucucccgcgcccucaaggagcucuuccacgaggcccgcgagcgcgccuccaaggcccucggcuucgccaagaugcuccgcaaggaccucgagaucgccgccgaguuccgccucuccgcccccguccgcgaccuccucgacguccucaaguccaagcaguacgucaagguccagauccccggccucgagaaccuccagauguucguccccgacacccucgccgaggagaaguccaucauccuccagcuccucaacgccgccgccggcaaggacugcuccaaggacuccgacgacguccucaucgacgccuaccuccuccucaccaagcacggcgaccgcgcccgcgacuccgaggacuccuggggcaccugggaggcccagcccgucaaggucgucccccaggucgagaccgucgacacccuccgcuccaugcaggucgacaaccuccuccucgucgucaugcaguccgcccaccucaccauccagcgcaaggccuuccagcaguccaucgagggccucaugacccucugccaggagcagaccuccucccagcccgucaucgccaaggcccuccagcagcucaagaacgacgcccucgagcucugcaaccgcaucuccaacgccaucgaccgcgucgaccacauguucaccuccgaguucgacgccgaggucgacgaguccgaguccgucacccuccagcaguacuaccgcgaggccaugauccagggcuacaacuucggcuucgaguaccacaaggaggucguccgccucauguccggcgaguuccgccagaagaucggcgacaaguacaucuccuucgcccgcaaguggaugaacuacguccucaccaagugcgaguccggccgcggcacccgcccccgcugggccacccagggcuucgacuuccuccaggccaucgagcccgccuucaucuccgcccuccccgaggacgacuuccucucccuccaggcccucaugaacgagugcaucggccacgucaucggcaagccccacucccccgucaccggccucuaccucgccauccaccgcaacuccccccgccccaugaaggucccccgcugccacuccgacccccccaacccccaccucaucauccccacccccgagggcuucuccacccgcuccaugcccuccgacgcccgcucccacggcucccccgccgccgccgccgccgccgccgccgccgccgucgccgccucccgccccucccccuccggcggcgacuccguccuccccaaguccaucuccuccgcccacgacacccgcggcuccuccguccccgagaacgaccgccucgccuccaucgccgccgagcuccaguuccgcucccucucccgccacuccucccccaccgaggagcgcgacgagcccgccuacccccgcggcgacuccuccggcuccacccgccgcuccugggagcuccgcacccucaucucccaguccaaggacaccgccuccaagcucggccccaucgaggccauccagaaguccguccgccucuucgaggagaagcgcuaccgcgagaugcgccgcaagaacaucaucggccaggucugcgacacccccaaguccuacgacaacgucaugcacgucggccuccgcaaggucaccuucaaguggcagcgcggcaacaagaucggcgagggccaguacggcaaggucuacaccugcaucuccgucgacaccggcgagcucauggccaugaaggagauccgcuuccagcccaacgaccacaagaccaucaaggagaccgccgacgagcucaagaucuucgagggcaucaagcaccccaaccucguccgcuacuucggcgucgagcuccaccgcgaggagauguacaucuucauggaguacugcgacgagggcacccucgaggaggucucccgccucggccuccaggagcacgucauccgccucuacuccaagcagaucaccaucgccaucaacguccuccacgagcacggcaucguccaccgcgacaucaagggcgccaacaucuuccucaccuccuccggccucaucaagcucggcgacuucggcugcuccgucaagcucaagaacaacgcccagaccaugcccggcgaggucaacuccacccucggcaccgccgccuacauggcccccgaggucaucacccgcgccaagggcgagggccacggccgcgccgccgacaucuggucccucggcugcgucgucaucgagauggucaccggcaagcgccccuggcacgaguacgagcacaacuuccagaucauguacaaggucggcaugggccacaagccccccauccccgagcgccucucccccgagggcaaggacuuccucucccacugccucgaguccgaccccaagaugcgcuggaccgccucccagcuccucgaccacuccuucgucaaggucugcaccgacgaggaguga

SEQ ID NO: 45722 - RNA, 4125 nt, Artificial Sequence
  derived and/or modified sequence opt2 from MAP3K5__Homo_sapiens__NP_005914
auguccaccgaggccgacgagggcaucaccuucuccgucccccccuucgcccccuccggcuucugcaccauccccgagggcggcaucugccgccgcggcggcgccgccgccgucggcgagggcgaggagcaccagcuccccccccccccccccggcuccuucuggaacgucgaguccgccgccgcccccggcaucggcugccccgccgccaccuccuccuccuccgccacccgcggccgcggcuccuccgucggcggcggcucccgccgcaccaccgucgccuacgucaucaacgaggccucccagggccagcucgucgucgccgaguccgaggcccuccagucccuccgcgaggccugcgagaccgucggcgccacccucgagacccuccacuucggcaagcucgacuucggcgagaccaccguccucgaccgcuucuacaacgccgacaucgccgucgucgagauguccgacgccuuccgccagcccucccucuucuaccaccucggcguccgcgaguccuucuccauggccaacaacaucauccucuacugcgacaccaacuccgacucccuccagucccucaaggagaucaucugccagaagaacaccaugugcaccggcaacuacaccuucguccccuacaugaucaccccccacaacaaggucuacugcugcgacuccuccuucaugaagggccucaccgagcucaugcagcccaacuucgagcuccuccucggccccaucugccucccccucgucgaccgcuucauccagcuccucaaggucgcccaggccuccuccucccaguacuuccgcgaguccauccucaacgacauccgcaaggcccgcaaccucuacaccggcaaggagcucgccgccgagcucgcccgcauccgccagcgcgucgacaacaucgagguccucaccgccgacaucgucaucaaccuccuccucuccuaccgcgacauccaggacuacgacuccaucgucaagcucgucgagacccucgagaagcuccccaccuucgaccucgccucccaccaccacgucaaguuccacuacgccuucgcccucaaccgccgcaaccuccccggcgaccgcgccaaggcccucgacaucaugauccccaugguccaguccgagggccaggucgccuccgacauguacugccucgucggccgcaucuacaaggacauguuccucgacuccaacuucaccgacaccgagucccgcgaccacggcgccuccugguucaagaaggccuucgaguccgagcccacccuccaguccggcaucaacuacgccguccuccuccucgccgccggccaccaguucgaguccuccuucgagcuccgcaaggucggcgucaagcucuccucccuccucggcaagaagggcaaccucgagaagcuccaguccuacugggaggucggcuucuuccucggcgccuccguccucgccaacgaccacaugcgcgucauccaggccuccgagaagcucuucaagcucaagacccccgccugguaccucaaguccaucgucgagaccauccucaucuacaagcacuucgucaagcucaccaccgagcagcccgucgccaagcaggagcucgucgacuucuggauggacuuccucgucgaggccaccaagaccgacgucaccgucguccgcuuccccguccucauccucgagcccaccaagaucuaccagcccuccuaccucuccaucaacaacgaggucgaggagaagaccaucuccaucuggcacguccuccccgacgacaagaagggcauccacgaguggaacuucuccgccuccuccguccgcggcgucuccaucuccaaguucgaggagcgcugcugcuuccucuacguccuccacaacuccgacgacuuccagaucuacuucugcaccgagcuccacugcaagaaguucuucgagauggucaacaccaucaccgaggagaagggccgcuccaccgaggagggcgacugcgaguccgaccuccucgaguacgacuacgaguacgacgagaacggcgaccgcgucguccucggcaagggcaccuacggcaucgucuacgccggccgcgaccucuccaaccagguccgcaucgccaucaaggagauccccgagcgcgacucccgcuacucccagccccuccacgaggagaucgcccuccacaagcaccucaagcacaagaacaucguccaguaccucggcuccuucuccgagaacggcuucaucaagaucuucauggagcagguccccggcggcucccucuccgcccuccuccgcuccaaguggggcccccucaaggacaacgagcagaccaucggcuucuacaccaagcagauccucgagggccucaaguaccuccacgacaaccagaucguccaccgcgacaucaagggcgacaacguccucaucaacaccuacuccggcguccucaagaucuccgacuucggcaccuccaagcgccucgccggcaucaaccccugcaccgagaccuucaccggcacccuccaguacauggcccccgagaucaucgacaagggcccccgcggcuacggcaaggccgccgacaucuggucccucggcugcaccaucaucgagauggccaccggcaagccccccuucuacgagcucggcgagccccaggccgccauguucaaggucggcauguucaagguccaccccgagauccccgaguccauguccgccgaggccaaggccuucauccucaagugcuucgagcccgaccccgacaagcgcgccugcgccaacgaccuccucgucgacgaguuccucaaggucuccuccaagaagaagaagacccagcccaagcucuccgcccucuccgccggcuccaacgaguaccuccgcuccaucucccuccccguccccguccucgucgaggacaccuccuccuccuccgaguacggcuccgucucccccgacaccgagcucaaggucgaccccuucuccuucaagacccgcgccaaguccugcggcgagcgcgacgucaagggcauccgcacccucuuccucggcauccccgacgagaacuucgaggaccacuccgccccccccucccccgaggagaaggacuccggcuucuucaugcuccgcaaggacuccgagcgccgcgccacccuccaccgcauccucaccgaggaccaggacaagaucguccgcaaccucauggagucccucgcccagggcgccgaggagcccaagcucaagugggagcacaucaccacccucaucgccucccuccgcgaguucguccgcuccaccgaccgcaagaucaucgccaccacccucuccaagcucaagcucgagcucgacuucgacucccacggcaucucccagguccaggucguccucuucggcuuccaggacgccgucaacaagguccuccgcaaccacaacaucaagccccacuggauguucgcccucgacuccaucauccgcaaggccguccagaccgccaucaccauccucguccccgagcuccgcccccacuucucccucgccuccgaguccgacaccgccgaccaggaggaccucgacgucgaggacgaccacgaggagcagcccuccaaccagaccguccgccgcccccaggccgucaucgaggacgccgucgccaccuccggcgucuccacccucuccuccaccgucucccacgacucccaguccgcccaccgcucccucaacguccagcucggccgcaugaagaucgagaccaaccgccuccucgaggagcucguccgcaaggagaaggagcuccaggcccuccuccaccgcgccaucgaggagaaggaccaggagaucaagcaccucaagcucaagucccagcccaucgagauccccgagcuccccgucuuccaccucaacuccuccggcaccaacaccgaggacuccgagcucaccgacuggcuccgcgucaacggcgccgacgaggacaccaucucccgcuuccucgccgaggacuacacccuccucgacguccucuacuacgucacccgcgacgaccucaagugccuccgccuccgcggcggcaugcucugcacccucuggaaggccaucaucgacuuccgcaacaagcagaccuga

SEQ ID NO: 45723 - RNA, 3843 nt, Artificial Sequence
  derived and/or modified sequence opt2 from MAP3K6__Homo_sapiens__NP_001284538
auggccggccccugcccccgcuccggcgccgagcgcgccggcuccugcuggcaggacccccucgccgucgcccucucccgcggccgccagcucgccgccccccccggccgcggcugcgcccgcucccgcccccucuccgucgucuacguccucacccgcgagccccagcccggccucgagccccgcgagggcaccgaggccgagccccucccccuccgcugccuccgcgaggccugcgcccaggucccccgcccccgcccccccccccagcuccgcucccuccccuucggcacccucgagcucggcgacaccgccgcccucgacgccuucuacaacgccgacgucgucguccucgaggucuccuccucccucguccagcccucccucuucuaccaccucggcguccgcgaguccuucuccaugaccaacaacguccuccucugcucccaggccgaccuccccgaccuccaggcccuccgcgacugcgucggcuccuacacccucauccccuacgucgucaccgccaccggccgcguccucugcggcgacgccggccuccuccgcggccucgccgacggccucguccaggccggcgucggcaccgaggcccuccucaccccccucgucggccgccucgcccgccuccucgaggccacccccaccgacuccugcggcuacuuccgcgagaccauccgccgcgacauccgccaggcccgcgagcgcuucuccggcccccagcuccgccaggagcucgcccgccuccagcgccgccucgacuccgucgagcuccucucccccgacaucaucaugaaccuccuccucuccuaccgcgacguccaggacuacuccgccaucaucgagcucgucgagacccuccaggcccuccccaccugcgacgucgccgagcagcacaacgucugcuuccacuacaccuucgcccucaaccgccgcaaccgccccggcgaccgcgccaaggcccucuccguccuccucccccucguccagcucgagggcuccgucgcccccgaccucuacugcaugugcggccgcaucuacaaggacauguucuucuccuccggcuuccaggacgccggccaccgcgagcaggccuaccacugguaccgcaaggccuucgacgucgagcccucccuccacuccggcaucaacgccgccguccuccucaucgccgccggccagcacuucgaggacuccaaggagcuccgccucaucggcaugaagcucggcugccuccucgcccgcaagggcugcgucgagaagaugcaguacuacugggacgucggcuucuaccucggcgcccagauccucgccaacgaccccacccaggucguccucgccgccgagcagcucuacaagcucaacgcccccaucugguaccucgucuccgucauggagaccuuccuccucuaccagcacuuccgccccacccccgagccccccggcggccccccccgccgcgcccacuucuggcuccacuuccuccuccaguccugccagcccuucaagaccgccugcgcccagggcgaccagugccucguccucguccucgagaugaacaagguccuccuccccgccaagcucgagguccgcggcaccgaccccgucuccaccgucacccucucccuccucgagcccgagacccaggacauccccuccuccuggaccuuccccgucgccuccaucugcggcgucuccgccuccaagcgcgacgagcgcugcugcuuccucuacgcccucccccccgcccaggacguccagcucugcuuccccuccgucggccacugccagugguucugcggccucauccaggccugggucaccaaccccgacuccaccgcccccgccgaggaggccgagggcgccggcgagaugcucgaguucgacuacgaguacaccgagaccggcgagcgccucguccucggcaagggcaccuacggcgucgucuacgccggccgcgaccgccacacccgcguccgcaucgccaucaaggagauccccgagcgcgacucccgcuucucccagccccuccacgaggagaucgcccuccaccgccgccuccgccacaagaacaucguccgcuaccucggcuccgccucccagggcggcuaccucaagaucuucauggaggagguccccggcggcucccucuccucccuccuccgcuccgucuggggcccccucaaggacaacgaguccaccaucuccuucuacacccgccagauccuccagggccucggcuaccuccacgacaaccacaucguccaccgcgacaucaagggcgacaacguccucaucaacaccuucuccggccuccucaagaucuccgacuucggcaccuccaagcgccucgccggcaucacccccugcaccgagaccuucaccggcacccuccaguacauggcccccgagaucaucgaccagggcccccgcggcuacggcaaggccgccgacaucuggucccucggcugcaccgucaucgagauggccaccggccgcccccccuuccacgagcucggcuccccccaggccgccauguuccaggucggcauguacaagguccacccccccaugcccuccucccucuccgccgaggcccaggccuuccuccuccgcaccuucgagcccgacccccgccuccgcgccuccgcccagacccuccucggcgaccccuuccuccagcccggcaagcgcucccgcucccccuccuccccccgccacgccccccgccccuccgacgcccccuccgccucccccacccccuccgccaacuccaccacccagucccagaccuuccccugcccccaggcccccucccagcacccccccuccccccccaagcgcugccucuccuacggcggcaccucccagcuccgcguccccgaggagcccgccgccgaggagcccgccucccccgaggaguccuccggccucucccuccuccaccaggaguccaagcgccgcgccaugcucgccgccguccucgagcaggagcuccccgcccucgccgagaaccuccaccaggagcagaagcaggagcagggcgcccgccucggccgcaaccacgucgaggagcuccuccgcugccucggcgcccacauccacacccccaaccgccgccagcucgcccaggagcuccgcgcccuccagggccgccuccgcgcccagggccucggccccgcccuccuccaccgcccccucuucgccuuccccgacgccgucaagcagauccuccgcaagcgccagauccgcccccacuggauguucguccucgacucccuccucucccgcgccguccgcgccgcccucggcguccucggccccgaggucgagaaggaggccgucuccccccgcuccgaggagcucuccaacgagggcgacucccagcagucccccggccagcaguccccccuccccgucgagcccgagcagggccccgccccccucaugguccagcucucccuccuccgcgccgagaccgaccgccuccgcgagauccucgccggcaaggagcgcgaguaccaggcccucguccagcgcgcccuccagcgccucaacgaggaggcccgcaccuacguccucgcccccgagccccccaccgcccucuccaccgaccagggccucguccaguggcuccaggagcucaacgucgacuccggcaccauccagaugcuccucaaccacuccuucacccuccacacccuccucaccuacgccacccgcgacgaccucaucuacacccgcauccgcggcggcauggucugccgcaucuggcgcgccauccucgcccagcgcgccggcuccacccccgucaccuccggccccuga

SEQ ID NO: 45724 - RNA, 429 nt, Artificial Sequence
  derived and/or modified sequence opt2 from MAP3K7CL__Homo_sapiens__NP_001273546
augaucuccaccgcccgcguccccgccgacaagcccguccgcaucgccuucucccucaacgacgccuccgacgacaccccccccgaggacuccaucccccucgucuuccccgagcucgaccagcagcuccagccccucccccccugccacgacuccgaggaguccauggaggucuucaagcagcacugccagaucgccgaggaguaccacgaggucaagaaggagaucacccuccucgagcagcgcaagaaggagcucaucgccaagcucgaccaggccgagaaggagaaggucgacgccgccgagcucguccgcgaguucgaggcccucaccgaggagaaccgcacccuccgccucgcccagucccagugcgucgagcagcucgagaagcuccgcauccaguaccagaagcgccagggcuccuccuga

SEQ ID NO: 45725 - RNA, 1740 nt, Artificial Sequence
  derived and/or modified sequence opt2 from MAP3K7__Homo_sapiens__NP_003179
auguccaccgccuccgccgccuccuccuccuccuccuccuccgccggcgagaugaucgaggcccccucccagguccucaacuucgaggagaucgacuacaaggagaucgaggucgaggaggucgucggccgcggcgccuucggcgucgucugcaaggccaaguggcgcgccaaggacgucgccaucaagcagaucgaguccgaguccgagcgcaaggccuucaucgucgagcuccgccagcucucccgcgucaaccaccccaacaucgucaagcucuacggcgccugccucaaccccgucugccucgucauggaguacgccgagggcggcucccucuacaacguccuccacggcgccgagccccuccccuacuacaccgccgcccacgccauguccuggugccuccagugcucccagggcgucgccuaccuccacuccaugcagcccaaggcccucauccaccgcgaccucaagccccccaaccuccuccucgucgccggcggcaccguccucaagaucugcgacuucggcaccgccugcgacauccagacccacaugaccaacaacaagggcuccgccgccuggauggcccccgaggucuucgagggcuccaacuacuccgagaagugcgacgucuucuccuggggcaucauccucugggaggucaucacccgccgcaagcccuucgacgagaucggcggccccgccuuccgcaucaugugggccguccacaacggcacccgccccccccucaucaagaaccuccccaagcccaucgagucccucaugacccgcugcugguccaaggaccccucccagcgccccuccauggaggagaucgucaagaucaugacccaccucaugcgcuacuuccccggcgccgacgagccccuccaguaccccugccaguacuccgacgagggccaguccaacuccgccaccuccaccggcuccuucauggacaucgccuccaccaacaccuccaacaaguccgacaccaacauggagcagguccccgccaccaacgacaccaucaagcgccucgaguccaagcuccucaagaaccaggccaagcagcaguccgaguccggccgccucucccucggcgccucccgcggcuccuccgucgagucccucccccccaccuccgagggcaagcgcauguccgccgacauguccgagaucgaggcccgcaucgccgccaccaccggcaacggccagccccgccgccgcuccauccaggaccucaccgucaccggcaccgagcccggccaggucuccucccgcuccuccucccccuccguccgcaugaucaccaccuccggccccaccuccgagaagcccacccgcucccaccccuggacccccgacgacuccaccgacaccaacggcuccgacaacuccauccccauggccuaccucacccucgaccaccagcuccagccccucgcccccugccccaacuccaaggaguccauggccgucuucgagcagcacugcaagauggcccaggaguacaugaagguccagaccgagaucgcccuccuccuccagcgcaagcaggagcucgucgccgagcucgaccaggacgagaaggaccagcagaacaccucccgccucguccaggagcacaagaagcuccucgacgagaacaagucccucuccaccuacuaccagcagugcaagaagcagcucgaggucauccgcucccagcagcagaagcgccagggcaccuccuga

SEQ ID NO: 45726 - RNA, 1404 nt, Artificial Sequence
  derived and/or modified sequence opt2 from MAP3K8__Homo_sapiens__XP_005252421
auggaguacauguccaccggcuccgacaacaaggaggagaucgaccuccucaucaagcaccucaacgucuccgacgucaucgacaucauggagaaccucuacgccuccgaggagcccgccgucuacgagcccucccucaugaccaugugccaggacuccaaccagaacgacgagcgcuccaagucccuccuccucuccggccaggagguccccuggcucuccuccguccgcuacggcaccgucgaggaccuccucgccuucgccaaccacaucuccaacaccgccaagcacuucuacggccagcgcccccaggaguccggcauccuccucaacauggucaucaccccccagaacggccgcuaccagaucgacuccgacguccuccucauccccuggaagcucaccuaccgcaacaucggcuccgacuucaucccccgcggcgccuucggcaaggucuaccucgcccaggacaucaagaccaagaagcgcauggccugcaagcucauccccgucgaccaguucaagcccuccgacgucgagauccaggccugcuuccgccacgagaacaucgccgagcucuacggcgccguccucuggggcgagaccguccaccucuucauggaggccggcgagggcggcuccguccucgagaagcucgaguccugcggccccaugcgcgaguucgagaucaucugggucaccaagcacguccucaagggccucgacuuccuccacuccaagaaggucauccaccacgacaucaagcccuccaacaucgucuucauguccaccaaggccguccucgucgacuucggccucuccguccagaugaccgaggacgucuacuuccccaaggaccuccgcggcaccgagaucuacaugucccccgaggucauccucugccgcggccacuccaccaaggccgacaucuacucccucggcgccacccucauccacaugcagaccggcaccccccccugggucaagcgcuacccccgcuccgccuaccccuccuaccucuacaucauccacaagcaggcccccccccucgaggacaucgccgacgacugcucccccggcaugcgcgagcucaucgaggccucccucgagcgcaaccccaaccaccgcccccgcgccgccgaccuccucaagcacgaggcccucaaccccccccgcgaggaccagccccgcugccagucccucgacuccgcccuccucgagcgcaagcgccuccucucccgcaaggagcucgagcuccccgagaacaucgccgacuccuccugcaccggcuccaccgaggaguccgagaugcucaagcgccagcgcucccucuacaucgaccucggcgcccucgccggcuacuucaaccucguccgcggcccccccacccucgaguacggcuga

SEQ ID NO: 45727 - RNA, 3315 nt, Artificial Sequence
  derived and/or modified sequence opt2 from MAP3K9__Homo_sapiens__NP_001271159
auggagcccucccgcgcccuccucggcugccucgccuccgccgccgccgccgccccccccggcgaggacggcgccggcgccggcgccgaggaggaggaggaggaggaggaggaggccgccgccgccgucggccccggcgagcucggcugcgacgccccccuccccuacuggaccgccgucuucgaguacgaggccgccggcgaggacgagcucacccuccgccucggcgacgucgucgagguccucuccaaggacucccaggucuccggcgacgagggcugguggaccggccagcucaaccagcgcgucggcaucuuccccuccaacuacgucaccccccgcuccgccuucuccucccgcugccagcccggcggcgaggaccccuccugcuacccccccauccagcuccucgagaucgacuucgccgagcucacccucgaggagaucaucggcaucggcggcuucggcaaggucuaccgcgccuucuggaucggcgacgaggucgccgucaaggccgcccgccacgaccccgacgaggacaucucccagaccaucgagaacguccgccaggaggccaagcucuucgccaugcucaagcaccccaacaucaucgcccuccgcggcgucugccucaaggagcccaaccucugccucgucauggaguucgcccgcggcggcccccucaaccgcguccucuccggcaagcgcaucccccccgacauccucgucaacugggccguccagaucgcccgcggcaugaacuaccuccacgacgaggccaucguccccaucauccaccgcgaccucaaguccuccaacauccucauccuccagaaggucgagaacggcgaccucuccaacaagauccucaagaucaccgacuucggccucgcccgcgaguggcaccgcaccaccaagauguccgccgccggcaccuacgccuggauggcccccgaggucauccgcgccuccauguucuccaagggcuccgacgucugguccuacggcguccuccucugggagcuccucaccggcgagguccccuuccgcggcaucgacggccucgccgucgccuacggcgucgccaugaacaagcucgcccuccccauccccuccaccugccccgagcccuucgccaagcucauggaggacugcuggaaccccgacccccacucccgccccuccuucaccaacauccucgaccagcucaccaccaucgaggaguccggcuucuucgagaugcccaaggacuccuuccacugccuccaggacaacuggaagcacgagauccaggagauguucgaccagcuccgcgccaaggagaaggagcuccgcaccugggaggaggagcucacccgcgccgcccuccagcagaagaaccaggaggagcuccuccgccgccgcgagcaggagcucgccgagcgcgagaucgacauccucgagcgcgagcucaacaucaucauccaccagcucugccaggagaagccccgcgucaagaagcgcaagggcaaguuccgcaagucccgccucaagcucaaggacggcaaccgcaucucccuccccuccgacuuccagcacaaguucaccguccaggccucccccaccauggacaagcgcaagucccucaucaacucccgcuccuccccccccgccucccccaccaucaucccccgccuccgcgccauccagcucacccccggcgaguccuccaagaccuggggccgcuccuccgucguccccaaggaggagggcgaggaggaggagaagcgcgcccccaagaagaagggccgcaccuggggccccggcacccucggccagaaggagcucgccuccggcgacgagggcuccccccagcgccgcgagaaggccaacggccucuccacccccuccgaguccccccacuuccaccucggccucaagucccucgucgacggcuacaagcagugguccuccuccgcccccaaccucgucaagggcccccgcuccucccccgcccuccccggcuucaccucccucauggagauggaggacgaggacuccgagggccccggcuccggcgagucccgccuccagcacucccccucccaguccuaccucugcauccccuucccccgcggcgaggacggcgacggccccuccuccgacggcauccacgaggagcccacccccgucaacuccgccaccuccaccccccagcucacccccaccaacucccucaagcgcggcggcgcccaccaccgccgcugcgaggucgcccuccucggcugcggcgccguccucgccgccaccggccucggcuucgaccuccucgaggccggcaagugccagcuccucccccucgaggagcccgagccccccgcccgcgaggagaagaagcgccgcgagggccucuuccagcgcuccucccgcccccgccgcuccaccuccccccccucccgcaagcucuucaagaaggaggagcccaugcuccuccucggcgaccccuccgccucccucacccuccucucccucuccuccaucuccgagugcaacuccacccgcucccuccuccgcuccgacuccgacgagaucgucgucuacgagaugcccgucucccccgucgaggcccccccccucucccccugcacccacaacccccucgucaacguccgcgucgagcgcuucaagcgcgaccccaaccagucccucacccccacccacgucacccucaccacccccucccagcccuccucccaccgccgcacccccuccgacggcgcccucaagcccgagacccuccucgccucccgcucccccuccuccaacggccucucccccucccccggcgccggcaugcucaagacccccucccccucccgcgaccccggcgaguucccccgccuccccgaccccaacgucgucuucccccccaccccccgccgcuggaacacccagcaggacuccacccucgagcgccccaagacccucgaguuccucccccgcccccgccccuccgccaaccgccagcgccucgaccccuggugguucgucucccccucccacgcccgcuccaccucccccgccaacuccuccuccaccgagacccccuccaaccucgacuccugcuucgccuccuccuccuccaccgucgaggagcgccccggccuccccgcccuccuccccuuccaggccggcccccucccccccaccgagcgcacccuccucgaccucgacgccgagggccagucccaggacuccaccgucccccucugccgcgccgagcucaacacccaccgccccgcccccuacgagauccagcaggaguucugguccuga

SEQ ID NO: 45728 - RNA, 3408 nt, Artificial Sequence
  derived and/or modified sequence opt2 from MAP4__Homo_sapiens__NP_001127836
auggccgaccucucccucgccgacgcccucaccgagcccucccccgacaucgagggcgagaucaagcgcgacuucaucgccacccucgaggccgaggccuucgacgacgucgucggcgagaccgucggcaagaccgacuacaucccccuccucgacgucgacgagaagaccggcaacuccgaguccaagaagaagcccugcuccgagaccucccagaucgaggacacccccuccuccaagcccacccuccucgccaacggcggccacggcgucgagggcuccgacaccaccggcucccccaccgaguuccucgaggagaagauggccuaccaggaguaccccaacucccagaacuggcccgaggacaccaacuucugcuuccagcccgagcaggucgucgaccccauccagaccgaccccuucaagauguaccacgacgacgaccucgccgaccucgucuuccccuccuccgccaccgccgacaccuccaucuucgccggccagaacgacccccucaaggacuccuacggcaugucccccugcaacaccgccgucgucccccagggcugguccgucgaggcccucaacuccccccacuccgaguccuucgucucccccgaggccgucgccgagcccccccagcccaccgccgucccccucgagcucgccaaggagaucgagauggccuccgaggagcgcccccccgcccaggcccucgagaucaugaugggccucaagaccaccgacauggcccccuccaaggagaccgagauggcccucgccaaggacauggcccucgccaccaagaccgaggucgcccucgccaaggacauggagucccccaccaagcucgacgucacccucgccaaggacaugcagcccuccauggaguccgacauggcccucgucaaggacauggagcuccccaccgagaaggaggucgcccucgucaaggacguccgcuggcccaccgagaccgacgucuccuccgccaagaacgucguccuccccaccgagaccgaggucgcccccgccaaggacgucacccuccucaaggagaccgagcgcgccucccccaucaagauggaccucgcccccuccaaggacaugggcccccccaaggagaacaagaaggagaccgagcgcgccucccccaucaagauggaccucgcccccuccaaggacaugggcccccccaaggagaacaagaucguccccgccaaggaccucguccuccucuccgagaucgaggucgcccaggccaacgacaucaucuccuccaccgagaucuccuccgccgagaaggucgcccucuccuccgagaccgaggucgcccucgcccgcgacaugacccucccccccgagaccaacgucauccucaccaaggacaaggcccucccccucgaggccgaggucgcccccgucaaggacauggcccagcuccccgagaccgagaucgcccccgccaaggacgucgcccccuccaccgucaaggaggucggccuccucaaggacauguccccccucuccgagaccgagauggcccucggcaaggacgucacccccccccccgagaccgaggucguccucaucaagaacgucugccucccccccgagauggaggucgcccucaccgaggaccagguccccgcccucaagaccgaggccccccucgccaaggacggcguccucacccucgccaacaacgucacccccgccaaggacguccccccccucuccgagaccgaggccacccccguccccaucaaggacauggagaucgcccagacccagaagggcaucuccgaggacucccaccucgagucccuccaggacgucggccaguccgccgcccccaccuucaugaucucccccgagaccgucaccggcaccggcaagaagugcucccuccccgccgaggaggacuccguccucgagaagcucggcgagcgcaagcccugcaacucccagcccuccgagcucuccuccgagaccuccggcaucgcccgccccgaggagggccgccccgucgucuccggcaccggcaacgacaucaccaccccccccaacaaggagcucccccccucccccgagaagaagaccaagccccucgccaccacccagcccgccaagaccuccaccuccaaggccaagacccagcccaccucccuccccaagcagcccgcccccaccaccaucggcggccucaacaagaagcccaugucccucgccuccggccucguccccgccgccccccccaagcgccccgccgucgccuccgcccgccccuccauccuccccuccaaggacgucaagcccaagcccaucgccgacgccaaggcccccgagaagcgcgccucccccuccaagcccgccuccgcccccgccucccgcuccggcuccaaguccacccagaccgucgccaagaccaccaccgccgccgccgucgccuccaccggccccuccucccgcucccccuccacccuccuccccaagaagcccaccgccaucaagaccgagggcaagcccgccgaggucaagaagaugaccgccaaguccguccccgccgaccucucccgccccaaguccaccuccaccuccuccaugaagaagaccaccacccucuccggcaccgcccccgccgccggcgucguccccucccgcgucaaggccacccccaugcccucccgccccuccaccacccccuucaucgacaagaagcccaccuccgccaagcccuccuccaccaccccccgccucucccgccucgccaccaacaccuccgcccccgaccucaagaacguccgcuccaaggucggcuccaccgagaacaucaagcaccagcccggcggcggccgcgccaaggucgagaagaagaccgaggccgccgccaccacccgcaagcccgaguccaacgccgucaccaagaccgccggccccaucgccuccgcccagaagcagcccgccggcaagguccagaucgucuccaagaaggucuccuacucccacauccaguccaagugcggcuccaaggacaacaucaagcacguccccggcggcggcaacguccagauccagaacaagaaggucgacaucuccaaggucuccuccaagugcggcuccaaggccaacaucaagcacaagcccggcggcggcgacgucaagaucgagucccagaagcucaacuucaaggagaaggcccaggccaaggucggcucccucgacaacgucggccaccuccccgccggcggcgccgucaagaucgagaccuaccgccucaccuuccgcgccaacgcccgcgcccgcaccgaccacggcgccgacaucgucucccgccccccccacuuccccggcggccccaacuccggcucccgcguccucggcccccucucccgcgccguccacuga

SEQ ID NO: 45729 - RNA, 2466 nt, Artificial Sequence
  derived and/or modified sequence opt2 from MAP4K1__Homo_sapiens__NP_001036065
auggacgucgucgaccccgacaucuucaaccgcgacccccgcgaccacuacgaccuccuccagcgccucggcggcggcaccuacggcgaggucuucaaggcccgcgacaaggucuccggcgaccucgucgcccucaagauggucaagauggagcccgacgacgacgucuccacccuccagaaggagauccucauccucaagaccugccgccacgccaacaucgucgccuaccacggcuccuaccucuggcuccagaagcucuggaucugcauggaguucugcggcgccggcucccuccaggacaucuaccaggucaccggcucccucuccgagcuccagaucuccuacgucugccgcgagguccuccagggccucgccuaccuccacucccagaagaagauccaccgcgacaucaagggcgccaacauccucaucaacgacgccggcgagguccgccucgccgacuucggcaucuccgcccagaucggcgccacccucgcccgccgccucuccuucaucggcacccccuacuggauggcccccgaggucgccgccgucgcccucaagggcggcuacaacgagcucugcgacaucuggucccucggcaucaccgccaucgagcucgccgagcuccagcccccccucuucgacguccacccccuccgcguccucuuccucaugaccaaguccggcuaccagcccccccgccucaaggagaagggcaagugguccgccgccuuccacaacuucaucaaggucacccucaccaagucccccaagaagcgccccuccgccaccaagaugcucucccaccagcucgucucccagcccggccucaaccgcggccucauccucgaccuccucgacaagcucaagaaccccggcaagggccccuccaucggcgacaucgaggacgaggagcccgagcucccccccgccaucccccgccgcauccgcuccacccaccgcuccuccucccucggcauccccgacgccgacugcugccgccgccacauggaguuccgcaagcuccgcggcauggagacccgcccccccgccaacaccgcccgccuccagcccccccgcgaccuccgcuccuccuccccccgcaagcagcucuccgaguccuccgacgacgacuacgacgacgucgacauccccacccccgccgaggacaccccccccccccucccccccaagcccaaguuccgcucccccuccgacgagggccccggcuccaugggcgacgacggccagcucucccccggcguccucguccgcugcgccuccggccccccccccaacuccccccgccccggccccccccccuccaccuccuccccccaccucaccgcccacuccgagcccucccucuggaacccccccucccgcgagcucgacaagcccccccuccucccccccaagaaggagaagaugaagcgcaagggcugcgcccuccucgucaagcucuucaacggcugcccccuccgcauccacuccaccgccgccuggacccaccccuccaccaaggaccagcaccuccuccucggcgccgaggagggcaucuucauccucaaccgcaacgaccaggaggccacccucgagaugcucuuccccucccgcaccaccugggucuacuccaucaacaacguccucaugucccucuccggcaagaccccccaccucuacucccacuccauccucggccuccucgagcgcaaggagacccgcgccggcaaccccaucgcccacaucuccccccaccgccuccucgcccgcaagaacauggucuccaccaagauccaggacaccaagggcugccgcgccugcugcgucgccgagggcgccuccuccggcggccccuuccucugcggcgcccucgagaccuccgucguccuccuccagugguaccagcccaugaacaaguuccuccucguccgccagguccucuucccccuccccaccccccucuccgucuucgcccuccucaccggccccggcuccgagcuccccgccgucugcaucggcgucucccccggccgccccggcaaguccguccucuuccacaccguccgcuucggcgcccucuccugcuggcucggcgagauguccaccgagcaccgcggccccguccaggucacccaggucgaggaggacauggucaugguccucauggacggcuccgucaagcucgucacccccgagggcucccccguccgcggccuccgcacccccgagauccccaugaccgaggccgucgaggccgucgccauggucggcggccagcuccaggccuucuggaagcacggcguccaggucugggcccucggcuccgaccagcuccuccaggagcuccgcgaccccacccucaccuuccgccuccucggcuccccccgccccgucgucgucgagacccgccccgucgacgaccccaccgcccccuccaaccucuacauccaggaguga

SEQ ID NO: 45730 - RNA, 2463 nt, Artificial Sequence
  derived and/or modified sequence opt2 from MAP4K2__Homo_sapiens__NP_004570
auggcccuccuccgcgacgucucccuccaggacccccgcgaccgcuucgagcuccuccagcgcgucggcgccggcaccuacggcgacgucuacaaggcccgcgacaccgucaccuccgagcucgccgccgucaagaucgucaagcucgaccccggcgacgacaucuccucccuccagcaggagaucaccauccuccgcgagugccgccaccccaacgucgucgccuacaucggcuccuaccuccgcaacgaccgccucuggaucugcauggaguucugcggcggcggcucccuccaggagaucuaccacgccaccggcccccucgaggagcgccagaucgccuacgucugccgcgaggcccucaagggccuccaccaccuccacucccagggcaagauccaccgcgacaucaagggcgccaaccuccuccucacccuccagggcgacgucaagcucgccgacuucggcgucuccggcgagcucaccgccuccgucgccaagcgccgcuccuucaucggcacccccuacuggauggcccccgaggucgccgccgucgagcgcaagggcggcuacaacgagcucugcgacgucugggcccucggcaucaccgccaucgagcucggcgagcuccagcccccccucuuccaccuccaccccaugcgcgcccucaugcucauguccaaguccuccuuccagccccccaagcuccgcgacaagacccgcuggacccagaacuuccaccacuuccucaagcucgcccucaccaagaaccccaagaagcgccccaccgccgagaagcuccuccagcaccccuucaccacccagcagcucccccgcgcccuccucacccagcuccucgacaaggccuccgacccccaccucggcacccccucccccgaggacugcgagcucgagaccuacgacauguuccccgacaccauccacucccgcggccagcacggccccgccgagcgcacccccuccgagauccaguuccaccaggucaaguucggcgccccccgccgcaaggagaccgacccccucaacgagcccugggaggaggaguggacccuccucggcaaggaggagcucuccggcucccuccuccaguccguccaggaggcccucgaggagcgcucccucaccauccgcuccgccuccgaguuccaggagcucgacucccccgacgacaccaugggcaccaucaagcgcgcccccuuccucggcccccuccccaccgacccccccgccgaggagccccucuccuccccccccggcacccucccccccccccccuccggccccaacuccuccccccuccuccccaccgccugggccaccaugaagcagcgcgaggaccccgagcgcuccuccugccacggccucccccccacccccaagguccacaugggcgccugcuucuccaaggucuucaacggcugcccccuccgcauccacgccgccgucaccuggauccaccccgucacccgcgaccaguuccucgucgucggcgccgaggagggcaucuacacccucaaccuccacgagcuccacgaggacacccucgagaagcucaucucccaccgcugcuccuggcucuacugcgucaacaacguccuccucucccucuccggcaaguccacccacaucugggcccacgaccuccccggccucuucgagcagcgccgccuccagcagcaggucccccucuccauccccaccaaccgccucacccagcgcaucaucccccgccgcuucgcccucuccaccaagauccccgacaccaagggcugccuccagugccgcgucguccgcaaccccuacaccggcgccaccuuccuccucgccgcccuccccaccucccuccuccuccuccagugguacgagccccuccagaaguuccuccuccucaagaacuucuccuccccccuccccucccccgccggcaugcucgagccccucguccucgacggcaaggagcucccccaggucugcgucggcgccgagggccccgagggccccggcugccgcguccucuuccacguccucccccucgaggccggccucacccccgacauccucaucccccccgagggcauccccggcuccgcccagcaggucauccaggucgaccgcgacaccauccucgucuccuucgagcgcugcguccgcaucgucaacaugcagggcgagcccaccgccacccucgcccccgagcucaccuucgacuuccccaucgagaccgucgucugccuccaggacuccguccucgccuucuggucccacggcaugcagggccgcucccucgacaccaacgaggucacccaggagaucaccgacgagacccgcaucuuccgcguccucggcgcccaccgcgacaucauccucgaguccauccccaccgacaaccccgaggcccacuccaaccucuacauccucaccggccaccaguccaccuacuga

SEQ ID NO: 45731 - RNA, 2622 nt, Artificial Sequence
  derived and/or modified sequence opt2 from MAP4K3__Homo_sapiens__NP_001257354
augaaccccggcuucgaccucucccgccgcaacccccaggaggacuucgagcucauccagcgcaucggcuccggcaccuacggcgacgucuacaaggcccgcaacgucaacaccggcgagcucgccgccaucaaggucaucaagcucgagcccggcgaggacuucgccgucguccagcaggagaucaucaugaugaaggacugcaagcaccccaacaucgucgccuacuucggcuccuaccuccgccgcgacaagcucuggaucugcauggaguucugcggcggcggcucccuccaggacaucuaccacgucaccggcccccucuccgagcuccagaucgccuacgucucccgcgagacccuccagggccucuacuaccuccacuccaagggcaagaugcaccgcgacaucaagggcgccaacauccuccucaccgacaacggccacgucaagcucgccgacuucggcgucuccgcccagaucaccgccaccaucgccaagcgcaaguccuucaucggcacccccuacuggauggcccccgaggucgccgccgucgagcgcaagggcggcuacaaccagcucugcgaccucugggccgucggcaucaccgccaucgagcucgccgagcuccagccccccauguucgaccuccaccccaugcgcgcccucuuccucaugaccaaguccaacuuccagccccccaagcucaaggacaagaugaagugguccaacuccuuccaccacuucgucaagauggcccucaccaagaaccccaagaagcgccccaccgccgagaagcuccuccagcaccccuucgucacccagcaccucacccgcucccucgccaucgagcuccucgacaaggucaacaaccccgaccacuccaccuaccacgacuucgacgacgacgaccccgagccccucgucgccgucccccaccgcauccacuccaccucccgcaacguccgcgaggagaagacccgcuccgagaucaccuucggccaggucaaguucgaccccccccuccgcaaggagaccgagccccaccacgagcucgaccuccagcucgaguacggccagggccaccagggcggcuacuuccucggcgccaacaagucccuccucaaguccgucgaggaggagcuccaccagcgcggccacgucgcccaccucgaggacgacgagggcgacgacgacgaguccaagcacuccacccucaaggccaagaucccccccccccucccccccaagcccaaguccaucuucaucccccaggagaugcacuccaccgaggacgagaaccagggcaccaucaagcgcugccccauguccggcucccccgccaagcccucccagguccccccccgccccccccccccccgccuccccccccacaagcccgucgcccucggcaacggcauguccuccuuccagcucaacggcgagcgcgacggcucccucugccagcagcagaacgagcaccgcggcaccaaccucucccgcaaggagaagaaggacguccccaagcccaucuccaacggccucccccccacccccaagguccacaugggcgccugcuucuccaaggucuucaacggcugcccccucaagauccacugcgccuccuccuggaucaaccccgacacccgcgaccaguaccucaucuucggcgccgaggagggcaucuacacccucaaccucaacgagcuccacgagaccuccauggagcagcucuucccccgccgcugcaccuggcucuacgucaugaacaacugccuccucuccaucuccggcaaggccucccagcucuacucccacaaccuccccggccucuucgacuacgcccgccagaugcagaagcuccccgucgccauccccgcccacaagcuccccgaccgcauccucccccgcaaguucuccgucuccgccaagauccccgagaccaaguggugccagaagugcugcgucguccgcaaccccuacaccggccacaaguaccucugcggcgcccuccagaccuccaucguccuccucgagugggucgagcccaugcagaaguucaugcucaucaagcacaucgacuuccccauccccugcccccuccgcauguucgagaugcucgucguccccgagcaggaguacccccucgucugcgucggcgucucccgcggccgcgacuucaaccaggucguccgcuucgagaccgucaaccccaacuccaccuccuccugguucaccgaguccgacaccccccagaccaacgucacccacgucacccagcucgagcgcgacaccauccucgucugccucgacugcugcaucaagaucgucaaccuccagggccgccucaaguccucccgcaagcucuccuccgagcucaccuucgacuuccagaucgaguccaucgucugccuccaggacuccguccucgccuucuggaagcacggcaugcagggccgcuccuuccgcuccaacgaggucacccaggagaucuccgacuccacccgcaucuuccgccuccucggcuccgaccgcgucgucguccucgagucccgccccaccgacaaccccaccgccaacuccaaccucuacauccucgccggccacgagaacuccuacuga

SEQ ID NO: 45732 - RNA, 3720 nt, Artificial Sequence
  derived and/or modified sequence opt2 from MAP4K4__Homo_sapiens__NP_001229488
auggccaacgacucccccgccaagucccucgucgacaucgaccucuccucccuccgcgaccccgccggcaucuucgagcucgucgaggucgucggcaacggcaccuacggccaggucuacaagggccgccacgucaagaccggccagcucgccgccaucaaggucauggacgucaccgaggacgaggaggaggagaucaagcucgagaucaacaugcucaagaaguacucccaccaccgcaacaucgccaccuacuacggcgccuucaucaagaaguccccccccggccacgacgaccagcucuggcucgucauggaguucugcggcgccggcuccaucaccgaccucgucaagaacaccaagggcaacacccucaaggaggacuggaucgccuacaucucccgcgagauccuccgcggccucgcccaccuccacauccaccacgucauccaccgcgacaucaagggccagaacguccuccucaccgagaacgccgaggucaagcucgucgacuucggcgucuccgcccagcucgaccgcaccgucggccgccgcaacaccuucaucggcacccccuacuggauggcccccgaggucaucgccugcgacgagaaccccgacgccaccuacgacuaccgcuccgaccucugguccugcggcaucaccgccaucgagauggccgagggcgcccccccccucugcgacaugcaccccaugcgcgcccucuuccucaucccccgcaacccccccccccgccucaaguccaagaagugguccaagaaguucuucuccuucaucgagggcugccucgucaagaacuacaugcagcgccccuccaccgagcagcuccucaagcaccccuucauccgcgaccagcccaacgagcgccagguccgcauccagcucaaggaccacaucgaccgcacccgcaagaagcgcggcgagaaggacgagaccgaguacgaguacuccggcuccgaggaggaggaggaggagguccccgagcaggagggcgagcccuccuccaucgucaacguccccggcgaguccacccuccgccgcgacuuccuccgccuccagcaggagaacaaggagcgcuccgaggcccuccgccgccagcagcuccuccaggagcagcagcuccgcgagcaggaggaguacaagcgccagcuccucgccgagcgccagaagcgcaucgagcagcagaaggagcagcgccgccgccucgaggagcagcagcgccgcgagcgcgaggcccgccgccagcaggagcgcgagcagcgccgccgcgagcaggaggagaagcgccgccucgaggagcucgagcgccgccgcaaggaggaggaggagcgccgccgcgccgaggaggagaagcgccgcgucgagcgcgagcaggaguacauccgccgccagcucgaggaggagcagcgccaccucgagguccuccagcagcagcuccuccaggagcaggccaugcuccucgagugccgcuggcgcgagauggaggagcaccgccaggccgagcgccuccagcgccagcuccagcaggagcaggccuaccuccucucccuccagcacgaccaccgccgcccccacccccagcacucccagcagcccccccccccccagcaggagcgcuccaagcccuccuuccacgcccccgagcccaaggcccacuacgagcccgccgaccgcgcccgcgaggucgaggaccgcuuccgcaagaccaaccacuccucccccgaggcccaguccaagcagaccggccgcguccucgagccccccguccccucccgcuccgaguccuucuccaacggcaacuccgaguccguccaccccgcccuccagcgccccgccgagccccagguccccguccgcaccaccucccgcucccccguccucucccgccgcgacuccccccuccagggcuccggccagcagaacucccaggccggccagcgcaacuccaccuccaucgagccccgccuccucugggagcgcgucgagaagcucgucccccgccccggcuccggcuccuccuccggcuccuccaacuccggcucccagcccggcucccaccccggcucccaguccggcuccggcgagcgcuuccgcguccgcuccuccuccaaguccgagggcucccccucccagcgccucgagaacgccgucaagaagcccgaggacaagaaggaggucuuccgcccccucaagcccgccgaccucaccgcccucgccaaggagcuccgcgccgucgaggacguccgccccccccacaaggucaccgacuacuccuccuccuccgaggaguccggcaccaccgacgaggaggacgacgacgucgagcaggagggcgccgacgaguccaccuccggccccgaggacacccgcgccgccuccucccucaaccucuccaacggcgagaccgaguccgucaagaccaugaucguccacgacgacgucgaguccgagcccgccaugacccccuccaaggagggcacccucaucguccgccagacccaguccgccuccuccacccuccagaagcacaaguccuccuccuccuucacccccuucaucgacccccgccuccuccagaucucccccuccuccggcaccaccgucaccuccgucgucggcuucuccugcgacggcaugcgccccgaggccauccgccaggaccccacccgcaagggcuccgucgucaacgucaaccccaccaacacccgcccccaguccgacacccccgagauccgcaaguacaagaagcgcuucaacuccgagauccucugcgccgcccucuggggcgucaaccuccucgucggcaccgaguccggccucaugcuccucgaccgcuccggccagggcaaggucuacccccucaucaaccgccgccgcuuccagcagauggacguccucgagggccucaacguccucgucaccaucuccggcaagaaggacaagcuccgcgucuacuaccucuccuggcuccgcaacaagauccuccacaacgaccccgaggucgagaagaagcagggcuggaccaccgucggcgaccucgagggcugcguccacuacaaggucgucaaguacgagcgcaucaaguuccucgucaucgcccucaaguccuccgucgaggucuacgccugggcccccaagcccuaccacaaguucauggccuucaaguccuucggcgagcucguccacaagccccuccucgucgaccucaccgucgaggagggccagcgccucaaggucaucuacggcuccugcgccggcuuccacgccgucgacgucgacuccggcuccgucuacgacaucuaccuccccacccacauccagugcuccaucaagccccacgccaucaucauccuccccaacaccgacggcauggagcuccucgucugcuacgaggacgagggcgucuacgucaacaccuacggccgcaucaccaaggacgucguccuccaguggggcgagaugcccaccuccgucgccuacauccgcuccaaccagaccaugggcuggggcgagaaggccaucgagauccgcuccgucgagaccggccaccucgacggcgucuucaugcacaagcgcgcccagcgccucaaguuccucugcgagcgcaacgacaaggucuucuucgccuccguccgcuccggcggcuccucccaggucuacuucaugacccucggccgcaccucccuccucuccugguga

SEQ ID NO: 45733 - RNA, 2541 nt, Artificial Sequence
  derived and/or modified sequence opt2 from MAP4K5__Homo_sapiens__XP_006720076
auggaggccccccuccgccccgccgccgacauccuccgccgcaacccccagcaggacuacgagcucguccagcgcgucggcuccggcaccuacggcgacgucuacaaggcccgcaacguccacaccggcgagcucgccgccgucaagaucaucaagcucgagcccggcgacgacuucucccucauccagcaggagaucuucauggucaaggagugcaagcacugcaacaucgucgccuacuucggcuccuaccucucccgcgagaagcucuggaucugcauggaguacugcggcggcggcucccuccaggacaucuaccacgucaccggcccccucuccgagcuccagaucgccuacgucugccgcgagacccuccagggccucgccuaccuccacaccaagggcaagaugcaccgcgacaucaagggcgccaacauccuccucaccgaccacggcgacgucaagcucgccgacuucggcgucgccgccaagaucaccgccaccaucgccaagcgcaaguccuucaucggcacccccuacuggauggcccccgaggucgccgccgucgagaagaacggcggcuacaaccagcucugcgacaucugggccgucggcaucaccgccaucgagcucggcgagcuccagccccccauguucgaccuccaccccaugcgcgcccucuuccucauguccaaguccaacuuccagccccccaagcucaaggacaagaccaagugguccuccaccuuccacaacuucgucaagaucgcccucaccaagaaccccaagaagcgccccaccgccgagcgccuccucacccacaccuucgucgcccagcccggccucucccgcgcccucgccgucgagcuccucgacaaggucaacaaccccgacaaccacgcccacuacaccgaggccgacgacgacgacuucgagccccacgccaucauccgccacaccauccgcuccaccaaccgcaacgcccgcgccgagcgcaccgccuccgagaucaacuucgacaagcuccaguucgagcccccccuccgcaaggagaccgaggcccgcgacgagaugggccucuccuccgaccccaacuucaugcuccaguggaaccccuucgucgacggcgccaacaccggcaaguccaccuccaagcgcgccaucccccccccccucccccccaagccccgcaucuccuccuaccccgaggacaacuuccccgacgaggagaaggccuccaccaucaagcacugccccgacuccgagucccgcgccccccagauccuccgccgccaguccucccccuccugcggccccgucgccgagaccuccuccaucggcaacggcgacggcaucuccaagcucauguccgagaacaccgagggcuccgcccaggccccccagcucccccgcaagaaggacaagcgcgacuuccccaagcccgccaucaacggccucccccccacccccaagguccucaugggcgccugcuucuccaaggucuucgacggcugcccccucaagaucaacugcgccaccuccuggauccaccccgacaccaaggaccaguacaucaucuucggcaccgaggacggcaucuacacccucaaccucaacgagcuccacgaggccaccauggagcagcucuucccccgcaagugcaccuggcucuacgucaucaacaacacccucaugucccucuccgagggcaagaccuuccagcucuacucccacaaccucaucgcccucuucgagcacgccaagaagcccggccucgccgcccacauccagacccaccgcuuccccgaccgcauccucccccgcaaguucgcccucaccaccaagauccccgacaccaagggcugccacaagugcugcaucguccgcaaccccuacaccggccacaaguaccucugcggcgcccuccaguccggcaucguccuccuccagugguacgagcccaugcagaaguucaugcucaucaagcacuucgacuucccccuccccuccccccucaacgucuucgagaugcucgucauccccgagcaggaguaccccauggucugcgucgccaucuccaagggcaccgaguccaaccaggucguccaguucgagaccaucaaccucaacuccgccuccuccugguucaccgagaucggcgccggcucccagcagcucgacuccauccacgucacccagcucgagcgcgacaccguccucgucugccucgacaaguucgucaagaucgucaaccuccagggcaagcucaaguccuccaagaagcucgccuccgagcucuccuucgacuuccgcaucgaguccgucgucugccuccaggacuccguccucgccuucuggaagcacggcaugcagggcaaguccuucaaguccgacgaggucacccaggagaucuccgacgagacccgcgucuuccgccuccucggcuccgaccgcgucgucguccucgagucccgccccaccgagaaccccaccgcccacuccaaccucuacauccucgccggccacgagaacuccuacuga

SEQ ID NO: 45734 - RNA, 2442 nt, Artificial Sequence
  derived and/or modified sequence opt2 from MAP6__Homo_sapiens__NP_149052
auggccuggcccugcaucacccgcgccugcugcaucgcccgcuucuggaaccagcucgacaaggccgacaucgccgucccccucgucuucaccaaguacuccgaggccaccgagcaccccggcgcccccccccagcccccccccccccagcagcaggcccagcccgcccucgccccccccuccgcccgcgccgucgccaucgagacccagcccgcccagggcgagcucgacgccgucgcccgcgccaccggccccgcccccggccccaccggcgagcgcgagcccgccgccggccccggccgcuccggccccggccccggccucggcuccggcuccaccuccggccccgccgacuccgucaugcgccaggacuaccgcgccuggaagguccagcgccccgagcccuccugccgcccccgcuccgaguaccagcccuccgacgcccccuucgagcgcgagacccaguaccagaaggacuuccgcgccuggccccucccccgccgcggcgaccaccccuggauccccaagcccguccagaucuccgccgccucccaggccuccgcccccauccucggcgcccccaagcgccgcccccagucccaggagcgcuggcccguccaggccgccgccgaggcccgcgagcaggaggccgcccccggcggcgccggcggccucgccgccggcaaggccuccggcgccgacgagcgcgacacccgccgcaaggccggccccgccuggaucguccgccgcgccgagggccucggccacgagcagaccccccuccccgccgcccaggcccagguccaggccaccggccccgaggccggccgcggccgcgccgccgccgacgcccucaaccgccagauccgcgaggaggucgccuccgccgucuccuccuccuaccgcaacgaguuccgcgccuggaccgacaucaagcccgucaagcccaucaaggccaagccccaguacaagccccccgacgacaagaugguccacgagaccuccuacuccgcccaguucaagggcgaggccuccaagcccaccaccgccgacaacaaggucaucgaccgccgccgcauccgcucccucuacuccgagcccuucaaggagccccccaaggucgagaagcccuccguccaguccuccaagcccaagaagaccuccgccucccacaagcccacccgcaaggccaaggacaagcaggccgucuccggccaggccgccaagaagaaguccgccgagggccccuccaccaccaagcccgacgacaaggagcaguccaaggagaugaacaacaagcucgccgaggccaaggagucccucgcccagcccgucuccgacuccuccaagacccagggccccgucgccaccgagcccgacaaggaccagggcuccgucguccccggccuccucaagggccagggccccaugguccaggagccccucaagaagcagggcuccgucguccccggcccccccaaggaccucggccccaugaucccccuccccgucaaggaccaggaccacaccguccccgagccccucaagaacgagucccccgucaucuccgcccccgucaaggaccagggccccuccguccccgucccccccaagaaccagucccccaugguccccgccaaggucaaggaccagggcuccgucguccccgagucccucaaggaccagggcccccgcauccccgagcccgucaagaaccaggcccccaugguccccgcccccgucaaggacgagggccccauggucuccgccuccgucaaggaccagggccccauggucuccgcccccgucaaggaccagggccccaucguccccgcccccgucaagggcgagggccccaucguccccgcccccgucaaggacgagggccccauggucuccgcccccaucaaggaccaggaccccaugguccccgagcaccccaaggacgaguccgccauggccaccgcccccaucaagaaccagggcuccauggucuccgagcccgucaagaaccagggccucgucgucuccggccccgucaaggaccaggacgucgucguccccgagcacgccaagguccacgacuccgccgucgucgcccccgucaagaaccagggccccgucguccccgaguccgucaagaaccaggaccccauccuccccguccucgucaaggaccagggccccaccguccuccagccccccaagaaccagggccgcaucguccccgagccccucaagaaccagguccccaucguccccgucccccucaaggaccaggacccccucguccccguccccgccaaggaccagggccccgccguccccgagccccucaagacccagggcccccgcgacccccagcuccccaccgucuccccccucccccgcgucaugauccccaccgccccccacaccgaguacaucgaguccucccccuga

SEQ ID NO: 45735 - RNA, 2205 nt, Artificial Sequence
  derived and/or modified sequence opt2 from MAP7__Homo_sapiens__NP_001185540
augcccggcuccgccaccgcccuccgccacgagcgccucaagaagaccaacgcccgccccaucccccucggccucuucaccaucaacgaggaggacgagcagcagaagaacggcaacucccgccgccccaaggcccccgacuccuacaagguccaggacaagaagaacgccuccucccgccccgccuccgccaucuccggccagaacaacaaccacuccggcaacaagcccgaccccccccccguccuccgcgucgacgaccgccagcgccucgcccgcgagcgccgcgaggagcgcgagaagcagcucgccgcccgcgagaucgucuggcucgagcgcgaggagcgcgcccgccagcacuacgagaagcaccucgaggagcgcaagaagcgccucgaggagcagcgccagaaggaggagcgccgccgcgccgccgucgaggagaagcgccgccagcgccucgaggaggacaaggagcgccacgaggccgucguccgccgcaccauggagcgcucccagaagcccaagcagaagcacaaccgcugguccuggggcggcucccuccacggcucccccuccauccacuccgccgcccgccgccuccagcucucccccugggaguccuccgucgucaaccgccuccucacccccacccacuccuuccucgcccgcuccaaguccaccgccgcccucuccggcgaggccgccuccugcucccccaucaucaugcccuacaaggccgcccacucccgcaacuccauggaccgccccaagcucuucgucaccccccccgagggcuccucccgccgccgcaucauccacggcaccgccuccuacaagaaggagcgcgagcgcgagaacguccucuuccucaccuccggcacccgccgcgccgucucccccuccaaccccaaggcccgccagcccgcccgcucccgccucuggcuccccuccaagucccucccccaccuccccggcaccccccgccccaccuccucccucccccccggcuccgucaaggccgcccccgcccagguccgcccccccucccccggcaacauccgccccgucaagcgcgaggucaaggucgagcccgagaagaaggaccccgagaaggagccccagaaggucgccaacgagcccucccucaagggccgcgccccccucgucaaggucgaggaggccaccgucgaggagcgcacccccgccgagcccgaggucggccccgccgcccccgccauggcccccgcccccgccuccgcccccgcccccgccuccgcccccgcccccgcccccguccccacccccgccauggucuccgcccccuccuccaccgucaacgccuccgccuccgucaagaccuccgccggcaccaccgaccccgaggaggccacccgccuccucgccgagaagcgccgccucgcccgcgagcagcgcgagaaggaggagcgcgagcgccgcgagcaggaggagcucgagcgccagaagcgcgaggagcucgcccagcgcgucgccgaggagcgcaccacccgccgcgaggaggagucccgccgccucgaggccgagcaggcccgcgagaaggaggagcagcuccagcgccaggccgaggagcgcgcccuccgcgagcgcgaggaggccgagcgcgcccagcgccagaaggaggaggaggcccgcguccgcgaggaggccgagcgcguccgccaggagcgcgagaagcacuuccagcgcgaggagcaggagcgccucgagcgcaagaagcgccucgaggagaucaugaagcgcacccgccgcaccgaggccaccgacaagaagaccuccgaccagcgcaacggcgacaucgccaagggcgcccucaccggcggcaccgaggucuccgcccuccccugcaccaccaacgcccccggcaacggcaagcccgucggcuccccccacgucgucaccucccaccaguccaaggucaccgucgaguccacccccgaccucgagaagcagcccaacgagaacggcgucuccguccagaacgagaacuucgaggagaucaucaaccuccccaucggcuccaagcccucccgccucgacgucaccaacuccgagucccccgagaucccccucaaccccauccucgccuucgacgacgagggcacccucggcccccucccccaggucgacggcguccagacccagcagaccgccgaggucaucuga

SEQ ID NO: 45736 - RNA, 1944 nt, Artificial Sequence
  derived and/or modified sequence opt2 from MAP9__Homo_sapiens__NP_001034669
auguccgacgaggucuucuccaccacccucgccuacaccaagucccccaaggucaccaagcgcaccaccuuccaggacgagcucauccgcgccaucaccgcccgcuccgcccgccagcgcuccuccgaguacuccgacgacuucgacuccgacgagaucgucucccucggcgacuucuccgacaccuccgccgacgagaacuccgucaacaagaagaugaacgacuuccacaucuccgacgacgaggagaagaaccccuccaagcuccucuuccucaagaccaacaaguccaacggcaacaucaccaaggacgagcccgucugcgccaucaagaacgaggaggagauggcccccgacggcugcgaggacaucgucgucaaguccuucuccgagucccagaacaaggacgaggaguucgagaaggacaagaucaagaugaagcccaagccccgcauccucuccaucaaguccaccuccuccgccgagaacaacucccucgacaccgacgaccacuucaagcccuccccccgcccccgcuccaugcucaagaagaagucccacauggaggagaaggacggccucgaggacaaggagaccgcccucuccgaggagcucgagcuccacuccgcccccuccucccuccccacccccaacggcauccagcucgaggccgagaagaaggccuucuccgagaaccucgaccccgaggacuccugccucaccucccucgccuccuccucccucaagcagauccucggcgacuccuucucccccggcuccgagggcaacgccuccggcaaggaccccaacgaggagaucaccgagaaccacaacucccucaaguccgacgagaacaaggagaacuccuucuccgccgaccacgucaccaccgccgucgagaaguccaaggagucccaggucaccgccgacgaccucgaggaggagaaggccaaggccgagcucaucauggacgacgaccgcaccgucgacccccuccucuccaagucccaguccauccucaucuccaccuccgccaccgccuccuccaagaagaccaucgaggaccgcaacaucaagaacaagaaguccaccaacaaccgcgccuccuccgccuccgcccgccucaugaccuccgaguuccucaagaaguccuccuccaagcgccgcacccccuccaccaccaccuccucccacuaccucggcacccucaagguccucgaccagaagcccucccagaagcaguccaucgagcccgaccgcgccgacaacauccgcgccgccgucuaccaggaguggcucgagaagaagaacgucuaccuccacgagaugcaccgcaucaagcgcaucgaguccgagaaccuccgcauccagaacgagcagaagaaggccgccaagcgcgaggaggcccucgccuccuucgaggccuggaaggccaugaaggagaaggaggccaagaagaucgccgccaagaagcgccucgaggagaagaacaagaagaagaccgaggaggagaacgccgcccgcaagggcgaggcccuccaggccuucgagaaguggaaggagaagaagauggaguaccucaaggagaagaaccgcaaggagcgcgaguacgagcgcgccaagaagcagaaggaggaggagaccgucgccgagaagaagaaggacaaccucaccgccgucgagaaguggaacgagaagaaggaggccuucuucaagcagaaggagaaggagaagaucaacgagaagcgcaaggaggagcucaagcgcgccgagaagaaggacaaggacaagcaggccaucaacgaguacgagaaguggcucgagaacaaggagaagcaggagcgcaucgagcgcaagcagaagaagcgccacuccuuccucgaguccgaggcccucccccccugguccccccccucccgcaccgucuucgccaaggucuucuga

SEQ ID NO: 45737 - RNA, 1269 nt, Artificial Sequence
  derived and/or modified sequence opt2 from MAPK10__Homo_sapiens__NP_002744
augucccuccacuuccucuacuacugcuccgagcccacccucgacgucaagaucgccuucugccagggcuucgacaagcaggucgacgucuccuacaucgccaagcacuacaacauguccaaguccaaggucgacaaccaguucuacuccgucgaggucggcgacuccaccuucaccguccucaagcgcuaccagaaccucaagcccaucggcuccggcgcccagggcaucgucugcgccgccuacgacgccguccucgaccgcaacgucgccaucaagaagcucucccgccccuuccagaaccagacccacgccaagcgcgccuaccgcgagcucguccucaugaagugcgucaaccacaagaacaucaucucccuccucaacgucuucaccccccagaagacccucgaggaguuccaggacgucuaccucgucauggagcucauggacgccaaccucugccaggucauccagauggagcucgaccacgagcgcauguccuaccuccucuaccagaugcucugcggcaucaagcaccuccacuccgccggcaucauccaccgcgaccucaagcccuccaacaucgucgucaaguccgacugcacccucaagauccucgacuucggccucgcccgcaccgccggcaccuccuucaugaugacccccuacgucgucacccgcuacuaccgcgcccccgaggucauccucggcaugggcuacaaggagaacgucgacaucugguccgucggcugcaucaugggcgagaugguccgccacaagauccucuuccccggccgcgacuacaucgaccaguggaacaaggucaucgagcagcucggcacccccugccccgaguucaugaagaagcuccagcccaccguccgcaacuacgucgagaaccgccccaaguacgccggccucaccuuccccaagcucuuccccgacucccucuuccccgccgacuccgagcacaacaagcucaaggccucccaggcccgcgaccuccucuccaagaugcucgucaucgaccccgccaagcgcaucuccgucgacgacgcccuccagcaccccuacaucaacgucugguacgaccccgccgaggucgaggccccccccccccagaucuacgacaagcagcucgacgagcgcgagcacaccaucgaggaguggaaggagcucaucuacaaggaggucaugaacuccgaggagaagaccaagaacggcgucgucaagggccagcccucccccuccgcccagguccagcaguga

SEQ ID NO: 45738 - RNA, 1095 nt, Artificial Sequence
  derived and/or modified sequence opt2 from MAPK11__Homo_sapiens__NP_002742
auguccggcccccgcgccggcuucuaccgccaggagcucaacaagaccgucugggaggucccccagcgccuccagggccuccgccccgucggcuccggcgccuacggcuccgucugcuccgccuacgacgcccgccuccgccagaaggucgccgucaagaagcucucccgccccuuccagucccucauccacgcccgccgcaccuaccgcgagcuccgccuccucaagcaccucaagcacgagaacgucaucggccuccucgacgucuucacccccgccaccuccaucgaggacuucuccgaggucuaccucgucaccacccucaugggcgccgaccucaacaacaucgucaagugccaggcccucuccgacgagcacguccaguuccucgucuaccagcuccuccgcggccucaaguacauccacuccgccggcaucauccaccgcgaccucaagcccuccaacgucgccgucaacgaggacugcgagcuccgcauccucgacuucggccucgcccgccaggccgacgaggagaugaccggcuacgucgccacccgcugguaccgcgcccccgagaucaugcucaacuggaugcacuacaaccagaccgucgacaucugguccgucggcugcaucauggccgagcuccuccagggcaaggcccucuuccccggcuccgacuacaucgaccagcucaagcgcaucauggaggucgucggcacccccucccccgagguccucgccaagaucuccuccgagcacgcccgcaccuacauccagucccucccccccaugccccagaaggaccucuccuccaucuuccgcggcgccaacccccucgccaucgaccuccucggccgcaugcucguccucgacuccgaccagcgcgucuccgccgccgaggcccucgcccacgccuacuucucccaguaccacgaccccgaggacgagcccgaggccgagcccuacgacgaguccgucgaggccaaggagcgcacccucgaggaguggaaggagcucaccuaccaggagguccucuccuucaagccccccgagccccccaagccccccggcucccucgagaucgagcaguga

SEQ ID NO: 45739 - RNA, 1074 nt, Artificial Sequence
  derived and/or modified sequence opt2 from MAPK12__Homo_sapiens__NP_001290181
auguccucccccccccccgcccgcuccggcuucuaccgccaggaggucaccaagaccgccugggagguccgcgccgucuaccgcgaccuccagcccgucggcuccggcgccuacggcgccgucugcuccgccgucgacggccgcaccggcgccaaggucgccaucaagaagcucuaccgccccuuccaguccgagcucuucgccaagcgcgccuaccgcgagcuccgccuccucaagcacaugcgccacgagaacgucaucggccuccucgacgucuucacccccgacgagacccucgacgacuucaccgacuucuaccucgucaugcccuucaugggcaccgaccucggcaagcucaugaagcacgagaagcucggcgaggaccgcauccaguuccucgucuaccagaugcucaagggccuccgcgaccucaagcccggcaaccucgccgucaacgaggacugcgagcucaagauccucgacuucggccucgcccgccaggccgacuccgagaugaccggcuacgucgucacccgcugguaccgcgcccccgaggucauccucaacuggaugcgcuacacccagaccgucgacaucugguccgucggcugcaucauggccgagaugaucaccggcaagacccucuucaagggcuccgaccaccucgaccagcucaaggagaucaugaaggucaccggcaccccccccgccgaguucguccagcgccuccaguccgacgaggccaagaacuacaugaagggccuccccgagcucgagaagaaggacuucgccuccauccucaccaacgccuccccccucgccgucaaccuccucgagaagaugcucguccucgacgccgagcagcgcgucaccgccggcgaggcccucgcccaccccuacuucgagucccuccacgacaccgaggacgagccccagguccagaaguacgacgacuccuucgacgacgucgaccgcacccucgacgaguggaagcgcgucaccuacaaggagguccucuccuucaagcccccccgccagcucggcgcccgcgucuccaaggagaccccccucuga

SEQ ID NO: 45740 - RNA, 1098 nt, Artificial Sequence
  derived and/or modified sequence opt2 from MAPK13__Homo_sapiens__NP_002745
augucccucauccgcaagaagggcuucuacaagcaggacgucaacaagaccgccugggagcuccccaagaccuacgucucccccacccacgucggcuccggcgccuacggcuccgucugcuccgccaucgacaagcgcuccggcgagaaggucgccaucaagaagcucucccgccccuuccaguccgagaucuucgccaagcgcgccuaccgcgagcuccuccuccucaagcacaugcagcacgagaacgucaucggccuccucgacgucuucacccccgccuccucccuccgcaacuucuacgacuucuaccucgucaugcccuucaugcagaccgaccuccagaagaucaugggcauggaguucuccgaggagaagauccaguaccucgucuaccagaugcucaagggccucaaguacauccacuccgccggcgucguccaccgcgaccucaagcccggcaaccucgccgucaacgaggacugcgagcucaagauccucgacuucggccucgcccgccacgccgacgccgagaugaccggcuacgucgucacccgcugguaccgcgcccccgaggucauccucuccuggaugcacuacaaccagaccgucgacaucugguccgucggcugcaucauggccgagaugcucaccggcaagacccucuucaagggcaaggacuaccucgaccagcucacccagauccucaaggucaccggcguccccggcaccgaguucguccagaagcucaacgacaaggccgccaaguccuacauccagucccucccccagaccccccgcaaggacuucacccagcucuucccccgcgccuccccccaggccgccgaccuccucgagaagaugcucgagcucgacgucgacaagcgccucaccgccgcccaggcccucacccaccccuucuucgagcccuuccgcgaccccgaggaggagaccgaggcccagcagcccuucgacgacucccucgagcacgagaagcucaccgucgacgaguggaagcagcacaucuacaaggagaucgucaacuucucccccaucgcccgcaaggacucccgccgccgcuccggcaugaagcucuga

SEQ ID NO: 45741 - RNA, 1083 nt, Artificial Sequence
  derived and/or modified sequence opt2 from MAPK14__Homo_sapiens__NP_001306
augucccaggagcgccccaccuucuaccgccaggagcucaacaagaccaucugggagguccccgagcgcuaccagaaccucucccccgucggcuccggcgccuacggcuccgucugcgccgccuucgacaccaagaccggccuccgcgucgccgucaagaagcucucccgccccuuccaguccaucauccacgccaagcgcaccuaccgcgagcuccgccuccucaagcacaugaagcacgagaacgucaucggccuccucgacgucuucacccccgcccgcucccucgaggaguucaacgacgucuaccucgucacccaccucaugggcgccgaccucaacaacaucgucaagugccagaagcucaccgacgaccacguccaguuccucaucuaccagauccuccgcggccucaaguacauccacuccgccgacaucauccaccgcgaccucaagcccuccaaccucgccgucaacgaggacugcgagcucaagauccucgacuucggccucgcccgccacaccgacgacgagaugaccggcuacgucgccacccgcugguaccgcgcccccgagaucaugcucaacuggaugcacuacaaccagaccgucgacaucugguccgucggcugcaucauggccgagcuccucaccggccgcacccucuuccccggcaccgaccacaucaaccagcuccagcagaucaugcgccucaccggcaccccccccgccuaccucaucaaccgcaugcccucccacgaggcccgcaacuacauccagucccucacccagaugcccaagaugaacuucgccaacgucuucaucggcgccaacccccucgccgucgaccuccucgagaagaugcucguccucgacuccgacaagcgcaucaccgccgcccaggcccucgcccacgccuacuucgcccaguaccacgaccccgacgacgagcccgucgccgaccccuacgaccaguccuucgagucccgcgaccuccucaucgacgaguggaagucccucaccuacgacgaggucaucuccuucgucccccccccccucgaccaggaggagauggaguccuga

SEQ ID NO: 45742 - RNA, 1635 nt, Artificial Sequence
  derived and/or modified sequence opt2 from MAPK15__Homo_sapiens__NP_620590
augugcaccgucgucgacccccgcaucguccgccgcuaccuccuccgccgccagcucggccagggcgccuacggcaucgucuggaaggccgucgaccgccgcaccggcgaggucgucgccaucaagaagaucuucgacgccuuccgcgacaagaccgacgcccagcgcaccuuccgcgagaucacccuccuccaggaguucggcgaccaccccaacaucaucucccuccucgacgucauccgcgccgagaacgaccgcgacaucuaccucgucuucgaguucauggacaccgaccucaacgccgucauccgcaagggcggccuccuccaggacguccacguccgcuccaucuucuaccagcuccuccgcgccacccgcuuccuccacuccggccacgucguccaccgcgaccagaagcccuccaacguccuccucgacgccaacugcaccgucaagcucugcgacuucggccucgcccgcucccucggcgaccuccccgagggccccgaggaccaggccgucaccgaguacgucgccacccgcugguaccgcgcccccgagguccuccucuccucccaccgcuacacccucggcgucgacauguggucccucggcugcauccucggcgagaugcuccgcggccgcccccucuuccccggcaccuccacccuccaccagcucgagcucauccucgagaccauccccccccccuccgaggaggaccuccucgcccucggcuccggcugccgcgccuccguccuccaccagcucggcucccgcccccgccagacccucgacgcccuccucccccccgacaccucccccgaggcccucgaccuccuccgccgccuccucgucuucgcccccgacaagcgccucuccgccacccaggcccuccagcaccccuacguccagcgcuuccacugccccuccgacgagugggcccgcgaggccgacguccgcccccgcgcccacgagggcguccagcucuccguccccgaguaccgcucccgcgucuaccagaugauccucgagugcggcggcuccuccggcaccucccgcgagaagggccccgagggcgucucccccucccaggcccaccuccacaagccccgcgccgacccccagcuccccucccgcacccccguccagggcccccgcccccgcccccaguccucccccggccacgaccccgccgagcacgaguccccccgcgccgccaagaacgucccccgccagaacuccgccccccuccuccagaccgcccuccucggcaacggcgagcgcccccccggcgccaaggaggcccccccccucacccucucccucgucaagcccuccggccgcggcgccgcccccucccucaccucccaggccgccgcccaggucgccaaccaggcccucauccgcggcgacuggaaccgcggcggcggcguccgcgucgccuccguccagcagguccccccccgccucccccccgaggcccgccccggccgccgcauguucuccaccuccgcccuccagggcgcccagggcggcgcccgcgcccuccucggcggcuacucccaggccuacggcaccgucugccacuccgcccucggccaccucccccuccucgagggccaccacgucuga

SEQ ID NO: 45743 - RNA, 1083 nt, Artificial Sequence
  derived and/or modified sequence opt2 from MAPK1__Homo_sapiens__NP_620407
auggccgccgccgccgccgccggcgccggccccgagaugguccgcggccaggucuucgacgucggcccccgcuacaccaaccucuccuacaucggcgagggcgccuacggcauggucugcuccgccuacgacaacgucaacaagguccgcgucgccaucaagaagaucucccccuucgagcaccagaccuacugccagcgcacccuccgcgagaucaagauccuccuccgcuuccgccacgagaacaucaucggcaucaacgacaucauccgcgcccccaccaucgagcagaugaaggacgucuacaucguccaggaccucauggagaccgaccucuacaagcuccucaagacccagcaccucuccaacgaccacaucugcuacuuccucuaccagauccuccgcggccucaaguacauccacuccgccaacguccuccaccgcgaccucaagcccuccaaccuccuccucaacaccaccugcgaccucaagaucugcgacuucggccucgcccgcgucgccgaccccgaccacgaccacaccggcuuccucaccgaguacgucgccacccgcugguaccgcgcccccgagaucaugcucaacuccaagggcuacaccaaguccaucgacaucugguccgucggcugcauccucgccgagaugcucuccaaccgccccaucuuccccggcaagcacuaccucgaccagcucaaccacauccucggcauccucggcucccccucccaggaggaccucaacugcaucaucaaccucaaggcccgcaacuaccuccucucccucccccacaagaacaagguccccuggaaccgccucuuccccaacgccgacuccaaggcccucgaccuccucgacaagaugcucaccuucaacccccacaagcgcaucgaggucgagcaggcccucgcccaccccuaccucgagcaguacuacgaccccuccgacgagcccaucgccgaggcccccuucaaguucgacauggagcucgacgaccuccccaaggagaagcucaaggagcucaucuucgaggagaccgcccgcuuccagcccggcuaccgcuccuga

SEQ ID NO: 45744 - RNA, 1074 nt, Artificial Sequence
  derived and/or modified sequence opt2 from MAPK3__Homo_sapiens__NP_001035145
auggccgccgccgccgcccagggcggcggcggcggcgagccccgccgcaccgagggcgucggccccggcguccccggcgaggucgagauggucaagggccagcccuucgacgucggcccccgcuacacccagcuccaguacaucggcgagggcgccuacggcauggucuccuccgccuacgaccacguccgcaagacccgcgucgccaucaagaagaucucccccuucgagcaccagaccuacugccagcgcacccuccgcgagauccagauccuccuccgcuuccgccacgagaacgucaucggcauccgcgacauccuccgcgccuccacccucgaggccaugcgcgacgucuacaucguccaggaccucauggagaccgaccucuacaagcuccucaagucccagcagcucuccaacgaccacaucugcuacuuccucuaccagauccuccgcggccucaaguacauccacuccgccaacguccuccaccgcgaccucaagcccuccaaccuccucaucaacaccaccugcgaccucaagaucugcgacuucggccucgcccgcaucgccgaccccgagcacgaccacaccggcuuccucaccgaguacgucgccacccgcugguaccgcgcccccgagaucaugcucaacuccaagggcuacaccaaguccaucgacaucugguccgucggcugcauccucgccgagaugcucuccaaccgccccaucuuccccggcaagcacuaccucgaccagcucaaccacauccucggcauccucggcucccccucccaggaggaccucaacugcaucaucaacaugaaggcccgcaacuaccuccagucccuccccuccaagaccaaggucgccugggccaagcucuuccccaaguccgacuccaaggcccucgaccuccucgaccgcaugcucaccuucaaccccaacaagcgcaucaccgucgaggaggcccucgcccaccccuaccucgagcaguacuacgaccccaccgacgaggucggccagucccccgccgccgucggccucggcgccggcgagcagggcggcaccuga

SEQ ID NO: 45745 - RNA, 2166 nt, Artificial Sequence
  derived and/or modified sequence opt2 from MAPK6__Homo_sapiens__XP_005254596
auggccgagaaguucgagucccucaugaacauccacggcuucgaccucggcucccgcuacauggaccucaagccccucggcugcggcggcaacggccucgucuucuccgccgucgacaacgacugcgacaagcgcgucgccaucaagaagaucguccucaccgacccccaguccgucaagcacgcccuccgcgagaucaagaucauccgccgccucgaccacgacaacaucgucaaggucuucgagauccucggccccuccggcucccagcucaccgacgacgucggcucccucaccgagcucaacuccgucuacaucguccaggaguacauggagaccgaccucgccaacguccucgagcagggcccccuccucgaggagcacgcccgccucuucauguaccagcuccuccgcggccucaaguacauccacuccgccaacguccuccaccgcgaccucaagcccgccaaccucuucaucaacaccgaggaccucguccucaagaucggcgacuucggccucgcccgcaucauggacccccacuacucccacaagggccaccucuccgagggccucgucaccaagugguaccgcuccccccgccuccuccucucccccaacaacuacaccaaggccaucgacaugugggccgccggcugcaucuucgccgagaugcucaccggcaagacccucuucgccggcgcccacgagcucgagcagaugcagcucauccucgaguccauccccgucguccacgaggaggaccgccaggagcuccucuccgucauccccgucuacauccgcaacgacaugaccgagccccacaagccccucacccagcuccuccccggcaucucccgcgaggcccucgacuuccucgagcagauccucaccuucucccccauggaccgccucaccgccgaggaggcccucucccaccccuacauguccaucuacuccuuccccauggacgagcccaucuccucccaccccuuccacaucgaggacgaggucgacgacauccuccucauggacgagacccacucccacaucuacaacugggagcgcuaccacgacugccaguucuccgagcacgacuggcccguccacaacaacuucgacaucgacgagguccagcucgacccccgcgcccucuccgacgucaccgacgaggaggagguccaggucgacccccgcaaguaccucgacggcgaccgcgagaaguaccucgaggaccccgccuucgacaccaacuacuccaccgagcccugcuggcaguacuccgaccaccacgagaacaaguacugcgaccucgagugcucccacaccugcaacuacaagacccgcuccuccuccuaccucgacaaccucgucuggcgcgaguccgaggucaaccacuacuacgagcccaagcucaucaucgaccucuccaacuggaaggagcaguccaaggagaaguccgacaagaagggcaaguccaagugcgagcgcaacggccucgucaaggcccagaucgcccucgaggaggccucccagcagcucgccggcaaggagcgcgagaagaaccagggcuucgacuucgacuccuucaucgccggcaccauccagcucuccucccagcacgagcccaccgacgucgucgacaagcucaacgaccucaacuccuccgucucccagcucgagcucaagucccucaucuccaaguccgucucccaggagaagcaggagaagggcauggccaaccucgcccagcucgaggcccucuaccaguccuccugggacucccaguucgucuccggcggcgaggacugcuucuucaucaaccaguucugcgagguccgcaaggacgagcaggucgagaaggagaacaccuacaccuccuaccucgacaaguucuucucccgcaaggaggacaccgagaugcucgagaccgagcccgucgaggacggcaagcucggcgagcgcggccacgaggagggcuuccucaacaacuccggcgaguuccucuucaacaagcagcucgaguccaucggcaucccccaguuccacucccccgucggcuccccccucaaguccauccaggccacccucacccccuccgccaugaaguccuccccccagaucccccaccagaccuacuccuccauccucaagcaccucaacuga

SEQ ID NO: 45746 - RNA, 2451 nt, Artificial Sequence
  derived and/or modified sequence opt2 from MAPK7__Homo_sapiens__NP_002740
auggccgagccccucaaggaggaggacggcgaggacggcuccgccgagccccccggccccgucaaggccgagcccgcccacaccgccgccuccgucgccgccaagaaccucgcccuccucaaggcccgcuccuucgacgucaccuucgacgucggcgacgaguacgagaucaucgagaccaucggcaacggcgccuacggcgucgucuccuccgcccgccgccgccucaccggccagcaggucgccaucaagaagauccccaacgccuucgacgucgucaccaacgccaagcgcacccuccgcgagcucaagauccucaagcacuucaagcacgacaacaucaucgccaucaaggacauccuccgccccaccguccccuacggcgaguucaaguccgucuacgucguccucgaccucauggaguccgaccuccaccagaucauccacuccucccagccccucacccucgagcacguccgcuacuuccucuaccagcuccuccgcggccucaaguacaugcacuccgcccaggucauccaccgcgaccucaagcccuccaaccuccucgucaacgagaacugcgagcucaagaucggcgacuucggcauggcccgcggccucugcaccucccccgccgagcaccaguacuucaugaccgaguacgucgccacccgcugguaccgcgcccccgagcucaugcucucccuccacgaguacacccaggccaucgaccucugguccgucggcugcaucuucggcgagaugcucgcccgccgccagcucuuccccggcaagaacuacguccaccagcuccagcucaucaugaugguccucggcacccccucccccgccgucauccaggccgucggcgccgagcgcguccgcgccuacauccagucccuccccccccgccagcccguccccugggagaccgucuaccccggcgccgaccgccaggcccucucccuccucggccgcaugcuccgcuucgagcccuccgcccgcaucuccgccgccgccgcccuccgccaccccuuccucgccaaguaccacgaccccgacgacgagcccgacugcgccccccccuucgacuucgccuucgaccgcgaggcccucacccgcgagcgcaucaaggaggccaucgucgccgagaucgaggacuuccacgcccgccgcgagggcauccgccagcagauccgcuuccagcccucccuccagcccgucgccuccgagcccggcugccccgacgucgagaugcccucccccugggcccccuccggcgacugcgccauggagucccccccccccgcccccccccccugccccggccccgcccccgacaccaucgaccucacccuccagccccccccccccgucuccgagcccgccccccccaagaaggacggcgccaucuccgacaacaccaaggccgcccucaaggccgcccuccucaagucccuccgcucccgccuccgcgacggccccuccgccccccucgaggcccccgagccccgcaagcccgucaccgcccaggagcgccagcgcgagcgcgaggagaagcgccgccgccgccaggagcgcgccaaggagcgcgagaagcgccgccaggagcgcgagcgcaaggagcgcggcgccggcgccuccggcggccccuccaccgacccccucgccggccucguccucuccgacaacgaccgcucccuccucgagcgcuggacccgcauggcccgccccgccgcccccgcccucaccuccguccccgcccccgcccccgcccccacccccacccccacccccguccagcccaccucccccccccccggccccgucgcccagcccaccggcccccagccccaguccgccggcuccaccuccggccccgucccccagcccgccugccccccccccggccccgccccccaccccaccggcccccccggccccauccccguccccgcccccccccagaucgccaccuccaccucccuccucgccgcccagucccucguccccccccccggccuccccggcuccuccacccccggcguccuccccuacuucccccccggccuccccccccccgacgccggcggcgccccccaguccuccauguccgagucccccgacgucaaccucgucacccagcagcucuccaagucccaggucgaggacccccucccccccgucuucuccggcacccccaagggcuccggcgccggcuacggcgucggcuucgaccucgaggaguuccucaaccaguccuucgacaugggcgucgccgacggcccccaggacggccaggccgacuccgccucccucuccgccucccuccucgccgacuggcucgagggccacggcaugaaccccgccgacaucgagucccuccagcgcgagauccagauggacucccccaugcuccucgccgaccuccccgaccuccaggaccccuga

SEQ ID NO: 45747 - RNA, 927 nt, Artificial Sequence
  derived and/or modified sequence opt2 from MAPK8__Homo_sapiens__NP_001265477
augucccgcuccaagcgcgacaacaacuucuacuccgucgagaucggcgacuccaccuucaccguccucaagcgcuaccagaaccucaagcccaucggcuccggcgcccagggcaucgucugcgccgccuacgacgccauccucgagcgcaacgucgccaucaagaagcucucccgccccuuccagaaccagacccacgccaagcgcgccuaccgcgagcucguccucaugaagugcgucaaccacaagaacaucaucggccuccucaacgucuucaccccccagaagucccucgaggaguuccaggacgucuacaucgucauggagcucauggacgccaaccucugccaggucauccagauggagcucgaccacgagcgcauguccuaccuccucuaccagaugcucugcggcaucaagcaccuccacuccgccggcaucauccaccgcgaccucaagcccuccaacaucgucgucaaguccgacugcacccucaagauccucgacuucggccucgcccgcaccgccggcaccuccuucaugaugacccccuacgucgucacccgcuacuaccgcgcccccgaggucauccucggcaugggcuacaaggagaacgccgacuccgagcacaacaagcucaaggccucccaggcccgcgaccuccucuccaagaugcucgucaucgacgccuccaagcgcaucuccgucgacgaggcccuccagcaccccuacaucaacgucugguacgaccccuccgaggccgaggcccccccccccaagauccccgacaagcagcucgacgagcgcgagcacaccaucgaggaguggaaggagcucaucuacaaggaggucauggaccucgaggagcgcaccaagaacggcgucauccgcggccagcccuccccccucgcccagguccagcaguga

SEQ ID NO: 45748 - RNA, 2136 nt, Artificial Sequence
  derived and/or modified sequence opt2 from MAPK8IP1__Homo_sapiens__NP_005447
auggccgagcgcgaguccggcggccucggcggcggcgccgccuccccccccgccgccucccccuuccucggccuccacaucgccuccccccccaacuuccgccucacccacgacaucucccucgaggaguucgaggacgaggaccucuccgagaucaccgacgagugcggcaucucccuccagugcaaggacacccucucccuccgccccccccgcgccggccuccucuccgccggcggcggcggcgccggcucccgccuccaggccgagaugcuccagauggaccucaucgacgccaccggcgacacccccggcgccgaggacgacgaggaggacgacgacgaggagcgcgccgcccgccgccccggcgccggcccccccaaggccgaguccggccaggagcccgccucccgcggccagggccagucccagggccagucccagggccccggcuccggcgacaccuaccgccccaagcgccccaccacccucaaccucuucccccaggucccccgcucccaggacacccucaacaacaacucccucggcaagaagcacuccuggcaggaccgcgucucccgcuccuccuccccccucaagaccggcgagcagacccccccccacgagcacaucugccucuccgacgagcuccccccccaguccggccccgcccccaccaccgaccgcggcaccuccaccgacucccccugccgccgcuccaccgccacccagauggccccccccggcggcccccccgccgccccccccggcggccgcggccacucccaccgcgaccgcauccacuaccaggccgacguccgccucgaggccaccgaggagaucuaccucacccccguccagcgcccccccgacgccgccgagcccaccuccgccuuccucccccccaccgagucccgcauguccgucuccuccgaccccgaccccgccgccuaccccuccaccgccggccgcccccaccccuccaucuccgaggaggaggagggcuucgacugccucuccucccccgagcgcgccgagccccccggcggcggcuggcgcggcucccucggcgagccccccccccccccccgcgccucccucuccuccgacaccuccgcccucuccuacgacuccgucaaguacacccucgucgucgacgagcacgcccagcucgagcucgucucccuccgccccugcuucggcgacuacuccgacgaguccgacuccgccaccgucuacgacaacugcgccuccgucuccucccccuacgaguccgccaucggcgaggaguacgaggaggccccccgcccccagccccccgccugccucuccgaggacuccacccccgacgagcccgacguccacuucuccaagaaguuccucaacgucuucauguccggccgcucccgcuccuccuccgccgaguccuucggccucuucuccugcaucaucaacggcgaggagcaggagcagacccaccgcgccaucuuccgcuucgucccccgccacgaggacgagcucgagcucgaggucgacgacccccuccucgucgagcuccaggccgaggacuacugguacgaggccuacaacaugcgcaccggcgcccgcggcgucuuccccgccuacuacgccaucgaggucaccaaggagcccgagcacauggccgcccucgccaagaacuccgacugggucgaccaguuccgcgucaaguuccucggcuccguccagguccccuaccacaagggcaacgacguccucugcgccgccaugcagaagaucgccaccacccgccgccucaccguccacuucaacccccccuccuccugcguccucgagaucuccguccgcggcgucaagaucggcgucaaggccgacgacucccaggaggccaagggcaacaagugcucccacuucuuccagcucaagaacaucuccuucugcggcuaccaccccaagaacaacaaguacuucggcuucaucaccaagcaccccgccgaccaccgcuucgccugccacgucuucgucuccgaggacuccaccaaggcccucgccgaguccgucggccgcgccuuccagcaguucuacaagcaguucgucgaguacaccugccccaccgaggacaucuaccucgaguga

SEQ ID NO: 45749 - RNA, 2475 nt, Artificial Sequence
  derived and/or modified sequence opt2 from MAPK8IP2__Homo_sapiens__NP_036456
auggccgaccgcgccgagauguucucccucuccaccuuccacucccucuccccccccggcugccgccccccccaggacaucucccucgaggaguucgacgacgaggaccucuccgagaucaccgacgacugcggccucggccucuccuacgacuccgaccacugcgagaaggacucccucucccucggccgcuccgagcagccccaccccaucugcuccuuccaggacgacuuccaggaguucgagaugaucgacgacaacgaggaggaggacgacgaggacgaggaggaggaggaggaggaggaggagggcgacggcgagggccaggagggcggcgaccccggcuccgaggcccccgcccccggcccccucauccccucccccuccgucgaggagccccacaagcaccgccccaccacccuccgccucaccacccucggcgcccaggacucccucaacaacaacggcggcuucgaccucguccgccccgccuccuggcaggagaccgcccucugcucccccgcccccgaggcccuccgcgagcuccccggcccccuccccgccaccgacaccggccccggcggcgcccagucccccguccgccccggcugcgacugcgagggcaaccgccccgccgagccccccgcccccggcggcaccucccccuccuccgaccccggcaucgaggccgaccuccgcucccgcuccuccggcggccgcggcggccgccgcuccucccaggagcucuccucccccggcuccgacuccgaggacgccggcggcgcccgccucggccgcaugaucuccuccaucuccgagaccgagcucgagcucuccuccgacggcggcuccuccuccuccggccgcuccucccaccucaccaacuccaucgaggaggccuccucccccgccuccgagcccgagcccccccgcgagcccccccgccgccccgccuuccuccccgucggccccgacgacaccaacuccgaguacgaguccggcuccgaguccgagcccgaccucuccgaggacgccgacucccccuggcuccucuccaaccucgucucccgcaugaucuccgagggcuccucccccauccgcugccccggccagugccucucccccgccccccgcccccccggcgagcccgucucccccgccggcggcgccgcccaggacucccaggaccccgaggccgccgccggccccggcggcgucgagcucgucgacauggagacccucugcgccccccccccccccgcccccgccgccccccgccccggccccgcccagcccggccccugccucuuccucuccaaccccacccgcgacaccaucaccccccucugggccgcccccggccgcgccgcccgccccggccgcgccugcuccgccgccugcuccgaggaggaggacgaggaggacgacgaggaggaggaggacgccgaggacuccgccggcucccccggcggccgcggcaccggccccuccgccccccgcgacgccucccucgucuacgacgccgucaaguacacccucgucgucgacgagcacacccagcucgagcucgucucccuccgccgcugcgccggccucggccacgacuccgaggaggacuccggcggcgaggccuccgaggaggaggccggcgccgcccuccucggcggcggccaggucuccggcgacaccucccccgacucccccgaccucaccuucuccaagaaguuccucaacgucuucgucaacuccaccucccgcuccuccuccaccgaguccuucggccucuucuccugccucgucaacggcgaggagcgcgagcagacccaccgcgccgucuuccgcuucaucccccgccaccccgacgagcucgagcucgacgucgacgaccccguccucgucgaggccgaggaggacgacuucugguuccgcggcuucaacaugcgcaccggcgagcgcggcgucuuccccgccuucuacgcccacgccguccccggccccgccaaggaccuccucggcuccaagcgcucccccugcugggucgagcgcuucgacguccaguuccucggcuccgucgagguccccugccaccagggcaacggcauccucugcgccgccaugcagaagaucgccaccgcccgcaagcucaccguccaccuccgcccccccgccuccugcgaccucgagaucucccuccgcggcgucaagcucucccucuccggcggcggccccgaguuccagcgcugcucccacuucuuccagaugaagaacaucuccuucugcggcugccacccccgcaacuccugcuacuucggcuucaucaccaagcacccccuccucucccgcuucgccugccacgucuucgucucccaggaguccaugcgccccgucgcccaguccgucggccgcgccuuccucgaguacuaccaggagcaccucgccuacgccugccccaccgaggacaucuaccucgaguga

SEQ ID NO: 45750 - RNA, 3993 nt, Artificial Sequence
  derived and/or modified sequence opt2 from MAPK8IP3__Homo_sapiens__NP_001035529
augauggagauccagauggacgagggcggcggcgucgucgucuaccaggacgacuacugcuccggcuccgucauguccgagcgcgucuccggccucgccggcuccaucuaccgcgaguucgagcgccucauccacugcuacgacgaggaggucgucaaggagcucaugccccucgucgucaacguccucgagaaccucgacuccguccucuccgagaaccaggagcacgaggucgagcucgagcuccuccgcgaggacaacgagcagcuccucacccaguacgagcgcgagaaggcccuccgccgccaggccgaggagaaguucaucgaguucgaggacgcccucgagcaggagaagaaggagcuccagauccaggucgagcacuacgaguuccagacccgccagcucgagcucaaggccaagaacuacgccgaccagaucucccgccucgaggagcgcgaguccgagaugaagaaggaguacaacgcccuccaccagcgccacaccgagaugauccagaccuacgucgagcacaucgagcgcuccaagaugcagcaggucggcggcaacucccagaccgaguccucccuccccggccgccgcaaggagcgccccaccucccucaacgucuucccccucgccgacggcaccguccgcgcccagaucggcggcaagcucguccccgccggcgaccacuggcaccucuccgaccucggccagcuccaguccuccuccuccuaccagugcccccaggacgagauguccgaguccggccaguccuccgccgccgccacccccuccaccaccggcaccaaguccaacacccccaccuccuccguccccuccgccgccgucaccccccucaacgagucccuccagccccucggcgacuacggcgucggcuccaagaacuccaagcgcgcccgcgagaagcgcgacucccgcaacauggagguccaggucacccaggagaugcgcaacgucuccaucggcaugggcuccuccgacgagugguccgacguccaggacaucaucgacuccacccccgagcucgacaugugccccgagacccgccucgaccgcaccggcuccucccccacccagggcaucgucaacaaggccuucggcaucaacaccgacucccucuaccacgagcucuccaccgccggcuccgaggucaucggcgacgucgacgagggcgccgaccuccucggcgaguucuccggcaugggcaaggaggucggcaaccuccuccucgagaacucccagcuccucgagaccaagaacgcccucaacgucgucaagaacgaccucaucgccaaggucgaccagcucuccggcgagcaggagguccuccgcggcgagcucgaggccgccaagcaggccaaggucaagcucgagaaccgcaucaaggagcucgaggaggagcucaagcgcgucaaguccgaggccaucaucgcccgccgcgagcccaaggaggaggccgaggacgucuccuccuaccucugcaccgaguccgacaagauccccauggcccagcgccgccgcuucacccgcgucgagauggcccgcguccucauggagcgcaaccaguacaaggagcgccucauggagcuccaggaggccguccgcuggaccgagaugauccgcgccucccgcgagcaccccuccguccaggagaagaagaaguccaccaucuggcaguucuucucccgccucuucuccuccuccuccucccccccccccgccaagcgccccuaccccuccgucaacauccacuacaagucccccaccaccgccggcuucucccagcgccgcaaccacgccaugugccccaucuccgccggcucccgcccccucgaguucuuccccgacgacgacugcaccuccuccgcccgccgcgagcagaagcgcgagcaguaccgccagguccgcgagcacguccgcaacgacgacggccgccuccaggccugcggcuggucccuccccgccaaguacaagcagcucucccccaacggcggccaggaggacacccgcaugaagaacguccccguccccgucuacugccgcccccucgucgagaaggaccccaccaugaagcucuggugcgccgccggcgucaaccucuccggcuggcgccccaacgaggacgacgccggcaacggcgucaagcccgcccccggccgcgacccccucaccugcgaccgcgagggcgacggcgagcccaaguccgcccacaccucccccgagaagaagaaggccaaggagcuccccgagauggacgccaccuccucccgcgucuggauccucaccuccacccucaccaccuccaaggucgucaucaucgacgccaaccagcccggcaccgucgucgaccaguucaccgucugcaacgcccacguccucugcaucuccuccauccccgccgccuccgacuccgacuacccccccggcgagauguuccucgacuccgacgucaaccccgaggaccccggcgccgacggcguccucgccggcaucacccucgucggcugcgccacccgcugcaacgucccccgcuccaacugcuccucccgcggcgacacccccguccucgacaagggccagggcgaggucgccaccaucgccaacggcaaggucaaccccucccaguccaccgaggaggccaccgaggccaccgagguccccgaccccggccccuccgagcccgagaccgccacccuccgccccggcccccucaccgagcacgucuucaccgaccccgcccccacccccuccuccggcccccagcccggcuccgagaacggccccgagcccgacuccuccuccacccgccccgagcccgagcccuccggcgaccccaccggcgccggcuccuccgccgcccccaccauguggcucggcgcccagaacggcuggcucuacguccacuccgccgucgccaacuggaagaagugccuccacuccaucaagcucaaggacuccguccucucccucguccacgucaagggccgcguccucgucgcccucgccgacggcacccucgccaucuuccaccgcggcgaggacggccagugggaccucuccaacuaccaccucauggaccucggccacccccaccacuccauccgcugcauggccgucgucuacgaccgcgucuggugcggcuacaagaacaagguccacgucauccagcccaagaccaugcagaucgagaaguccuucgacgcccacccccgccgcgagucccagguccgccagcucgccuggaucggcgacggcgucugggucuccauccgccucgacuccacccuccgccucuaccacgcccacacccaccagcaccuccaggacgucgacaucgagcccuacgucuccaagaugcucggcaccggcaagcucggcuucuccuucguccgcaucaccgcccuccucgucgccggcucccgccucugggucggcaccggcaacggcgucgucaucuccaucccccucaccgagaccgucguccuccaccgcggccagcuccucggccuccgcgccaacaagaccucccccaccuccggcgagggcgcccgccccggcggcaucauccacgucuacggcgacgacuccuccgaccgcgccgccuccuccuucauccccuacugcuccauggcccaggcccagcucugcuuccacggccaccgcgacgccgucaaguucuucgucuccguccccggcaacguccucgccacccucaacggcuccguccucgacucccccgccgagggccccggccccgccgcccccgccuccgaggucgagggccagaagcuccgcaacguccucguccucuccggcggcgagggcuacaucgacuuccgcaucggcgacggcgaggacgacgagaccgaggagggcgccggcgacaugucccaggucaagcccguccucuccaaggccgagcgcucccacaucaucgucuggcaggucuccuacacccccgaguga

SEQ ID NO: 45751 - RNA, 729 nt, Artificial Sequence
  derived and/or modified sequence opt2 from MAPK9__Homo_sapiens__NP_001128516
auguccgacuccaagugcgacucccaguucuacuccguccaggucgccgacuccaccuucaccguccucaagcgcuaccagcagcucaagcccaucggcuccggcgcccagggcaucgucugcgccgccuucgacaccguccucggcaucaacgucgccgucaagaagcucucccgccccuuccagaaccagacccacgccaagcgcgccuaccgcgagcucguccuccucaagugcgucaaccacaagaacaucaucucccuccucaacgucuucaccccccagaagacccucgaggaguuccaggacgucuaccucgucauggagcucauggacgccaaccucugccaggucauccacauggagcucgaccacgagcgcauguccuaccuccucuaccagaugcucugcggcaucaagcaccuccacuccgccggcaucauccaccgcgaccucaagcccuccaacaucgucgucaaguccgacugcacccucaagauccucgacuucggccucgcccgcaccgccugcaccaacuucaugaugacccccuacgucgucacccgcuacuaccgcgcccccgaggucauccucggcaugggcuacaaggagaacgucgacaucugguccgucggcugcaucaugggcgagcucgucaagggcugcgucaucuuccagggcaccgaccgcauccucccccgcgaccucggccccgccaugcucuccuga

SEQ ID NO: 45752 - RNA, 1569 nt, Artificial Sequence
  derived and/or modified sequence opt2 from MAPKAP1__Homo_sapiens__NP_001006618
auggccuuccucgacaaccccaccaucauccucgcccacauccgccagucccacgucaccuccgacgacaccggcaugugcgagaugguccucaucgaccacgacgucgaccucgagaagauccacccccccuccaugcccggcgacuccggcuccgagauccagggcuccaacggcgagacccagggcuacgucuacgcccaguccgucgacaucaccuccuccugggacuucggcauccgccgccgcuccaacaccgcccagcgccucgagcgccuccgcaaggagcgccagaaccagaucaagugcaagaacauccaguggaaggagcgcaacuccaagcaguccgcccaggagcucaagucccucuucgagaagaagucccucaaggagaagccccccaucuccggcaagcaguccauccucuccguccgccucgagcagugcccccuccagcucaacaaccccuucaacgaguacuccaaguucgacggcaagggccacgucggcaccaccgccaccaagaagaucgacgucuaccucccccuccacuccucccaggaccgccuccuccccaugaccgucgucaccauggccuccgcccgcguccaggaccucaucggccucaucugcuggcaguacaccuccgagggccgcgagcccaagcucaacgacaacgucuccgccuacugccuccacaucgccgaggacgacggcgaggucgacaccgacuuccccccccucgacuccaacgagcccauccacaaguucggcuucuccacccucgcccucgucgagaaguacuccucccccggccucaccuccaaggagucccucuucguccgcaucaacgccgcccacggcuucucccucauccaggucgacaacaccaaggucaccaugaaggagauccuccucaaggccgucaagcgccgcaagggcucccagaaggucuccggcccccaguaccgccucgagaagcaguccgagcccaacgucgccgucgaccucgacuccacccucgagucccaguccgccugggaguucugccucguccgcgagaacuccucccgcgccgacggcgucuucgaggaggacucccagaucgacaucgccaccguccaggacaugcucuccucccaccacuacaaguccuucaaggucuccaugauccaccgccuccgcuucaccaccgacguccagcucggcaucuccggcgacaaggucgagaucgaccccgucaccaaccagaaggccuccaccaaguucuggaucaagcagaagcccaucuccaucgacuccgaccuccucugcgccugcgaccucgccgaggagaagucccccucccacgccaucuucaagcucaccuaccucuccaaccacgacuacaagcaccucuacuucgaguccgacgccgccaccgucaacgagaucguccucaaggucaacuacauccucgagucccgcgccuccaccgcccgcgccgacuacuucgcccagaagcagcgcaagcucaaccgccgcaccuccuucuccuuccagaaggagaagaaguccggccagcaguga

SEQ ID NO: 45753 - RNA, 1113 nt, Artificial Sequence
  derived and/or modified sequence opt2 from MAPKAPK2__Homo_sapiens__NP_004750
augcucuccaacucccagggccaguccccccccguccccuuccccgcccccgccccccccccccagccccccacccccgcccucccccacccccccgcccagcccccccccccccccccccagcaguucccccaguuccacgucaaguccggccuccagaucaagaagaacgccaucaucgacgacuacaaggucaccucccagguccucggccucggcaucaacggcaagguccuccagaucuucaacaagcgcacccaggagaaguucgcccucaagaugcuccaggacugccccaaggcccgccgcgaggucgagcuccacuggcgcgccucccagugcccccacaucguccgcaucgucgacgucuacgagaaccucuacgccggccgcaagugccuccucaucgucauggagugccucgacggcggcgagcucuucucccgcauccaggaccgcggcgaccaggccuucaccgagcgcgaggccuccgagaucaugaaguccaucggcgaggccauccaguaccuccacuccaucaacaucgcccaccgcgacgucaagcccgagaaccuccucuacaccuccaagcgccccaacgccauccucaagcucaccgacuucggcuucgccaaggagaccaccucccacaacucccucaccacccccugcuacacccccuacuacgucgcccccgagguccucggccccgagaaguacgacaaguccugcgacauguggucccucggcgucaucauguacauccuccucugcggcuacccccccuucuacuccaaccacggccucgccaucucccccggcaugaagacccgcauccgcaugggccaguacgaguuccccaaccccgagugguccgaggucuccgaggaggucaagaugcucauccgcaaccuccucaagaccgagcccacccagcgcaugaccaucaccgaguucaugaaccaccccuggaucaugcaguccaccaaggucccccagaccccccuccacaccucccgcguccucaaggaggacaaggagcgcugggaggacgucaagggcugccuccacgacaagaacuccgaccaggccaccuggcucacccgccucuga

SEQ ID NO: 45754 - RNA, 1149 nt, Artificial Sequence
  derived and/or modified sequence opt2 from MAPKAPK3__Homo_sapiens__NP_001230855
auggacggcgagaccgccgaggagcagggcggccccguccccccccccgucgcccccggcggccccggccucggcggcgcccccggcggccgccgcgagcccaagaaguacgccgucaccgacgacuaccagcucuccaagcagguccucggccucggcgucaacggcaagguccucgagugcuuccaccgccgcaccggccagaagugcgcccucaagcuccucuacgacucccccaaggcccgccaggaggucgaccaccacuggcaggccuccggcggcccccacaucgucugcauccucgacgucuacgagaacaugcaccacggcaagcgcugccuccucaucaucauggagugcauggagggcggcgagcucuucucccgcauccaggagcgcggcgaccaggccuucaccgagcgcgaggccgccgagaucaugcgcgacaucggcaccgccauccaguuccuccacucccacaacaucgcccaccgcgacgucaagcccgagaaccuccucuacaccuccaaggagaaggacgccguccucaagcucaccgacuucggcuucgccaaggagaccacccagaacgcccuccagacccccugcuacacccccuacuacgucgcccccgagguccucggccccgagaaguacgacaaguccugcgacauguggucccucggcgucaucauguacauccuccucugcggcuucccccccuucuacuccaacaccggccaggccaucucccccggcaugaagcgccgcauccgccucggccaguacggcuuccccaaccccgagugguccgaggucuccgaggacgccaagcagcucauccgccuccuccucaagaccgaccccaccgagcgccucaccaucacccaguucaugaaccaccccuggaucaaccaguccauggucgucccccagaccccccuccacaccgcccgcguccuccaggaggacaaggaccacugggacgaggucaaggaggagaugaccuccgcccucgccaccaugcgcgucgacuacgaccaggucaagaucaaggaccucaagaccuccaacaaccgccuccucaacaagcgccgcaagaagcaggccggcuccuccuccgccucccagggcugcaacaaccaguga

SEQ ID NO: 45755 - RNA, 4545 nt, Artificial Sequence
  derived and/or modified sequence opt2 from MAPKBP1__Homo_sapiens__NP_001122080
auggccgucgagggcuccaccaucaccucccgcaucaagaaccuccuccgcucccccuccaucaagcuccgccgcuccaaggccggcaaccgccgcgaggaccucuccuccaaggucacccucgagaagguccucggcaucaccgucuccggcggccgcggccucgccugcgacccccgcuccggccucgucgccuaccccgccggcugcgucgucguccucuucaacccccgcaagcacaagcagcaccacauccucaacuccucccgcaagaccaucaccgcccucgccuucucccccgacggcaaguaccucgucaccggcgaguccggccacaugcccgccguccgcgucugggacgucgccgagcacucccaggucgccgagcuccaggagcacaaguacggcgucgccugcgucgccuucucccccuccgccaaguacaucgucuccgucggcuaccagcacgacaugaucgucaacgucugggccuggaagaagaacaucgucgucgccuccaacaaggucuccucccgcgucaccgccgucuccuucuccgaggacugcuccuacuucgucaccgccggcaaccgccacaucaaguucugguaccucgacgacuccaagaccuccaaggucaacgccaccgucccccuccucggccgcuccggccuccucggcgagcuccgcaacaaccucuucaccgacgucgccugcggccgcggcaagaaggccgacuccaccuucugcaucaccuccuccggccuccucugcgaguucuccgaccgccgccuccucgacaagugggucgagcuccgcaacaucgacuccuucaccaccaccgucgcccacugcaucuccgucucccaggacuacaucuucugcggcugcgccgacggcaccguccgccucuucaaccccuccaaccuccacuuccucuccacccucccccgcccccacgcccucggcaccgacaucgccuccgucaccgaggccucccgccucuucuccggcgucgccaacgcccgcuaccccgacaccaucgcccucaccuucgaccccaccaaccaguggcucuccugcgucuacaacgaccacuccaucuacgucugggacguccgcgaccccaagaaggucggcaaggucuacuccgcccucuaccacuccuccugcgucugguccgucgaggucuaccccgaggucaaggacuccaaccaggccugccucccccccuccuccuucaucaccugcuccuccgacaacaccauccgccucuggaacaccgaguccuccggcguccacggcuccacccuccaccgcaacauccucuccuccgaccucaucaagaucaucuacgucgacggcaacacccaggcccuccucgacaccgagcuccccggcggcgacaaggccgacgccucccuccucgacccccgcgucggcauccgcuccgucugcgucucccccaacggccagcaccucgccuccggcgaccgcaugggcacccuccgcguccacgagcuccagucccucuccgagaugcucaaggucgaggcccacgacuccgagauccucugccucgaguacuccaagcccgacaccggccucaagcuccucgccuccgccucccgcgaccgccucauccacguccucgacgccggccgcgaguacucccuccagcagacccucgacgagcacuccuccuccaucaccgccgucaaguucgccgccuccgacggccagguccgcaugaucuccugcggcgccgacaaguccaucuacuuccgcaccgcccagaaguccggcgacggcguccaguucacccgcacccaccacgucguccgcaagaccacccucuacgacauggacgucgagcccuccuggaaguacaccgccaucggcugccaggaccgcaacauccgcaucuucaacaucuccuccggcaagcagaagaagcucuucaagggcucccagggcgaggacggcacccucaucaagguccagaccgaccccuccggcaucuacaucgccaccuccugcuccgacaagaaccucuccaucuucgacuucuccuccggcgagugcgucgccaccauguucggccacuccgagaucgucaccggcaugaaguucuccaacgacugcaagcaccucaucuccgucuccggcgacuccugcaucuucgucuggcgccucuccuccgagaugaccaucuccaugcgccagcgccucgccgagcuccgccagcgccagcgcggcggcaagcagcagggccccuccuccccccagcgcgccuccggccccaaccgccaccaggcccccuccaugcucucccccggccccgcccucuccuccgacuccgacaaggagggcgaggacgagggcaccgaggaggagcuccccgcccuccccguccucgccaaguccaccaagaaggcccucgccuccguccccucccccgcccucccccgcucccucucccacugggagaugucccgcgcccaggaguccgucggcuuccucgaccccgcccccgccgccaaccccggcccccgccgccgcggccgcuggguccagcccggcgucgagcucuccguccgcuccaugcucgaccuccgccagcucgagacccucgcccccucccuccaggaccccucccaggacucccucgccaucauccccuccggcccccgcaagcacggccaggaggcccucgagaccucccucaccucccagaacgagaagcccccccgcccccaggccucccagcccugcuccuacccccacaucauccgccuccucucccaggaggagggcgucuucgcccaggaccucgagcccgcccccaucgaggacggcaucgucuaccccgagcccuccgacaaccccaccauggacaccuccgaguuccagguccaggcccccgcccgcggcacccucggccgcgucuaccccggcucccgcuccuccgagaagcacucccccgacuccgccugcuccgucgacuacuccuccuccugccucuccucccccgagcaccccaccgaggacuccgaguccaccgagccccucuccgucgacggcaucuccuccgaccucgaggagcccgccgagggcgacgaggaggaggaggaggaggagggcggcaugggccccuacggccuccaggagggcuccccccagacccccgaccaggagcaguuccucaagcagcacuucgagacccucgccuccggcgccgcccccggcgcccccguccagguccccgagcgcuccgagucccgcuccaucuccucccgcuuccuccuccagguccagacccgcccccuccgcgagcccucccccuccuccuccucccucgcccucaugucccgccccgcccaggucccccaggccuccggcgagcagccccgcggcaacggcgccaacccccccggcgccccccccgaggucgagcccuccuccggcaaccccuccccccagcaggccgccuccguccuccucccccgcugccgccucaaccccgacuccuccugggcccccaagcgcgucgccaccgccucccccuucuccggccuccagaaggcccaguccguccacucccucgucccccaggagcgccacgaggccucccuccaggcccccucccccggcgcccuccucucccgcgagaucgaggcccaggacggccucggcucccucccccccgccgacggccgccccucccgcccccacuccuaccagaaccccaccaccuccuccauggccaagaucucccgcuccaucuccgucggcgagaaccucggccucgucgccgagccccaggcccacgcccccauccgcgucuccccccucuccaagcucgcccuccccucccgcgcccaccucguccucgacauccccaagccccuccccgaccgccccacccucgccgccuucucccccgucaccaagggccgcgcccccggcgaggccgagaagcccggcuuccccgucggccucggcaaggcccacuccaccaccgagcgcugggccugccucggcgagggcaccacccccaagccccgcaccgagugccaggcccaccccggccccuccucccccugcgcccagcagcuccccgucuccucccucuuccagggccccgagaaccuccagccccccccccccgagaagacccccaaccccauggagugcaccaagcccggcgccgcccucucccaggacuccgagcccgccgucucccucgagcagugcgagcagcucgucgccgagcuccgcggcuccguccgccaggccguccgccucuaccacuccgucgccggcugcaagaugcccuccgccgagcagucccgcaucgcccagcuccuccgcgacaccuucuccuccguccgccaggagcucgaggccgucgccggcgccguccucuccucccccggcuccucccccggcgccgucggcgccgagcagacccaggcccuccucgagcaguacuccgagcuccuccuccgcgccgucgagcgccgcauggagcgcaagcucuga

SEQ ID NO: 45756 - RNA, 807 nt, Artificial Sequence
  derived and/or modified sequence opt2 from MAPRE1__Homo_sapiens__NP_036457
auggccgucaacgucuacuccaccuccgucaccuccgacaaccucucccgccacgacaugcucgccuggaucaacgagucccuccagcucaaccucaccaagaucgagcagcucugcuccggcgccgccuacugccaguucauggacaugcucuuccccggcuccaucgcccucaagaaggucaaguuccaggccaagcucgagcacgaguacauccagaacuucaagauccuccaggccggcuucaagcgcaugggcgucgacaagaucauccccgucgacaagcucgucaagggcaaguuccaggacaacuucgaguucguccagugguucaagaaguucuucgacgccaacuacgacggcaaggacuacgaccccgucgccgcccgccagggccaggagaccgccgucgcccccucccucgucgcccccgcccucaacaagcccaagaagccccucaccuccuccuccgccgccccccagcgccccaucuccacccagcgcaccgccgccgcccccaaggccggccccggcgucguccgcaagaaccccggcgucggcaacggcgacgacgaggccgccgagcucaugcagcaggucaacguccucaagcucaccgucgaggaccucgagaaggagcgcgacuucuacuucggcaagcuccgcaacaucgagcucaucugccaggagaacgagggcgagaacgaccccguccuccagcgcaucgucgacauccucuacgccaccgacgagggcuucgucauccccgacgagggcggcccccaggaggagcaggaggaguacuga

SEQ ID NO: 45757 - RNA, 855 nt, Artificial Sequence
  derived and/or modified sequence opt2 from MAPRE2__Homo_sapiens__NP_001137298
auggccgucaacgucuacuccaccuccaucacccaggagaccaugucccgccacgacaucaucgccugggucaacgacaucgucucccucaacuacaccaaggucgagcagcucugcuccggcgccgccuacugccaguucauggacaugcucuuccccggcugcaucucccucaagaaggucaaguuccaggccaagcucgagcacgaguacauccacaacuucaagcuccuccaggccuccuucaagcgcaugaacgucgacaaggucauccccgucgagaagcucgucaagggccgcuuccaggacaaccucgacuucauccagugguucaagaaguucuacgacgccaacuacgacggcaaggaguacgaccccgucgaggcccgccagggccaggacgccauccccccccccgaccccggcgagcagaucuucaaccuccccaagaagucccaccacgccaacucccccaccgccggcgccgccaaguccucccccgccgccaagcccggcuccacccccucccgccccuccuccgccaagcgcgccuccuccuccggcuccgccuccaaguccgacaaggaccucgagacccaggucauccagcucaacgagcagguccacucccucaagcucgcccucgagggcgucgagaaggagcgcgacuucuacuucggcaagcuccgcgagaucgagcuccucugccaggagcacggccaggagaacgacgaccucguccagcgccucauggacauccucuacgccuccgaggagcacgagggccacaccgaggagcccgaggccgaggagcaggcccacgagcagcagcccccccagcaggaggaguacuga

SEQ ID NO: 45758 - RNA, 846 nt, Artificial Sequence
  derived and/or modified sequence opt2 from MAPRE3__Homo_sapiens__NP_001289979
auggccgucaacgucuacuccaccuccgucaccuccgagaaccucucccgccacgacaugcucgccugggucaacgacucccuccaccucaacuacaccaagaucgagcagcucugcuccggcgccgccuacugccaguucauggacaugcucuuccccggcugcguccaccuccgcaaggucaaguuccaggccaagcucgagcacgaguacauccacaacuucaagguccuccaggccgccuucaagaagaugggcgucgacaagaucauccccgucgagaagcucgucaagggcaaguuccaggacaacuucgaguucauccagugguucaagaaguucuucgacgccaacuacgacggcaaggacuacaacccccuccucgcccgccagggccaggacgucgcccccccccccaaccccggcgaccagaucuucaacaaguccaagaagcucaucggcaccgccgucccccagcgcaccucccccaccggccccaagaacaugcagaccuccggccgccucuccaacgucgccccccccugcauccuccgcaagaacccccccuccgcccgcaacggcggccacgagaccgacgcccagauccucgagcucaaccagcagcucgucgaccucaagcucaccgucgacggccucgagaaggagcgcgacuucuacuucuccaagcuccgcgacaucgagcucaucugccaggagcacgaguccgagaacucccccgucaucuccggcaucaucggcauccucuacgccaccgaggagggcuucgccccccccgaggacgacgagaucgaggagcaccagcaggaggaccaggacgaguacuga

SEQ ID NO: 45759 - RNA, 2331 nt, Artificial Sequence
  derived and/or modified sequence opt2 from MAPT__Homo_sapiens__NP_001116538
auggccgagccccgccaggaguucgaggucauggaggaccacgccggcaccuacggccucggcgaccgcaaggaccagggcggcuacaccaugcaccaggaccaggagggcgacaccgacgccggccucaaggaguccccccuccagacccccaccgaggacggcuccgaggagcccggcuccgagaccuccgacgccaaguccacccccaccgccgaggacgucaccgccccccucgucgacgagggcgcccccggcaagcaggccgccgcccagccccacaccgagauccccgagggcaccaccgccgaggaggccggcaucggcgacacccccucccucgaggacgaggccgccggccacgucacccaggagcccgaguccggcaaggucguccaggagggcuuccuccgcgagcccggcccccccggccucucccaccagcucauguccggcaugcccggcgccccccuccuccccgagggcccccgcgaggccacccgccagcccuccggcaccggccccgaggacaccgagggcggccgccacgcccccgagcuccucaagcaccagcuccucggcgaccuccaccaggagggccccccccucaagggcgccggcggcaaggagcgccccggcuccaaggaggaggucgacgaggaccgcgacgucgacgaguccuccccccaggacuccccccccuccaaggccucccccgcccaggacggccgccccccccagaccgccgcccgcgaggccaccuccauccccggcuuccccgccgagggcgccaucccccuccccgucgacuuccucuccaaggucuccaccgagauccccgccuccgagcccgacggccccuccgucggccgcgccaagggccaggacgccccccucgaguucaccuuccacgucgagaucacccccaacguccagaaggagcaggcccacuccgaggagcaccucggccgcgccgccuuccccggcgcccccggcgagggccccgaggcccgcggccccucccucggcgaggacaccaaggaggccgaccuccccgagcccuccgagaagcagcccgccgccgccccccgcggcaagcccgucucccgcgucccccagcucaaggcccgcauggucuccaaguccaaggacggcaccggcuccgacgacaagaaggccaagaccuccacccgcuccuccgccaagacccucaagaaccgccccugccucucccccaagcaccccacccccggcuccuccgacccccucauccagcccuccucccccgccgucugccccgagccccccuccucccccaaguacgucuccuccgucaccucccgcaccggcuccuccggcgccaaggagaugaagcucaagggcgccgacggcaagaccaagaucgccaccccccgcggcgccgccccccccggccagaagggccaggccaacgccacccgcauccccgccaagaccccccccgcccccaagaccccccccuccuccgccaccaagcagguccagcgccgccccccccccgccggcccccgcuccgagcgcggcgagccccccaaguccggcgaccgcuccggcuacuccucccccggcucccccggcacccccggcucccgcucccgcacccccucccuccccaccccccccacccgcgagcccaagaaggucgccgucguccgcaccccccccaagucccccuccuccgccaagucccgccuccagaccgcccccguccccaugcccgaccucaagaacgucaaguccaagaucggcuccaccgagaaccucaagcaccagcccggcggcggcaagguccagaucaucaacaagaagcucgaccucuccaacguccaguccaagugcggcuccaaggacaacaucaagcacguccccggcggcggcuccguccagaucgucuacaagcccgucgaccucuccaaggucaccuccaagugcggcucccucggcaacauccaccacaagcccggcggcggccaggucgaggucaaguccgagaagcucgacuucaaggaccgcguccaguccaagaucggcucccucgacaacaucacccacguccccggcggcggcaacaagaagaucgagacccacaagcucaccuuccgcgagaacgccaaggccaagaccgaccacggcgccgagaucgucuacaagucccccgucgucuccggcgacaccuccccccgccaccucuccaacgucuccuccaccggcuccaucgacauggucgacuccccccagcucgccacccucgccgacgaggucuccgccucccucgccaagcagggccucuga

SEQ ID NO: 45760 - RNA, 1014 nt, Artificial Sequence
  derived and/or modified sequence opt2 from MARC1__Homo_sapiens__NP_073583
augggcgccgccggcuccuccgcccucgcccgcuucguccuccucgcccagucccgccccggcuggcucggcgucgccgcccucggccucaccgccgucgcccucggcgccgucgccuggcgccgcgccuggcccacccgccgccgccgccuccuccagcaggucggcaccgucgcccagcucuggaucuaccccgucaaguccugcaagggcguccccgucuccgaggccgagugcaccgccaugggccuccgcuccggcaaccuccgcgaccgcuucuggcucgucaucaaccaggagggcaacauggucaccgcccgccaggagccccgccucguccucaucucccucaccugcgacggcgacacccucacccucuccgccgccuacaccaaggaccuccuccuccccaucaagacccccaccaccaacgccguccacaagugccgcguccacggccucgagaucgagggccgcgacugcggcgaggccaccgcccaguggaucaccuccuuccucaagucccagcccuaccgccucguccacuucgagccccacaugcgcccccgccgcccccaccagaucgccgaccucuuccgccccaaggaccagaucgccuacuccgacaccucccccuuccucauccucuccgaggccucccucgccgaccucaacucccgccucgagaagaaggucaaggccaccaacuuccgccccaacaucgucaucuccggcugcgacgucuacgccgaggacuccugggacgagcuccucaucggcgacgucgagcucaagcgcgucauggccugcucccgcugcauccucaccaccgucgaccccgacaccggcgucaugucccgcaaggagccccucgagacccucaaguccuaccgccagugcgaccccuccgagcgcaagcucuacggcaaguccccccucuucggccaguacuucguccucgagaaccccggcaccaucaaggucggcgaccccgucuaccuccucggccaguga

SEQ ID NO: 45761 - RNA, 738 nt, Artificial Sequence
  derived and/or modified sequence opt2 from MARC2__Homo_sapiens__XP_011507986
auguucuggcucgucaucaaggaggacggccacauggucaccgcccgccaggagccccgccucguccucaucuccaucaucuacgagaacaacugccucaucuuccgcgcccccgacauggaccagcucguccuccccuccaagcagcccuccuccaacaagcuccacaacugccgcaucuucggccucgacaucaagggccgcgacugcggcaacgaggccgccaagugguucaccaacuuccucaagaccgaggccuaccgccucguccaguucgagaccaacaugaagggccgcaccucccgcaagcuccuccccacccucgaccagaacuuccaggucgccuaccccgacuacugcccccuccucaucaugaccgacgccucccucgucgaccucaacacccgcauggagaagaagaugaagauggagaacuuccgccccaacaucgucgucaccggcugcgacgccuucgaggaggacaccugggacgagcuccucaucggcuccgucgaggucaagaaggucauggccugcccccgcugcauccucaccaccgucgaccccgacaccggcgucaucgaccgcaagcagccccucgacacccucaaguccuaccgccucugcgaccccuccgagcgcgagcucuacaagcucuccccccucuucggcaucuacuacuccgucgagaagaucggcucccuccgcgucggcgaccccgucuaccgcauggucuga

SEQ ID NO: 45762 - RNA, 870 nt, Artificial Sequence
  derived and/or modified sequence opt2 from MARCH1__Homo_sapiens__NP_001159845
augcucggcuggugcgaggccaucgcccgcaacccccaccgcauccccaacaacacccgcacccccgagaucuccggcgaccucgccgacgccucccagaccuccacccucaacgagaagucccccggccgcuccgccucccgcuccuccaacaucuccaaggccuccucccccaccaccggcaccgccccccgcucccagucccgccucuccgucugccccuccacccaggacaucugccgcaucugccacugcgagggcgacgaggaguccccccucaucacccccugccgcugcaccggcacccuccgcuucguccaccaguccugccuccaccaguggaucaaguccuccgacacccgcugcugcgagcucugcaaguacgacuucaucauggagaccaagcucaagccccuccgcaagugggagaagcuccagaugaccaccuccgagcgccgcaagaucuucugcuccgucaccuuccacgucaucgccaucaccugcgucgucuggucccucuacguccucaucgaccgcaccgccgaggagaucaagcagggcaacgacaacggcguccucgaguggcccuucuggaccaagcucgucgucgucgccaucggcuucaccggcggccucgucuucauguacguccagugcaaggucuacguccagcucuggcgccgccucaaggccuacaaccgcgucaucuucguccagaacugccccgacaccgccaagaagcucgagaagaacuucuccugcaacgucaacaccgacaucaaggacgccgucgucguccccgucccccagaccggcgccaacucccuccccuccgccgagggcggcccccccgaggucgucuccgucuga

SEQ ID NO: 45763 - RNA, 741 nt, Artificial Sequence
  derived and/or modified sequence opt2 from MARCH2__Homo_sapiens__NP_001005415
augaccaccggcgacugcugccaccuccccggcucccucugcgacugcuccggcucccccgccuucuccaaggucgucgaggccaccggccucggccccccccaguacgucgcccaggucaccucccgcgacggccgccuccucuccaccgucauccgcgcccucgacacccccuccgacggccccuucugccgcaucugccacgagggcgccaacggcgagugccuccucucccccugcggcugcaccggcacccucggcgccguccacaaguccugccucgagaaguggcucuccuccuccaacaccuccuacugcgagcucugccacaccgaguucgccgucgagaagcgcccccgcccccucaccgaguggcucaaggaccccggcccccgcaccgagaagcgcacccucugcugcgacauggucugcuuccucuucaucaccccccucgccgccaucuccggcuggcucugccuccgcggcgcccaggaccaccuccgccuccacucccagcucgaggccgucggccucaucgcccucaccaucgcccucuucaccaucuacguccucuggacccucgucuccuuccgcuaccacugccagcucuacuccgaguggcgcaagaccaaccagaagguccgccucaagauccgcgaggccgacucccccgagggcccccagcacuccccccucgccgccggccuccucaagaaggucgccgaggagacccccgucuga

SEQ ID NO: 45764 - RNA, 837 nt, Artificial Sequence
  derived and/or modified sequence opt2 from MARCH5__Homo_sapiens__NP_060294
augcccgaccaggcccuccagcagaugcucgaccgcuccugcugggucugcuucgccaccgacgaggacgaccgcaccgccgaguggguccgccccugccgcugccgcggcuccaccaaguggguccaccaggccugccuccagcgcugggucgacgagaagcagcgcggcaacuccaccgcccgcgucgccugcccccagugcaacgccgaguaccucaucgucuuccccaagcucggccccgucgucuacguccucgaccucgccgaccgccucaucuccaaggccugccccuucgccgccgccggcaucauggucggcuccaucuacuggaccgccgucaccuacggcgccgucaccgucaugcaggucgucggccacaaggagggccucgacgucauggagcgcgccgacccccucuuccuccucaucggccuccccaccauccccgucaugcucauccucggcaagaugauccgcugggaggacuacguccuccgccucuggcgcaaguacuccaacaagcuccagauccucaacuccaucuuccccggcaucggcugccccgucccccgcauccccgccgaggccaacccccucgccgaccacgucuccgccacccgcauccucugcggcgcccucgucuuccccaccaucgccaccaucgucggcaagcucauguucuccuccgucaacuccaaccuccagcgcaccauccucggcggcaucgccuucgucgccaucaagggcgccuucaaggucuacuucaagcagcagcaguaccuccgccaggcccaccgcaagauccucaacuaccccgagcaggaggaggccuga

SEQ ID NO: 45765 - RNA, 2733 nt, Artificial Sequence
  derived and/or modified sequence opt2 from MARCH6__Homo_sapiens__NP_005876
auggacaccgccgaggaggacaucugccgcgucugccgcuccgagggcacccccgagaagccccucuaccaccccugcgucugcaccggcuccaucaaguucauccaccaggagugccucguccaguggcucaagcacucccgcaaggaguacugcgagcucugcaagcaccgcuucgccuucacccccaucuacucccccgacaugcccucccgccuccccauccaggacaucuucgccggccucgucaccuccaucggcaccgccauccgcuacugguuccacuacacccucgucgccuucgccuggcucggcgucgucccccucaccgccugccgcaucuacaagugccucuucaccggcuccgucuccucccuccucacccucccccucgacaugcucuccaccgagaaccuccucgccgacugccuccagggcugcuucgucgucaccugcacccucugcgccuucaucucccucgucuggcuccgcgagcagaucguccacggcggcgcccccaucuggcucgagcacgccgccccccccuucaacgccgccggccaccaccagaacgaggcccccgccggcggcaacggcgccgagaacgucgccgccgaccagcccgccaacccccccgccgagaacgccgucgucggcgagaaccccgacgcccaggacgaccaggccgaggaggaggaggaggacaacgaggaggaggacgacgccggcgucgaggacgccgccgacgccaacaacggcgcccaggacgacaugaacuggaacgcccucgagugggaccgcgccgccgaggagcucaccugggagcgcaugcucggccucgacggcucccucgucuuccucgagcacgucuucugggucgucucccucaacacccucuucauccucgucuucgccuucugccccuaccacaucggccacuucucccucgucggccucggcuucgaggagcacguccaggccucccacuucgagggccucaucaccaccaucgucggcuacauccuccucgccaucacccucaucaucugccacggccucgccacccucgucaaguuccaccgcucccgccgccuccucggcgucugcuacaucgucgucaaggucucccuccucgucgucgucgagaucggcgucuucccccucaucugcggcugguggcucgacaucugcucccucgagauguucgacgccacccucaaggaccgcgagcucuccuuccaguccgcccccggcaccaccauguuccuccacuggcucgucggcauggucuacgucuucuacuucgccuccuucauccuccuccuccgcgagguccuccgccccggcguccucugguuccuccgcaaccucaacgaccccgacuucaaccccguccaggagaugauccaccuccccaucuaccgccaccuccgccgcuucauccucuccgucaucgucuucggcuccaucguccuccucaugcucuggcuccccauccgcaucaucaaguccguccuccccaacuuccuccccuacaacgucaugcucuacuccgacgcccccgucuccgagcucucccucgagcuccuccuccuccaggucguccuccccgcccuccucgagcagggccacacccgccaguggcucaagggccucguccgcgccuggaccgucaccgccggcuaccuccucgaccuccacuccuaccuccucggcgaccaggaggagaacgagaacuccgccaaccagcaggucaacaacaaccagcacgcccgcaacaacaacgccauccccgucgucggcgagggccuccacgccgcccaccaggccauccuccagcagggcggccccgucggcuuccagcccuaccgccgcccccucaacuucccccuccgcaucuuccuccucaucgucuucaugugcaucacccuccucaucgccucccucaucugccucacccuccccgucuucgccggccgcuggcucauguccuucuggaccggcaccgccaagauccacgagcucuacaccgccgccugcggccucuacgucugcuggcucaccauccgcgccgucaccgucauggucgccuggaugccccagggccgccgcgucaucuuccagaaggucaaggaguggucccucaugaucaugaagacccucaucgucgccguccuccucgccggcgucgucccccuccuccucggccuccucuucgagcucgucaucgucgccccccuccgcgucccccucgaccagaccccccucuucuaccccuggcaggacugggcccucggcguccuccacgccaagaucaucgccgccaucacccucaugggcccccagugguggcucaagaccgucaucgagcaggucuacgccaacggcauccgcaacaucgaccuccacuacaucguccgcaagcucgccgcccccgucaucuccguccuccuccucucccucugcguccccuacgucaucgccuccggcgucgucccccuccucggcgucaccgccgagaugcagaaccucguccaccgccgcaucuaccccuuccuccucauggucgucguccucauggccauccucuccuuccagguccgccaguucaagcgccucuacgagcacaucaagaacgacaaguaccucgucggccagcgccucgucaacuacgagcgcaaguccggcaagcagggcuccucccccccccccccccaguccucccaggaguga

SEQ ID NO: 45766 - RNA, 1908 nt, Artificial Sequence
  derived and/or modified sequence opt2 from MARCH7__Homo_sapiens__NP_001269735
auggaguccaagcccucccgcaucccccgccgcaucuccguccagcccuccuccucccucuccgcccgcaugauguccggcucccgcggcuccucccucaacgacaccuaccacucccgcgacuccuccuuccgccucgacuccgaguaccaguccaccuccgccuccgccuccgccucccccuuccaguccgccugguacuccgaguccgagaucacccagggcgcccgcucccgcucccagaaccagcagcgcgaccacgacuccaagcgccccaagcucuccugcaccaacugcaccaccuccgccggccgcaacgucggcaacggccucaacacccucuccgacguccaggaccgcguccccuccuacucccagggcgcccgccccaaggagaacuccauguccacccuccagcucaacaccuccuccaccaaccaccagcuccccuccgagcaccagaccauccucuccucccgcgacucccgcaacucccuccgcuccaacuucuccucccgcgaguccgaguccucccgcuccaacacccagcccggcuucuccuacuccuccucccgcgacgaggcccccaucaucuccaacuccgagcgcgucgucuccucccagcgccccuuccaggaguccuccgacaacgagggccgccgcaccacccgccgccuccucucccgcaucgccuccuccauguccuccaccuucuucucccgccgcuccucccaggacucccucaacacccgcucccucaacuccgagaacuccuacgucuccccccgcauccucaccgccucccagucccgcuccaacguccccuccgccuccgagguccccgacaaccgcgccuccgaggccucccagggcuuccgcuuccuccgccgccgcuggggccucuccucccucucccacaaccacuccuccgaguccgacuccgagaacuucaaccaggaguccgagggccgcaacaccggccccuggcucuccuccucccuccgcaaccgcugcaccccccucuucucccgccgccgccgcgagggccgcgacgaguccucccgcauccccaccuccgacaccuccucccgcucccacaucuuccgccgcgaguccaacgaggucguccaccucgaggcccagaacgacccccucggcgccgccgccaaccgcccccaggccuccgccgccuccuccuccgccaccaccggcggcuccaccuccgacuccgcccagggcggccgcaacaccggcaucuccggcauccuccccggcucccucuuccgcuucgccgucccccccgcccucggcuccaaccucaccgacaacgucaugaucaccgucgacaucauccccuccggcuggaacuccgccgacggcaaguccgacaagaccaaguccgcccccucccgcgaccccgagcgccuccagaagaucaaggagucccuccuccucgaggacuccgaggaggaggagggcgaccucugccgcaucugccagauggccgccgccuccuccuccaaccuccucaucgagcccugcaagugcaccggcucccuccaguacguccaccaggacugcaugaagaaguggcuccaggccaagaucaacuccggcuccucccucgaggccgucaccaccugcgagcucugcaaggagaagcucgagcucaaccucgaggacuucgacauccacgagcuccaccgcgcccacgccaacgagcaggccgaguacgaguucaucuccuccggccucuaccucgucguccuccuccaccucugcgagcaguccuucuccgacaugaugggcaacaccaacgagcccuccacccgcguccgccuccagcgcaugauccccaagaagaccgagaccaucaccggccaccucauccuccccaacuucaucuga

SEQ ID NO: 45767 - RNA, 876 nt, Artificial Sequence
  derived and/or modified sequence opt2 from MARCH8__Homo_sapiens__NP_001002266
auguccaugccccuccaccagaucuccgccauccccucccaggacgccaucuccgcccgcgucuaccgcuccaagaccaaggagaaggagcgcgaggagcagaacgagaagacccucggccacuucaugucccacuccuccaacaucuccaaggccggcuccccccccuccgccuccgcccccgcccccgucuccuccuucucccgcaccuccaucacccccuccucccaggacaucugccgcaucugccacugcgagggcgacgacgaguccccccucaucacccccugccacugcaccggcucccuccacuucguccaccaggccugccuccagcaguggaucaaguccuccgacacccgcugcugcgagcucugcaaguacgaguucaucauggagaccaagcucaagccccuccgcaagugggagaagcuccagaugaccuccuccgagcgccgcaagaucaugugcuccgucaccuuccacgucaucgccaucaccugcgucgucuggucccucuacguccucaucgaccgcaccgccgaggagaucaagcagggccaggccaccggcauccucgaguggcccuucuggaccaagcucgucgucgucgccaucggcuucaccggcggccuccucuucauguacguccagugcaaggucuacguccagcucuggaagcgccucaaggccuacaaccgcgucaucuacguccagaacugccccgagaccuccaagaagaacaucuucgagaaguccccccucaccgagcccaacuucgagaacaagcacggcuacggcaucugccacuccgacaccaacuccuccugcugcaccgagcccgaggacaccggcgccgagaucauccacgucuga

SEQ ID NO: 45768 - RNA, 999 nt, Artificial Sequence
  derived and/or modified sequence opt2 from MARCKS__Homo_sapiens__NP_002347
augggcgcccaguucuccaagaccgccgccaagggcgaggccgccgccgagcgccccggcgaggccgccgucgccuccucccccuccaaggccaacggccaggagaacggccacgucaaggucaacggcgacgccucccccgccgccgccgaguccggcgccaaggaggagcuccaggccaacggcuccgcccccgccgccgacaaggaggagcccgccgccgccggcuccggcgccgccucccccuccgccgccgagaagggcgagcccgccgccgccgccgcccccgaggccggcgccucccccgucgagaaggaggcccccgccgagggcgaggccgccgagcccggcucccccaccgccgccgagggcgaggccgccuccgccgccuccuccaccuccucccccaaggccgaggacggcgccacccccucccccuccaacgagacccccaagaagaagaagaagcgcuucuccuucaagaaguccuucaagcucuccggcuucuccuucaagaagaacaagaaggaggccggcgagggcggcgaggccgaggcccccgccgccgagggcggcaaggacgaggccgccggcggcgccgccgccgccgccgccgaggccggcgccgccuccggcgagcaggccgccgcccccggcgaggaggccgccgccggcgaggagggcgccgccggcggcgacccccaggaggccaagccccaggaggccgccgucgcccccgagaagccccccgccuccgacgagaccaaggccgccgaggagcccuccaaggucgaggagaagaaggccgaggaggccggcgccuccgccgccgccugcgaggcccccuccgccgccggccccggcgccccccccgagcaggaggccgcccccgccgaggagcccgccgccgccgccgccuccuccgccugcgccgcccccucccaggaggcccagcccgagugcucccccgaggccccccccgccgaggccgccgaguga

SEQ ID NO: 45769 - RNA, 1563 nt, Artificial Sequence
  derived and/or modified sequence opt2 from MARCO__Homo_sapiens__NP_006761
augcgcaacaagaagauccucaaggaggacgagcuccucuccgagacccagcaggccgccuuccaccagaucgccauggagcccuucgagaucaacguccccaagcccaagcgccgcaacggcgucaacuucucccucgccgucgucgucaucuaccucauccuccucaccgccggcgccggccuccucgucguccagguccucaaccuccaggcccgccuccgcguccucgagauguacuuccucaacgacacccucgccgccgaggacucccccuccuucucccuccuccaguccgcccaccccggcgagcaccucgcccagggcgccucccgccuccagguccuccaggcccagcucaccuggguccgcgucucccacgagcaccuccuccagcgcgucgacaacuucacccagaaccccggcauguuccgcaucaagggcgagcagggcgcccccggccuccagggccacaagggcgccaugggcaugcccggcgcccccggcccccccggcccccccgccgagaagggcgccaagggcgccaugggccgcgacggcgccaccggccccuccggcccccagggcccccccggcgucaagggcgaggccggccuccagggcccccagggcgcccccggcaagcagggcgccaccggcacccccggcccccagggcgagaagggcuccaagggcgacggcggccucaucggccccaagggcgagaccggcaccaagggcgagaagggcgaccucggccuccccggcuccaagggcgaccgcggcaugaagggcgacgccggcgucaugggcccccccggcgcccagggcuccaagggcgacuucggccgccccggcccccccggccucgccggcuuccccggcgccaagggcgaccagggccagcccggccuccagggcguccccggcccccccggcgccgucggccaccccggcgccaagggcgagcccggcuccgccggcucccccggccgcgccggccuccccggcucccccggcucccccggcgccaccggccucaagggcuccaagggcgacaccggccuccagggccagcagggccgcaagggcgaguccggcguccccggccccgccggcgucaagggcgagcagggcucccccggccucgccggccccaagggcgcccccggccaggccggccagaagggcgaccagggcgucaagggcuccuccggcgagcagggcgucaagggcgagaagggcgagcgcggcgagaacuccgucuccguccgcaucgucggcuccuccaaccgcggccgcgccgaggucuacuacuccggcaccuggggcaccaucugcgacgacgaguggcagaacuccgacgccaucgucuucugccgcaugcucggcuacuccaagggccgcgcccucuacaaggucggcgccggcaccggccagaucuggcucgacaacguccagugccgcggcaccgaguccacccucugguccugcaccaagaacuccuggggccaccacgacugcucccacgaggaggacgccggcgucgagugcuccgucuga

SEQ ID NO: 45770 - RNA, 2343 nt, Artificial Sequence
  derived and/or modified sequence opt2 from MARK1__Homo_sapiens__NP_001273055
auguccgcccgcaccccccuccccaccgucaacgagcgcgacaccgagaaccacaccuccgucgacggcuacaccgagccccacauccagcccaccaaguccuccucccgccagaacaucccccgcugccgcaacuccaucaccuccgccaccgacgagcagccccacaucggcaacuaccgccuccagaagaccaucggcaagggcaacuucgccaaggucaagcucgcccgccacguccucaccggccgcgaggucgccgucaagaucaucgacaagacccagcucaaccccaccucccuccagaagcucuuccgcgagguccgcaucaugaagauccucaaccaccccaacaucgucaagcucuucgaggucaucgagaccgagaagacccucuaccucgucauggaguacgccuccggcggcgaggucuucgacuaccucgucgcccacggccgcaugaaggagaaggaggcccgcgccaaguuccgccagaucgucuccgccguccaguacugccaccagaaguacaucguccaccgcgaccucaaggccgagaaccuccuccucgacggcgacaugaacaucaagaucgccgacuucggcuucuccaacgaguucaccgucggcaacaagcucgacaccuucugcggcuccccccccuacgccgcccccgagcucuuccagggcaagaaguacgacggccccgaggucgacgucuggucccucggcgucauccucuacacccucgucuccggcucccuccccuucgacggccagaaccucaaggagcuccgcgagcgcguccuccgcggcaaguaccgcauccccuucuacauguccaccgacugcgagaaccuccucaagaagcuccucguccucaaccccaucaagcgcggcucccucgagcagaucaugaaggaccgcuggaugaacgucggccacgaggaggaggagcucaagcccuacaccgagcccgaccccgacuucaacgacaccaagcgcaucgacaucauggucaccaugggcuucgcccgcgacgagaucaacgacgcccucaucaaccagaaguacgacgaggucauggccaccuacauccuccucggccgcaagccccccgaguucgagggcggcgagucccucuccuccggcaaccucugccagcgcucccgccccuccuccgaccucaacaacuccacccuccagucccccgcccaccucaagguccagcgcuccaucuccgccaaccagaagcagcgccgcuucuccgaccacgccggccccuccaucccccccgccgucuccuacaccaagcgcccccaggccaacuccgucgaguccgagcagaaggaggagugggacaaggacgucgcccgcaagcucggcuccaccaccgucggcuccaaguccgagaugaccgccuccccccucgucggccccgagcgcaagaaguccuccaccauccccuccaacaacgucuacuccggcggcuccauggcccgccgcaacaccuacgucugcgagcgcaccaccgaccgcuacgucgcccuccagaacggcaaggacuccucccucaccgagauguccgucuccuccaucuccuccgccggcuccuccgucgccuccgccguccccuccgcccgcccccgccaccagaaguccauguccaccuccggccaccccaucaaggucacccuccccaccaucaaggacggcuccgaggccuaccgccccggcaccacccagcgcguccccgccgccucccccuccgcccacuccaucuccaccgccacccccgaccgcacccgcuucccccgcggcuccuccucccgcuccaccuuccacggcgagcagcuccgcgagcgccgcuccgucgccuacaacggcccccccgccucccccucccacgagaccggcgccuucgcccacgcccgccgcggcaccuccaccggcaucaucuccaagaucaccuccaaguucguccgccgcuccaccuccggcgagcccaaggagcgcgacaaggaggagggcaaggacuccaagccccgcucccuccgcuucaccugguccaugaagaccaccuccuccauggaccccaacgacaugaugcgcgagauccgcaagguccucgacgccaacaacugcgacuacgagcagaaggagcgcuuccuccucuucugcguccacggcgacgcccgccaggacucccucguccagugggagauggaggucugcaagcucccccgccucucccucaacggcguccgcuucaagcgcaucuccggcaccuccaucgccuucaagaacaucgccuccaagaucgccaacgagcucaagcucuga

SEQ ID NO: 45771 - RNA, 2367 nt, Artificial Sequence
  derived and/or modified sequence opt2 from MARK2__Homo_sapiens__NP_001034558
auguccuccgcccgcaccccccuccccacccucaacgagcgcgacaccgagcagcccacccucggccaccucgacuccaagcccuccuccaaguccaacaugauccgcggccgcaacuccgccaccuccgccgacgagcagccccacaucggcaacuaccgccuccucaagaccaucggcaagggcaacuucgccaaggucaagcucgcccgccacauccucaccggcaaggaggucgccgucaagaucaucgacaagacccagcucaacuccuccucccuccagaagcucuuccgcgagguccgcaucaugaagguccucaaccaccccaacaucgucaagcucuucgaggucaucgagaccgagaagacccucuaccucgucauggaguacgccuccggcggcgaggucuucgacuaccucgucgcccacggccgcaugaaggagaaggaggcccgcgccaaguuccgccagaucgucuccgccguccaguacugccaccagaaguucaucguccaccgcgaccucaaggccgagaaccuccuccucgacgccgacaugaacaucaagaucgccgacuucggcuucuccaacgaguucaccuucggcaacaagcucgacaccuucugcggcuccccccccuacgccgcccccgagcucuuccagggcaagaaguacgacggccccgaggucgacgucuggucccucggcgucauccucuacacccucgucuccggcucccuccccuucgacggccagaaccucaaggagcuccgcgagcgcguccuccgcggcaaguaccgcauccccuucuacauguccaccgacugcgagaaccuccucaagaaguuccucauccucaaccccuccaagcgcggcacccucgagcagaucaugaaggaccgcuggaugaacgucggccacgaggacgacgagcucaagcccuacgucgagccccuccccgacuacaaggacccccgccgcaccgagcucauggucuccaugggcuacacccgcgaggagauccaggacucccucgucggccagcgcuacaacgaggucauggccaccuaccuccuccucggcuacaaguccuccgagcucgagggcgacaccaucacccucaagccccgccccuccgccgaccucaccaacuccuccgcccccucccccucccacaagguccagcgcuccgucuccgccaaccccaagcagcgccgcuucuccgaccaggccgccggccccgccauccccaccuccaacuccuacuccaagaagacccaguccaacaacgccgagaacaagcgccccgaggaggaccgcgaguccggccgcaaggccuccuccaccgccaagguccccgccuccccccuccccggccucgagcgcaagaagaccacccccacccccuccaccaacuccguccucuccaccuccaccaaccgcucccgcaacuccccccuccucgagcgcgccucccucggccaggccuccauccagaacggcaaggacucccucaccaugcccggcucccgcgccuccaccgccuccgccuccgccgccgucuccgccgcccgcccccgccagcaccagaaguccauguccgccuccguccaccccaacaaggccuccggccucccccccaccgaguccaacugcgaggucccccgccccuccaccgccccccagcgcguccccgucgccucccccuccgcccacaacaucuccuccuccggcggcgcccccgaccgcaccaacuucccccgcggcgucuccucccgcuccaccuuccacgccggccagcuccgccagguccgcgaccagcagaaccuccccuacggcgucacccccgccucccccuccggccacucccagggccgccgcggcgccuccggcuccaucuucuccaaguucaccuccaaguucguccgccgcaaccucuccuuccgcuucgcccgccgcaaccucaacgagcccgaguccaaggaccgcgucgagacccuccgcccccacgucgucggcuccggcggcaacgacaaggagaaggaggaguuccgcgaggccaagccccgcucccuccgcuucaccugguccaugaagaccaccuccuccauggagcccaacgagaugaugcgcgagauccgcaagguccucgacgccaacuccugccaguccgagcuccacgagaaguacaugcuccucugcaugcacggcacccccggccacgaggacuucguccagugggagauggaggucugcaagcucccccgccucucccucaacggcguccgcuucaagcgcaucuccggcaccuccauggccuucaagaacaucgccuccaagaucgccaacgagcucaagcucuga

SEQ ID NO: 45772 - RNA, 2262 nt, Artificial Sequence
  derived and/or modified sequence opt2 from MARK3__Homo_sapiens__NP_001122390
auguccacccgcaccccccuccccaccgucaacgagcgcgacaccgagaaccacaccucccacggcgacggccgccaggaggucaccucccgcaccucccgcuccggcgcccgcugccgcaacuccaucgccuccugcgccgacgagcagccccacaucggcaacuaccgccuccucaagaccaucggcaagggcaacuucgccaaggucaagcucgcccgccacauccucaccggccgcgaggucgccaucaagaucaucgacaagacccagcucaaccccaccucccuccagaagcucuuccgcgagguccgcaucaugaagauccucaaccaccccaacaucgucaagcucuucgaggucaucgagaccgagaagacccucuaccucaucauggaguacgccuccggcggcgaggucuucgacuaccucgucgcccacggccgcaugaaggagaaggaggcccgcuccaaguuccgccagaucgucuccgccguccaguacugccaccagaagcgcaucguccaccgcgaccucaaggccgagaaccuccuccucgacgccgacaugaacaucaagaucgccgacuucggcuucuccaacgaguucaccgucggcggcaagcucgacaccuucugcggcuccccccccuacgccgcccccgagcucuuccagggcaagaaguacgacggccccgaggucgacgucuggucccucggcgucauccucuacacccucgucuccggcucccuccccuucgacggccagaaccucaaggagcuccgcgagcgcguccuccgcggcaaguaccgcauccccuucuacauguccaccgacugcgagaaccuccucaagcgcuuccucguccucaaccccaucaagcgcggcacccucgagcagaucaugaaggaccgcuggaucaacgccggccacgaggaggacgagcucaagcccuucgucgagcccgagcucgacaucuccgaccagaagcgcaucgacaucauggucggcaugggcuacucccaggaggagauccaggagucccucuccaagaugaaguacgacgagaucaccgccaccuaccuccuccucggccgcaaguccuccgagcucgacgccuccgacuccuccuccuccuccaaccucucccucgccaagguccgccccuccuccgaccucaacaacuccaccggccaguccccccaccacaagguccagcgcuccgucuccuccucccagaagcagcgccgcuacuccgaccacgccggccccgccauccccuccgucgucgccuaccccaagcgcucccagaccuccaccgccgacuccgaccucaaggaggacggcaucuccucccgcaaguccuccggcuccgccgucggcggcaagggcaucgcccccgccucccccaugcucggcaacgccuccaaccccaacaaggccgacauccccgagcgcaagaaguccuccaccguccccuccuccaacaccgccuccggcggcaugacccgccgcaacaccuacgucugcuccgagcgcaccaccgccgaccgccacuccgucauccagaacggcaaggagaacuccaccauccccgaccagcgcacccccgucgccuccacccacuccaucuccuccgccgccacccccgaccgcauccgcuucccccgcggcaccgccucccgcuccaccuuccacggccagccccgcgagcgccgcaccgccaccuacaacggcccccccgccucccccucccucucccacgaggccaccccccucucccagacccgcucccgcggcuccaccaaccucuucuccaagcucaccuccaagcucacccgccgcaacauguccuuccgcuucaucaagcgccuccccaccgaguacgagcgcaacggccgcuacgagggcuccucccgcaacgucuccgccgagcagaaggacgagaacaaggaggccaagccccgcucccuccgcuucaccugguccaugaagaccaccuccuccauggaccccggcgacaugaugcgcgagauccgcaagguccucgacgccaacaacugcgacuacgagcagcgcgagcgcuuccuccucuucugcguccacggcgacggccacgccgagaaccucguccagugggagauggaggucugcaagcucccccgccucucccucaacggcguccgcuucaagcgcaucuccggcaccuccaucgccuucaagaacaucgccuccaagaucgccaacgagcucaagcucuga

SEQ ID NO: 45773 - RNA, 2259 nt, Artificial Sequence
  derived and/or modified sequence opt2 from MARK4__Homo_sapiens__NP_001186796
auguccucccgcaccguccucgcccccggcaacgaccgcaacuccgacacccacggcacccucggcuccggccgcuccuccgacaagggccccuccugguccucccgcucccucggcgcccgcugccgcaacuccaucgccuccugccccgaggagcagccccacgucggcaacuaccgccuccuccgcaccaucggcaagggcaacuucgccaaggucaagcucgcccgccacauccucaccggccgcgaggucgccaucaagaucaucgacaagacccagcucaaccccuccucccuccagaagcucuuccgcgagguccgcaucaugaagggccucaaccaccccaacaucgucaagcucuucgaggucaucgagaccgagaagacccucuaccucgucauggaguacgccuccgccggcgaggucuucgacuaccucgucucccacggccgcaugaaggagaaggaggcccgcgccaaguuccgccagaucgucuccgccguccacuacugccaccagaagaacaucguccaccgcgaccucaaggccgagaaccuccuccucgacgccgaggccaacaucaagaucgccgacuucggcuucuccaacgaguucacccucggcuccaagcucgacaccuucugcggcuccccccccuacgccgcccccgagcucuuccagggcaagaaguacgacggccccgaggucgacaucuggucccucggcgucauccucuacacccucgucuccggcucccuccccuucgacggccacaaccucaaggagcuccgcgagcgcguccuccgcggcaaguaccgcguccccuucuacauguccaccgacugcgaguccauccuccgccgcuuccucguccucaaccccgccaagcgcugcacccucgagcagaucaugaaggacaaguggaucaacaucggcuacgagggcgaggagcucaagcccuacaccgagcccgaggaggacuucggcgacaccaagcgcaucgaggucauggucggcaugggcuacacccgcgaggagaucaaggagucccucaccucccagaaguacaacgaggucaccgccaccuaccuccuccucggccgcaagaccgaggagggcggcgaccgcggcgcccccggccucgcccucgcccgcguccgcgcccccuccgacaccaccaacggcaccuccuccuccaagggcaccucccacuccaagggccagcgcuccuccuccuccaccuaccaccgccagcgccgccacuccgacuucugcggccccucccccgccccccuccaccccaagcgcucccccaccuccaccggcgaggccgagcucaaggaggagcgccuccccggccgcaaggccuccugcuccaccgccggcuccggcucccgcggccucccccccuccucccccauggucuccuccgcccacaaccccaacaaggccgagauccccgagcgccgcaaggacuccaccuccacccccaacaaccucccccccuccaugaugacccgccgcaacaccuacgucugcaccgagcgccccggcgccgagcgccccucccuccuccccaacggcaaggagaacuccuccggcaccccccgcgucccccccgccucccccuccucccacucccucgccccccccuccggcgagcgcucccgccucgcccgcggcuccaccauccgcuccaccuuccacggcggccagguccgcgaccgccgcgccggcggcggcggcggcggcggcguccagaacggcccccccgccucccccacccucgcccacgaggccgccccccuccccgccggccgcccccgccccaccaccaaccucuucaccaagcucaccuccaagcucacccgccgcgucgccgacgagcccgagcgcaucggcggccccgaggucaccuccugccaccuccccugggaccagaccgagaccgccccccgccuccuccgcuuccccugguccgucaagcucaccuccucccgcccccccgaggcccucauggccgcccuccgccaggccaccgccgccgcccgcugccgcugccgccagccccagcccuuccuccucgccugccuccacggcggcgccggcggccccgagccccucucccacuucgaggucgaggucugccagcucccccgccccggccuccgcggcguccucuuccgccgcgucgccggcaccgcccucgccuuccgcacccucgucacccgcaucuccaacgaccucgagcucuga

SEQ ID NO: 45774 - RNA, 1782 nt, Artificial Sequence
  derived and/or modified sequence opt2 from MARS2__Homo_sapiens__NP_612404
augcuccgcaccuccguccuccgccuccucggccgcaccggcgccucccgccucucccuccucgaggacuucggcccccgcuacuacuccuccggcucccucuccgccggcgacgacgccugcgacguccgcgccuacuucaccacccccaucuucuacgucaacgccgccccccacaucggccaccucuacuccgcccuccucgccgacgcccucugccgccaccgccgccuccgcggccccuccaccgccgccacccgcuucuccaccggcaccgacgagcacggccucaagauccagcaggccgccgccaccgccggccucgcccccaccgagcucugcgaccgcgucuccgagcaguuccagcagcucuuccaggaggccggcaucuccugcaccgacuucauccgcaccaccgaggcccgccaccgcgucgccguccagcacuucuggggcguccucaagucccgcggccuccucuacaagggcgucuacgagggcugguacugcgccuccgacgagugcuuccuccccgaggccaaggucacccagcagcccggccccuccggcgacuccuuccccgucucccucgaguccggccaccccgucuccuggaccaaggaggagaacuacaucuuccgccucucccaguuccgcaagccccuccagcgcuggcuccgcggcaacccccaggccaucacccccgagcccuuccaccacgucguccuccaguggcucgacgaggagcuccccgaccucuccgucucccgccgcuccucccaccuccacuggggcauccccguccccggcgacgacucccagaccaucuacgucuggcucgacgcccucgucaacuaccucaccgucaucggcuaccccaacgccgaguucaaguccugguggcccgccaccucccacaucaucggcaaggacauccucaaguuccacgccaucuacuggcccgccuuccuccucggcgccggcaugucccccccccagcgcaucugcguccacucccacuggaccgucugcggccagaagauguccaagucccucggcaacgucgucgacccccgcaccugccucaaccgcuacaccgucgacggcuuccgcuacuuccuccuccgccagggcguccccaacugggacugcgacuacuacgacgagaaggucgucaagcuccucaacuccgagcucgccgacgcccucggcggccuccucaaccgcugcaccgccaagcgcaucaaccccuccgagaccuaccccgccuucugcaccaccugcuuccccuccgagcccggccucgucggccccuccguccgcgcccaggccgaggacuacgcccucgucuccgccgucgccacccuccccaagcaggucgccgaccacuacgacaacuuccgcaucuacaaggcccucgaggccgucuccuccugcguccgccagaccaacggcuucguccagcgccacgcccccuggaagcucaacugggagucccccgucgacgcccccuggcucggcaccguccuccacgucgcccucgagugccuccgcgucuucggcacccuccuccagcccgucacccccucccucgccgacaagcuccucucccgccucggcgucuccgccuccgagcgcucccucggcgagcucuacuuccucccccgcuucuacggccaccccugccccuucgagggccgccgccucggccccgagaccggccuccucuucccccgccucgaccagucccgcaccuggcucgucaaggcccaccgcaccuga

SEQ ID NO: 45775 - RNA, 2703 nt, Artificial Sequence
  derived and/or modified sequence opt2 from MARS__Homo_sapiens__NP_004981
augcgccucuucgucuccgacggcguccccggcugccuccccguccucgccgccgccggccgcgcccgcggccgcgccgagguccucaucuccaccgucggccccgaggacugcgucguccccuuccucacccgccccaagguccccguccuccagcucgacuccggcaacuaccucuucuccaccuccgccaucugccgcuacuucuuccuccucuccggcugggagcaggacgaccucaccaaccaguggcucgagugggaggccaccgagcuccagcccgcccucuccgccgcccucuacuaccucgucguccagggcaagaagggcgaggacguccucggcuccguccgccgcgcccucacccacaucgaccacucccucucccgccagaacugccccuuccucgccggcgagaccgagucccucgccgacaucguccucuggggcgcccucuacccccuccuccaggaccccgccuaccuccccgaggagcucuccgcccuccacuccugguuccagacccucuccacccaggagcccugccagcgcgccgccgagaccguccucaagcagcagggcguccucgcccuccgccccuaccuccagaagcagccccagcccucccccgccgagggccgcgccgucaccaacgagcccgaggaggaggagcucgccacccucuccgaggaggagaucgccauggccgucaccgccugggagaagggccucgagucccuccccccccuccgcccccagcagaaccccguccuccccgucgccggcgagcgcaacguccucaucaccuccgcccuccccuacgucaacaacgucccccaccucggcaacaucaucggcugcguccucuccgccgacgucuucgcccgcuacucccgccuccgccaguggaacacccucuaccucugcggcaccgacgaguacggcaccgccaccgagaccaaggcccucgaggagggccucaccccccaggagaucugcgacaaguaccacaucauccacgccgacaucuaccgcugguucaacaucuccuucgacaucuucggccgcaccaccaccccccagcagaccaagaucacccaggacaucuuccagcagcuccucaagcgcggcuucguccuccaggacaccgucgagcagcuccgcugcgagcacugcgcccgcuuccucgccgaccgcuucgucgagggcgucugccccuucugcggcuacgaggaggcccgcggcgaccagugcgacaagugcggcaagcucaucaacgccgucgagcucaagaagccccagugcaaggucugccgcuccugccccgucguccaguccucccagcaccucuuccucgaccuccccaagcucgagaagcgccucgaggaguggcucggccgcacccuccccggcuccgacuggacccccaacgcccaguucaucacccgcuccuggcuccgcgacggccucaagccccgcugcaucacccgcgaccucaaguggggcacccccgucccccucgagggcuucgaggacaaggucuucuacgucugguucgacgccaccaucggcuaccucuccaucaccgccaacuacaccgaccagugggagcgcugguggaagaaccccgagcaggucgaccucuaccaguucauggccaaggacaacguccccuuccacucccucgucuuccccugcuccgcccucggcgccgaggacaacuacacccucgucucccaccucaucgccaccgaguaccucaacuacgaggacggcaaguucuccaagucccgcggcgucggcgucuucggcgacauggcccaggacaccggcauccccgccgacaucuggcgcuucuaccuccucuacauccgccccgagggccaggacuccgccuucuccuggaccgaccuccuccucaagaacaacuccgagcuccucaacaaccucggcaacuucaucaaccgcgccggcauguucgucuccaaguucuucggcggcuacguccccgagaugguccucacccccgacgaccagcgccuccucgcccacgucacccucgagcuccagcacuaccaccagcuccucgagaagguccgcauccgcgacgcccuccgcuccauccucaccaucucccgccacggcaaccaguacauccaggucaacgagcccuggaagcgcaucaagggcuccgaggccgaccgccagcgcgccggcaccgucaccggccucgccgucaacaucgccgcccuccucuccgucaugcuccagcccuacaugcccaccgucuccgccaccauccaggcccagcuccagcuccccccccccgccugcuccauccuccucaccaacuuccucugcacccuccccgccggccaccagaucggcaccgucuccccccucuuccagaagcucgagaacgaccagaucgagucccuccgccagcgcuucggcggcggccaggccaagaccucccccaagcccgccgucgucgagaccgucaccaccgccaagccccagcagauccaggcccucauggacgaggucaccaagcagggcaacaucguccgcgagcucaaggcccagaaggccgacaagaacgaggucgccgccgaggucgccaagcuccucgaccucaagaagcagcucgccgucgccgagggcaagccccccgaggcccccaagggcaagaagaagaaguga

SEQ ID NO: 45776 - RNA, 522 nt, Artificial Sequence
  derived and/or modified sequence opt2 from MARVELD1__Homo_sapiens__NP_113672
augcuccccccccccccccgccagccccccccccaggcccgcgccgcccgcggcgccguccgccuccagcgccccuuccuccgcuccccccucggcguccuccgccuccuccagcuccucgccggcgccgccuucuggaucaccaucgccaccuccaaguaccagggccccguccacuucgcccucuucgucuccguccucuucuggcuccucacccucggccucuacuuccucacccuccucggcaagcacgagcucguccccguccucggcucccgcuggcucauggucaacgucgcccacgacguccucgccgccgcccucuacggcgccgccaccggcaucauguccgaccagaugcagcgccacuccuacugcaaccucaaggacuacccccuccccugcgccuaccacgccuuccucgccgccgccgucugcggcggcgucugccacggccucuaccuccucuccgcccucuacggcugcggccgccgcugccagggcaagcaggaggucgccuga

SEQ ID NO: 45777 - RNA, 1641 nt, Artificial Sequence
  derived and/or modified sequence opt2 from MARVELD2__Homo_sapiens__NP_001231663
auguccaacgacggccgcucccgcaaccgcgaccgccgcuacgacgagguccccuccgaccuccccuaccaggacaccaccauccgcacccaccccacccuccacgacuccgagcgcgccgucuccgccgacccccuccccccccccccccucccccuccagccccccuucggccccgacuucuacuccuccgacaccgaggagcccgccaucgcccccgaccucaagcccguccgccgcuucguccccgacuccuggaagaacuucuuccgcggcaagaagaaggaccccgagugggacaagcccgucuccgacauccgcuacaucuccgacggcgucgagugcuccccccccgccucccccgcccgccccaaccaccgcuccccccucaacuccugcaaggaccccuacggcggcuccgagggcaccuucuccucccgcaaggaggccgacgccgucuucccccgcgaccccuacggcucccucgaccgccacacccagaccguccgcaccuacuccgagaaggucgaggaguacaaccuccgcuacuccuacaugaaguccugggccggccuccuccgcauccucggcgucgucgagcuccuccucggcgccggcgucuucgccugcgucaccgccuacauccacaaggacuccgagugguacaaccucuucggcuacucccagcccuacggcaugggcggcgucggcggccucggcuccauguacggcggcuacuacuacaccggccccaagacccccuucguccucgucgucgccggccucgccuggaucaccaccaucaucauccucguccucggcauguccauguacuaccgcaccauccuccucgacuccaacugguggccccucaccgaguucggcaucaacgucgcccucuucauccucuacauggccgccgccaucgucuacgucaacgacaccaaccgcggcggccucugcuacuacccccucuucaacacccccgucaacgccgucuucugccgcgucgagggcggccagaucgccgccaugaucuuccucuucgucaccaugaucgucuaccucaucuccgcccucgucugccucaagcucuggcgccacgaggccgcccgccgccaccgcgaguacauggagcagcaggagugcgagauggccaccuccggcgaccgccagcgcgacuccgaggucaacuucaaggagcuccgcaccgccaagaugaagcccgagcuccucuccggccacaucccccccggccacauccccaagcccaucgucaugcccgacuacgucgccaaguaccccgucauccagaccgacgacgagcgcgagcgcuacaaggccgucuuccaggaccaguucuccgaguacaaggagcucuccgccgagguccaggccguccuccgcaaguucgacgagcucgacgccgucaugucccgccucccccaccacuccgagucccgccaggagcacgagcgcaucucccgcauccacgaggaguucaagaagaagaagaacgaccccaccuuccucgagaagaaggagcgcugcgacuaccucaagaacaagcucucccacaucaagcagcgcauccaggaguacgacaaggucaugaacugggacguccagggcuacuccuga

SEQ ID NO: 45778 - RNA, 1233 nt, Artificial Sequence
  derived and/or modified sequence opt2 from MARVELD3__Homo_sapiens__NP_001017967
auggaggaccccuccggcgcccgcgagccccgcgcccgcccccgcgagcgcgaccccggccgccgcccccaccccgaccagggccgcacccacgaccgcccccgcgaccgccccggcgacccccgccgcaagcgcuccuccgacggcaaccgccgccgcgacggcgaccgcgaccccgagcgcgaccaggagcgcgacggcaaccgcgaccgcaaccgcgaccgcgagcgcgagcgcgagcgcgagcgcgaccccgaccgcggcccccgccgcgacacccaccgcgacgccggcccccgcgccggcgagcacggcgucugggagaagccccgccagucccgcacccgcgacggcgcccgcggccucaccugggacgccgccgccccccccggccccgcccccugggaggcccccgagcccccccagccccagcgcaagggcgaccccggccgccgccgccccgaguccgagccccccuccgagcgcuaccuccccuccaccccccgccccggccgcgaggaggucgaguacuaccaguccgaggccgagggccuccucgagugccacaagugcaaguaccucugcaccggccgcggcgucguccagaucgucgaggucguccucaacggcaugguccucaucugcaucgucgccuccuacuucguccucgccggcuucuccgccuccuucuccuccggcggcggcuucggcaacaacuacuacucccccuucgagggcaccgagcucgagcagguccgccagcucgaccagcaguacaccauccuccgcuccccccucaucuacggcggcgucgccgucucccucggccucggcguccucaccaugggcguccuccuccagggcgccaagucccgcaccaugcucuccggcaaguggcuccucaccgaggccgccuucucccuccucgccgccgucggcuacugcaccggcaucggcgucuaccuccacgucgcccuccagaucaacuccaccgacaccugcaagacccgcgagcgccucuacgcccgcaagggccucaccuggauggacugccagcucgccggcaccgacggcgccgccgccaccuucgccugccuccucgucaucauguacggcgccuccgucguccucgcccuccgcuccuaccgcgagcagaagcgcuacaagggcucccgcgagcagcccggcuccuacuccgacgcccccgaguaccucugguccggcacccucuga

SEQ ID NO: 45779 - RNA, 978 nt, Artificial Sequence
  derived and/or modified sequence opt2 from MAS1__Homo_sapiens__NP_002368
auggacggcuccaacgucaccuccuucgucgucgaggagcccaccaacaucuccaccggccgcaacgccuccgucggcaacgcccaccgccagauccccaucguccacugggucaucauguccaucucccccgucggcuucgucgagaacggcauccuccucugguuccucugcuuccgcaugcgccgcaaccccuucaccgucuacaucacccaccucuccaucgccgacaucucccuccucuucugcaucuucauccucuccaucgacuacgcccucgacuacgagcucuccuccggccacuacuacaccaucgucacccucuccgucaccuuccucuucggcuacaacaccggccucuaccuccucaccgccaucuccgucgagcgcugccucuccguccucuaccccaucugguaccgcugccaccgccccaaguaccaguccgcccucgucugcgcccuccucugggcccucuccugccucgucaccaccauggaguacgucaugugcaucgaccgcgaggaggagucccacucccgcaacgacugccgcgccgucaucaucuucaucgccauccucuccuuccucgucuucaccccccucaugcucgucuccuccaccauccucgucgucaagauccgcaagaacaccugggccucccacuccuccaagcucuacaucgucaucauggucaccaucaucaucuuccucaucuucgccaugcccaugcgccuccucuaccuccucuacuacgaguacugguccaccuucggcaaccuccaccacaucucccuccucuucuccaccaucaacuccuccgccaaccccuucaucuacuucuucgucggcuccuccaagaagaagcgcuucaaggagucccucaaggucguccucacccgcgccuucaaggacgagaugcagccccgccgccagaaggacaacugcaacaccgucaccgucgagaccgucgucuga

SEQ ID NO: 45780 - RNA, 1137 nt, Artificial Sequence
  derived and/or modified sequence opt2 from MAS1L__Homo_sapiens__NP_443199
auggucuggggcaagaucugcugguucucccagcgcgccggcuggaccgucuucgccgagucccagaucucccucuccugcucccucugccuccacuccggcgaccaggaggcccagaaccccaaccucgucucccagcucugcggcgucuuccuccagaacgagaccaacgagaccauccacaugcagauguccauggccgucggccagcaggcccucccccucaacaucaucgcccccaaggccguccucgucucccucugcggcguccuccucaacggcaccgucuucuggcuccucugcugcggcgccaccaaccccuacauggucuacauccuccaccucgucgccgccgacgucaucuaccucugcugcuccgccgucggcuuccuccaggucacccuccucaccuaccacggcgucgucuucuucauccccgacuuccucgccauccucucccccuucuccuucgaggucugccucugccuccucgucgccaucuccaccgagcgcugcgucugcguccucuuccccaucugguaccgcugccaccgccccaaguacaccuccaacgucgucugcacccucaucuggggccuccccuucugcaucaacaucgucaagucccucuuccucaccuacuggaagcacgucaaggccugcgucaucuuccucaagcucuccggccucuuccacgccauccucucccucgucaugugcgucuccucccucacccuccucauccgcuuccucugcugcucccagcagcagaaggccacccgcgucuacgccgucguccagaucuccgcccccauguuccuccucugggcccucccccucuccgucgccccccucaucaccgacuucaagauguucgucaccaccuccuaccucaucucccucuuccucaucaucaacuccuccgccaaccccaucaucuacuucuucgucggcucccuccgcaagaagcgccucaaggagucccuccgcgucauccuccagcgcgcccucgccgacaagcccgaggucggccgcaacaagaaggccgccggcaucgaccccauggagcagccccacuccacccagcacgucgagaaccuccucccccgcgagcaccgcgucgacgucgagaccuga

SEQ ID NO: 45781 - RNA, 1143 nt, Artificial Sequence
  derived and/or modified sequence opt2 from MASP1__Homo_sapiens__NP_001027019
augcgcuggcuccuccucuacuacgcccucugcuucucccucuccaaggccuccgcccacaccgucgagcucaacaacauguucggccagauccagucccccggcuaccccgacuccuaccccuccgacuccgaggucaccuggaacaucaccguccccgacggcuuccgcaucaagcucuacuucaugcacuucaaccucgaguccuccuaccucugcgaguacgacuacgucaaggucgagaccgaggaccagguccucgccaccuucugcggccgcgagaccaccgacaccgagcagacccccggccaggaggucguccucucccccggcuccuucauguccaucaccuuccgcuccgacuucuccaacgaggagcgcuucaccggcuucgacgcccacuacauggccgucgacgucgacgagugcaaggagcgcgaggacgaggagcucuccugcgaccacuacugccacaacuacaucggcggcuacuacugcuccugccgcuucggcuacauccuccacaccgacaaccgcaccugccgcgucgagugcuccgacaaccucuucacccagcgcaccggcgucaucaccucccccgacuuccccaaccccuaccccaaguccuccgagugccucuacaccaucgagcucgaggagggcuucauggucaaccuccaguucgaggacaucuucgacaucgaggaccaccccgagguccccugccccuacgacuacaucaagaucaaggucggccccaagguccucggccccuucugcggcgagaaggcccccgagcccaucuccacccagucccacuccguccucauccucuuccacuccgacaacuccggcgagaaccgcggcuggcgccucuccuaccgcgccgccggcaacgagugccccgagcuccagccccccguccacggcaagaucgagcccucccaggccaaguacuucuucaaggaccagguccucgucuccugcgacaccggcuacaagguccucaaggacaacgucgagauggacaccuuccagaucgagugccucaaggacggcaccugguccaacaagauccccaccugcaagaagaacgagaucgaccucgaguccgagcucaaguccgagcaggucaccgaguga

SEQ ID NO: 45782 - RNA, 5592 nt, Artificial Sequence
  derived and/or modified sequence opt2 from MAST2__Homo_sapiens__XP_011539364
augaagcgcucccgcugccgcgaccgcccccagccccccccccccgaccgccgcgaggacggcguccagcgcgccgccgagcucucccagucccuccccccccgccgccgcgccccccccggccgccagcgccucgaggagcgcaccggccccgccggccccgagggcaaggagcaggacgucgucaccggcgucuccccccuccucuuccgcaagcucuccaaccccgacaucuucuccuccaccggcaaggucaagcuccagcgccagcucucccaggacgacugcaagcucuggcgcggcaaccucgccuccucccucuccggcaagcagcuccucccccucuccuccuccguccacuccuccgucggccaggucaccuggcaguccuccggcgaggccuccaaccucguccgcaugcgcaaccagucccucggccaguccgcccccucccucaccgccggccucaaggagcucucccucccccgccgcggcucccucaucuccacccucugccgcggcgccgaggucaaccagcacauguucucccccaccuccgcccccgcccucuuccucaccaagguccccuucuccgccgacugcgcccucgccaccuccccccucgccaucuuccucaacccccgcgcccacuccucccccggcacccccugcuccucccgcccccuccccugguccugccgcaccuccaaccgcaagucccucaucgucaccuccuccaccucccccacccucccccgcccccacuccccccuccacggccacaccggcaacuccccccucgacuccccccgcaacuucucccccaacgcccccgcccacuucuccuucguccccgcccgccgcaccgacggccgccgcuggucccucgccucccuccccuccuccggcuacggcaccaacacccccuccuccaccgucuccuccuccugcuccucccaggagaagcuccaccagcuccccuuccagcccaccgccgacgagcuccacuuccucaccaagcacuucuccaccgaguccguccccgacgaggagggccgccagucccccgccaugcgcccccgcucccgcucccucucccccggccgcucccccgucuccuucgacuccgagaucaucaugaugaaccacgucuacaaggagcgcuuccccaaggccaccgcccagauggaggagcgccucgccgaguucaucuccuccaacacccccgacuccguccucccccucgccgacggcgcccucuccuucauccaccaccaggucaucgagauggcccgcgacugccucgacaagucccgcuccggccucaucaccucccaguacuucuacgagcuccaggacaaccucgagaagcuccuccaggacgcccacgagcgcuccgaguccuccgaggucgccuucgucaugcagcucgucaagaagcucaugaucaucaucgcccgccccgcccgccuccucgagugccucgaguucgaccccgaggaguucuaccaccuccucgaggccgccgagggccacgccaaggagggccagggcaucaagugcgacaucccccgcuacaucgucucccagcucggccucacccgcgacccccucgaggagauggcccagcucuccuccugcgacucccccgacacccccgagaccgacgacuccaucgagggccacggcgccucccuccccuccaagaagacccccuccgaggaggacuucgagaccaucaagcucaucuccaacggcgccuacggcgccgucuuccucguccgccacaaguccacccgccagcgcuucgccaugaagaagaucaacaagcagaaccucauccuccgcaaccagauccagcaggccuucgucgagcgcgacauccucaccuucgccgagaaccccuucgucgucuccauguucugcuccuucgacaccaagcgccaccucugcauggucauggaguacgucgagggcggcgacugcgccacccuccucaagaacaucggcgcccuccccgucgacaugguccgccucuacuucgccgagaccguccucgcccucgaguaccuccacaacuacggcaucguccaccgcgaccucaagcccgacaaccuccucaucaccuccaugggccacaucaagcucaccgacuucggccucuccaagaucggccucaugucccucaccaccaaccucuacgagggccacaucgagaaggacgcccgcgaguuccucgacaagcaggucugcggcacccccgaguacaucgcccccgaggucauccuccgccagggcuacggcaagcccgucgacuggugggccaugggcaucauccucuacgaguuccucgucggcugcguccccuucuucggcgacacccccgaggagcucuucggccaggucaucuccgacgagaucgucuggcccgagggcgacgaggcccucccccccgacgcccaggaccucaccuccaagcuccuccaccagaacccccucgagcgccucggcaccggcuccgccuacgaggucaagcagcaccccuucuucaccggccucgacuggaccggccuccuccgccagaaggccgaguucaucccccagcucgaguccgaggacgacaccuccuacuucgacacccgcuccgagcgcuaccaccacauggacuccgaggacgaggaggaggucuccgaggacggcugccucgagauccgccaguucuccuccugcuccccccgcuucaacaaggucuacuccuccauggagcgccucucccuccucgaggagcgccgcacccccccccccaccaagcgcucccucuccgaggagaaggaggaccacuccgacggccucgccggccucaagggccgcgaccgcuccugggucaucggcucccccgagauccuccgcaagcgccucuccgucuccgaguccucccacaccgaguccgacuccuccccccccaugaccguccgccgccgcugcuccggccuccucgacgccccccgcuuccccgagggccccgaggaggccuccuccacccuccgccgccagccccaggagggcaucuggguccucaccccccccuccggcgagggcgucuccggccccgucaccgagcacuccggcgagcagcgccccaagcucgacgaggaggccgucggccgcuccuccggcuccucccccgccauggagacccgcggccgcggcaccucccagcucgccgagggcgccaccgccaaggccaucuccgaccucgccguccgccgcgcccgccaccgccuccucuccggcgacuccaccgagaagcgcaccgcccgccccgucaacaaggucaucaaguccgccuccgccaccgcccucucccuccucauccccuccgagcaccacaccugcuccccccucgccucccccauguccccccacucccaguccuccaaccccuccucccgcgacuccucccccucccgcgacuuccuccccgcccucggcuccaugcgcccccccaucaucauccaccgcgccggcaagaaguacggcuucacccuccgcgccauccgcgucuacaugggcgacuccgacgucuacaccguccaccacauggucuggcacgucgaggacggcggccccgccuccgaggccggccuccgccagggcgaccucaucacccacgucaacggcgagcccguccacggccucguccacaccgaggucgucgagcucauccucaaguccggcaacaaggucgccaucuccaccaccccccucgagaacaccuccaucaaggucggccccgcccgcaagggcuccuacaaggccaagauggcccgccgcuccaagcgcucccgcggcaaggacggccaggagucccgcaagcgcuccucccucuuccgcaagaucaccaagcaggccucccuccuccacaccucccgcucccucuccucccucaaccgcucccucuccuccggcgaguccggccccggcucccccacccacucccacucccucuccccccgcucccccacccagggcuaccgcgucacccccgacgccguccacuccgucggcggcaacuccucccaguccuccucccccuccuccuccguccccuccucccccgccggcuccggccacacccgccccuccucccuccacggccucgcccccaagcuccagcgccaguaccgcuccccccgccgcaaguccgccggcuccaucccccucuccccccucgcccacacccccuccccccccccccccaccgccuccccccagcgcucccccuccccccucuccggccacgucgcccaggccuuccccaccaagcuccaccucucccccccccucggccgccagcucucccgccccaaguccgccgagcccccccgcuccccccuccucaagcgcguccaguccgccgagaagcucgccgccgcccucgccgccuccgagaagaagcucgccaccucccgcaagcacucccucgaccucccccacuccgagcucaagaaggagcuccccccccgcgaggucuccccccucgaggucgucggcgcccgcuccguccucuccggcaagggcgcccuccccggcaagggcguccuccagcccgcccccucccgcgcccucggcacccuccgccaggaccgcgccgagcgccgcgagucccuccagaagcaggaggccauccgcgaggucgacuccuccgaggacgacaccgaggagggccccgagaacucccagggcgcccaggagcucucccucgccccccaccccgaggucucccaguccgucgcccccaagggcgccggcgaguccggcgaggaggaccccuuccccucccgcgacccccgcucccucggccccaugguccccucccuccucaccggcaucacccucggccccccccgcauggagucccccuccggcccccaccgccgccucggcuccccccaggccaucgaggaggccgccuccuccuccuccgccggccccaaccucggccaguccggcgccaccgaccccaucccccccgagggcugcuggaaggcccagcaccuccacacccaggcccucaccgcccucucccccuccaccuccggccucacccccaccuccuccugcuccccccccuccuccaccuccggcaagcucuccaugugguccuggaagucccucaucgagggccccgaccgcgccucccccucccgcaaggccaccauggccggcggccucgccaaccuccaggaccucgagaacaccacccccgcccagcccaagaaccucuccccccgcgagcagggcaagacccagccccccuccgccccccgccucgcccaccccuccuacgaggaccccucccagggcuggcucugggaguccgagugcgcccaggccgucaaggaggaccccgcccucuccaucacccagguccccgacgccuccggcgaccgccgccaggacguccccugccgcggcugcccccucacccagaaguccgagcccucccuccgccgcggccaggagcccggcggccaccagaagcaccgcgaccucgcccucguccccgacgagcuccucaagcagaccuga

SEQ ID NO: 45783 - RNA, 7872 nt, Artificial Sequence
  derived and/or modified sequence opt2 from MAST4__Homo_sapiens__NP_001158136
augggcgagaaggucuccgaggcccccgagcccgucccccgcggcugcuccggccacggcucccgcacccccgccuccgcccucgucgccgccuccucccccggcgccuccuccgccgaguccuccuccggcuccgagacccucuccgaggagggcgagcccggcggcuucucccgcgagcaccagcccccccccccccccccccucggcggcacccucggcgcccgcgcccccgccgccugggcccccgccuccguccuccucgagcgcggcguccucgcccucccccccccccuccccggcggcgccgucccccccgccccccgcggcuccuccgccucccaggaggagcaggacgaggagcucgaccacauccucucccccccccccaugcccuuccgcaagugcuccaaccccgacgucgccuccggccccggcaagucccucaaguacaagcgccagcucuccgaggacggccgccagcuccgccgcggcucccucggcggcgcccucaccggccgcuaccuccuccccaaccccgucgccggccaggccuggcccgccuccgccgagaccuccaaccucguccgcaugcgcucccaggcccucggccaguccgcccccucccucaccgccucccucaaggagcucucccucccccgccgcggcuccuucugccgcaccuccaaccgcaagucccucaucggcaacggccagucccccgcccucccccgcccccacuccccccucuccgcccacgccggcaacuccccccaggacuccccccgcaacuucucccccuccgccuccgcccacuucuccuucgcccgccgcaccgacggccgccgcuggucccucgccucccuccccuccuccggcuacggcaccaacacccccuccuccaccgucuccuccuccugcuccucccaggagaagcuccaccagcuccccuaccagcccacccccgacgagcuccacuuccucuccaagcacuucugcaccaccgaguccaucgccaccgagaaccgcugccgcaacacccccaugcgcccccgcucccgcucccucucccccggccgcucccccgccugcugcgaccacgagaucaucaugaugaaccacgucuacaaggagcgcuuccccaaggccaccgcccagauggaggagcgccucaaggagaucaucaccuccuacucccccgacaacguccucccccucgccgacggcguccucuccuucacccaccaccagaucaucgagcucgcccgcgacugccucgacaagucccaccagggccucaucaccucccgcuacuuccucgagcuccagcacaagcucgacaagcuccuccaggaggcccacgaccgcuccgaguccggcgagcucgccuucaucaagcagcucguccgcaagauccucaucgucaucgcccgccccgcccgccuccucgagugccucgaguucgaccccgaggaguucuacuaccuccucgaggccgccgagggccacgccaaggagggccagggcaucaagaccgacaucccccgcuacaucaucucccagcucggccucaacaaggacccccucgaggagauggcccaccucggcaacuacgacuccggcaccgccgagacccccgagaccgacgaguccgucuccuccuccaacgccucccucaagcuccgccgcaagccccgcgaguccgacuucgagaccaucaagcucaucuccaacggcgccuacggcgccgucuacuucguccgccacaaggagucccgccagcgcuucgccaugaagaagaucaacaagcagaaccucauccuccgcaaccagauccagcaggccuucgucgagcgcgacauccucaccuucgccgagaaccccuucgucgucuccauguacugcuccuucgagacccgccgccaccucugcauggucauggaguacgucgagggcggcgacugcgccacccucaugaagaacaugggcccccuccccgucgacauggcccgcauguacuucgccgagaccguccucgcccucgaguaccuccacaacuacggcaucguccaccgcgaccucaagcccgacaaccuccucgucaccuccaugggccacaucaagcucaccgacuucggccucuccaaggucggccucauguccaugaccaccaaccucuacgagggccacaucgagaaggacgcccgcgaguuccucgacaagcaggucugcggcacccccgaguacaucgcccccgaggucauccuccgccagggcuacggcaagcccgucgacuggugggccaugggcaucauccucuacgaguuccucgucggcugcguccccuucuucggcgacacccccgaggagcucuucggccaggucaucuccgacgagaucaacuggcccgagaaggacgaggcccccccccccgacgcccaggaccucaucacccuccuccuccgccagaacccccucgagcgccucggcaccggcggcgccuacgaggucaagcagcaccgcuucuuccgcucccucgacuggaacucccuccuccgccagaaggccgaguucaucccccagcucgaguccgaggacgacaccuccuacuucgacacccgcuccgagaaguaccaccacauggagaccgaggaggaggacgacaccaacgacgaggacuucaacgucgagauccgccaguucuccuccugcucccaccgcuucuccaaggucuucuccuccaucgaccgcaucacccagaacuccgccgaggagaaggaggacuccgucgacaagaccaaguccaccacccuccccuccaccgagacccucuccugguccuccgaguacuccgagaugcagcagcucuccaccuccaacuccuccgacaccgaguccaaccgccacaagcucuccuccggccuccuccccaagcucgccaucuccaccgagggcgagcaggacgaggccgccuccugccccggcgacccccacgaggagcccggcaagcccgcccucccccccgaggagugcgcccaggaggagcccgaggucaccacccccgccuccaccaucuccuccuccacccucuccgucggcuccuucuccgagcaccucgaccagaucaacggccgcuccgagugcgucgacuccaccgacaacuccuccaagcccuccuccgagcccgccucccacauggcccgccagcgccucgaguccaccgagaagaagaagaucuccggcaaggucaccaagucccucuccgccuccgcccucucccucaugauccccggcgacauguucgccgucuccccccucggcucccccauguccccccacucccucuccuccgaccccuccuccucccgcgacuccucccccucccgcgacuccuccgccgccuccgccuccccccaccagcccaucgucauccacuccuccggcaagaacuacggcuucaccauccgcgccauccgcgucuacgucggcgacuccgacaucuacaccguccaccacaucgucuggaacgucgaggagggcucccccgccugccaggccggccucaaggccggcgaccucaucacccacaucaacggcgagcccguccacggccucguccacaccgaggucaucgagcuccuccucaaguccggcaacaaggucuccaucaccaccacccccuucgagaacaccuccaucaagaccggccccgcccgccgcaacuccuacaagucccgcaugguccgccgcuccaagaaguccaagaagaaggagucccucgagcgccgccgcucccucuucaagaagcucgccaagcagcccuccccccuccuccacaccucccgcuccuucuccugccucaaccgcucccucuccuccggcgagucccuccccggcucccccacccacucccucuccccccgcucccccacccccuccuaccgcuccacccccgacuuccccuccggcaccaacuccucccaguccuccucccccuccuccuccgcccccaacucccccgccggcuccggccacauccgccccuccacccuccacggccucgcccccaagcucggcggccagcgcuaccgcuccggccgccgcaaguccgccggcaacaucccccucuccccccucgcccgcacccccucccccaccccccagcccaccuccccccagcgcucccccuccccccuccucggccacucccucggcaacuccaagaucgcccaggccuuccccuccaagaugcacuccccccccaccaucguccgccacaucguccgccccaaguccgccgagcccccccgcuccccccuccucaagcgcguccaguccgaggagaagcucucccccuccuacggcuccgacaagaagcaccucugcucccgcaagcacucccucgaggucacccaggaggagguccagcgcgagcagucccagcgcgaggccccccuccagucccucgacgagaacgucugcgacguccccccccucucccgcgcccgccccgucgagcagggcugccucaagcgccccgucucccgcaaggucggccgccaggaguccgucgacgaccucgaccgcgacaagcucaaggccaaggucgucgucaagaaggccgacggcuuccccgagaagcaggagucccaccagaagucccacggccccggcuccgaccucgagaacuucgcccucuucaagcucgaggagcgcgagaagaaggucuaccccaaggccgucgagcgcuccuccaccuucgagaacaaggccuccaugcaggaggcccccccccucggcucccuccucaaggacgcccuccacaagcaggccuccguccgcgccuccgagggcgccauguccgacggccgcguccccgccgagcaccgccagggcggcggcgacuuccgccgcgcccccgcccccggcacccuccaggacggccucugccacucccucgaccgcggcaucuccggcaagggcgagggcaccgagaaguccucccaggccaaggagcuccuccgcugcgagaagcucgacuccaagcucgccaacaucgacuaccuccgcaagaagaugucccucgaggacaaggaggacaaccucugccccguccucaagcccaagaugaccgccggcucccacgagugccuccccggcaaccccguccgccccaccggcggccagcaggagcccccccccgccuccgagucccgcgccuucgucuccuccacccacgccgcccagauguccgccgucuccuucgucccccucaaggcccucaccggccgcgucgacuccggcaccgagaagcccggccucgucgcccccgagucccccguccgcaagucccccuccgaguacaagcucgagggccgcuccgucuccugccucaagcccaucgagggcacccucgacaucgcccuccucuccggcccccaggccuccaagaccgagcuccccucccccgaguccgcccagucccccucccccuccggcgacguccgcgccuccgucccccccguccuccccuccuccuccggcaagaagaacgacaccaccuccgcccgcgagcucucccccuccucccucaagaugaacaaguccuaccuccucgagcccugguuccucccccccucccgcggccuccagaacucccccgccgucucccuccccgaccccgaguucaagcgcgaccgcaagggcccccaccccaccgcccgcucccccggcaccgucauggaguccaacccccagcagcgcgagggcuccucccccaagcaccaggaccacaccaccgaccccaagcuccucaccugccucggccagaaccuccacucccccgaccucgcccgcccccgcugcccccucccccccgaggccucccccucccgcgagaagcccggccuccgcgaguccuccgagcgcggcccccccaccgcccgcuccgagcgcuccgccgcccgcgccgacaccugccgcgagcccuccauggagcucugcuuccccgagaccgccaagaccuccgacaacuccaagaaccuccucuccgucggccgcacccaccccgacuucuacacccagacccaggccauggagaaggccugggcccccggcggcaagaccaaccacaaggacggccccggcgaggcccgcccccccccccgcgacaacuccucccuccacuccgccggcauccccugcgagaaggagcucggcaagguccgccgcggcgucgagcccaagcccgaggcccuccucgcccgccgcucccuccagccccccggcaucgaguccgagaaguccgagaagcucuccuccuuccccucccuccagaaggacggcgccaaggagcccgagcgcaaggagcagccccuccagcgccaccccuccuccauccccccccccccccucaccgccaaggaccucuccucccccgccgcccgccagcacugcuccucccccucccacgccuccggccgcgagcccggcgccaagcccuccaccgccgagcccuccuccuccccccaggacccccccaagcccgucgccgcccacuccgaguccuccucccacaagccccgccccggccccgaccccggcccccccaagaccaagcaccccgaccgcucccucuccucccagaagcccuccgucggcgccaccaagggcaaggagcccgccacccagucccucggcggcuccucccgcgagggcaagggccacuccaaguccggccccgacgucuuccccgccacccccggcucccagaacaaggccuccgacggcaucggccagggcgagggcggccccuccgucccccuccacaccgaccgcgccccccucgacgccaagccccagcccaccuccggcggccgcccccucgagguccucgagaagcccguccaccucccccgccccggccaccccggccccuccgagcccgccgaccagaagcucuccgccgucggcgagaagcagacccucucccccaagcaccccaagcccuccaccgucaaggacugccccacccucugcaagcagaccgacaaccgccagaccgacaagucccccucccagcccgccgccaacaccgaccgccgcgccgagggcaagaagugcaccgaggcccucuacgcccccgccgagggcgacaagcucgaggccggccucuccuucguccacuccgagaaccgccucaagggcgccgagcgccccgccgccggcgucggcaagggcuuccccgaggcccgcggcaagggccccggcccccagaagccccccaccgaggccgacaagcccaacggcaugaagcgcucccccuccgccaccggccaguccuccuuccgcuccaccgcccuccccgagaagucccucuccugcuccuccuccuuccccgagacccgcgccggcguccgcgaggccuccgccgccuccuccgacaccuccuccgccaaggccgccggcggcaugcucgagcuccccgcccccuccaaccgcgaccaccgcaaggcccagcccgccggcgagggccgcacccacaugaccaaguccgacucccuccccuccuuccgcgucuccacccucccccucgagucccaccaccccgaccccaacaccaugggcggcgccucccaccgcgaccgcgcccucuccgucaccgccaccgucggcgagaccaagggcaaggaccccgcccccgcccagcccccccccgcccgcaagcagaacgucggccgcgacgucaccaagcccucccccgcccccaacaccgaccgccccaucucccucuccaacgagaaggacuucgucguccgccagcgccgcggcaaggagucccuccgcuccuccccccacaagaaggcccucuga

SEQ ID NO: 45784 - RNA, 2640 nt, Artificial Sequence
  derived and/or modified sequence opt2 from MASTL__Homo_sapiens__NP_001165774
auggaccccaccgccggcuccaagaaggagcccggcggcggcgccgccaccgaggagggcgucaaccgcaucgccguccccaagccccccuccaucgaggaguucuccaucgucaagcccaucucccgcggcgccuucggcaaggucuaccucggccagaagggcggcaagcucuacgccgucaaggucgucaagaaggccgacaugaucaacaagaacaugacccaccagguccaggccgagcgcgacgcccucgcccucuccaagucccccuucaucguccaccucuacuacucccuccaguccgccaacaacgucuaccucgucauggaguaccucaucggcggcgacgucaagucccuccuccacaucuacggcuacuucgacgaggagauggccgucaaguacaucuccgaggucgcccucgcccucgacuaccuccaccgccacggcaucauccaccgcgaccucaagcccgacaacaugcucaucuccaacgagggccacaucaagcucaccgacuucggccucuccaaggucacccucaaccgcgacaucaacaugauggacauccucaccacccccuccauggccaagccccgccaggacuacucccgcacccccggccagguccucucccucaucuccucccucggcuucaacacccccaucgccgagaagaaccaggaccccgccaacauccucuccgccugccucuccgagaccucccagcucucccagggccucgucugccccauguccgucgaccagaaggacaccacccccuacuccuccaagcuccucaaguccugccucgagaccgucgccuccaaccccggcaugcccgucaagugccucaccuccaaccuccuccagucccgcaagcgccucgccaccuccuccgccuccucccagucccacaccuucaucuccuccgucgaguccgagugccacuccucccccaagugggagaaggacugccaggaguccgacgaggcccucggccccaccaugauguccuggaacgccgucgagaagcucugcgccaaguccgccaacgccaucgagaccaagggcuucaacaagaaggaccucgagcucgcccucucccccauccacaacuccuccgcccuccccaccaccggccgcuccugcgucaaccucgccaagaagugcuucuccggcgaggucuccugggaggccgucgagcucgacgucaacaacaucaacauggacaccgacaccucccagcucggcuuccaccaguccaaccagugggccgucgacuccggcggcaucuccgaggagcaccucggcaagcgcucccucaagcgcaacuucgagcucgucgacuccucccccugcaagaagaucauccagaacaagaagaccugcgucgaguacaagcacaacgagaugaccaacugcuacaccaaccagaacaccggccucaccgucgagguccaggaccucaagcucuccguccacaagucccagcagaacgacugcgccaacaaggagaacaucgucaacuccuucaccgacaagcagcagacccccgagaagcuccccauccccaugaucgccaagaaccucaugugcgagcucgacgaggacugcgagaagaacuccaagcgcgacuaccucuccuccuccuuccucugcuccgacgacgaccgcgccuccaagaacaucuccaugaacuccgacuccuccuuccccggcaucuccaucauggaguccccccucgagucccagccccucgacuccgaccgcuccaucaaggaguccuccuucgaggaguccaacaucgaggacccccucaucgucacccccgacugccaggagaagaccucccccaagggcgucgagaaccccgccguccaggaguccaaccagaagaugcucggccccccccucgagguccucaagacccucgccuccaagcgcaacgccgucgccuuccgcuccuucaacucccacaucaacgccuccaacaacuccgagcccucccgcaugaacaugaccucccucgacgccauggacaucuccugcgccuacuccggcuccuaccccauggccaucacccccacccagaagcgccgcuccugcaugccccaccagcagacccccaaccagaucaaguccggcacccccuaccgcacccccaaguccguccgccgcggcgucgcccccgucgacgacggccgcauccucggcacccccgacuaccucgcccccgagcuccuccucggccgcgcccacggccccgccgucgacuggugggcccucggcgucugccucuucgaguuccucaccggcaucccccccuucaacgacgagaccccccagcaggucuuccagaacauccucaagcgcgacauccccuggcccgagggcgaggagaagcucuccgacaacgcccaguccgccgucgagauccuccucaccaucgacgacaccaagcgcgccggcaugaaggagcucaagcgccacccccucuucuccgacgucgacugggagaaccuccagcaccagaccaugcccuucaucccccagcccgacgacgagaccgacaccuccuacuucgaggcccgcaacaccgcccagcaccucaccgucuccggcuucucccucuga

SEQ ID NO: 45785 - RNA, 1188 nt, Artificial Sequence
  derived and/or modified sequence opt2 from MAT1A__Homo_sapiens__XP_005269899
augaacggccccgucgacggccucugcgaccacucccucuccgagggcgucuucauguucaccuccgaguccgucggcgagggccaccccgacaagaucugcgaccagaucuccgacgccguccucgacgcccaccucaagcaggaccccaacgccaaggucgccugcgagaccgucugcaagaccggcaugguccuccucugcggcgagaucaccuccauggccauggucgacuaccagcgcgucguccgcgacaccaucaagcacaucggcuacgacgacuccgccaagggcuucgacuucaagaccugcaacguccucgucgcccucgagcagcagucccccgacaucgcccagugcguccaccucgaccgcaacgaggaggacgucggcgccggcgaccagggccucauguucggcuacgccaccgacgagaccgaggagugcaugccccucaccaucauccucgcccacaagcucaacgcccgcauggccgaccuccgccgcuccggccuccuccccuggcuccgccccgacuccaagacccaggucaccguccaguacaugcaggacaacggcgccgucauccccguccgcauccacaccaucgucaucuccguccagcacaacgaggacaucacccucgaggagaugcgccgcgcccucaaggagcaggucauccgcgccgucguccccgccaaguaccucgacgaggacaccgucuaccaccuccagcccuccggccgcuucgucaucggcggcccccagggcgacgccggcgucaccggccgcaagaucaucgucgacaccuacggcggcuggggcgcccacggcggcggcgccuucuccggcaaggacuacaccaaggucgaccgcuccgccgccuacgccgcccgcugggucgccaagucccucgucaaggccggccucugccgccgcguccucguccaggucuccuacgccaucggcgucgccgagccccucuccaucuccaucuucaccuacggcaccucccagaagaccgagcgcgagcuccucgacgucguccacaagaacuucgaccuccgccccggcgucaucguccgcgaccucgaccucaagaagcccaucuaccagaagaccgccugcuacggccacuucggccgcuccgaguuccccugggaggucccccgcaagcucgucuucuga

SEQ ID NO: 45786 - RNA, 1188 nt, Artificial Sequence
  derived and/or modified sequence opt2 from MAT2A__Homo_sapiens__NP_005902
augaacggccagcucaacggcuuccacgaggccuucaucgaggagggcaccuuccucuucaccuccgaguccgucggcgagggccaccccgacaagaucugcgaccagaucuccgacgccguccucgacgcccaccuccagcaggaccccgacgccaaggucgccugcgagaccgucgccaagaccggcaugauccuccucgccggcgagaucaccucccgcgccgccgucgacuaccagaaggucguccgcgaggccgucaagcacaucggcuacgacgacuccuccaagggcuucgacuacaagaccugcaacguccucgucgcccucgagcagcagucccccgacaucgcccagggcguccaccucgaccgcaacgaggaggacaucggcgccggcgaccagggccucauguucggcuacgccaccgacgagaccgaggagugcaugccccucaccaucguccucgcccacaagcucaacgccaagcucgccgagcuccgccgcaacggcacccuccccuggcuccgccccgacuccaagacccaggucaccguccaguacaugcaggaccgcggcgccguccuccccauccgcguccacaccaucgucaucuccguccagcacgacgaggaggucugccucgacgagaugcgcgacgcccucaaggagaaggucaucaaggccgucguccccgccaaguaccucgacgaggacaccaucuaccaccuccagcccuccggccgcuucgucaucggcggcccccagggcgacgccggccucaccggccgcaagaucaucgucgacaccuacggcggcuggggcgcccacggcggcggcgccuucuccggcaaggacuacaccaaggucgaccgcuccgccgccuacgccgcccgcugggucgccaagucccucgucaagggcggccucugccgccgcguccucguccaggucuccuacgccaucggcgucucccacccccucuccaucuccaucuuccacuacggcaccucccagaaguccgagcgcgagcuccucgagaucgucaagaagaacuucgaccuccgccccggcgucaucguccgcgaccucgaccucaagaagcccaucuaccagcgcaccgccgccuacggccacuucggccgcgacuccuuccccugggagguccccaagaagcucaaguacuga

SEQ ID NO: 45787 - RNA, 1005 nt, Artificial Sequence
  derived and/or modified sequence opt2 from MAT2B__Homo_sapiens__NP_037415
auggucggccgcgagaaggagcucuccauccacuucguccccggcuccugccgccucgucgaggaggaggucaacauccccaaccgccgcguccucgucaccggcgccaccggccuccucggccgcgccguccacaaggaguuccagcagaacaacuggcacgccgucggcugcggcuuccgccgcgcccgccccaaguucgagcaggucaaccuccucgacuccaacgccguccaccacaucauccacgacuuccagccccacgucaucguccacugcgccgccgagcgccgccccgacgucgucgagaaccagcccgacgccgccucccagcucaacgucgacgccuccggcaaccucgccaaggaggccgccgccgucggcgccuuccucaucuacaucuccuccgacuacgucuucgacggcaccaacccccccuaccgcgaggaggacauccccgccccccucaaccucuacggcaagaccaagcucgacggcgagaaggccguccucgagaacaaccucggcgccgccguccuccgcauccccauccucuacggcgaggucgagaagcucgaggaguccgccgucaccgucauguucgacaagguccaguucuccaacaaguccgccaacauggaccacuggcagcagcgcuuccccacccacgucaaggacgucgccaccgucugccgccagcucgccgagaagcgcaugcucgaccccuccaucaagggcaccuuccacugguccggcaacgagcagaugaccaaguacgagauggccugcgccaucgccgacgccuucaaccuccccuccucccaccuccgccccaucaccgacucccccguccucggcgcccagcgcccccgcaacgcccagcucgacugcuccaagcucgagacccucggcaucggccagcgcacccccuuccgcaucggcaucaaggagucccucuggcccuuccucaucgacaagcgcuggcgccagaccgucuuccacuga

SEQ ID NO: 45788 - RNA, 1527 nt, Artificial Sequence
  derived and/or modified sequence opt2 from MATK__Homo_sapiens__NP_002369
augcagggccacuuccccgccgagcgccgcgagggccgcccccgccgcggcacccgcggccagcagcagcuccucgucuccccccgcuuccuccgcgccuggcaccccccccccgucuccgcccgcaugcccacccgccgcugggcccccggcacccagugcaucaccaagugcgagcacacccgccccaagcccggcgagcucgccuuccgcaagggcgacgucgucaccauccucgaggccugcgagaacaaguccugguaccgcgucaagcaccacaccuccggccaggagggccuccucgccgccggcgcccuccgcgagcgcgaggcccucuccgccgaccccaagcucucccucaugcccugguuccacggcaagaucuccggccaggaggccguccagcagcuccagccccccgaggacggccucuuccucguccgcgaguccgcccgccaccccggcgacuacguccucugcgucuccuucggccgcgacgucauccacuaccgcguccuccaccgcgacggccaccucaccaucgacgaggccgucuucuucugcaaccucauggacauggucgagcacuacuccaaggacaagggcgccaucugcaccaagcucguccgccccaagcgcaagcacggcaccaaguccgccgaggaggagcucgcccgcgccggcuggcuccucaaccuccagcaccucacccucggcgcccagaucggcgagggcgaguucggcgccguccuccagggcgaguaccucggccagaaggucgccgucaagaacaucaagugcgacgucaccgcccaggccuuccucgacgagaccgccgucaugaccaagaugcagcacgagaaccucguccgccuccucggcgucauccuccaccagggccucuacaucgucauggagcacgucuccaagggcaaccucgucaacuuccuccgcacccgcggccgcgcccucgucaacaccgcccagcuccuccaguucucccuccacgucgccgagggcauggaguaccucgaguccaagaagcucguccaccgcgaccucgccgcccgcaacauccucgucuccgaggaccucgucgccaaggucuccgacuucggccucgccaaggccgagcgcaagggccucgacuccucccgccuccccgucaaguggaccgcccccgaggcccucaagcacggcaaguucaccuccaaguccgacgucugguccuucggcguccuccucugggaggucuucuccuacggccgcgcccccuaccccaagaugucccucaaggaggucuccgaggccgucgagaagggcuaccgcauggagccccccgagggcugccccggccccguccacguccucauguccuccugcugggaggccgagcccgcccgccgcccccccuuccgcaagcucgccgagaagcucgcccgcgagcuccgcuccgccggcgcccccgccuccgucuccggccaggacgccgacggcuccaccuccccccgcucccaggagcccuga

SEQ ID NO: 45789 - RNA, 2871 nt, Artificial Sequence
  derived and/or modified sequence opt2 from MATN2__Homo_sapiens__NP_002371
auggagaagaugcucgccggcugcuuccuccucauccucggccagaucguccuccuccccgccgaggcccgcgagcgcucccgcggccgcuccaucucccgcggccgccacgcccgcacccacccccagaccgcccuccucgaguccuccugcgagaacaagcgcgccgaccucgucuucaucaucgacuccucccgcuccgucaacacccacgacuacgccaaggucaaggaguucaucgucgacauccuccaguuccucgacaucggccccgacgucacccgcgucggccuccuccaguacggcuccaccgucaagaacgaguucucccucaagaccuucaagcgcaaguccgaggucgagcgcgccgucaagcgcaugcgccaccucuccaccggcaccaugaccggccucgccauccaguacgcccucaacaucgccuucuccgaggccgagggcgcccgcccccuccgcgagaacgucccccgcgucaucaugaucgucaccgacggccgcccccaggacuccgucgccgaggucgccgccaaggcccgcgacaccggcauccucaucuucgccaucggcgucggccaggucgacuucaacacccucaaguccaucggcuccgagccccacgaggaccacgucuuccucgucgccaacuucucccagaucgagacccucaccuccgucuuccagaagaagcucugcaccgcccacaugugcuccacccucgagcacaacugcgcccacuucugcaucaacauccccggcuccuacgucugccgcugcaagcagggcuacauccucaacuccgaccagaccaccugccgcauccaggaccucugcgccauggaggaccacaacugcgagcagcucugcgucaacguccccggcuccuucgucugccagugcuacuccggcuacgcccucgccgaggacggcaagcgcugcgucgccgucgacuacugcgccuccgagaaccacggcugcgagcacgagugcgucaacgccgacggcuccuaccucugccagugccacgagggcuucgcccucaaccccgacaagaagaccugcaccaagaucgacuacugcgccuccuccaaccacggcugccagcacgagugcgucaacaccgacgacuccuacuccugccacugccucaagggcuucacccucaaccccgacaagaagaccugccgccgcaucaacuacugcgcccucaacaagcccggcugcgagcacgagugcgucaacauggaggaguccuacuacugccgcugccaccgcggcuacacccucgaccccaacggcaagaccugcucccgcgucgaccacugcgcccagcaggaccacggcugcgagcagcucugccucaacaccgaggacuccuucgucugccagugcuccgagggcuuccucaucaacgaggaccucaagaccugcucccgcgucgacuacugccuccucuccgaccacggcugcgaguacuccugcgucaacauggaccgcuccuucgccugccagugccccgagggccacguccuccgcuccgacggcaagaccugcgccaagcucgacuccugcgcccucggcgaccacggcugcgagcacuccugcgucuccuccgaggacuccuucgucugccagugcuucgagggcuacauccuccgcgaggacggcaagaccugccgccgcaaggacgucugccaggccaucgaccacggcugcgagcacaucugcgucaacuccgacgacuccuacaccugcgagugccucgagggcuuccgccucgccgaggacggcaagcgcugccgccgcaaggacgucugcaaguccacccaccacggcugcgagcacaucugcgucaacaacggcaacuccuacaucugcaagugcuccgagggcuucguccucgccgaggacggccgccgcugcaagaagugcaccgagggccccaucgaccucgucuucgucaucgacggcuccaagucccucggcgaggagaacuucgaggucgucaagcaguucgucaccggcaucaucgacucccucaccaucucccccaaggccgcccgcgucggccuccuccaguacuccacccagguccacaccgaguucacccuccgcaacuucaacuccgccaaggacaugaagaaggccgucgcccacaugaaguacaugggcaagggcuccaugaccggccucgcccucaagcacauguucgagcgcuccuucacccagggcgagggcgcccgcccccucuccacccgcgucccccgcgccgccaucgucuucaccgacggccgcgcccaggacgacgucuccgagugggccuccaaggccaaggccaacggcaucaccauguacgccgucggcgucggcaaggccaucgaggaggagcuccaggagaucgccuccgagcccaccaacaagcaccucuucuacgccgaggacuucuccaccauggacgagaucuccgagaagcucaagaagggcaucugcgaggcccucgaggacuccgacggccgccaggacucccccgccggcgagcuccccaagaccguccagcagcccaccgaguccgagcccgucaccaucaacauccaggaccuccucuccugcuccaacuucgccguccagcaccgcuaccucuucgaggaggacaaccuccuccgcuccacccagaagcucucccacuccaccaagcccuccggcuccccccucgaggagaagcacgaccagugcaagugcgagaaccucaucauguuccagaaccucgccaacgaggagguccgcaagcucacccagcgccucgaggagaugacccagcgcauggaggcccucgagaaccgccuccgcuaccgcuga

SEQ ID NO: 45790 - RNA, 1461 nt, Artificial Sequence
  derived and/or modified sequence opt2 from MATN3__Homo_sapiens__NP_002372
augccccgccccgcccccgcccgccgccuccccggccuccuccuccuccucuggccccuccuccuccuccccuccgccgcccccgaccccgucgcccgccccggcuuccgccgccucgagacccgcggccccggcggcucccccggccgccgccccucccccgccgcccccgacggcgcccccgccuccggcaccuccgagcccggccgcgcccgcggcgccggcgucugcaagucccgcccccucgaccucgucuucaucaucgacuccucccgcuccguccgcccccucgaguucaccaaggucaagaccuucgucucccgcaucaucgacacccucgacaucggccccgccgacacccgcgucgccgucgucaacuacgccuccaccgucaagaucgaguuccagcuccaggccuacaccgacaagcagucccucaagcaggccgucggccgcaucaccccccucuccaccggcaccauguccggccucgccauccagaccgccauggacgaggccuucaccgucgaggccggcgcccgcgagcccuccuccaacauccccaaggucgccaucaucgucaccgacggccgcccccaggaccaggucaacgaggucgccgcccgcgcccaggccuccggcaucgagcucuacgccgucggcgucgaccgcgccgacauggccucccucaagaugauggccuccgagccccucgaggagcacgucuucuacgucgagaccuacggcgucaucgagaagcucuccucccgcuuccaggagaccuucugcgcccucgaccccugcguccucggcacccaccagugccagcacgucugcaucuccgacggcgagggcaagcaccacugcgagugcucccagggcuacacccucaacgccgacaagaagaccugcuccgcccucgaccgcugcgcccucaacacccacggcugcgagcacaucugcgucaacgaccgcuccggcuccuaccacugcgagugcuacgagggcuacacccucaacgaggaccgcaagaccugcuccgcccaggacaagugcgcccucggcacccacggcugccagcacaucugcgucaacgaccgcaccggcucccaccacugcgagugcuacgagggcuacacccucaacgccgacaagaagaccugcuccguccgcgacaagugcgcccucggcucccacggcugccagcacaucugcgucuccgacggcgccgccuccuaccacugcgacugcuaccccggcuacacccucaacgaggacaagaagaccugcuccgccaccgaggaggcccgccgccucgucuccaccgaggacgccugcggcugcgaggccacccucgccuuccaggacaaggucuccuccuaccuccagcgccucaacaccaagcucgacgacauccucgagaagcucaagaucaacgaguacggccagauccaccgcuga

SEQ ID NO: 45791 - RNA, 2544 nt, Artificial Sequence
  derived and/or modified sequence opt2 from MATR3__Homo_sapiens__NP_001181883
auguccaaguccuuccagcaguccucccucucccgcgacucccagggccacggccgcgaccucuccgccgccggcaucggccuccucgccgccgccacccagucccucuccaugcccgccucccucggccgcaugaaccagggcaccgcccgccucgccucccucaugaaccucggcauguccuccucccucaaccagcagggcgcccacuccgcccucuccuccgccuccaccuccucccacaaccuccaguccaucuucaacaucggcucccgcggcccccucccccucuccucccagcaccgcggcgacgccgaccaggccuccaacauccucgccuccuucggccucuccgcccgcgaccucgacgagcucucccgcuaccccgaggacaagaucacccccgagaaccucccccagauccuccuccagcucaagcgccgccgcaccgaggagggccccacccucuccuacggccgcgacggccgcuccgccacccgcgagccccccuaccgcgucccccgcgacgacugggaggagaagcgccacuuccgccgcgacuccuucgacgaccgcggccccucccucaaccccguccucgacuacgaccacggcucccgcucccaggaguccggcuacuacgaccgcauggacuacgaggacgaccgccuccgcgacggcgagcgcugccgcgacgacuccuucuucggcgagaccucccacaacuaccacaaguucgacuccgaguacgagcgcaugggccgcggccccggcccccuccaggagcgcucccucuucgagaagaagcgcggcgccccccccuccuccaacaucgaggacuuccacggccuccuccccaagggcuacccccaccucugcuccaucugcgaccuccccguccacuccaacaaggaguggucccagcacaucaacggcgccucccacucccgccgcugccagcuccuccucgagaucuaccccgaguggaaccccgacaacgacaccggccacaccaugggcgaccccuucaugcuccagcaguccaccaaccccgcccccggcauccucggcccccccccccccuccuuccaccucggcggccccgccgucggcccccgcggcaaccucggcgccggcaacggcaaccuccagggcccccgccacaugcagaagggccgcgucgagaccucccgcgucguccacaucauggacuuccagcgcggcaagaaccuccgcuaccagcuccuccagcucgucgagcccuucggcgucaucuccaaccaccucauccucaacaagaucaacgaggccuucaucgagauggccaccaccgaggacgcccaggccgccgucgacuacuacaccaccacccccgcccucgucuucggcaagcccguccgcguccaccucucccagaaguacaagcgcaucaagaagcccgagggcaagcccgaccagaaguucgaccagaagcaggagcucggccgcgucauccaccucuccaaccucccccacuccggcuacuccgacuccgccguccucaagcucgccgagcccuacggcaagaucaagaacuacauccucaugcgcaugaagucccaggccuucaucgagauggagacccgcgaggacgccauggccauggucgaccacugccucaagaaggcccucugguuccagggccgcugcgucaaggucgaccucuccgagaaguacaagaagcucguccuccgcauccccaaccgcggcaucgaccuccucaagaaggacaagucccgcaagcgcuccuacucccccgacggcaaggagucccccuccgacaagaaguccaagaccgacggcucccagaagaccgaguccuccaccgagggcaaggagcaggaggagaaguccggcgaggacggcgagaaggacaccaaggacgaccagaccgagcaggagcccaacaugcuccucgaguccgaggacgagcuccucgucgacgaggaggaggccgccgcccuccucgaguccggcuccuccgucggcgacgagaccgaccucgccaaccucggcgacgucgccuccgacggcaagaaggagcccuccgacaaggccgucaagaaggacggcuccgccuccgccgccgccaagaagaagcucaagaaggucgacaagaucgaggagcucgaccaggagaacgaggccgcccucgagaacggcaucaagaacgaggagaacaccgagcccggcgccgaguccuccgagaacgccgacgaccccaacaaggacaccuccgagaacgccgacggccaguccgacgagaacaaggacgacuacaccauccccgacgaguaccgcaucggccccuaccagcccaacguccccgucggcaucgacuacgucauccccaagaccggcuucuacugcaagcucugcucccucuucuacaccaacgaggaggucgccaagaacacccacugcuccucccucccccacuaccagaagcucaagaaguuccucaacaagcucgccgaggagcgccgccagaagaaggagaccuga

SEQ ID NO: 45792 - RNA, 1842 nt, Artificial Sequence
  derived and/or modified sequence opt2 from MAU2__Homo_sapiens__NP_056144
auggccgcccaggccgccgccgccgcccaggccgccgccgcccaggccgcccaggccgaggccgccgacuccugguaccucgcccuccucggcuucgccgagcacuuccgcaccuccuccccccccaagauccgccucugcguccacugccuccaggccgucuuccccuucaagcccccccagcgcaucgaggcccgcacccaccuccagcucggcuccguccucuaccaccacaccaagaacuccgagcaggcccgcucccaccucgagaaggccuggcucaucucccagcagaucccccaguucgaggacgucaaguucgaggccgccucccuccucuccgagcucuacugccaggagaacuccgucgacgccgccaagccccuccuccgcaaggccauccagaucucccagcagacccccuacuggcacugccgccuccucuuccagcucgcccagcuccacacccucgagaaggaccucgucuccgccugcgaccuccucggcgucggcgccgaguacgcccgcgucgucggcuccgaguacacccgcgcccucuuccuccucuccaagggcaugcuccuccucauggagcgcaagcuccaggagguccacccccuccucacccucugcggccagaucgucgagaacuggcagggcaaccccauccagaaggagucccuccgcgucuucuuccucguccuccaggucacccacuaccucgacgccggccaggucaaguccgucaagcccugccucaagcagcuccagcagugcauccagaccaucuccacccuccacgacgacgagauccuccccuccaaccccgccgaccucuuccacuggcuccccaaggagcacaugugcguccucgucuaccucgucaccgucaugcacuccaugcaggccggcuaccucgagaaggcccagaaguacaccgacaaggcccucaugcagcucgagaagcucaagaugcucgacugcucccccauccucuccuccuuccaggucauccuccucgagcacaucaucaugugccgccucgucaccggccacaaggccaccgcccuccaggagaucucccaggucugccagcucugccagcaguccccccgccucuucuccaaccacgccgcccagcuccacacccuccucggccucuacugcgucuccgucaacugcauggacaacgccgaggcccaguucaccaccgcccuccgccucaccaaccaccaggagcucugggccuucaucgucaccaaccucgccuccgucuacauccgcgagggcaaccgccaccaggagguccucuacucccuccucgagcgcaucaaccccgaccacuccuuccccgucuccucccacugccuccgcgccgccgccuucuacguccgcggccucuucuccuucuuccagggccgcuacaacgaggccaagcgcuuccuccgcgagacccucaagauguccaacgccgaggaccucaaccgccucaccgccugcucccucguccuccucggccacaucuucuacguccucggcaaccaccgcgaguccaacaacauggucguccccgccaugcagcucgccuccaagauccccgacauguccguccagcucugguccuccgcccuccuccgcgaccucaacaaggccugcggcaacgccauggacgcccacgaggccgcccagaugcaccagaacuucucccagcagcuccuccaggaccacaucgaggccugcucccuccccgagcacaaccucaucaccuggaccgacggccccccccccguccaguuccaggcccagaacggccccaacaccucccucgccucccuccucuga

SEQ ID NO: 45793 - RNA, 1200 nt, Artificial Sequence
  derived and/or modified sequence opt2 from MAVS__Homo_sapiens__NP_001193420
augcccguccaggagacccaggcccccgagucccccggcgagaacuccgagcaggcccuccagacccucuccccccgcgccaucccccgcaaccccgacggcggcccccucgaguccuccuccgaccucgccgcccucuccccccucaccuccuccggccaccaggagcaggacaccgagcucggcuccacccacaccgccggcgccaccuccucccucacccccucccgcggccccgucucccccuccgucuccuuccagccccucgcccgcuccaccccccgcgccucccgccuccccggccccaccggcuccgucgucuccaccggcaccuccuucuccuccuccucccccggccucgccuccgccggcgccgccgagggcaagcagggcgccgaguccgaccaggccgagcccaucaucugcuccuccggcgccgaggcccccgccaacucccuccccuccaagguccccaccacccucaugcccgucaacaccgucgcccucaagguccccgccaaccccgccuccgucuccaccguccccuccaagcuccccaccuccuccaagccccccggcgccguccccuccaacgcccucaccaaccccgcccccuccaagcuccccaucaacuccacccgcgccggcaugguccccuccaagguccccaccuccaugguccucaccaaggucuccgccuccaccguccccaccgacggcuccucccgcaacgaggagacccccgccgcccccacccccgccggcgccaccggcggcuccuccgccuggcucgacuccuccuccgagaaccgcggccucggcuccgagcucuccaagcccggcguccucgccucccaggucgacucccccuucuccggcugcuucgaggaccucgccaucuccgccuccaccucccucggcaugggccccugccacggccccgaggagaacgaguacaaguccgagggcaccuucggcauccacgucgccgagaaccccuccauccagcuccucgagggcaaccccggcccccccgccgaccccgacggcggcccccgcccccaggccgaccgcaaguuccaggagcgcgagguccccugccaccgccccucccccggcgcccucuggcuccaggucgccgucaccggcguccucgucgucacccuccucgucguccucuaccgccgccgccuccacuga

SEQ ID NO: 45794 - RNA, 483 nt, Artificial Sequence
  derived and/or modified sequence opt2 from MAX__Homo_sapiens__NP_002373
auguccgacaacgacgacaucgaggucgaguccgacgaggagcagccccgcuuccaguccgccgccgacaagcgcgcccaccacaacgcccucgagcgcaagcgccgcgaccacaucaaggacuccuuccacucccuccgcgacuccguccccucccuccagggcgagaaggccucccgcgcccagauccucgacaaggccaccgaguacauccaguacaugcgccgcaagaaccacacccaccagcaggacaucgacgaccucaagcgccagaacgcccuccucgagcagcagguccgcgcccucgagaaggcccgcuccuccgcccagcuccagaccaacuaccccuccuccgacaacucccucuacaccaacgccaagggcuccaccaucuccgccuucgacggcggcuccgacuccuccuccgaguccgagcccgaggagccccagucccgcaagaagcuccgcauggaggccuccuga

SEQ ID NO: 45795 - RNA, 1482 nt, Artificial Sequence
  derived and/or modified sequence opt2 from MAZ__Homo_sapiens__NP_001036004
auguuccccgucuuccccugcacccuccucgccccccccuuccccguccucggccucgacucccgcggcgucggcggccucaugaacuccuucccccccccccagggccacgcccagaacccccuccaggucggcgccgagcuccagucccgcuucuucgccucccagggcugcgcccagucccccuuccaggccgcccccgcccccccccccaccccccaggcccccgccgccgagccccuccaggucgaccuccuccccguccucgccgccgcccaggaguccgccgccgccgccgccgccgccgccgccgccgccgccgccgucgccgccgccccccccgcccccgccgccgccuccaccgucgacaccgccgcccucaagcagccccccgcccccccccccccccccccccccgucuccgcccccgccgccgaggccgccccccccgccuccgccgccaccaucgccgccgccgccgccaccgccgucgucgcccccaccuccaccgucgccgucgcccccgucgccuccgcccucgagaagaagaccaaguccaagggccccuacaucugcgcccucugcgccaaggaguucaagaacggcuacaaccuccgccgccacgaggccauccacaccggcgccaaggccggccgcguccccuccggcgccaugaagaugcccaccauggucccccucucccuccucuccgucccccagcucuccggcgccggcggcggcggcggcgaggccggcgccggcggcggcgccgccgccgucgccgccggcggcgucgucaccaccaccgccuccggcaagcgcauccgcaagaaccacgccugcgagaugugcggcaaggccuuccgcgacgucuaccaccucaaccgccacaagcucucccacuccgacgagaagcccuaccagugccccgucugccagcagcgcuucaagcgcaaggaccgcauguccuaccacguccgcucccacgacggcgccguccacaagcccuacaacugcucccacugcggcaaguccuucucccgccccgaccaccucaacucccacguccgccagguccacuccaccgagcgccccuucaagugcgagaagugcgaggccgccuucgccaccaaggaccgccuccgcgcccacaccguccgccacgaggagaagguccccugccacgucugcggcaagaugcucuccuccgccuacaucuccgaccacaugaagguccacucccagggcccccaccacgucugcgagcucugcaacaagggcuucaccaccgccgccuaccuccgcauccacgccgucaaggaccacggccuccaggccccccgcgccgaccgcauccucugcaagcucugcuccguccacugcaagacccccgcccagcucgccggccacaugcagacccaccucggcggcgccgccccccccguccccggcgacgccccccagccccagcccaccugcuga

SEQ ID NO: 45796 - RNA, 1569 nt, Artificial Sequence
  derived and/or modified sequence opt2 from MB21D1__Homo_sapiens__NP_612450
augcagcccuggcacggcaaggccaugcagcgcgccuccgaggccggcgccaccgcccccaaggccuccgcccgcaacgcccgcggcgcccccauggaccccaccgagucccccgccgcccccgaggccgcccuccccaaggccggcaaguucggccccgcccgcaaguccggcucccgccagaagaaguccgcccccgacacccaggagcgcccccccguccgcgccaccggcgcccgcgccaagaaggccccccagcgcgcccaggacacccagcccuccgacgccaccuccgcccccggcgccgagggccucgagccccccgccgcccgcgagcccgcccucucccgcgccggcuccugccgccagcgcggcgcccgcugcuccaccaagccccgccccccccccggccccugggacguccccucccccggccuccccgucuccgcccccauccucguccgccgcgacgccgcccccggcgccuccaagcuccgcgccguccucgagaagcucaagcucucccgcgacgacaucuccaccgccgccggcauggucaagggcgucgucgaccaccuccuccuccgccucaagugcgacuccgccuuccgcggcgucggccuccucaacaccggcuccuacuacgagcacgucaagaucuccgcccccaacgaguucgacgucauguucaagcucgaggucccccgcauccagcucgaggaguacuccaacacccgcgccuacuacuucgucaaguucaagcgcaaccccaaggagaacccccucucccaguuccucgagggcgagauccucuccgccuccaagaugcucuccaaguuccgcaagaucaucaaggaggagaucaacgacaucaaggacaccgacgucaucaugaagcgcaagcgcggcggcucccccgccgucacccuccucaucuccgagaagaucuccgucgacaucacccucgcccucgaguccaaguccuccuggcccgccuccacccaggagggccuccgcauccagaacuggcucuccgccaagguccgcaagcagcuccgccucaagcccuucuaccucguccccaagcacgccaaggagggcaacggcuuccaggaggagaccuggcgccucuccuucucccacaucgagaaggagauccucaacaaccacggcaaguccaagaccugcugcgagaacaaggaggagaagugcugccgcaaggacugccucaagcucaugaaguaccuccucgagcagcucaaggagcgcuucaaggacaagaagcaccucgacaaguucuccuccuaccacgucaagaccgccuucuuccacgucugcacccagaacccccaggacucccagugggaccgcaaggaccucggccucugcuucgacaacugcgucaccuacuuccuccagugccuccgcaccgagaagcucgagaacuacuucauccccgaguucaaccucuucuccuccaaccucaucgacaagcgcuccaaggaguuccucaccaagcagaucgaguacgagcgcaacaacgaguuccccgucuucgacgaguucuga

SEQ ID NO: 45797 - RNA, 1476 nt, Artificial Sequence
  derived and/or modified sequence opt2 from MB21D2__Homo_sapiens__NP_848591
augaagauggccgcccccaccgccaacaaggccgccucccucggcugcaacaacaagcccgccuuccccgagcucgacuuccgcuccggcgcccgcgucgaggagcucaacaagcucauccaggaguucaccaagcacgaccagcgcgaguacgacgaccagcgcgcccucgagauccacaccgccaaggacuucaucuucuccaugcucggcaugguccagaagcucgaccagaagcuccccgucgccaacgaguaccuccuccucuccggcggcguccgcgagggcgucgucgaccucgaccucgacgagcucaacgucuacgcccgcggcaccgacuacgacauggacuucacccuccucguccccgcccucaagcuccacgaccgcaaccagcccgucacccucgacaugcgccacuccgcccucugccacuccuggcucucccuccgccucuucgacgagggcaccaucuccaaguggaaggacugcugcaccaucgucgaccacaucaacggcgccaccaacuacuucuucucccccaccaaggucgccgacugguucuacgacuccaucuccaucguccucuccgagauccagaagaagccccagcgcggcaugcccaaggucgagaaggucgagaagaacggcaccaucaucuccaucauccucggcgucggcuccucccgcaugcucuacgacaucguccccgucgucuccuucaagggcuggcccgccgucgcccaguccuggcucauggagaaccacuucugggacggcaagaucaccgaggaggaggucaucuccggcuucuaccucguccccgccugcuccuacaagggcaagaaggacaacgaguggcgccucuccuucgcccgcuccgagguccagcucaagaagugcaucuccuccucccucaugcaggccuaccaggccugcaaggccaucaucaucaagcuccucucccgccccaaggccaucucccccuaccaccuccgcuccaugaugcucugggccugcgaccgccuccccgccaacuaccucgcccaggaggacuacgccgcccacuuccuccucggccucaucgacgaccuccagcacugccucgucaacaagaugugccccaacuacuucaucccccagugcaacaugcucgagcaccucuccgaggagaccgucaugcuccacgcccgcaagcucuccuccguccgcuccgaccccgccgagcaccuccgcaccgccaucgagcacgucaaggccgccaaccgccucacccucgagcuccagcgccgcggcuccaccaccuccauccccuccccccaguccgacggcggcgaccccaaccagcccgacgaccgccucgccaagaagcuccagcagcucgucaccgagaaccccggcaaguccaucuccgucuucaucaaccccgacgacgucacccgcccccacuuccgcaucgacgacaaguucuucuga

SEQ ID NO: 45798 - RNA, 1968 nt, Artificial Sequence
  derived and/or modified sequence opt2 from MBD1__Homo_sapiens__NP_001191065
auggccgaggacuggcucgacugccccgcccucggccccggcuggaagcgccgcgaggucuuccgcaaguccggcgccaccugcggccgcuccgacaccuacuaccagucccccaccggcgaccgcauccgcuccaaggucgagcucacccgcuaccucggccccgccugcgaccucacccucuucgacuucaagcagggcauccucugcuaccccgcccccaaggcccaccccgucgccgucgccuccaagaagcgcaagaagcccucccgccccgccaagacccgcaagcgccaggucggcccccaguccggcgagguccgcaaggaggccccccgcgacgagaccaaggccgacaccgacaccgcccccgccuccuuccccgcccccggcugcugcgagaacugcggcaucuccuucuccggcgacggcacccagcgccagcgccucaagacccucugcaaggacugccgcgcccagcgcaucgccuucaaccgcgagcagcgcauguucaagcgcgucggcugcggcgagugcgccgccugccaggucaccgaggacugcggcgccugcuccaccugccuccuccagcucccccacgacgucgccuccggccucuucugcaagugcgagcgccgccgcugccuccgcaucgucgagcgcucccgcggcugcggcgucugccgcggcugccagacccaggaggacugcggccacugccccaucugccuccgccccccccgccccggccuccgccgccaguggaagugcguccagcgccgcugccuccgcggcaagcacgcccgccgcaagggcggcugcgacuccaagauggccgcccgccgccgccccggcgcccagccccuccccccccccccccccucccagucccccgagcccaccgagccccacccccgcgcccucgcccccuccccccccgccgaguucaucuacuacugcgucgacgaggacgagcuccagcccuacaccaaccgccgccagaaccgcaagugcggcgccugcgccgccugccuccgccgcauggacugcggccgcugcgacuucugcugcgacaagcccaaguucggcggcuccaaccagaagcgccagaagugccgcuggcgccagugccuccaguucgccaugaagcgccuccuccccuccgucugguccgaguccgaggacggcgccggcucccccccccccuaccgccgccgcaagcgccccuccuccgcccgccgccaccaccucggccccacccucaagcccacccucgccacccgcaccgcccagcccgaccacacccaggcccccaccaagcaggaggccggcggcggcuucguccuccccccccccggcaccgaccucgucuuccuccgcgagggcgccuccucccccguccagguccccggccccgucgccgccuccaccgaggcccuccuccaggaggcccagugcuccggccucuccugggucgucgcccucccccaggucaagcaggagaaggccgacacccaggacgaguggacccccggcaccgccguccucaccucccccguccucguccccggcugccccuccaaggccgucgaccccggccuccccuccgucaagcaggagccccccgaccccgaggaggacaaggaggagaacaaggacgacuccgccuccaagcucgcccccgaggaggaggccggcggcgccggcacccccgucaucaccgagaucuucucccucggcggcacccgcuuccgcgacaccgccgucuggcuccccucccuccagggccgccacuccggccgcgaggacggcugcaaggucugggagaccgaggacaccgucgagcccaccuccaccuccuggaacccccgcggcuggcccggcacccacgucucccucucccccccccccgccuccaugaugugggucuccugccgccgcuccuggugccccuccucccaguccuga

SEQ ID NO: 45799 - RNA, 1236 nt, Artificial Sequence
  derived and/or modified sequence opt2 from MBD2__Homo_sapiens__NP_003918
augcgcgcccaccccggcggcggccgcugcugccccgagcaggaggagggcgaguccgccgccggcggcuccggcgccggcggcgacuccgccaucgagcagggcggccagggcuccgcccucgcccccucccccgucuccggcguccgccgcgagggcgcccgcggcggcggccgcggccgcggccgcuggaagcaggccggccgcggcggcggcgucugcggccgcggccgcggccgcggccgcggccgcggccgcggccgcggccgcggccgcggccgcggccgcccccccuccggcggcuccggccucggcggcgacggcggcggcugcggcggcggcggcuccggcggcggcggcgccccccgccgcgagcccguccccuuccccuccggcuccgccggccccggcccccgcggcccccgcgccaccgaguccggcaagcgcauggacugccccgcccucccccccggcuggaagaaggaggaggucauccgcaaguccggccucuccgccggcaaguccgacgucuacuacuucucccccuccggcaagaaguuccgcuccaagccccagcucgcccgcuaccucggcaacaccgucgaccucuccuccuucgacuuccgcaccggcaagaugaugcccuccaagcuccagaagaacaagcagcgccuccgcaacgacccccucaaccagaacaagggcaagcccgaccucaacaccacccuccccauccgccagaccgccuccaucuucaagcagcccgucaccaaggucaccaaccaccccuccaacaaggucaaguccgacccccagcgcaugaacgagcagccccgccagcucuucugggagaagcgccuccagggccucuccgccuccgacgucaccgagcagaucaucaagaccauggagcuccccaagggccuccagggcgucggccccggcuccaacgacgagacccuccucuccgccgucgccuccgcccuccacaccuccuccgcccccaucaccggccaggucuccgccgccgucgagaagaaccccgccgucuggcucaacaccucccagccccucugcaaggccuucaucgucaccgacgaggacauccgcaagcaggaggagcgcguccagcagguccgcaagaagcucgaggaggcccucauggccgacauccucucccgcgccgccgacaccgaggagauggacaucgagauggacuccggcgacgaggccuga

SEQ ID NO: 45800 - RNA, 876 nt, Artificial Sequence
  derived and/or modified sequence opt2 from MBD3__Homo_sapiens__NP_001268382
auggagcgcaagcgcugggagugccccgcccucccccagggcugggagcgcgaggaggucccccgccgcuccggccucuccgccggccaccgcgacgucuucuacuacucccccuccggcaagaaguuccgcuccaagccccagcucgcccgcuaccucggcggcuccauggaccucuccaccuucgacuuccgcaccggcaagaugcucauguccaagaugaacaagucccgccagcgcguccgcuacgacuccuccaaccaggucaagggcaagcccgaccucaacaccgcccuccccguccgccagaccgccuccaucuucaagcagcccgucaccaagaucaccaaccaccccuccaacaaggucaaguccgacccccagaaggccgucgaccagccccgccagcucuucugggagaagaagcucuccggccucaacgccuucgacaucgccgaggagcucgucaagaccauggaccuccccaagggccuccagggcgucggccccggcugcaccgacgagacccuccucuccgccaucgccuccgcccuccacaccuccaccaugcccaucaccggccagcucuccgccgccgucgagaagaaccccggcgucuggcucaacaccacccagccccucugcaaggccuucauggucaccgacgaggacauccgcaagcaggaggagcucguccagcagguccgcaagcgccucgaggaggcccucauggccgacaugcucgcccacgucgaggagcucgcccgcgacggcgaggccccccucgacaaggccugcgccgaggacgacgacgaggaggacgaggaggaggaggaggaggagcccgaccccgaccccgagauggagcacgucuga

SEQ ID NO: 45801 - RNA, 627 nt, Artificial Sequence
  derived and/or modified sequence opt2 from MBD3L2__Homo_sapiens__NP_653215
augggcgagcccgccuucaccuccuuccccucccuccccguccucggcaagcucaagcgcaacaugaugcccugggcccuccagaagaagcgcgagauccacauggccaaggcccaccgccgccgcgccgcccgcuccgcccuccccaugcgccucaccuccugcaucuuccgccgccccgucacccgcauccgcucccaccccgacaaccagguccgccgccgcaagggcgacgagcaccucgagaagccccagcagcucugcgccuaccgccgccuccaggcccuccagcccugcuccucccagggcgagggcuccuccccccuccaccucgaguccguccucuccauccucgcccccggcaccgccggcgagucccucgaccgcgccggcgccgagcgcguccgcuccccccucgagcccacccccggccgcuuccccgccgucgccggcggccccacccccggcaugggcugccagcucccccccccccucuccggccagcucgucacccccgccgacauccgccgccaggcccgccgcgucaagaaggcccgcgagcgccucgccaaggcccuccaggccgaccgccucgcccgccgcgccgagaugcucaccggcggcuga

SEQ ID NO: 45802 - RNA, 1725 nt, Artificial Sequence
  derived and/or modified sequence opt2 from MBD4__Homo_sapiens__NP_001263199
augggcaccaccggccucgagucccucucccucggcgaccgcggcgccgcccccaccgucaccuccuccgagcgccucguccccgacccccccaacgaccuccgcaaggaggacgucgccauggagcucgagcgcgucggcgaggacgaggagcagaugaugaucaagcgcuccuccgagugcaacccccuccuccaggagcccaucgccuccgcccaguucggcgccaccgccggcaccgagugccgcaaguccguccccugcggcugggagcgcgucgucaagcagcgccucuucggcaagaccgccggccgcuucgacgucuacuucaucuccccccagggccucaaguuccgcuccaaguccucccucgccaacuaccuccacaagaacggcgagaccucccucaagcccgaggacuucgacuucaccguccucuccaagcgcggcaucaagucccgcuacaaggacugcuccauggccgcccucaccucccaccuccagaaccaguccaacaacuccaacuggaaccuccgcacccgcuccaagugcaagaaggacgucuucaugccccccuccuccuccuccgagcuccaggagucccgcggccucuccaacuucaccuccacccaccuccuccucaaggaggacgagggcgucgacgacgucaacuuccgcaagguccgcaagcccaagggcaaggucaccauccucaagggcauccccaucaagaagaccaagaagggcugccgcaaguccugcuccggcuucguccaguccgacuccaagcgcgaguccgucugcaacaaggccgacgccgaguccgagcccgucgcccagaagucccagcucgaccgcaccgucugcaucuccgacgccggcgccugcggcgagacccucuccgucaccuccgaggagaacucccucgucaagaagaaggagcgcucccucuccuccggcuccaacuucugcuccgagcagaagaccuccggcaucaucaacaaguucugcuccgccaaggacuccgagcacaacgagaaguacgaggacaccuuccucgaguccgaggagaucggcaccaaggucgaggucgucgagcgcaaggagcaccuccacaccgacauccucaagcgcggcuccgagauggacaacaacugcucccccacccgcaaggacuucaccgaggacaccaucccccgcacccagaucgagcgccgcaagaccucccucuacuucuccuccaaguacaacaaggaggcccucucccccccccgccgcaaggccuucaagaaguggacccccccccgcucccccuucaaccucguccaggagacccucuuccacgaccccuggaagcuccucaucgccaccaucuuccucaaccgcaccuccggcaagauggccauccccguccucuggaaguuccucgagaaguaccccuccgccgaggucgcccgcaccgccgacuggcgcgacgucuccgagcuccucaagccccucggccucuacgaccuccgcgccaagaccaucgucaaguucuccgacgaguaccucaccaagcaguggaaguaccccaucgagcuccacggcaucggcaaguacggcaacgacuccuaccgcaucuucugcgucaacgaguggaagcagguccaccccgaggaccacaagcucaacaaguaccacgacuggcucugggagaaccacgagaagcucucccucuccuga

SEQ ID NO: 45803 - RNA, 4485 nt, Artificial Sequence
  derived and/or modified sequence opt2 from MBD5__Homo_sapiens__NP_060798
augaacggcggcaaggagugcgacggcggcgacaaggagggcggccuccccgccauccagguccccgucggcuggcagcgccgcgucgaccagaacggcguccucuacgucucccccuccggcucccuccucuccugccucgagcaggucaagaccuaccuccucaccgacggcaccugcaagugcggccucgagugcccccucauccuccccaaggucuucaacuucgaccccggcgccgccgucaagcagcgcaccgccgaggacgucaaggccgacgaggacgucaccaagcucugcauccacaagcgcaagaucaucgccgucgccacccuccacaaguccauggaggccccccaccccucccucguccucaccucccccggcggcggcaccaacgccacccccgucguccccucccgcgccgccaccccccgcuccguccgcaacaagucccacgagggcaucaccaacuccgucaugcccgagugcaagaaccccuucaagcucaugaucggcuccuccaacgccaugggccgccucuacguccaggagcuccccggcucccagcagcaggagcuccaccccgucuacccccgccagcgccucggcuccuccgagcacggccagaagucccccuuccgcggcucccacggcggccuccccucccccgccuccuccggcucccagaucuacggcgacggcuccaucuccccccgcaccgacccccucggcucccccgacgucuucacccgcuccaaccccggcuuccacggcgcccccaacuccucccccauccaccucaaccgcaccccccucuccccccccuccgucaugcuccacggcucccccguccaguccuccugcgccauggccggccgcaccaacaucccccucucccccacccucaccaccaagucccccgucaugaagaagcccaugugcaacuucuccaccaacauggagaucccccgcgccauguuccaccacaagcccccccagggccccccccccccccccccccccuccugcgcccuccagaagaagccccucaccuccgagaaggacccccucggcauccucgaccccauccccuccaagcccgucaaccagaaccccgucaucaucaaccccaccuccuuccacuccaacguccacucccagguccccaugaugaacgucuccaugccccccgccgucgucccccuccccuccaaccucccccuccccaccgucaagcccggccacaugaaccacggcucccacguccagcgcguccagcacuccgccuccaccucccucucccccucccccgucaccucccccguccacaugaugggcaccggcaucggccgcaucgaggccuccccccagcgcucccgcuccuccuccaccuccuccgaccacggcaacuucaugaugccccccgucggcccccaggccaccuccuccggcaucaagguccccccccgcuccccccgcuccaccaucggcuccccccgccccuccaugcccuccucccccuccaccaaguccgacggccaccaccaguacaaggacauccccaacccccucaucgccggcaucuccaacguccucaacacccccuccuccgccgccuuccccaccgccuccgccggcuccuccuccgucaagucccagcccggccuccucggcaugccccucaaccagauccucaaccagcacaacgccgccuccuuccccgccuccucccuccucuccgccgccgccaaggcccagcucgccaaccagaacaagcucgccggcaacaacuccuccuccuccuccaacuccggcgccgucgccggcuccggcaacaccgagggccacuccacccucaacaccauguucccccccaccgccaacaugcuccuccccaccggcgagggccaguccggccgcgccgcccuccgcgacaagcucaugucccagcagaaggacgcccuccgcaagcgcaagcagccccccaccaccguccucucccuccuccgccagucccagauggacuccuccgccguccccaagcccggccccgaccuccuccgcaagcagggccagggcuccuuccccaucuccuccaugucccagcuccuccaguccauguccugccaguccucccaccucuccuccaacuccacccccggcugcggcgccuccaacaccgcccuccccugcuccgccaaccagcuccacuucaccgaccccuccaugaacuccuccguccuccagaacaucccccuccgcggcgaggccguccacugccacaacgccaacaccaacuucguccacuccaacucccccguccccaaccaccaccucgccggccucaucaaccagauccaggccuccggcaacugcggcaugcucucccaguccggcauggcccucggcaacucccuccaccccaaccccccccagucccgcaucuccaccuccuccacccccgucauccccaacuccaucgucuccuccuacaaccagaccuccuccgaggccggcggcuccggccccuccuccuccaucgccaucgccggcaccaaccaccccgccaucaccaagaccaccuccguccuccaggacggcgucaucgucaccaccgccgccggcaacccccuccagucccagcuccccaucggcuccgacuuccccuucgucggccaggagcacgcccuccacuuccccuccaacuccaccuccaacaaccaccucccccacccccucaaccccucccuccucuccucccuccccaucucccuccccgucaaccagcagcaccuccucaaccagaaccuccucaacauccuccagcccuccgccggcgagggcgacauguccuccaucaacaacacccucuccaaccaccagcucacccaccuccagucccuccucaacaacaaccagauguucccccccaaccagcagcagcagcagcuccuccagggcuaccagaaccuccaggccuuccagggccaguccaccauccccugccccgccaacaacaaccccauggccugccucuuccagaacuuccagguccgcaugcaggaggacgccgcccuccucaacaagcgcaucuccacccagcccggccucaccgcccuccccgagaaccccaacaccacccucccccccuuccaggacacccccugcgagcuccagccccgcaucgaccccucccucggccagcaggucaaggacggccucgucgucggcggccccggcgacgccuccgucgacgccaucuacaaggccgucgucgacgccgccuccaagggcaugcaggucgucaucaccaccgccgucaacuccaccacccagaucucccccauccccgcccucuccgccauguccgccuucaccgccuccaucggcgacccccucaaccucuccuccgccgucuccgccgucauccacggccgcaacaugggcggcgucgaccacgacggccgccuccgcaacucccgcggcgcccgccuccccaagaaccucgaccacggcaagaacgucaacgagggcgacggcuucgaguacuucaaguccgccuccugccacaccuccaagaagcagugggacggcgagcaguccccccgcggcgagcgcaaccgcuggaaguacgaggaguuccucgaccaccccggccacauccacuccucccccugccacgagcgccccaacaacgucuccacccuccccuuccuccccggcgagcagcaccccauccuccuccccccccgcaacugccccggcgacaagauccucgaggagaacuuccgcuacaacaacuacaagcgcaccaugauguccuucaaggagcgccucgagaacaccgucgagcgcugcgcccacaucaacggcaaccgcccccgccagucccgcggcuucggcgagcuccucuccaccgccaagcaggaccucguccucgaggagcagucccccuccuccuccaacucccucgagaacucccucgucaaggacuacauccacuacaacggcgacuucaacgccaaguccgucaacggcugcguccccucccccuccgacgccaaguccaucuccuccgaggacgaccuccgcaaccccgacucccccuccuccaacgagcucauccacuaccgcccccgcaccuucaacgucggcgaccucgucuggggccagaucaagggccucaccuccuggcccggcaagcucguccgcgaggacgacguccacaacuccugccagcagucccccgaggagggcaaggucgagcccgagaagcucaagacccucaccgagggccucgaggccuacucccgcguccgcaagcgcaaccgcaaguccggcaagcucaacaaccaccucgaggccgccauccacgaggccauguccgagcucgacaagauguccggcaccguccaccagaucccccagggcgaccgccagaugcgcccccccaagcccaagcgccgcaagaucucccgcuga

SEQ ID NO: 45804 - RNA, 3012 nt, Artificial Sequence
  derived and/or modified sequence opt2 from MBD6__Homo_sapiens__NP_443129
augaacggcggcaacgaguccuccggcgccgaccgcgccggcggccccgucgccaccuccguccccaucggcuggcagcgcugcguccgcgagggcgccguccucuacaucucccccuccggcaccgagcucuccucccucgagcagacccgcuccuaccuccucuccgacggcaccugcaagugcggccucgagugcccccucaacguccccaaggucuucaacuucgacccccucgcccccgucacccccggcggcgccggcgucggccccgccuccgaggaggacaugaccaagcucugcaaccaccgccgcaaggccgucgccauggccacccucuaccgcuccauggagaccaccugcucccacuccucccccggcgagggcgccuccccccagauguuccacaccgucucccccggcccccccuccgcccgcccccccugccgcgucccccccaccaccccccucaacggcggccccggcucccucccccccgagccccccuccgucucccaggccuuccccacccucgccggccccggcggccucuuccccccccgccucgccgaccccguccccuccggcggcuccuccuccccccgcuuccucccccgcggcaacgcccccucccccgcccccccccccccccccgccaucucccucaacgcccccuccuacaacuggggcgccgcccuccgcuccucccucguccccuccgaccucggcuccccccccgccccccacgccuccuccuccccccccuccgaccccccccucuuccacugcuccgacgcccucaccccccccccccucccccccuccaacaaccuccccgcccaccccggccccgccucccagccccccgucuccuccgccaccaugcaccucccccucguccucggcccccucggcggcgcccccaccgucgagggccccggcgccccccccuuccucgccuccucccuccucuccgccgccgccaaggcccagcaccccccccuccccccccccuccacccuccagggccgccgcccccgcgcccaggcccccuccgccucccacuccuccucccuccgccccucccagcgccgcccccgccgcccccccaccgucuuccgccuccucgagggccgcggcccccagaccccccgccgcucccgcccccgcgcccccgcccccgucccccagcccuucucccuccccgagcccucccagcccauccuccccuccguccucucccuccucggccuccccacccccggccccucccacuccgacggcuccuucaaccuccucggcuccgacgcccaccucccccccccccccacccucuccuccggcucccccccccagccccgccaccccauccagcccucccuccccggcaccaccuccggcucccucuccuccguccccggcgcccccgccccccccgccgccuccaaggcccccgucguccccucccccguccuccagucccccuccgagggccucggcaugggcgccggccccgccugcccccuccccccccucgccggcggcgaggccuuccccuuccccucccccgagcagggccucgcccucuccggcgccggcuuccccggcaugcucggcgcccucccccucccccucucccucggccagcccccccccuccccccuccucaaccacucccucuucggcguccucaccggcggcggcggccagcccccccccgagccccuccuccccccccccggcggccccggccccccccucgcccccggcgagcccgagggccccucccuccucgucgccucccuccucccccccccccccuccgaccuccuccccccccccuccgccccccccuccaaccuccucgccuccuuccucccccuccucgcccucggccccaccgccggcgacggcgagggcuccgccgagggcgccggcggccccuccggcgagcccuucuccggccucggcgaccucuccccccuccucuuccccccccucuccgccccccccacccucaucgcccucaacuccgcccuccucgccgccacccucgacccccccuccggcacccccccccagcccugcguccucuccgccccccagcccggcccccccaccuccuccgucaccaccgccaccaccgaccccggcgccuccucccucggcaaggcccccuccaacuccggccgccccccccagcuccucuccccccuccucggcgccucccuccucggcgaccucuccucccucaccuccucccccggcgcccuccccucccuccuccagccccccggcccccuccucuccggccagcucggccuccagcuccuccccggcggcggcgccccccccccccucuccgaggccuccuccccccucgccugccuccuccagucccuccagaucccccccgagcagcccgaggcccccugccucccccccgagucccccgccuccgcccucgagcccgagcccgcccgccccccccucuccgcccucgcccccccccacggcucccccgacccccccguccccgagcuccucaccggccgcggcuccggcaagcgcggccgccgcggcggcggcggccuccgcggcaucaacggcgaggcccgccccgcccgcggccgcaagcccggcucccgccgcgagcccggccgccucgcccucaaguggggcacccgcggcggcuucaacggccagauggagcgcuccccccgccgcacccaccacuggcagcacaacggcgagcucgccgagggcggcgccgagcccaaggacccccccccccccggcccccacuccgaggaccucaaggucccccccggcgucguccgcaagucccgccgcggccgccgccgcaaguacaaccccacccgcaacuccaacuccucccgccaggacaucacccucgagcccucccccaccgcccgcgccgccgucccccuccccccccgcgcccgccccggccgccccgccaagaacaagcgccgcaagcucgcccccuga

SEQ ID NO: 45805 - RNA, 465 nt, Artificial Sequence
  derived and/or modified sequence opt2 from MB__Homo_sapiens__XP_005261662
augggccucuccgacggcgaguggcagcucguccucaacgucuggggcaaggucgaggccgacauccccggccacggccaggagguccucauccgccucuucaagggccaccccgagacccucgagaaguucgacaaguucaagcaccucaaguccgaggacgagaugaaggccuccgaggaccucaagaagcacggcgccaccguccucaccgcccucggcggcauccucaagaagaagggccaccacgaggccgagaucaagccccucgcccagucccacgccaccaagcacaagauccccgucaaguaccucgaguucaucuccgagugcaucauccagguccuccaguccaagcaccccggcgacuucggcgccgacgcccagggcgccaugaacaaggcccucgagcucuuccgcaaggacauggccuccaacuacaaggagcucggcuuccagggcuga

SEQ ID NO: 45806 - RNA, 1032 nt, Artificial Sequence
  derived and/or modified sequence opt2 from MBIP__Homo_sapiens__NP_001138363
auggccgccgccaccgagcucaaccgccccuccuccggcgaccgcaaccucgagcgccgcugccgccccaaccucucccgcgagguccucuacgagaucuuccgcucccuccacacccucgucggccagcucgaccuccgcgacgacgucgucaagaucaccaucgacuggaacaagcuccagucccucuccgccuuccagcccgcccuccucuucuccgcccucgagcagcacauccucuaccuccagcccuuccucgccaagcuccagucccccaucaaggaggagaacaccaccgccgucgaggagaucggccgcaccgagaugggcaacaagaacgaggucaacgacaaguucuccaucggcgaccuccaggaggaggagaagcacaaggaguccgaccuccgcgacgucaagaagacccagauccacuucgaccccgaggucguccagaucaaggccggcaaggccgagaucgaccgccgcaucuccgccuucaucgagcgcaagcaggccgagaucaacgagaacaacguccgcgaguucugcaacgucaucgacugcaaccaggagaacuccugcgcccgcaccgacgccaucuucacccccuaccccggcuucaagucccacgucaaggucucccgcgucgucaacaccuacggcccccagacccgccccgagggcauccccggcuccggccacaagcccaacuccaugcuccgcgacugcggcaaccaggccgucgaggagcgccuccagaacaucgaggcccaccuccgccuccagaccggcggccccgucccccgcgacaucuaccagcgcaucaagaagcucgaggacaagauccucgagcucgagggcaucucccccgaguacuuccaguccgucuccuucuccggcaagcgccgcaagguccagcccccccagaacuacucccucgccgagcucgacgagaagaucuccgcccucaagcaggcccuccuccgcaagucccgcgaggccgaguccauggccacccaccaccuccccuga

SEQ ID NO: 45807 - RNA, 747 nt, Artificial Sequence
  derived and/or modified sequence opt2 from MBL2__Homo_sapiens__XP_011538118
augucccucuuccccucccucccccuccuccuccucuccauggucgccgccuccuacuccgagaccgucaccugcgaggacgcccagaagaccugccccgccgucaucgccugcuccucccccggcaucaacggcuuccccggcaaggacggccgcgacggcaccaagggcgagaagggcgagcccggccagggccuccgcggccuccagggcccccccggcaagcucggcccccccggcaaccccggccccuccggcucccccggccccaagggccagaagggcgaccccggcaagucccccgacggcgacuccucccucgccgccuccgagcgcaaggcccuccagaccgagauggcccgcaucaagaaguggcucaccuucucccucggcaagcaggucggcaacaaguucuuccucaccaacggcgagaucaugaccuucgagaaggucaaggcccucugcgucaaguuccaggccuccgucgccaccccccgcaacgccgccgagaacggcgccauccagaaccucaucaaggaggaggccuuccucggcaucaccgacgagaagaccgagggccaguucgucgaccucaccggcaaccgccucaccuacaccaacuggaacgagggcgagcccaacaacgccggcuccgacgaggacugcguccuccuccucaagaacggccaguggaacgacguccccugcuccaccucccaccucgccgucugcgaguuccccaucuga

SEQ ID NO: 45808 - RNA, 1149 nt, Artificial Sequence
  derived and/or modified sequence opt2 from MBNL1__Homo_sapiens__NP_066368
auggccgucuccgucacccccauccgcgacaccaaguggcucacccucgaggucugccgcgaguuccagcgcggcaccugcucccgccccgacaccgagugcaaguucgcccaccccuccaaguccugccaggucgagaacggccgcgucaucgccugcuucgacucccucaagggccgcugcucccgcgagaacugcaaguaccuccacccccccccccaccucaagacccagcucgagaucaacggccgcaacaaccucauccagcagaagaacauggccaugcucgcccagcagaugcagcucgccaacgccaugaugcccggcgccccccuccagcccguccccauguucuccgucgcccccucccucgccaccaacgccuccgccgccgccuucaaccccuaccucggccccgucucccccucccucguccccgccgagauccuccccaccgcccccaugcucgucaccggcaaccccggcguccccguccccgccgccgccgccgccgccgcccagaagcucaugcgcaccgaccgccucgaggucugccgcgaguaccagcgcggcaacugcaaccgcggcgagaacgacugccgcuucgcccaccccgccgacuccaccaugaucgacaccaacgacaacaccgucaccgucugcauggacuacaucaagggccgcugcucccgcgagaagugcaaguacuuccacccccccgcccaccuccaggccaagaucaaggccgcccaguaccaggucaaccaggccgccgccgcccaggccgccgccaccgccgccgccaugggcaucccccaggccguccuccccccccuccccaagcgccccgcccucgagaagaccaacggcgccaccgccgucuucaacaccggcaucuuccaguaccagcaggcccucgccaacaugcagcuccagcagcacaccgccuuccucccccccggcuccauccucugcaugacccccgccaccuccgucguccccaugguccacggcgccacccccgccaccgucuccgccgccaccaccuccgccaccuccguccccuucgccgccaccgccaccgccaaccagauccccaucaucuccgccgagcaccucaccucccacaaguacgucacccagauguga

SEQ ID NO: 45809 - RNA, 1104 nt, Artificial Sequence
  derived and/or modified sequence opt2 from MBNL2__Homo_sapiens__NP_659002
auggcccucaacgucgcccccguccgcgacaccaaguggcucacccucgaggucugccgccaguuccagcgcggcaccugcucccgcuccgacgaggagugcaaguucgcccacccccccaaguccugccaggucgagaacggccgcgucaucgccugcuucgacucccucaagggccgcugcucccgcgagaacugcaaguaccuccacccccccacccaccucaagacccagcucgagaucaacggccgcaacaaccucauccagcagaagaccgccgccgccaugcucgcccagcagaugcaguucauguuccccggcaccccccuccaccccguccccaccuuccccgucggccccgccaucggcaccaacaccgccaucuccuucgcccccuaccucgcccccgucacccccggcgucggccucguccccaccgagauccuccccaccacccccgucaucguccccggcuccccccccgucaccguccccggcuccaccgccacccagaagcuccuccgcaccgacaagcucgaggucugccgcgaguuccagcgcggcaacugcgcccgcggcgagaccgacugccgcuucgcccaccccgccgacuccaccaugaucgacaccuccgacaacaccgucaccgucugcauggacuacaucaagggccgcugcaugcgcgagaagugcaaguacuuccacccccccgcccaccuccaggccaagaucaaggccgcccagcaccaggccaaccaggccgccgucgccgcccaggccgccgccgccgccgccaccgucauggccuucccccccggcgcccuccacccccuccccaagcgccaggcccucgagaaguccaacggcaccuccgccgucuucaaccccuccguccuccacuaccagcaggcccucaccuccgcccagcuccagcagcacgccgccuucauccccaccggcuccguccucugcaugacccccgccaccuccaucguccccaugaugcacuccgccaccuccgccaccgucuccgccgccaccacccccgccaccuccguccccuucgccgccaccgccaccgccaaccagaucauccucaaguga

SEQ ID NO: 45810 - RNA, 1488 nt, Artificial Sequence
  derived and/or modified sequence opt2 from MBOAT1__Homo_sapiens__NP_001073949
auggccgccgagccccagcccuccucccucuccuaccgcaccaccggcuccaccuaccuccacccccucuccgagcuccucggcaucccccucgaccaggucaacuucgucgucugccagcucgucgcccucuucgccgccuucugguuccgcaucuaccuccgccccggcaccaccuccuccgacguccgccacgccgucgccaccaucuucggcaucuacuucgucaucuucugcuucggcugguacuccguccaccucuucguccucguccucaugugcuacgccaucauggucaccgccuccgucuccaacauccaccgcuacuccuucuucgucgccaugggcuaccucaccaucugccacaucucccgcaucuacaucuuccacuacggcauccucaccaccgacuucuccggcccccucaugaucgucacccagaagaucaccacccucgccuuccagguccacgacggccucggccgccgcgccgaggaccucuccgccgagcagcaccgccucgccaucaaggucaagcccuccuuccucgaguaccucuccuaccuccucaacuucauguccgucaucgccggccccugcaacaacuucaaggacuacaucgccuucaucgagggcaagcacauccacaugaagcuccucgaggucaacuggaagcgcaagggcuuccacucccuccccgagcccucccccaccggcgccgucauccacaagcucggcaucacccucgucucccuccuccucuuccucacccucaccaagaccuuccccgucaccugccucgucgacgacugguucguccacaaggccuccuuccccgcccgccucugcuaccucuacgucgucaugcaggccuccaagcccaaguacuacuucgccuggacccucgccgacgccgucaacaacgccgccggcuucggcuucuccggcgucgacaagaacggcaacuucugcugggaccuccucuccaaccucaacaucuggaagaucgagaccgccaccuccuucaagauguaccucgagaacuggaacauccagaccgccaccuggcucaagugcgucugcuaccagcgcguccccugguaccccaccguccucaccuucauccucuccgcccucuggcacggcgucuaccccggcuacuacuucaccuuccucaccggcauccucgucacccucgccgcccgcgccguccgcaacaacuaccgccacuacuuccucuccucccgcgcccucaaggccgucuacgacgccggcaccugggccgucacccagcucgccgucuccuacaccgucgcccccuucgucaugcucgccgucgagcccaccaucucccucuacaaguccauguacuucuaccuccacaucaucucccuccucaucauccucuuccuccccaugaagccccaggcccacacccagcgccgcccccagacccucaacuccaucaacaagcgcaagaccgacuga

SEQ ID NO: 45811 - RNA, 1563 nt, Artificial Sequence
  derived and/or modified sequence opt2 from MBOAT2__Homo_sapiens__NP_620154
auggccaccaccuccaccaccggcuccacccuccuccagccccucuccaacgccguccagcuccccaucgaccaggucaacuucgucgucugccagcucuucgcccuccucgccgccaucugguuccgcaccuaccuccacuccuccaagaccuccuccuucauccgccacgucgucgccacccuccucggccucuaccucgcccucuucugcuucggcugguacgcccuccacuuccucguccaguccggcaucuccuacugcaucaugaucaucaucggcgucgagaacaugcacaacuacugcuucgucuucgcccucggcuaccucaccgucugccaggucacccgcgucuacaucuucgacuacggccaguacuccgccgacuucuccggccccaugaugaucaucacccagaagaucaccucccucgccugcgagauccacgacggcauguuccgcaaggacgaggagcucaccuccucccagcgcgaccucgccguccgccgcaugcccucccuccucgaguaccucuccuacaacugcaacuucaugggcauccucgccggcccccucugcuccuacaaggacuacaucaccuucaucgagggccgcuccuaccacaucacccaguccggcgagaacggcaaggaggagacccaguacgagcgcaccgagcccucccccaacaccgccgucguccagaagcuccucgucugcggccucucccuccucuuccaccucaccaucugcaccacccuccccgucgaguacaacaucgacgagcacuuccaggccaccgccuccuggcccaccaagaucaucuaccucuacaucucccuccucgccgcccgccccaaguacuacuucgccuggacccucgccgacgccaucaacaacgccgccggcuucggcuuccgcggcuacgacgagaacggcgccgcccgcugggaccucaucuccaaccuccgcauccagcagaucgagauguccaccuccuucaagauguuccucgacaacuggaacauccagaccgcccucuggcucaagcgcgucugcuacgagcgcaccuccuucucccccaccauccagaccuucauccucuccgccaucuggcacggcgucuaccccggcuacuaccucaccuuccucaccggcguccucaugacccucgccgcccgcgccaugcgcaacaacuuccgccacuacuucaucgagcccucccagcucaagcucuucuacgacgucaucaccuggaucgucacccaggucgccaucuccuacaccgucguccccuucguccuccucuccaucaagcccucccucaccuucuacuccuccugguacuacugccuccacauccucggcauccucguccuccuccuccuccccgucaagaagacccagcgccgcaagaacacccacgagaacauccagcucucccaguccaagaaguucgacgagggcgagaacucccucggccagaacuccuucuccaccaccaacaacgucugcaaccagaaccaggagaucgccucccgccacuccucccucaagcaguga

SEQ ID NO: 45812 - RNA, 1308 nt, Artificial Sequence
  derived and/or modified sequence opt2 from MBOAT4__Homo_sapiens__XP_011542911
auggaguggcucuggcucuucuuccuccaccccaucuccuucuaccagggcgccgccuuccccuucgcccuccucuucaacuaccucugcaucauggacuccuucuccacccgcgcccgcuaccucuuccuccucaccggcggcggcgcccucgccgucgccgccaugggcuccuacgccguccucgucuucacccccgccgucugcgccgucgcccuccucugcucccucgccccccagcagguccaccgcuggaccuucugcuuccagauguccuggcagacccucugccaccucggccuccacuacaccgaguacuaccuccacgagccccccuccguccgcuucugcaucacccucuccucccucaugcuccucacccagcgcgucaccucccucucccucgacaucugcgagggcaaggucaaggccgccuccggcggcuuccgcucccgcuccucccucuccgagcacgucugcaaggcccuccccuacuucuccuaccuccucuucuuccccgcccuccucggcggcucccucugcuccuuccagcgcuuccaggcccgcguccagggcuccuccgcccuccacccccgccacuccuucugggcccucuccuggcgcggccuccagauccucggccucgagugccucaacgucgccgucucccgcgucgucgacgccggcgccggccucaccgacugccagcaguucgagugcaucuacgucgucuggaccaccgccggccucuucaagcucaccuacuacucccacuggauccucgacgacucccuccuccacgccgccggcuucggccccgagcucggccagucccccggcgaggagggcuacguccccgacgccgacaucuggacccucgagcgcacccaccgcaucuccgucuucucccgcaaguggaaccaguccaccgcccgcuggcuccgccgccucgucuuccagcacucccgcgccuggccccuccuccagaccuucgccuucuccgccugguggcacggccuccaccccggccaggucuucggcuucgucugcugggccgucauggucgaggccgacuaccucauccacuccuucgccaacgaguucauccgcuccuggcccaugcgccucuucuaccgcacccucaccugggcccacacccagcucaucaucgccuacaucaugcucgccgucgagguccgcucccucuccucccucuggcuccucugcaacuccuacaacuccgucuuccccauggucuacugcauccuccuccuccuccucgccaagcgcaagcacaagugcaacuga

SEQ ID NO: 45813 - RNA, 594 nt, Artificial Sequence
  derived and/or modified sequence opt2 from MBP__Homo_sapiens__NP_001020252
auggccucccagaagcgccccucccagcgccacggcuccaaguaccucgccaccgccuccaccauggaccacgcccgccacggcuuccucccccgccaccgcgacaccggcauccucgacuccaucggccgcuucuucggcggcgaccgcggcgcccccaagcgcggcuccggcaagguccccuggcucaagcccggccgcuccccccuccccucccacgcccgcucccagcccggccucugcaacauguacaaggacucccaccaccccgcccgcaccgcccacuacggcucccucccccagaagucccacggccgcacccaggacgagaaccccgucguccacuucuucaagaacaucgucaccccccgcacccccccccccucccagggcaagggccgcggccucucccucucccgcuucuccuggggcgccgagggccagcgccccggcuucggcuacggcggccgcgccuccgacuacaaguccgcccacaagggcuucaagggcgucgacgcccagggcacccucuccaagaucuucaagcucggcggccgcgacucccgcuccggcucccccauggcccgccgcuga

SEQ ID NO: 45814 - RNA, 1956 nt, Artificial Sequence
  derived and/or modified sequence opt2 from MBTD1__Homo_sapiens__XP_005257525
auggagaacaccaaggaccucaccgagcacuccucccgcuccgagcgcaagcgccgcgacuccuucggcauguucgacggcuacgacuccugcuccgaggacaccuccuccuccuccuccuccgaggaguccgaggaggaggucgccccccuccccuccaaccuccccaucaucaagaacaacggccaggucuacaccuaccccgacggcaaguccggcauggccaccugcgagaugugcggcauggucggcguccgcgacgccuucuacuccaagaccaagcgcuucugcuccgucuccugcucccgcuccuacuccuccaacuccaagaaggccuccauccucgcccgccuccagggcaagccccccaccaagaaggccaagguccuccagaagcagccccucgucgccaagcucgccgccuacgcccaguaccaggccacccuccagaaccaggccaagaccaaggccgccgucuccauggagggcuucuccuggggcaacuacaucaacuccaacuccuucaucgccgcccccgucaccugcuucaagcacgcccccaugggcaccugcuggggcgacaucuccgagaacguccgcgucgagguccccaacaccgacugcucccuccccaccaaggucuucuggaucgccggcaucgucaagcucgccggcuacaacgcccuccuccgcuacgagggcuucgagaacgacuccggccucgacuucuggugcaacaucugcggcuccgacauccaccccgucggcuggugcgccgccuccggcaagccccucguccccccccgcaccauccagcacaaguacaccaacuggaaggccuuccucgucaagcgccucaccggcgccaagacccucccccccgacuucucccagaaggucuccgaguccaugcaguaccccuucaagcccugcaugcgcgucgaggucgucgacaagcgccaccucugccgcacccgcgucgccgucgucgaguccgucaucggcggccgccuccgccucgucuacgaggaguccgaggaccgcaccgacgacuucuggugccacaugcacuccccccucauccaccacaucggcuggucccgcuccaucggccaccgcuucaagcgcuccgacaucaccaagaagcaggacggccacuucgacacccccccccaccucuucgccaaggucaaggaggucgaccaguccggcgagugguucaaggagggcaugaagcucgaggccaucgacccccucaaccucuccaccaucugcgucgccaccauccgcaagguccucgccgacggcuuccucaugaucggcaucgacggcuccgaggccgccgacggcuccgacugguucugcuaccacgccaccucccccuccaucuuccccgucggcuucugcgagaucaacaugaucgagcucacccccccccgcggcuacaccaagcuccccuucaagugguucgacuaccuccgcgagaccggcuccaucgccgcccccgucaagcucuucaacaaggacguccccaaccacggcuuccgcgucggcaugaagcucgaggccgucgaccucauggagccccgccucaucugcgucgccaccgucacccgcaucauccaccgccuccuccgcauccacuucgacggcugggaggaggaguacgaccagugggucgacugcgagucccccgaccucuaccccgucggcuggugccagcucaccggcuaccagcuccagccccccgccucccaguccucccgcgagaaccaguccgccuccuccaagcagaagaagaaggccaagucccagcaguacaagggccacaagaagaugaccacccuccagcucaaggaggagcuccucgacggcgaggacuacaacuuccuccagggcgccuccgaccaggaguccaacggcuccgccaacuucuacaucaagcaggagcccuga

SEQ ID NO: 45815 - RNA, 3159 nt, Artificial Sequence
  derived and/or modified sequence opt2 from MBTPS1__Homo_sapiens__NP_003782
augaagcucgucaacaucuggcuccuccuccucgucguccuccucugcggcaagaagcaccucggcgaccgccucgagaagaaguccuucgagaaggcccccugccccggcugcucccaccucacccucaaggucgaguucuccuccaccgucgucgaguacgaguacaucgucgccuucaacggcuacuucaccgccaaggcccgcaacuccuucaucuccuccgcccucaaguccuccgaggucgacaacuggcgcaucaucccccgcaacaaccccuccuccgacuaccccuccgacuucgaggucauccagaucaaggagaagcagaaggccggccuccucacccucgaggaccaccccaacaucaagcgcgucaccccccagcgcaaggucuuccgcucccucaaguacgccgaguccgaccccaccguccccugcaacgagacccgcuggucccagaaguggcaguccucccgcccccuccgccgcgccucccucucccucggcuccggcuucuggcacgccaccggccgccacuccucccgccgccuccuccgcgccaucccccgccaggucgcccagacccuccaggccgacguccucuggcagaugggcuacaccggcgccaacguccgcgucgccgucuucgacaccggccucuccgagaagcacccccacuucaagaacgucaaggagcgcaccaacuggaccaacgagcgcacccucgacgacggccucggccacggcaccuucgucgccggcgucaucgccuccaugcgcgagugccagggcuucgcccccgacgccgagcuccacaucuuccgcgucuucaccaacaaccaggucuccuacaccuccugguuccucgacgccuucaacuacgccauccucaagaagaucgacguccucaaccucuccaucggcggccccgacuucauggaccaccccuucgucgacaaggucugggagcucaccgccaacaacgucaucauggucuccgccaucggcaacgacggcccccucuacggcacccucaacaaccccgccgaccagauggacgucaucggcgucggcggcaucgacuucgaggacaacaucgcccgcuucuccucccgcggcaugaccaccugggagcuccccggcggcuacggccgcaugaagcccgacaucgucaccuacggcgccggcguccgcggcuccggcgucaagggcggcugccgcgcccucuccggcaccuccgucgccucccccgucgucgccggcgccgucacccuccucgucuccaccguccagaagcgcgagcucgucaaccccgccuccaugaagcaggcccucaucgccuccgcccgccgccuccccggcgucaacauguucgagcagggccacggcaagcucgaccuccuccgcgccuaccagauccucaacuccuacaagccccaggccucccucucccccuccuacaucgaccucaccgagugccccuacauguggcccuacugcucccagcccaucuacuacggcggcaugcccaccgucgucaacgucaccauccucaacggcaugggcgucaccggccgcaucgucgacaagcccgacuggcagcccuaccucccccagaacggcgacaacaucgaggucgccuucuccuacuccuccguccucuggcccugguccggcuaccucgccaucuccaucuccgucaccaagaaggccgccuccugggagggcaucgcccagggccacgucaugaucaccgucgccucccccgccgagaccgaguccaagaacggcgccgagcagaccuccaccgucaagcuccccaucaaggucaagaucauccccacccccccccgcuccaagcgcguccucugggaccaguaccacaaccuccgcuacccccccggcuacuucccccgcgacaaccuccgcaugaagaacgacccccucgacuggaacggcgaccacauccacaccaacuuccgcgacauguaccagcaccuccgcuccaugggcuacuucgucgagguccucggcgcccccuucaccugcuucgacgccucccaguacggcacccuccucauggucgacuccgaggaggaguacuuccccgaggagaucgccaagcuccgccgcgacgucgacaacggccucucccucgucaucuucuccgacugguacaacaccuccgucaugcgcaaggucaaguucuacgacgagaacacccgccagugguggaugcccgacaccggcggcgccaacauccccgcccucaacgagcuccucuccgucuggaacaugggcuucuccgacggccucuacgagggcgaguucacccucgccaaccacgacauguacuacgccuccggcugcuccaucgccaaguuccccgaggacggcgucgucaucacccagaccuucaaggaccagggccucgagguccucaagcaggagaccgccgucgucgagaacguccccauccucggccucuaccagauccccgccgagggcggcggccgcaucguccucuacggcgacuccaacugccucgacgacucccaccgccagaaggacugcuucuggcuccucgacgcccuccuccaguacaccuccuacggcgucaccccccccucccucucccacuccggcaaccgccagcgcccccccuccggcgccggcuccgucacccccgagcgcauggagggcaaccaccuccaccgcuacuccaagguccucgaggcccaccucggcgaccccaagccccgcccccuccccgccugcccccgccucuccugggccaagccccagccccucaacgagaccgcccccuccaaccucuggaagcaccagaagcuccucuccaucgaccucgacaaggucguccuccccaacuuccgcuccaaccgcccccagguccgcccccucucccccggcgaguccggcgccugggacauccccggcggcaucaugcccggccgcuacaaccaggaggucggccagaccauccccgucuucgccuuccucggcgccauggucguccucgccuucuucgucguccagaucaacaaggccaagucccgccccaagcgccgcaagccccgcgucaagcgcccccagcucaugcagcagguccacccccccaagacccccuccgucuga

SEQ ID NO: 45816 - RNA, 1560 nt, Artificial Sequence
  derived and/or modified sequence opt2 from MBTPS2__Homo_sapiens__NP_056968
augauccccgucucccucgucgucgucgucgucggcggcuggaccgucgucuaccucaccgaccucguccucaaguccuccgucuacuucaagcacuccuacgaggacuggcucgagaacaacggccucuccaucucccccuuccacauccgcuggcagaccgccgucuucaaccgcgccuucuacuccuggggccgccgcaaggcccgcaugcucuaccagugguucaacuucggcauggucuucggcgucaucgccauguucuccuccuucuuccuccucggcaagacccucaugcagacccucgcccagaugauggccgacucccccuccuccuacuccuccuccuccuccuccuccuccuccuccuccuccuccuccuccuccuccuccuccuccuccuccucccuccacaacgagcagguccuccaggucgucguccccggcaucaaccuccccgucaaccagcucaccuacuucuucaccgccguccucaucuccggcgucguccacgagaucggccacggcaucgccgccauccgcgagcagguccgcuucaacggcuucggcaucuuccucuucaucaucuaccccggcgccuucgucgaccucuucaccacccaccuccagcucaucucccccguccagcagcuccgcaucuucugcgccggcaucuggcacaacuucguccucgcccuccucggcauccucgcccucguccuccuccccgucauccuccuccccuucuacuacaccggcgucggcguccucaucaccgaggucgccgaggacucccccgccaucggcccccgcggccucuucgucggcgaccucgucacccaccuccaggacugccccgucaccaacguccaggacuggaacgagugccucgacaccaucgccuacgagccccagaucggcuacugcaucuccgccuccacccuccagcagcucuccuuccccguccgcgccuacaagcgccucgacggcuccaccgagugcugcaacaaccacucccucaccgacgucugcuucuccuaccgcaacaacuucaacaagcgccuccacaccugccuccccgcccgcaaggccgucgaggccacccaggucugccgcaccaacaaggacugcaagaaguccuccuccuccuccuucugcaucauccccucccucgagacccacacccgccucaucaaggucaagcaccccccccagaucgacaugcucuacgucggccacccccuccaccuccacuacaccgucuccaucaccuccuucaucccccgcuucaacuuccucuccaucgaccuccccgucgucgucgagaccuucgucaaguaccucaucucccucuccggcgcccucgccaucgucaacgccguccccugcuucgcccucgacggccaguggauccucaacuccuuccucgacgccacccucaccuccgucaucggcgacaacgacgucaaggaccucaucggcuucuucauccuccucggcggcuccguccuccucgccgccaacgucacccucggccucuggauggucaccgcccgcuga

SEQ ID NO: 45817 - RNA, 954 nt, Artificial Sequence
  derived and/or modified sequence opt2 from MC1R__Homo_sapiens__NP_002377
auggccguccagggcucccagcgccgccuccucggcucccucaacuccacccccaccgccaucccccagcucggccucgccgccaaccagaccggcgcccgcugccucgaggucuccaucuccgacggccucuuccucucccucggccucgucucccucgucgagaacgcccucgucgucgccaccaucgccaagaaccgcaaccuccacucccccauguacugcuucaucugcugccucgcccucuccgaccuccucgucuccggcuccaacguccucgagaccgccgucauccuccuccucgaggccggcgcccucgucgcccgcgccgccguccuccagcagcucgacaacgucaucgacgucaucaccugcuccuccaugcucuccucccucugcuuccucggcgccaucgccgucgaccgcuacaucuccaucuucuacgcccuccgcuaccacuccaucgucacccucccccgcgcccgccgcgccgucgccgccaucugggucgccuccgucgucuucuccacccucuucaucgccuacuacgaccacgucgccguccuccucugccucgucgucuucuuccucgccaugcucguccucauggccguccucuacguccacaugcucgcccgcgccugccagcacgcccagggcaucgcccgccuccacaagcgccagcgccccguccaccagggcuucggccucaagggcgccgucacccucaccauccuccucggcaucuucuuccucugcuggggccccuucuuccuccaccucacccucaucguccucugccccgagcaccccaccugcggcugcaucuucaagaacuucaaccucuuccucgcccucaucaucugcaacgccaucaucgacccccucaucuacgccuuccacucccaggagcuccgccgcacccucaaggagguccucaccugcuccugguga

SEQ ID NO: 45818 - RNA, 894 nt, Artificial Sequence
  derived and/or modified sequence opt2 from MC2R__Homo_sapiens__NP_001278840
augaagcacaucaucaacuccuacgagaacaucaacaacaccgcccgcaacaacuccgacugcccccgcgucguccuccccgaggagaucuucuucaccaucuccaucgucggcguccucgagaaccucaucguccuccucgccgucuucaagaacaagaaccuccaggcccccauguacuucuucaucugcucccucgccaucuccgacaugcucggcucccucuacaagauccucgagaacauccucaucauccuccgcaacaugggcuaccucaagccccgcggcuccuucgagaccaccgccgacgacaucaucgacucccucuucguccucucccuccucggcuccaucuucucccucuccgucaucgccgccgaccgcuacaucaccaucuuccacgcccuccgcuaccacuccaucgucaccaugcgccgcaccgucgucguccucaccgucaucuggaccuucugcaccggcaccggcaucaccauggucaucuucucccaccacguccccaccgucaucaccuucaccucccucuucccccucaugcucgucuucauccucugccucuacguccacauguuccuccucgcccgcucccacacccgcaagaucuccacccucccccgcgccaacaugaagggcgccaucacccucaccauccuccucggcgucuucaucuucugcugggcccccuucguccuccacguccuccucaugaccuucugccccuccaaccccuacugcgccugcuacaugucccucuuccaggucaacggcaugcucaucaugugcaacgccgucaucgaccccuucaucuacgccuuccgcucccccgagcuccgcgacgccuucaagaagaugaucuucugcucccgcuacugguga

SEQ ID NO: 45819 - RNA, 972 nt, Artificial Sequence
  derived and/or modified sequence opt2 from MC3R__Homo_sapiens__NP_063941
augaacgccuccugcugccuccccuccguccagcccacccuccccaacggcuccgagcaccuccaggcccccuucuucuccaaccaguccuccuccgccuucugcgagcaggucuucaucaagcccgaggucuuccucucccucggcaucgucucccuccucgagaacauccucgucauccucgccgucguccgcaacggcaaccuccacucccccauguacuucuuccucugcucccucgccgucgccgacaugcucgucuccgucuccaacgcccucgagaccaucaugaucgccaucguccacuccgacuaccucaccuucgaggaccaguucauccagcacauggacaacaucuucgacuccaugaucugcaucucccucgucgccuccaucugcaaccuccucgccaucgccgucgaccgcuacgucaccaucuucuacgcccuccgcuaccacuccaucaugaccguccgcaaggcccucacccucaucgucgccaucugggucugcugcggcgucugcggcgucgucuucaucgucuacuccgaguccaagauggucaucgucugccucaucaccauguucuucgccaugaugcuccucaugggcacccucuacguccacauguuccucuucgcccgccuccacgucaagcgcaucgccgcccucccccccgccgacggcgucgccccccagcagcacuccugcaugaagggcgccgucaccaucaccauccuccucggcgucuucaucuucugcugggcccccuucuuccuccaccucguccucaucaucaccugccccaccaaccccuacugcaucugcuacaccgcccacuucaacaccuaccucguccucaucaugugcaacuccgucaucgacccccucaucuacgccuuccgcucccucgagcuccgcaacaccuuccgcgagauccucugcggcugcaacggcaugaaccucggcuga

SEQ ID NO: 45820 - RNA, 999 nt, Artificial Sequence
  derived and/or modified sequence opt2 from MC4R__Homo_sapiens__NP_005903
auggucaacuccacccaccgcggcaugcacaccucccuccaccucuggaaccgcuccuccuaccgccuccacuccaacgccuccgagucccucggcaagggcuacuccgacggcggcugcuacgagcagcucuucgucucccccgaggucuucgucacccucggcgucaucucccuccucgagaacauccucgucaucgucgccaucgccaagaacaagaaccuccacucccccauguacuucuucaucugcucccucgccgucgccgacaugcucgucuccgucuccaacggcuccgagaccaucgucaucacccuccucaacuccaccgacaccgacgcccaguccuucaccgucaacaucgacaacgucaucgacuccgucaucugcuccucccuccucgccuccaucugcucccuccucuccaucgccgucgaccgcuacuucaccaucuucuacgcccuccaguaccacaacaucaugaccgucaagcgcgucggcaucaucaucuccugcaucugggccgccugcaccgucuccggcauccucuucaucaucuacuccgacuccuccgccgucaucaucugccucaucaccauguucuucaccaugcucgcccucauggccucccucuacguccacauguuccucauggcccgccuccacaucaagcgcaucgccguccuccccggcaccggcgccauccgccagggcgccaacaugaagggcgccaucacccucaccauccucaucggcgucuucgucgucugcugggcccccuucuuccuccaccucaucuucuacaucuccugcccccagaaccccuacugcgucugcuucaugucccacuucaaccucuaccucauccucaucaugugcaacuccaucaucgacccccucaucuacgcccuccgcucccaggagcuccgcaagaccuucaaggagaucaucugcugcuacccccucggcggccucugcgaccucuccucccgcuacuga

SEQ ID NO: 45821 - RNA, 978 nt, Artificial Sequence
  derived and/or modified sequence opt2 from MC5R__Homo_sapiens__NP_005904
augaacuccuccuuccaccuccacuuccucgaccucaaccucaacgccaccgagggcaaccucuccggccccaacgucaagaacaaguccucccccugcgaggacaugggcaucgccgucgaggucuuccucacccucggcgucaucucccuccucgagaacauccucgucaucggcgccaucgucaagaacaagaaccuccacucccccauguacuucuucgucugcucccucgccgucgccgacaugcucgucuccauguccuccgccugggagaccaucaccaucuaccuccucaacaacaagcaccucgucaucgccgacgccuucguccgccacaucgacaacgucuucgacuccaugaucugcaucuccgucgucgccuccaugugcucccuccucgccaucgccgucgaccgcuacgucaccaucuucuacgcccuccgcuaccaccacaucaugaccgcccgccgcuccggcgccaucaucgccggcaucugggccuucugcaccggcugcggcaucgucuucauccucuacuccgaguccaccuacgucauccucugccucaucuccauguucuucgccaugcucuuccuccucgucucccucuacauccacauguuccuccucgcccgcacccacgucaagcgcaucgccgcccuccccggcgccuccuccgcccgccagcgcaccuccaugcagggcgccgucaccgucaccaugcuccucggcgucuucaccgucugcugggcccccuucuuccuccaccucacccucaugcucuccugcccccagaaccucuacugcucccgcuucaugucccacuucaacauguaccucauccucaucaugugcaacuccgucauggacccccucaucuacgccuuccgcucccaggagaugcgcaagaccuucaaggagaucaucugcugccgcggcuuccgcaucgccugcuccuucccccgccgcgacuga

SEQ ID NO: 45822 - RNA, 1941 nt, Artificial Sequence
  derived and/or modified sequence opt2 from MCAM__Homo_sapiens__NP_006491
augggccucccccgccucgucugcgccuuccuccucgccgccugcugcugcugcccccgcgucgccggcguccccggcgaggccgagcagcccgcccccgagcucgucgaggucgaggucggcuccaccgcccuccucaagugcggccucucccagucccagggcaaccucucccacgucgacugguucuccguccacaaggagaagcgcacccucaucuuccgcguccgccagggccagggccaguccgagcccggcgaguacgagcagcgccucucccuccaggaccgcggcgccacccucgcccucacccaggucaccccccaggacgagcgcaucuuccucugccagggcaagcgcccccgcucccaggaguaccgcauccagcuccgcgucuacaaggcccccgaggagcccaacauccaggucaacccccucggcauccccgucaacuccaaggagcccgaggaggucgccaccugcgucggccgcaacggcuaccccaucccccaggucaucugguacaagaacggccgcccccucaaggaggagaagaaccgcguccacauccaguccucccagaccgucgaguccuccggccucuacacccuccaguccauccucaaggcccagcucgucaaggaggacaaggacgcccaguucuacugcgagcucaacuaccgccuccccuccggcaaccacaugaaggagucccgcgaggucaccguccccgucuucuaccccaccgagaaggucuggcucgaggucgagcccgucggcaugcucaaggagggcgaccgcgucgagauccgcugccucgccgacggcaacccccccccccacuucuccaucuccaagcagaaccccuccacccgcgaggccgaggaggagaccaccaacgacaacggcguccucguccucgagcccgcccgcaaggagcacuccggccgcuacgagugccagggccucgaccucgacaccaugaucucccuccucuccgagccccaggagcuccucgucaacuacgucuccgacguccgcgucucccccgccgcccccgagcgccaggagggcuccucccucacccucaccugcgaggccgaguccucccaggaccucgaguuccaguggcuccgcgaggagaccggccagguccucgagcgcggccccguccuccagcuccacgaccucaagcgcgaggccggcggcggcuaccgcugcgucgccuccguccccuccauccccggccucaaccgcacccagcucgucaacgucgccaucuucggcccccccuggauggccuucaaggagcgcaaggucugggucaaggagaacaugguccucaaccucuccugcgaggccuccggccacccccgccccaccaucuccuggaacgucaacggcaccgccuccgagcaggaccaggacccccagcgcguccucuccacccucaacguccucgucacccccgagcuccucgagaccggcgucgagugcaccgccuccaacgaccucggcaagaacaccuccauccucuuccucgagcucgucaaccucaccacccucacccccgacuccaacaccaccaccggccucuccaccuccaccgccuccccccacacccgcgccaacuccaccuccaccgagcgcaagcuccccgagcccgagucccgcggcgucgucaucgucgccgucaucgucugcauccucguccucgccguccucggcgccguccucuacuuccucuacaagaagggcaagcuccccugccgccgcuccggcaagcaggagaucacccucccccccucccgcaaguccgagcucgucgucgaggucaaguccgacaagcuccccgaggagaugggccuccuccagggcuccuccggcgacaagcgcgcccccggcgaccagggcgagaaguacaucgaccuccgccacuga

SEQ ID NO: 45823 - RNA, 543 nt, Artificial Sequence
  derived and/or modified sequence opt2 from MCAT__Homo_sapiens__NP_055322
auguccguccgcgucgcccgcgucgccuggguccgcggccucggcgccuccuaccgccgcggcgccuccuccuuccccguccccccccccggcgcccagggcgucgccgagcuccuccgcgacgccaccggcgccgaggaggaggcccccugggccgccaccgagcgccgcaugcccggccagugcuccguccuccucuuccccggccagggcucccaggucgucggcaugggccgcggccuccucaacuacccccgcguccgcgagcucuacgccgccgcccgccgcguccucggcuacgaccuccucgagcucucccuccacggcccccaggagacccucgaccgcaccguccacugccagcccgccaucuucgucgccucccucgccgccgucgagaagcuccaccaccuccagcccuccgucaucgagaacugcgucgccgccgccggcuucuccgucggcgaguucgccgcccucgucuucgccggcgccauggaguucgccgagggcuccaccgucucccccgaggaguuccucuga

SEQ ID NO: 45824 - RNA, 2178 nt, Artificial Sequence
  derived and/or modified sequence opt2 from MCCC1__Homo_sapiens__NP_064551
auggccgccgccuccgccgucuccguccuccucgucgccgccgagcgcaaccgcuggcaccgccuccccucccuccuccuccccccccgcaccugggucuggcgccagcgcaccaugaaguacaccaccgccaccggccgcaacaucaccaagguccucaucgccaaccgcggcgagaucgccugccgcgucaugcgcaccgccaagaagcucggcguccagaccgucgccgucuacuccgaggccgaccgcaacuccaugcacgucgacauggccgacgaggccuacuccaucggccccgcccccucccagcaguccuaccucuccauggagaagaucauccaggucgccaagaccuccgccgcccaggccauccaccccggcugcggcuuccucuccgagaacauggaguucgccgagcucugcaagcaggagggcaucaucuucaucggccccccccccuccgccauccgcgacaugggcaucaaguccaccuccaaguccaucauggccgccgccggcguccccgucgucgagggcuaccacggcgaggaccaguccgaccagugccucaaggagcacgcccgccgcaucggcuaccccgucaugaucaaggccguccgcggcggcggcggcaagggcaugcgcaucguccgcuccgagcaggaguuccaggagcagcucgaguccgcccgccgcgaggccaagaaguccuucaacgacgacgccaugcucaucgagaaguucgucgacaccccccgccacgucgagguccaggucuucggcgaccaccacggcaacgccgucuaccucuucgagcgcgacugcuccguccagcgccgccaccagaagaucaucgaggaggcccccgcccccggcaucaaguccgagguccgcaagaagcucggcgaggccgccguccgcgccgccaaggccgucaacuacgucggcgccggcaccgucgaguucaucauggacuccaagcacaacuucugcuucauggagaugaacacccgccuccaggucgagcaccccgucaccgagaugaucaccggcaccgaccucgucgaguggcagcuccgcaucgccgccggcgagaagaucccccucucccaggaggagaucacccuccagggccacgccuucgaggcccgcaucuacgccgaggaccccuccaacaacuucaugcccgucgccggcccccucguccaccucuccaccccccgcgccgaccccuccacccgcaucgagaccggcguccgccagggcgacgaggucuccguccacuacgaccccaugaucgccaagcucgucgucugggccgccgaccgccaggccgcccucaccaagcuccgcuacucccuccgccaguacaacaucgucggccuccacaccaacaucgacuuccuccucaaccucuccggccaccccgaguucgaggccggcaacguccacaccgacuucaucccccagcaccacaagcagcuccuccucucccgcaaggccgccgccaaggagucccucugccaggccgcccucggccucauccucaaggagaaggccaugaccgacaccuucacccuccaggcccacgaccaguucucccccuucuccuccuccuccggccgccgccucaacaucuccuacacccgcaacaugacccucaaggacggcaagaacaacgucgccaucgccgucaccuacaaccacgacggcuccuacuccaugcagaucgaggacaagaccuuccagguccucggcaaccucuacuccgagggcgacugcaccuaccucaagugcuccgucaacggcgucgccuccaaggccaagcucaucauccucgagaacaccaucuaccucuucuccaaggagggcuccaucgagaucgacauccccguccccaaguaccucuccuccgucuccucccaggagacccagggcggcccccucgcccccaugaccggcaccaucgagaaggucuucgucaaggccggcgacaaggucaaggccggcgacucccucauggucaugaucgccaugaagauggagcacaccaucaagucccccaaggacggcaccgucaagaaggucuucuaccgcgagggcgcccaggccaaccgccacaccccccucgucgaguucgaggaggaggaguccgacaagcgcgaguccgaguga

SEQ ID NO: 45825 - RNA, 1692 nt, Artificial Sequence
  derived and/or modified sequence opt2 from MCCC2__Homo_sapiens__NP_071415
augugggccguccuccgccucgcccuccgccccugcgcccgcgccucccccgccggcccccgcgccuaccacggcgacuccgucgccucccucggcacccagcccgaccucggcuccgcccucuaccaggagaacuacaagcagaugaaggcccucgucaaccagcuccacgagcgcgucgagcacaucaagcucggcggcggcgagaaggcccgcgcccuccacaucucccgcggcaagcuccucccccgcgagcgcaucgacaaccucaucgaccccggcucccccuuccucgagcucucccaguucgccggcuaccagcucuacgacaacgaggagguccccggcggcggcaucaucaccggcaucggccgcgucuccggcgucgagugcaugaucaucgccaacgacgccaccgucaagggcggcgccuacuaccccgucaccgucaagaagcagcuccgcgcccaggagaucgccaugcagaaccgccuccccugcaucuaccucgucgacuccggcggcgccuaccucccccgccaggccgacgucuuccccgaccgcgaccacuucggccgcaccuucuacaaccaggccaucauguccuccaagaacaucgcccagaucgccgucgucaugggcuccugcaccgccggcggcgccuacguccccgccauggccgacgagaacaucaucguccgcaagcagggcaccaucuuccucgccggccccccccucgucaaggccgccaccggcgaggaggucuccgccgaggaccucggcggcgccgaccuccacugccgcaaguccggcgucuccgaccacugggcccucgacgaccaccacgcccuccaccucacccgcaaggucguccgcaaccucaacuaccagaagaagcucgacgucaccaucgagcccuccgaggagccccucuuccccgccgacgagcucuacggcaucgucggcgccaaccucaagcgcuccuucgacguccgcgaggucaucgcccgcaucgucgacggcucccgcuucaccgaguucaaggccuucuacggcgacacccucgucaccggcuucgcccgcaucuucggcuaccccgucggcaucgucggcaacaacggcguccucuucuccgaguccgccaagaagggcacccacuucguccagcucugcugccagcgcaacaucccccuccucuuccuccagaacaucaccggcuucauggucggccgcgaguacgaggccgagggcaucgccaaggacggcgccaagauggucgccgccgucgccugcgcccagguccccaagaucacccucaucaucggcggcuccuacggcgccggcaacuacggcaugugcggccgcgccuacuccccccgcuuccucuacaucuggcccaacgcccgcaucuccgucaugggcggcgagcaggccgccaacguccucgccaccaucaccaaggaccagcgcgcccgcgagggcaagcaguucuccuccgccgacgaggccgcccucaaggagcccaucaucaagaaguucgaggaggagggcaaccccuacuacuccuccgcccgcgucugggacgacggcaucaucgaccccgccgacacccgccucguccucggccucuccuucuccgccgcccucaacgcccccaucgagaagaccgacuucggcaucuuccgcauguga

SEQ ID NO: 45826 - RNA, 360 nt, Artificial Sequence
  derived and/or modified sequence opt2 from MCCD1__Homo_sapiens__NP_001011700
augguccucccccuccccuggcucucccgcuaccacuuccuccgccuccuccuccccuccuggucccucgccccccagggcucccacggcugcugcucccagaaccccaaggccuccauggaggagcagaccuccucccgcggcaacggcaagaugaccucccccccccgcggccccggcacccaccgcaccgccgagcucgcccgcgccgaggagcuccucgagcagcagcucgagcucuaccaggcccuccucgagggccaggagggcgccugggaggcccaggcccucguccucaagauccagaagcucaaggagcagaugcgccgccaccaggagucccucggcggcggcgccuga

SEQ ID NO: 45827 - RNA, 3060 nt, Artificial Sequence
  derived and/or modified sequence opt2 from MCC__Homo_sapiens__NP_001078846
augauggccgccgccgccgccgccgccgccggcuccuccuccuccggcggcggcggcggcggcuccggcuccuccuccuccuccuccgacaccuccuccaccggcgaggaggagcgcaugcgccgccucuuccagaccugcgacggcgacggcgacggcuacaucucccgcaacgaccuccucauggucugccgccagcucaacauggaggaguccgucgccgagaucaugaaccagcucggcgccgacgagaacggcaagaucuccuuccaggacuucacccgcugccgcaugcagcucguccgcgagauccgcaaggaggaggucgaccucuccgccaaguccgacaacuccugcaccaagaagcuccgcgaccgcaucgccuccuggcccaccuccuccgacaacucccucggcgcccucuccgccgcccgcgaguccugggaguacgacuccggcgcccgcgaccuccagucccccgacguccagucccaguccgcccuccagaagcuccucgaguacggcggcuccucccuccaccagcaggccgcccuccacaagcuccucacccaguccccccacaucggcaacuccgucggcggcuccuaccucgagcucgccaacacccuccacuccgccgcccucgccucccucaagggcgacaucgucgagcucaacaagcgccuccagcagaccgagcgcgagcgcgaccuccucgagaagaagcucgccaaggcccagugcgagcagucccaccucaugcgcgagcacgaggacguccaggagcgcaccacccuccgcuacgaggagcgcaucaccgagcuccacuccgucaucgccgagcucaacaagaagaucgaccgccuccagggcaccaccauccgcgaggaggacgaguacuccgagcuccgcuccgagcucucccagucccagcacgaggucaacgaggacucccgcuccauggaccaggaccagaccuccgucuccauccccgagaaccaguccaccauggucaccgccgacauggacaacugcuccgaccucaacuccgagcuccagcgcguccucaccggccucgagaacgucgucugcggccgcaagaaguccuccugcucccucuccgucgccgaggucgaccgccacaucgagcagcucaccaccgccuccgagcacugcgaccucgccaucaagaccgucgaggagaucgagggcguccucggccgcgaccucuaccccaaccucgccgaggagcgcucccgcugggagaaggagcucgccggccuccgcgaggagaacgagucccucaccgccaugcucugcuccaaggaggaggagcucaaccgcaccaaggccaccaugaacgccauccgcgaggagcgcgaccgccuccgccgccgcguccgcgagcuccagacccgccuccaguccguccaggccaccggccccuccucccccggccgccucaccuccaccaaccgccccaucaaccccuccaccggcgagcucuccaccuccuccuccuccaacgacauccccaucgccaagaucgccgagcgcgucaagcucuccaagacccgcuccgaguccuccuccuccgaccgccccguccucggcuccgagaucuccuccaucggcgucuccuccuccgucgccgagcaccucgcccacucccuccaggacugcuccaacauccaggagaucuuccagacccucuacucccacggcuccgccaucuccgaguccaagauccgcgaguucgaggucgagaccgagcgccucaacucccgcaucgagcaccucaagucccagaacgaccuccucaccaucacccucgaggagugcaaguccaacgccgagcgcauguccaugcucgucggcaaguacgaguccaacgccaccgcccuccgccucgcccuccaguacuccgagcagugcaucgaggccuacgagcuccuccucgcccucgccgaguccgagcagucccucauccucggccaguuccgcgccgccggcgucggcuccucccccggcgaccaguccggcgacgagaacaucacccagaugcucaagcgcgcccacgacugccgcaagaccgccgagaacgccgccaaggcccuccucaugaagcucgacggcuccugcggcggcgccuucgccgucgccggcugcuccguccagcccugggagucccucuccuccaacucccacaccuccaccaccuccuccaccgccuccuccugcgacaccgaguucaccaaggaggacgagcagcgccucaaggacuacauccagcagcucaagaacgaccgcgccgccgucaagcucaccaugcucgagcucgaguccauccacaucgacccccucuccuacgacgucaagccccgcggcgacucccagcgccucgaccucgagaacgccguccucaugcaggagcucauggccaugaaggaggagauggccgagcucaaggcccagcucuaccuccucgagaaggagaagaaggcccucgagcucaagcucuccacccgcgaggcccaggagcaggccuaccucguccacaucgagcaccucaaguccgaggucgaggagcagaaggagcagcgcaugcgcucccucuccuccaccuccuccggcuccaaggacaagcccggcaaggagugcgccgacgccgccucccccgcccucucccucgccgagcuccgcaccaccugcuccgagaacgagcucgccgccgaguucaccaacgccauccgccgcgagaagaagcucaaggcccgcguccaggagcucgucuccgcccucgagcgccucaccaaguccuccgagauccgccaccagcaguccgccgaguucgucaacgaccucaagcgcgccaacuccaaccucgucgccgccuacgagaaggccaagaagaagcaccagaacaagcucaagaagcucgagucccagaugauggccauggucgagcgccacgagacccagguccgcaugcucaagcagcgcaucgcccuccucgaggaggagaacucccgcccccacaccaacgagaccucccucuga

SEQ ID NO: 45828 - RNA, 531 nt, Artificial Sequence
  derived and/or modified sequence opt2 from MCEE__Homo_sapiens__NP_115990
auggcccgcguccucaaggccgccgccgccaacgccgucggccucuucucccgccuccaggcccccauccccaccguccgcgccuccuccaccucccagccccucgaccaggucaccggcuccgucuggaaccucggccgccucaaccacgucgccaucgccguccccgaccucgagaaggccgccgccuucuacaagaacauccucggcgcccaggucuccgaggccgucccccuccccgagcacggcgucuccgucgucuucgucaaccucggcaacaccaagauggagcuccuccacccccucggccgcgacucccccaucgccggcuuccuccagaagaacaaggccggcggcaugcaccacaucugcaucgaggucgacaacaucaacgccgccgucauggaccucaagaagaagaagauccgcucccucuccgaggaggucaagaucggcgcccacggcaagcccgucaucuuccuccaccccaaggacugcggcggcguccucgucgagcucgagcaggccuga

SEQ ID NO: 45829 - RNA, 2958 nt, Artificial Sequence
  derived and/or modified sequence opt2 from MCF2__Homo_sapiens__NP_001093325
augcaggacaucgccuuccucuccggcggccgcggcaaggacaacgccuggaucaucaccuuccccgagaacugcaacuuccgcugcauccccgaggaggucaucgccaagguccucaccuaccucaccuccaucgcccgccagaacggcuccgacucccgcuucaccaucauccucgaccgccgccucgacaccugguccucccucaagaucucccuccagaagaucuccgccuccuuccccggcaaccuccaccucguccucguccuccgccccaccuccuuccuccagcgcaccuucaccgacaucggcuucugguucucccaggaggacuucaugcucaagcuccccgucgucaugcucuccuccgucuccgaccuccucaccuacaucgacgacaagcagcucacccccgagcucggcggcacccuccaguacugccacuccgaguggaucaucuuccgcaacgccaucgagaacuucgcccucaccgucaaggagauggcccagaugcuccaguccuucggcaccgagcucgccgagaccgagcuccccgacgacauccccuccaucgaggagauccucgccauccgcgccgagcgcuaccaccuccucaagaacgacaucaccgccgucaccaaggagggcaagauccuccucaccaaccucgagguccccgacaccgagggcgccgucuccucccgccucgagugccaccgccagaucuccggcgacuggcagaccaucaacaagcuccucacccagguccacgacauggagaccgccuucgacggcuucugggagaagcaccagcucaagauggagcaguaccuccagcucuggaaguucgagcaggacuuccagcagcucgucaccgaggucgaguuccuccucaaccagcaggccgagcucgccgacgucaccggcaccaucgcccaggucaagcagaagaucaagaagcucgagaaccucgacgagaacucccaggagcuccucuccaaggcccaguucgucauccuccacggccacaagcucgccgccaaccaccacuacgcccucgaccucaucugccagcgcugcaacgagcuccgcuaccucuccgacauccucgucaacgagaucaaggccaagcgcauccagcucucccgcaccuucaagaugcacaagcuccuccagcaggcccgccagugcugcgacgagggcgagugccuccucgccaaccaggagaucgacaaguuccaguccaaggaggacgcccagaaggcccuccaggacaucgagaacuuccucgagauggcccuccccuucaucaacuacgagcccgagacccuccaguacgaguucgacgucauccucucccccgagcucaagguccagaugaagaccauccagcucaagcucgagaacauccgcuccaucuucgagaaccagcaggccggcuuccgcaaccucgccgacaagcacguccgccccauccaguucgucguccccacccccgagaaccucgucaccuccggcacccccuucuucuccuccaagcagggcaagaagaccuggcgccagaaccaguccaaccucaagaucgaggucguccccgacugccaggagaagcgcuccuccggccccuccuccucccucgacaacggcaacucccucgacguccucaagaaccacguccucaacgagcucauccagaccgagcgcgucuacguccgcgagcucuacaccguccuccucggcuaccgcgccgagauggacaaccccgagauguucgaccucaugcccccccuccuccgcaacaagaaggacauccucuucggcaacauggccgagaucuacgaguuccacaacgacaucuuccucuccucccucgagaacugcgcccacgcccccgagcgcgucggccccugcuuccucgagcgcaaggacgacuuccagauguacgccaaguacugccagaacaagccccgcuccgagaccaucuggcgcaaguacuccgagugcgccuucuuccaggagugccagcgcaagcucaagcaccgccuccgccucgacuccuaccuccucaagcccguccagcgcaucaccaaguaccagcuccuccucaaggagcuccucaaguacuccaaggacugcgagggcuccgcccuccucaagaaggcccucgacgccaugcucgaccuccucaaguccgucaacgacuccaugcaccagaucgccaucaacggcuacaucggcaaccucaacgagcucggcaagaugaucaugcagggcggcuucuccgucuggaucggccacaagaagggcgccaccaagaugaaggaccucgcccgcuucaagcccaugcagcgccaccucuuccucuacgagaaggccaucgucuucugcaagcgccgcgucgaguccggcgagggcuccgaccgcuaccccuccuacuccuucaagcacugcuggaagauggacgaggucggcaucaccgaguacgucaagggcgacaaccgcaaguucgagaucugguacggcgagaaggaggaggucuacaucguccaggccuccaacgucgacgucaagaugaccuggcucaaggagauccgcaacauccuccucaagcagcaggagcuccucaccgucaagaagcgcaagcagcaggaccagcucaccgagcgcgacaaguuccagaucucccuccagcagaacgacgagaagcagcagggcgccuucaucuccaccgaggagaccgagcucgagcacaccuccaccgucgucgaggucugcgaggccaucgccuccguccaggccgaggccaacaccgucuggaccgaggccucccaguccgccgagaucuccgaggagcccgccgagugguccuccaacuacuucuaccccaccuacgacgagaacgaggaggagaaccgcccccucaugcgccccgucuccgagauggcccuccucuacuga

SEQ ID NO: 45830 - RNA, 3345 nt, Artificial Sequence
  derived and/or modified sequence opt2 from MCF2L2__Homo_sapiens__NP_055893
augcucuccugccucaaggaggagaugcccccccaggagcucacccgccgccucgccaccgucaucacccacgucgacgagaucaugcagcaggagguccgcccccucauggccgucgagaucaucgagcagcuccaccgccaguucgccauccucuccggcggccgcggcgaggacggcgcccccaucaucaccuuccccgaguucuccggcuucaagcacauccccgacgaggacuuccucaacgucaugaccuaccucaccuccauccccuccgucgaggccgccuccaucggcuucaucgucgucaucgaccgccgccgcgacaagugguccuccgucaaggccucccucacccgcaucgccgucgccuuccccggcaaccuccagcucaucuucauccuccgccccucccgcuucauccagcgcaccuucaccgacaucggcaucaaguacuaccgcaacgaguucaagaccaagguccccaucaucauggucaacuccgucuccgaccuccacggcuacaucgacaagucccagcucacccgcgagcucggcggcacccucgaguaccgccacggccagugggucaaccaccgcaccgccaucgagaacuucgcccucacccucaagaccaccgcccagaugcuccagaccuucggcuccugccucgccaccgccgagcucccccgcuccaugcucuccaccgaggaccuccucaugucccacacccgccagcgcgacaagcuccaggacgagcucaagcuccucggcaagcagggcaccacccuccucuccugcauccaggagcccgccaccaagugccccaacuccaagcucaaccucaaccagcucgagaacgucaccaccauggagcgccuccucguccagcucgacgagaccgagaaggccuucucccacuucugguccgagcaccaccucaagcucaaccagugccuccagcuccagcacuucgagcacgacuucugcaaggccaagcucgcccucgacaaccuccucgaggagcaggccgaguucaccggcaucggcgacuccgucaugcacgucgagcagauccucaaggagcacaagaagcucgaggagaagucccaggagccccucgagaaggcccagcuccucgcccucgucggcgaccagcucauccagucccaccacuacgccgccgacgccauccgcccccgcugcgucgagcuccgccaccucugcgacgacuucaucaacggcaacaagaagaagugggacauccucggcaagucccucgaguuccaccgccagcucgacaaggucucccaguggugcgaggccggcaucuaccuccucgccucccaggccgucgacaagugccagucccgcgagggcgucgacaucgcccucaacgacaucgccaccuuccucggcaccgucaaggaguacccccuccucucccccaaggaguucuacaacgaguucgagcuccuccucacccucgacgccaaggccaaggcccagaagguccuccagcgccucgacgacguccaggagaucuuccacaagcgccaggucucccucaugaagcucgccgccaagcagacccgccccguccagcccgucgccccccaccccgaguccucccccaagugggucuccuccaagaccucccagcccuccaccuccgucccccucgcccgcccccuccgcaccuccgaggagcccuacaccgagaccgagcucaacucccgcggcaaggaggacgacgagaccaaguucgaggucaaguccgaggagaucuucgagucccaccacgagcgcggcaaccccgagcucgagcagcaggcccgccucggcgaccucuccccccgccgccgcaucauccgcgaccuccucgagaccgaggagaucuacaucaaggagaucaaguccaucaucgacggcuacaucacccccauggacuucaucuggcucaagcaccucauccccgacguccuccagaacaacaaggacuuccucuucggcaacauccgcgagcucuacgaguuccacaaccgcaccuuccucaaggagcucgagaagugcgccgagaaccccgagcuccucgcccacugcuuccucaagcgcaaggaggaccuccagaucuacuucaaguaccacaagaaccucccccgcgcccgcgccaucuggcaggagugccaggacugcgccuacuucggcgucugccagcgccagcucgaccacaaccucccccucuucaaguaccucaagggccccucccagcgccucaucaaguaccagaugcuccucaagggccuccucgacuucgagucccccgaggacauggagaucgaccccggcgagcucggcggcuccgccaaggacggccccaagcgcaccaaggacuccgccuucuccaccgagcuccagcaggcccucgccgucaucgaggaccucaucaaguccugcgagcucgccgucgaccucgccgccgucaccgagugccccgacgacaucggcaagcucggcaagcuccuccuccacggccccuucuccgucuggaccauccacaaggaccgcuacaagaugaaggaccucauccgcuucaagcccucccagcgccagaucuaccucuucgagcgcggcaucgucuucugcaagauccgcauggagcccggcgaccagggccucuccccccacuacuccuucaagaaggccaugaagcucaugacccucuccauccgccagcucggccgcggcucccaccgcaaguucgagaucgccucccgcaacggccucgagaaguacauccuccaggccgccuccaaggagauccgcgacugcugguucuccgagaucuccaagcuccucauggagcagcagaacaacaucaaggaccagggcaacccccaguucgagauguccaccuccaagggcuccggcgccggcuccggccccuggaucaagaacauggagcgcgccaccaccuccaaggaggaccccgccuccuccaccggcggcaucaagggcugcuccucccgcgaguucuccuccauggacaccuucgaggacugcgagggcgccgaggacauggagaaggaguccuccgcccucucccucgccggccucuuccaguccgacgacucccacgagaccugcuccuccaaguccgccuuccucgagcgcggcgaguccucccagggcgagaaggaggagcgcgacgaggaggagaccgccacccgcuccaccgaggaggagcgcgccggcgccuccaccggccgccucgcccccgccggcgccaccgccggcuuccaggcccgcgcccuccgcccccgcaccuccgcccaggaguccuga

SEQ ID NO: 45831 - RNA, 3378 nt, Artificial Sequence
  derived and/or modified sequence opt2 from MCF2L__Homo_sapiens__NP_001106203
augcgcuucuggcuccgcaccgaggagauggcccucgaggagaugguccagcgccucaacgccgucuccaagcacaccgacgagaucaugcaccaggacaucgucccccucugcgccgccgacauccaggaccagcucaagaagcgcuucgccuaccucuccggcggccgcggccaggacggcucccccgucaucaccuuccccgacuaccccgccuucuccgagauccccgacaaggaguuccagaacgucaugaccuaccucaccuccauccccucccuccaggacgccggcaucggcuucauccucgucaucgaccgccgccgcgacaaguggaccuccgucaaggccuccguccuccgcaucgccgccuccuuccccgccaaccuccagcucguccucguccuccgccccaccggcuucuuccagcgcacccucuccgacaucgccuucaaguucaaccgcgacgacuucaagaugaagguccccgucaucaugcucuccuccguccccgaccuccacggcuacaucgacaagucccagcucaccgaggaccucggcggcacccucgacuacugccacucccgcuggcucugccagcgcaccgccaucgaguccuucgcccucauggucaagcagaccgcccagaugcuccaguccuucggcaccgagcucgccgagaccgagcuccccaacgacguccaguccaccuccuccguccucugcgcccacaccgagaagaaggacaaggccaaggaggaccuccgccucgcccucaaggagggccacuccguccucgagucccuccgcgagcuccaggccgagggcuccgagcccuccgucaaccaggaccagcucgacaaccaggccaccguccagcgccuccucgcccagcucaacgagaccgaggccgccuucgacgaguucugggccaagcaccagcagaagcucgagcagugccuccagcuccgccacuucgagcagggcuuccgcgaggucaaggccauccucgacgccgccucccagaagaucgccaccuucaccgacaucggcaacucccucgcccacgucgagcaccuccuccgcgaccucgccuccuucgaggagaaguccggcgucgccgucgagcgcgcccgcgcccucucccucgacggcgagcagcucaucggcaacaagcacuacgccgucgacuccauccgccccaagugccaggagcuccgccaccucugcgaccaguucuccgccgagaucgcccgccgccgcggccuccucuccaagucccucgagcuccaccgccgccucgagaccuccaugaaguggugcgacgagggcaucuaccuccucgccucccagcccgucgacaagugccagucccaggacggcgccgaggccgcccuccaggagaucgagaaguuccucgagaccggcgccgagaacaagauccaggagcucaacgccaucuacaaggaguacgaguccauccucaaccaggaccucauggagcacguccgcaaggucuuccagaagcaggccuccauggaggaggucuuccaccgccgccaggccucccucaagaagcucgccgcccgccagacccgccccguccagcccgucgccccccgccccgaggcccucgccaagucccccugccccucccccggcauccgccgcggcuccgagaacuccuccuccgagggcggcgcccuccgccgcggccccuaccgccgcgccaaguccgagauguccgagucccgccagggccgcggcuccgccggcgaggaggaggagucccucgccauccuccgccgccacgucauguccgagcuccucgacaccgagcgcgccuacgucgaggagcuccucugcguccucgagggcuacgccgccgagauggacaacccccucauggcccaccuccucuccaccggccuccacaacaagaaggacguccucuucggcaacauggaggagaucuaccacuuccacaaccgcaucuuccuccgcgagcucgagaacuacaccgacugccccgagcucgucggccgcugcuuccucgagcgcauggaggacuuccagaucuacgagaaguacugccagaacaagccccgcuccgagucccucuggcgccagugcuccgacugccccuucuuccaggagugccagcgcaagcucgaccacaagcucucccucgacuccuaccuccucaagcccguccagcgcaucaccaaguaccagcuccuccucaaggagaugcucaaguacucccgcaacugcgagggcgccgaggaccuccaggaggcccucuccuccauccucggcauccucaaggccgucaacgacuccaugcaccucaucgccaucaccggcuacgacggcaaccucggcgaccucggcaagcuccucaugcagggcuccuucuccgucuggaccgaccacaagcgcggccacaccaaggucaaggagcucgcccgcuucaagcccaugcagcgccaccucuuccuccacgagaaggccguccucuucugcaagaagcgcgaggagaacggcgagggcuacgagaaggcccccuccuacuccuacaagcagucccucaacauggccgccgucggcaucaccgagaacgucaagggcgacgccaagaaguucgagaucugguacaacgcccgcgaggaggucuacaucguccaggcccccacccccgagaucaaggccgccugggucaacgagauccgcaagguccucaccucccagcuccaggccugccgcgaggccucccagcaccgcgcccucgagcagucccagucccucccccuccccgcccccaccuccaccucccccucccgcggcaacucccgcaacaucaagaagcucgaggagcgcaagaccgacccccucucccucgagggcuacgucuccuccgccccccucaccaagccccccgagaagggcaagggcugguccaagaccucccacucccucgaggcccccgaggacgacggcggcugguccuccgccgaggagcagaucaacuccuccgacgccgaggaggacggcggccucggccccaagaagcucguccccggcaaguacaccgucgucgccgaccacgagaagggcggccccgacgcccuccgcguccgcuccggcgacgucgucgagcucguccaggagggcgacgagggccucugguacguccgcgaccccaccaccggcaaggagggcuggguccccgccuccucccucuccguccgccucggccccuccggcuccgcccagugccucuccuccuccgaguccucccccggcuccgccguccucuccaacuccuccuccugcuccgagggcggccaggcccccuucuccgaccuccagggcuga

SEQ ID NO: 45832 - RNA, 441 nt, Artificial Sequence
  derived and/or modified sequence opt2 from MCFD2__Homo_sapiens__NP_001164979
augaccaugcgcucccuccuccgcacccccuuccucugcggccuccucugggccuucugcgcccccggcgcccgcgccgaggagcccgccgccuccuucucccagcccggcuccaugggccucgacaagaacaccguccacgaccaggagcacaucauggagcaccucgagggcgucaucaacaagcccgaggccgagauguccccccaggagcuccagcuccacuacuucaagaugcacgacuacgacggcaacaaccuccucgacggccucgagcucuccaccgccaucacccacguccacaaggaggagggcuccgagcaggccccccucauguccgaggacgagcucaucaacaucaucgacggcguccuccgcgacgacgacaagaacaacgacggcuacaucgacuacgccgaguucgccaagucccuccaguga

SEQ ID NO: 45833 - RNA, 1269 nt, Artificial Sequence
  derived and/or modified sequence opt2 from MCHR1__Homo_sapiens__NP_005288
auguccgucggcgccaugaagaagggcgucggccgcgccgucggccucggcggcggcuccggcugccaggccaccgaggaggacccccuccccaacugcggcgccugcgcccccggccagggcggccgccgcuggcgccucccccagcccgccugggucgagggcuccuccgcccgccucugggagcaggccaccggcaccggcuggauggaccucgaggccucccuccuccccaccggccccaacgccuccaacaccuccgacggccccgacaaccucaccuccgccggcucccccccccgcaccggcuccaucuccuacaucaacaucaucaugcccuccgucuucggcaccaucugccuccucggcaucaucggcaacuccaccgucaucuucgccgucgucaagaaguccaagcuccacuggugcaacaacguccccgacaucuucaucaucaaccucuccgucgucgaccuccucuuccuccucggcaugcccuucaugauccaccagcucaugggcaacggcgucuggcacuucggcgagaccaugugcacccucaucaccgccauggacgccaacucccaguucaccuccaccuacauccucaccgccauggccaucgaccgcuaccucgccaccguccaccccaucuccuccaccaaguuccgcaagcccuccgucgccacccucgucaucugccuccucugggcccucuccuucaucuccaucacccccgucuggcucuacgcccgccucauccccuuccccggcggcgccgucggcugcggcauccgccuccccaaccccgacaccgaccucuacugguucacccucuaccaguucuuccucgccuucgcccuccccuucgucgucaucaccgccgccuacguccgcauccuccagcgcaugaccuccuccgucgcccccgccucccagcgcuccauccgccuccgcaccaagcgcgucacccgcaccgccaucgccaucugccucgucuucuucgucugcugggcccccuacuacguccuccagcucacccagcucuccaucucccgccccacccucaccuucgucuaccucuacaacgccgccaucucccucggcuacgccaacuccugccucaaccccuucgucuacaucguccucugcgagaccuuccgcaagcgccucguccucuccgucaagcccgccgcccagggccagcuccgcgccgucuccaacgcccagaccgccgacgaggagcgcaccgaguccaagggcaccuga

SEQ ID NO: 45834 - RNA, 1023 nt, Artificial Sequence
  derived and/or modified sequence opt2 from MCHR2__Homo_sapiens__NP_001035269
augaaccccuuccacgccuccugcuggaacaccuccgccgagcuccucaacaaguccuggaacaaggaguucgccuaccagaccgccuccgucgucgacaccgucauccuccccuccaugaucggcaucaucugcuccaccggccucgucggcaacauccucaucgucuucaccaucauccgcucccgcaagaagaccguccccgacaucuacaucugcaaccucgccgucgccgaccucguccacaucgucggcaugcccuuccucauccaccagugggcccgcggcggcgagugggucuucggcggcccccucugcaccaucaucaccucccucgacaccugcaaccaguucgccugcuccgccaucaugaccgucauguccgucgaccgcuacuucgcccucguccagcccuuccgccucacccgcuggcgcacccgcuacaagaccauccgcaucaaccucggccucugggccgccuccuucauccucgcccuccccgucugggucuacuccaaggucaucaaguucaaggacggcgucgaguccugcgccuucgaccucaccucccccgacgacguccucugguacacccucuaccucaccaucaccaccuucuucuucccccucccccucauccucgucugcuacauccucauccucugcuacaccugggagauguaccagcagaacaaggacgcccgcugcugcaaccccuccguccccaagcagcgcgucaugaagcucaccaagaugguccucguccucgucgucgucuucauccucuccgccgcccccuaccacgucauccagcucgucaaccuccagauggagcagcccacccucgccuucuacgucggcuacuaccucuccaucugccucuccuacgccuccuccuccaucaaccccuuccucuacauccuccucuccggcaacuuccagaagcgccucccccagauccagcgccgcgccaccgagaaggagaucaacaacaugggcaacacccucaagucccacuucuga

SEQ ID NO: 45835 - RNA, 1158 nt, Artificial Sequence
  derived and/or modified sequence opt2 from MCIDAS__Homo_sapiens__NP_001177716
augcaggccugcggcggcggcgccgccggccgccgcgccuucgacuccaucugccccaaccgcaugcucgcccuccccggccgcgcccuccucugcaagcccggcaagcccgagcgcaaguucgcccccccccgcaaguucuuccccggcugcaccggcggcucccccgucuccgucuacgaggacccccccgacgccgagcccaccgcccuccccgcccucaccaccaucgaccuccaggaccucgccgacugcuccucccuccucggcuccgacgccccccccggcggcgaccucgccgccucccagaaccacucccaccagaccgaggccgacuucaaccuccaggacuuccgcgacaccgucgacgaccucaucuccgacuccuccuccaugaugucccccacccucgccuccggcgacuuccccuucucccccugcgacaucucccccuucggccccugccucucccccccccucgacccccgcgcccuccagucccccccccuccgcccccccgacguccccccccccgagcaguacuggaaggaggucgccgaccagaaccagcgcgcccucggcgacgcccucgucgagaacaaccagcuccacgucacccucacccagaagcaggaggagaucgccucccucaaggagcgcaacguccagcucaaggagcucgccucccgcacccgccaccucgccuccguccucgacaagcucaugaucacccagucccgcgacugcggcgccgccgccgagcccuuccuccucaaggccaaggccaagcgcucccucgaggagcucgucuccgccgccggccaggacugcgccgaggucgacgccauccuccgcgagaucuccgagcgcugcgacgaggcccuccagucccgcgaccccaagcgcccccgccuccuccccgagcccgccaacaccgacacccgccccggcaaccuccacggcgccuuccgcggccuccgcaccgacugcucccgcuccgcccucaaccucucccacuccgagcucgaggagggcggcuccuucuccacccgcauccgcucccacuccaccauccgcacccucgccuucccccagggcaacgccuucaccauccgcaccgccaacggcggcuacaaguuccgcuggguccccuccuga

SEQ ID NO: 45836 - RNA, 2625 nt, Artificial Sequence
  derived and/or modified sequence opt2 from MCM10__Homo_sapiens__NP_060988
auggacgaggaggaggacaaccucucccuccucaccgcccuccucgaggagaacgaguccgcccucgacugcaacuccgaggagaacaacuuccucacccgcgagaacggcgagcccgacgccuucgacgagcucuucgacgccgacggcgacggcgaguccuacaccgaggaggccgacgacggcgagaccggcgagacccgcgacgagaaggagaaccucgccacccucuucggcgacauggaggaccucaccgacgaggaggagguccccgccucccaguccaccgagaaccgcguccuccccgcccccgccccccgccgcgagaagaccaacgaggagcuccaggaggagcuccgcaaccuccaggagcagaugaaggcccuccaggagcagcucaaggucaccaccaucaagcagaccgccucccccgcccgccuccagaagucccccgagaaguccccccgccccccccucaaggagcgccgcguccagcgcauccaggaguccaccugcuucuccgccgagcucgacguccccgcccucccccgcaccaagcgcgucgcccgcacccccaaggccuccccccccgaccccaaguccuccuccucccgcaugaccuccgcccccucccagccccuccagaccaucucccgcaacaagcccuccggcaucacccgcggccagaucgucggcacccccggcuccuccggcgagaccacccagcccaucugcgucgaggccuucuccggccuccgccuccgccgcccccgcgucuccuccaccgagaugaacaagaagaugaccggccgcaagcucauccgccucucccagaucaaggagaagauggcccgcgagaagcucgaggagaucgacugggucaccuucggcgucauccucaagaaggucaccccccaguccgucaacuccggcaagaccuucuccaucuggaagcucaacgaccuccgcgaccucacccagugcgucucccucuuccucuucggcgagguccacaaggcccucuggaagaccgagcagggcaccgucgucggcauccucaacgccaaccccaugaagcccaaggacggcuccgaggaggucugccucuccaucgaccacccccagaagguccucaucaugggcgaggcccucgaccucggcaccugcaaggccaagaagaagaacggcgagcccugcacccagaccgucaaccuccgcgacugcgaguacugccaguaccacguccaggcccaguacaagaagcucuccgccaagcgcgccgaccuccaguccaccuucuccggcggccgcauccccaagaaguucgcccgccgcggcaccucccucaaggagcgccucugccaggacggcuucuacuacggcggcgucuccuccgccuccuacgccgccuccaucgccgccgccgucgcccccaagaagaagauccagaccacccucuccaaccucgucgucaagggcaccaaccucaucauccaggagacccgccagaagcucggcaucccccagaagucccucuccugcuccgaggaguucaaggagcucauggaccuccccaccugcggcgcccgcaaccucaagcagcaccucgccaaggccaccgccuccggcaucaugggcucccccaagcccgccaucaaguccaucuccgccuccgcccuccucaagcagcagaagcagcgcaugcucgagaugcgccgccgcaaguccgaggagauccagaagcgcuuccuccaguccuccuccgaggucgagucccccgccguccccuccuccucccgccagccccccgcccagcccccccgcaccggcuccgaguucccccgccucgagggcgcccccgccaccaugacccccaagcucggccgcggcguccucgagggcgacgacguccucuucuacgacgaguccccccccccccgccccaagcucuccgcccucgccgaggccaagaagcucgccgccaucaccaagcuccgcgccaagggccagguccucaccaagaccaaccccaacuccaucaagaagaagcagaaggacccccaggacauccucgaggucaaggagcgcgucgagaagaacaccauguucuccucccaggccgaggacgagcucgagcccgcccgcaagaagcgccgcgagcagcucgccuaccucgaguccgaggaguuccagaagauccucaaggccaaguccaagcacaccggcauccucaaggaggccgaggccgagaugcaggagcgcuacuucgagccccucgucaagaaggagcagauggaggagaagaugcgcaacauccgcgaggucaagugccgcgucgucaccugcaagaccugcgccuacacccacuucaagcuccucgagaccugcgucuccgagcagcacgaguaccacuggcacgacggcgucaagcgcuucuucaagugccccugcggcaaccgcuccaucucccucgaccgccuccccaacaagcacugcuccaacugcggccucuacaagugggagcgcgacggcaugcucaaggagaagaccggccccaagaucggcggcgagacccuccucccccgcggcgaggagcacgccaaguuccucaacucccucaaguga

SEQ ID NO: 45837 - RNA, 2715 nt, Artificial Sequence
  derived and/or modified sequence opt2 from MCM2__Homo_sapiens__NP_004517
auggccgaguccuccgaguccuucaccauggccuccucccccgcccagcgccgccgcggcaacgacccccucaccuccucccccggccgcuccucccgccgcaccgacgcccucaccuccucccccggccgcgaccucccccccuucgaggacgaguccgagggccuccucggcaccgagggcccccucgaggaggaggaggacggcgaggagcucaucggcgacggcauggagcgcgacuaccgcgccauccccgagcucgacgccuacgaggccgagggccucgcccucgacgacgaggacgucgaggagcucaccgccucccagcgcgaggccgccgagcgcgccaugcgccagcgcgaccgcgaggccggccgcggccucggccgcaugcgccgcggccuccucuacgacuccgacgaggaggacgaggagcgccccgcccgcaagcgccgccaggucgagcgcgccaccgaggacggcgaggaggacgaggagaugaucgaguccaucgagaaccucgaggaccucaagggccacuccguccgcgagugggucuccauggccggcccccgccucgagauccaccaccgcuucaagaacuuccuccgcacccacgucgacucccacggccacaacgucuucaaggagcgcaucuccgacaugugcaaggagaaccgcgagucccucgucgucaacuacgaggaccucgccgcccgcgagcacguccucgccuacuuccuccccgaggcccccgccgagcuccuccagaucuucgacgaggccgcccucgaggucguccucgccauguaccccaaguacgaccgcaucaccaaccacauccacguccgcaucucccaccucccccucgucgaggagcuccgcucccuccgccagcuccaccucaaccagcucauccgcaccuccggcgucgucaccuccugcaccggcguccucccccagcucuccauggucaaguacaacugcaacaagugcaacuucguccucggccccuucugccagucccagaaccaggaggucaagcccggcuccugccccgagugccaguccgccggccccuucgaggucaacauggaggagaccaucuaccagaacuaccagcgcauccgcauccaggagucccccggcaaggucgccgccggccgccucccccgcuccaaggacgccauccuccucgccgaccucgucgacuccugcaagcccggcgacgagaucgagcucaccggcaucuaccacaacaacuacgacggcucccucaacaccgccaacggcuuccccgucuucgccaccgucauccucgccaaccacgucgccaagaaggacaacaaggucgccgucggcgagcucaccgacgaggacgucaagaugaucaccucccucuccaaggaccagcagaucggcgagaagaucuucgccuccaucgcccccuccaucuacggccacgaggacaucaagcgcggccucgcccucgcccucuucggcggcgagcccaagaaccccggcggcaagcacaagguccgcggcgacaucaacguccuccucugcggcgaccccggcaccgccaagucccaguuccucaaguacaucgagaaggucuccucccgcgccaucuucaccaccggccagggcgccuccgccgucggccucaccgccuacguccagcgccaccccgucucccgcgaguggacccucgaggccggcgcccucguccucgccgaccgcggcgucugccucaucgacgaguucgacaagaugaacgaccaggaccgcaccuccauccacgaggccauggagcagcaguccaucuccaucuccaaggccggcaucgucaccucccuccaggcccgcugcaccgucaucgccgccgccaaccccaucggcggccgcuacgaccccucccucaccuucuccgagaacgucgaccucaccgagcccaucaucucccgcuucgacauccucugcgucguccgcgacaccgucgaccccguccaggacgagaugcucgcccgcuucgucgucggcucccacguccgccaccaccccuccaacaaggaggaggagggccucgccaacggcuccgccgccgagcccgccaugcccaacaccuacggcgucgagccccucccccaggagguccucaagaaguacaucaucuacgccaaggagcgcguccaccccaagcucaaccagauggaccaggacaaggucgccaagauguacuccgaccuccgcaaggaguccauggccaccggcuccauccccaucaccguccgccacaucgaguccaugauccgcauggccgaggcccacgcccgcauccaccuccgcgacuacgucaucgaggacgacgucaacauggccauccgcgucaugcucgaguccuucaucgacacccagaaguucuccgucaugcgcuccaugcgcaagaccuucgcccgcuaccucuccuuccgccgcgacaacaacgagcuccuccucuucauccucaagcagcucgucgccgagcaggucaccuaccagcgcaaccgcuucggcgcccagcaggacaccaucgagguccccgagaaggaccucgucgacaaggcccgccagaucaacauccacaaccucuccgccuucuacgacuccgagcucuuccgcaugaacaaguucucccacgaccucaagcgcaagaugauccuccagcaguucuga

SEQ ID NO: 45838 - RNA, 5943 nt, Artificial Sequence
  derived and/or modified sequence opt2 from MCM3AP__Homo_sapiens__XP_006724127
augaaccccaccaaccccuucuccggccagcagcccuccgccuucuccgccuccuccuccaacgucggcacccuccccuccaagccccccuuccgcuucggccagcccucccucuucggccagaacuccacccucuccggcaaguccuccggcuucucccaggucuccuccuuccccgccuccuccggcgucucccacuccuccuccguccagacccucggcuucacccagaccuccuccgucggccccuucuccggccucgagcacaccuccaccuucgucgccaccuccggccccuccuccuccuccguccucggcaacaccggcuucuccuucaagucccccaccuccgucggcgccuuccccuccaccuccgccuucggccaggaggccggcgagaucgucaacuccggcuucggcaagaccgaguucuccuucaagccccucgagaacgccgucuucaagcccauccucggcgccgaguccgagcccgagaagacccagucccagaucgccuccggcuucuucaccuucucccaccccaucuccuccgcccccggcggccucgcccccuucuccuucccccaggucaccuccuccuccgccaccaccuccaacuucaccuucuccaagcccgucuccuccaacaacucccucuccgccuucacccccgcccucuccaaccagaacgucgaggaggagaagcgcggccccaaguccaucuucggcuccuccaacaacuccuucuccuccuuccccgucuccuccgccguccucggcgagcccuuccaggccuccaaggccggcguccgccagggcugcgaggaggccgucucccaggucgagccccuccccucccucaugaagggccucaagcgcaaggaggaccaggaccgcuccccccgccgccacggccacgagcccgccgaggacuccgacccccucucccgcggcgaccacccccccgacaagcgccccguccgccucaaccgcccccgcggcggcacccucuucggccgcaccauccaggacgucuucaaguccaacaaggaggucggccgccucggcaacaaggaggccaagaaggagaccggcuucgucgaguccgccgaguccgaccacauggccauccccggcggcaaccaguccguccucgcccccucccgcauccccggcgucaacaaggaggaggagaccgagucccgcgagaagaaggaggacucccuccgcggcacccccgcccgccaguccaaccgcuccgaguccaccgacucccucggcggccucucccccuccgaggucaccgccauccagugcaagaacauccccgacuaccucaacgaccgcaccauccucgagaaccacuucggcaagaucgccaagguccagcgcaucuucacccgccgcuccaagaagcucgccgucguccacuucuucgaccacgccuccgccgcccucgcccgcaagaagggcaagucccuccacaaggacauggccaucuucuggcaccgcaagaagaucucccccaacaagaagcccuucucccucaaggagaagaagcccggcgacggcgaggucucccccuccaccgaggacgcccccuuccagcacuccccccucggcaaggccgccggccgcaccggcgccuccucccuccucaacaaguccucccccgucaagaagcccucccuccucaaggcccaccaguucgagggcgacuccuucgacuccgccuccgagggcuccgagggccucggccccugcguccucucccucuccacccucaucggcaccgucgccgagaccuccaaggagaaguaccgccuccucgaccagcgcgaccgcaucaugcgccaggcccgcgucaagcgcaccgaccucgacaaggcccgcaccuucgucggcaccugccucgacaugugccccgagaaggagcgcuacaugcgcgagacccgcucccagcucuccgucuucgaggucguccccggcaccgaccaggucgaccacgccgccgccgucaaggaguacucccgcuccuccgccgaccaggaggagccccucccccacgagcuccgcccccuccccguccucucccgcaccauggacuaccucgucacccagaucauggaccagaaggagggcucccuccgcgacugguacgacuucgucuggaaccgcacccgcggcauccgcaaggacaucacccagcagcaccucugcgacccccucaccgucucccucaucgagaagugcacccgcuuccacauccacugcgcccacuucaugugcgaggagcccauguccuccuucgacgccaagaucaacaacgagaacaugaccaagugccuccagucccucaaggagauguaccaggaccuccgcaacaagggcgucuucugcgccuccgaggccgaguuccagggcuacaacguccuccucucccucaacaagggcgacauccuccgcgagguccagcaguuccaccccgccguccgcaacuccuccgaggucaaguucgccguccaggccuucgccgcccucaacuccaacaacuucguccgcuucuucaagcucguccaguccgccuccuaccucaacgccugccuccuccacugcuacuucucccagauccgcaaggacgcccuccgcgcccucaacuucgccuacaccgucuccacccagcgcuccaccaucuucccccucgacggcgucguccgcaugcuccucuuccgcgacugcgaggaggccaccgacuuccucaccugccacggccucaccgucuccgacggcugcgucgagcucaaccgcuccgccuuccucgagcccgagggccucuccaagacccgcaaguccgucuucaucacccgcaagcucaccgucuccgucggcgagaucgucaacggcggcccccucccccccgucccccgccacacccccgucugcuccuucaacucccagaacaaguacaucggcgagucccucgccgccgagcuccccgucuccacccagcgccccggcuccgacaccgucggcggcggccgcggcgaggagugcggcgucgagcccgacgccccccucuccucccucccccagucccuccccgcccccgcccccucccccgucccccucccccccguccucgcccucacccccuccgucgcccccucccucuuccagcucuccguccagcccgagccccccccccccgagcccguccccauguacuccgacgaggaccucgcccaggucgucgacgagcucauccaggaggcccuccagcgcgacugcgaggaggucggcuccgccggcgccgccuacgccgccgccgcccucggcgucuccaacgccgccauggaggaccuccucaccgccgccaccaccggcauccuccgccacaucgccgccgaggaggucuccaaggagcgcgagcgccgcgagcaggagcgccagcgcgccgaggaggagcgccucaagcaggagcgcgagcucguccucuccgagcucucccagggccucgccgucgagcucauggagcgcgucaugauggaguucguccgcgagaccugcucccaggagcucaagaacgccgucgagaccgaccagcgcguccgcgucgcccgcugcugcgaggacgucugcgcccaccucgucgaccucuuccucgucgaggagaucuuccagaccgccaaggagacccuccaggagcuccagugcuucugcaaguaccuccagcgcuggcgcgaggccgucaccgcccgcaagaagcuccgccgccagaugcgcgccuuccccgccgcccccugcugcgucgacgucuccgaccgccuccgcgcccucgcccccuccgccgagugccccaucgccgaggagaaccucgcccgcggccuccucgaccucggccacgccggccgccucggcaucuccugcacccgccuccgccgccuccgcaacaagaccgcccaccagaugaagguccagcacuucuaccagcagcuccucuccgacgucgccugggccucccucgaccuccccucccucgucgccgagcaccuccccggccgccaggagcacgucuucuggaagcucguccucguccuccccgacgucgaggagcagucccccgaguccugcggccgcauccucgccaacuggcucaaggucaaguucaugggcgacgagggcuccgucgacgacaccuccuccgacgccggcggcauccagacccucucccucuucaacucccucuccuccaagggcgaccagaugaucuccgucaacgucugcaucaaggucgcccacggcgcccucuccgacggcgccaucgacgccgucgagacccagaaggaccuccucggcgccuccggccucaugcuccuccucccccccaagaugaaguccgaggacauggccgaggaggacgucuacuggcucuccgcccuccuccagcucaagcagcuccuccaggccaagcccuuccagcccgcccucccccucgucguccucguccccucccccggcggcgacgccgucgagaaggaggucgaggacggccucaugcuccaggaccucgucuccgccaagcucaucuccgacuacaccgucaccgagauccccgacaccaucaacgaccuccagggcuccaccaagguccuccaggccguccaguggcucgucucccacugcccccacucccucgaccucugcugccagacccucauccaguacgucgaggacggcaucggccacgaguucuccggccgcuucuuccacgaccgccgcgagcgccgccucggcggccucgccucccaggagcccggcgccaucaucgagcucuucaacuccguccuccaguuccucgccuccgucgucuccuccgagcagcucugcgaccucuccuggcccgucaccgaguucgccgaggccggcggcucccgccuccucccccaccuccacuggaacgcccccgagcaccucgccuggcucaagcaggccguccucggcuuccagcucccccagauggaccuccccccccucggcgcccccuggcuccccgucugcuccauggucguccaguacgccucccagauccccuccucccgccagacccagcccguccuccagucccaggucgagaaccuccuccaccgcaccuacugccgcuggaaguccaagucccccucccccguccacggcgccggccccuccgucauggagauccccugggacgaccucaucgcccucugcaucaaccacaagcuccgcgacuggacccccccccgccuccccgucaccuccgaggcccucuccgaggacggccagaucugcgucuacuucuucaagaacgaccucaagaaguacgacgucccccucuccugggagcaggcccgccuccagacccagaaggagcuccagcuccgcgagggccgccucgccaucaagcccuuccaccccuccgccaacaacuuccccaucccccuccuccacaugcaccgcaacuggaagcgcuccaccgagugcgcccaggagggccgcauccccuccaccgaggaccucaugcgcggcgccuccgccgaggagcuccucgcccagugccucuccuccucccuccuccucgagaaggaggagaacaagcgcuucgaggaccagcuccagcaguggcucuccgaggacuccggcgccuucaccgaccucaccucccucccccucuaccucccccagacccucgucucccucucccacaccaucgagcccgucaugaagaccuccgucaccaccuccccccaguccgacaugaugcgcgagcagcuccagcucuccgaggccaccggcaccugccucggcgagcgccucaagcaccucgagcgccucauccgcuccucccgcgaggaggaggucgccuccgagcuccaccucuccgcccuccucgacauggucgacaucuga

SEQ ID NO: 45839 - RNA, 2457 nt, Artificial Sequence
  derived and/or modified sequence opt2 from MCM3__Homo_sapiens__NP_001257401
augcucaucugcucccagggcccccgccucuuccucgaggucaccuucggcggcggcaaguccuccgaggucuucgcccccggcuggucccaccccggcaaccuccacgccacccucgucgaggucguccucuggcagcgcgccuggcgcguccccuggugcuggaccaugugguccugcggccgccuccgcgagaucaccuggaccuccuggaccacccgccuccucaacaacgccuucgaggagcucgucgccuuccagcgcgcccucaaggacuucgucgccuccaucgacgccaccuacgccaagcaguacgaggaguucuacgucggccucgagggcuccuucggcuccaagcacgucuccccccgcacccucaccuccugcuuccucuccugcgucgucugcgucgagggcaucgucaccaagugcucccucguccgccccaaggucguccgcuccguccacuacugccccgccaccaagaagaccaucgagcgccgcuacuccgaccucaccacccucgucgccuuccccuccuccuccgucuaccccaccaaggacgaggagaacaacccccucgagaccgaguacggccucuccgucuacaaggaccaccagaccaucaccauccaggagaugcccgagaaggcccccgccggccagcucccccgcuccgucgacgucauccucgacgacgaccucgucgacaaggccaagcccggcgaccgcguccaggucgucggcaccuaccgcugccuccccggcaagaagggcggcuacaccuccggcaccuuccgcaccguccucaucgccugcaacgucaagcagauguccaaggacgcccagcccuccuucuccgccgaggacaucgccaagaucaagaaguucuccaagacccgcuccaaggacaucuucgaccagcucgccaagucccucgcccccuccauccacggccacgacuacgucaagaaggccauccucugccuccuccucggcggcgucgagcgcgaccucgagaacggcucccacauccgcggcgacaucaacauccuccucaucggcgaccccuccgucgccaagucccagcuccuccgcuacguccucugcaccgccccccgcgccauccccaccaccggccgcggcuccuccggcgucggccucaccgccgccgucaccaccgaccaggagaccggcgagcgccgccucgaggccggcgccaugguccucgccgaccgcggcgucgucugcaucgacgaguucgacaagauguccgacauggaccgcaccgccauccacgaggucauggagcagggccgcgucaccaucgccaaggccggcauccacgcccgccucaacgcccgcugcuccguccucgccgccgccaaccccgucuacggccgcuacgaccaguacaagacccccauggagaacaucggccuccaggacucccuccucucccgcuucgaccuccucuucaucaugcucgaccagauggaccccgagcaggaccgcgagaucuccgaccacguccuccgcaugcaccgcuaccgcgcccccggcgagcaggacggcgacgccaugccccucggcuccgccgucgacauccucgccaccgacgaccccaacuucucccaggaggaccagcaggacacccagaucuacgagaagcacgacaaccuccuccacggcaccaagaagaagaaggagaagauggucuccgccgccuucaugaagaaguacauccacgucgccaagaucaucaagcccguccucacccaggaguccgccaccuacaucgccgaggaguacucccgccuccgcucccaggacuccauguccuccgacaccgcccgcaccucccccgucaccgcccgcacccucgagacccucauccgccucgccaccgcccacgccaaggcccgcauguccaagaccgucgaccuccaggacgccgaggaggccgucgagcucguccaguacgccuacuucaagaagguccucgagaaggagaagaagcgcaagaagcgcuccgaggacgaguccgagaccgaggacgaggaggagaagucccaggaggaccaggagcagaagcgcaagcgccgcaagacccgccagcccgacgccaaggacggcgacuccuacgaccccuacgacuucuccgacaccgaggaggagaugccccagguccacacccccaagaccgccgacucccaggagaccaaggagucccagaaggucgagcucuccgagucccgccucaaggccuucaaggucgcccuccucgacgucuuccgcgaggcccacgcccaguccaucggcaugaaccgccucaccgaguccaucaaccgcgacuccgaggagcccuucuccuccgucgagauccaggccgcccucuccaagaugcaggacgacaaccaggucauggucuccgagggcaucaucuuccucaucuga

SEQ ID NO: 45840 - RNA, 2592 nt, Artificial Sequence
  derived and/or modified sequence opt2 from MCM4__Homo_sapiens__NP_877423
auguccucccccgccuccacccccucccgccgcggcucccgccgcggccgcgccacccccgcccagaccccccgcuccgaggacgcccgcuccucccccucccagcgccgccgcggcgaggacuccaccuccaccggcgagcuccagcccaugcccaccucccccggcgucgaccuccagucccccgccgcccaggacguccucuucuccucccccccccagaugcacuccuccgccaucccccucgacuucgacgucuccuccccccucaccuacggcacccccuccucccgcgucgagggcaccccccgcuccggcguccgcggcacccccguccgccagcgccccgaccucggcuccgcccagaagggccuccaggucgaccuccaguccgacggcgccgccgccgaggacaucgucgccuccgagcagucccucggccagaagcucgucaucuggggcaccgacgucaacgucgccgccugcaaggagaacuuccagcgcuuccuccagcgcuucaucgacccccucgccaaggaggaggagaacgucggcaucgacaucaccgagccccucuacaugcagcgccucggcgagaucaacgucaucggcgagcccuuccucaacgucaacugcgagcacaucaaguccuucgacaagaaccucuaccgccagcucaucuccuacccccaggaggucauccccaccuucgacauggccgucaacgagaucuucuucgaccgcuaccccgacuccauccucgagcaccagauccagguccgccccuucaacgcccucaagaccaagaacaugcgcaaccucaaccccgaggacaucgaccagcucaucaccaucuccggcauggucauccgcaccucccagcucauccccgagaugcaggaggccuucuuccagugccaggucugcgcccacaccacccgcgucgagauggaccgcggccgcaucgccgagcccuccgucugcggccgcugccacaccacccacuccauggcccucauccacaaccgcucccucuucuccgacaagcagaugaucaagcuccaggagucccccgaggacaugcccgccggccagaccccccacaccgucauccucuucgcccacaacgaccucgucgacaagguccagcccggcgaccgcgucaacgucaccggcaucuaccgcgccguccccauccgcgucaacccccgcgucuccaacgucaaguccgucuacaagacccacaucgacgucauccacuaccgcaagaccgacgccaagcgccuccacggccucgacgaggaggccgagcagaagcucuucuccgagaagcgcgucgagcuccucaaggagcucucccgcaagcccgacaucuacgagcgccucgccuccgcccucgcccccuccaucuacgagcacgaggacaucaagaagggcauccuccuccagcucuucggcggcacccgcaaggacuucucccacaccggccgcggcaaguuccgcgccgagaucaacauccuccucugcggcgaccccggcaccuccaagucccagcuccuccaguacgucuacaaccucgucccccgcggccaguacaccuccggcaagggcuccuccgccgucggccucaccgccuacgucaugaaggaccccgagacccgccagcucguccuccagaccggcgcccucguccucuccgacaacggcaucugcugcaucgacgaguucgacaagaugaacgaguccacccgcuccguccuccacgaggucauggagcagcagacccucuccaucgccaaggccggcaucaucugccagcucaacgcccgcaccuccguccucgccgccgccaaccccaucgagucccaguggaaccccaagaagaccaccaucgagaacauccagcucccccacacccuccucucccgcuucgaccucaucuuccuccuccucgacccccaggacgaggccuacgaccgccgccucgcccaccaccucgucgcccucuacuaccaguccgaggagcaggccgaggaggagcuccucgacauggccguccucaaggacuacaucgccuacgcccacuccaccaucaugccccgccucuccgaggaggccucccaggcccucaucgaggccuacgucgacaugcgcaagaucggcuccucccgcggcauggucuccgccuacccccgccagcucgagucccucauccgccucgccgaggcccacgccaagguccgccucuccaacaaggucgaggccaucgacgucgaggaggccaagcgccuccaccgcgaggcccucaagcaguccgccaccgacccccgcaccggcaucgucgacaucuccauccucaccaccggcauguccgccaccucccgcaagcgcaaggaggagcucgccgaggcccucaagaagcucauccucuccaagggcaagacccccgcccucaaguaccagcagcucuucgaggacauccgcggccaguccgacaucgccaucaccaaggacauguucgaggaggcccuccgcgcccucgccgacgacgacuuccucaccgucaccggcaagaccguccgccuccucuga

SEQ ID NO: 45841 - RNA, 2205 nt, Artificial Sequence
  derived and/or modified sequence opt2 from MCM5__Homo_sapiens__NP_006730
auguccggcuucgacgaccccggcaucuucuacuccgacuccuucggcggcgacgcccaggccgacgagggccaggcccgcaagucccagcuccagcgccgcuucaaggaguuccuccgccaguaccgcgucggcaccgaccgcaccggcuucaccuucaaguaccgcgacgagcucaagcgccacuacaaccucggcgaguacuggaucgaggucgagauggaggaccucgccuccuucgacgaggaccucgccgacuaccucuacaagcagcccgccgagcaccuccagcuccucgaggaggccgccaaggaggucgccgacgaggucacccgcccccgccccuccggcgaggagguccuccaggacauccaggucaugcucaaguccgacgccucccccuccuccauccgcucccucaaguccgacaugaugucccaccucgucaagauccccggcaucaucaucgccgccuccgccguccgcgccaaggccacccgcaucuccauccagugccgcuccugccgcaacacccucaccaacaucgccaugcgccccggccucgagggcuacgcccucccccgcaagugcaacaccgaccaggccggccgccccaagugcccccucgaccccuacuucaucaugcccgacaagugcaagugcgucgacuuccagacccucaagcuccaggagcuccccgacgccgucccccacggcgagaugccccgccacaugcagcucuacugcgaccgcuaccucugcgacaaggucguccccggcaaccgcgucaccaucaugggcaucuacuccaucaagaaguucggccucaccaccucccgcggccgcgaccgcgucggcgucggcauccgcuccuccuacauccgcguccucggcauccaggucgacaccgacggcuccggccgcuccuucgccggcgccgucuccccccaggaggaggaggaguuccgccgccucgccgcccuccccaacgucuacgaggucaucuccaaguccaucgcccccuccaucuucggcggcaccgacaugaagaaggccaucgccugccuccucuucggcggcucccgcaagcgccuccccgacggccucacccgccgcggcgacaucaaccuccucaugcucggcgaccccggcaccgccaagucccagcuccucaaguucgucgagaagugcucccccaucggcgucuacaccuccggcaagggcuccuccgccgccggccucaccgccuccgucaugcgcgaccccuccucccgcaacuucaucauggagggcggcgccaugguccucgccgacggcggcgucgucugcaucgacgaguucgacaagaugcgcgaggacgaccgcgucgccauccacgaggccauggagcagcagaccaucuccaucgccaaggccggcaucaccaccacccucaacucccgcugcuccguccucgccgccgccaacuccgucuucggccgcugggacgagaccaagggcgaggacaacaucgacuucaugcccaccauccucucccgcuucgacaugaucuucaucgucaaggacgagcacaacgaggagcgcgacgucaugcucgccaagcacgucaucacccuccacgucuccgcccucacccagacccaggccgucgagggcgagaucgaccucgccaagcucaagaaguucaucgccuacugccgcgucaagugcggcccccgccucuccgccgaggccgccgagaagcucaagaaccgcuacaucaucaugcgcuccggcgcccgccagcacgagcgcgacuccgaccgccgcuccuccauccccaucaccguccgccagcucgaggccaucguccgcaucgccgaggcccucuccaagaugaagcuccagcccuucgccaccgaggccgacgucgaggaggcccuccgccucuuccaggucuccacccucgacgccgcccucuccggcacccucuccggcgucgagggcuucaccucccaggaggaccaggagaugcucucccgcaucgagaagcagcucaagcgccgcuucgccaucggcucccaggucuccgagcacuccaucaucaaggacuucaccaagcagaaguaccccgagcacgccauccacaagguccuccagcucaugcuccgccgcggcgagauccagcaccgcaugcagcgcaagguccucuaccgccucaaguga

SEQ ID NO: 45842 - RNA, 2466 nt, Artificial Sequence
  derived and/or modified sequence opt2 from MCM6__Homo_sapiens__NP_005906
auggaccucgccgccgccgccgagcccggcgccggcucccagcaccucgagguccgcgacgaggucgccgagaagugccagaagcucuuccucgacuuccucgaggaguuccaguccuccgacggcgagaucaaguaccuccagcucgccgaggagcucauccgccccgagcgcaacacccucgucgucuccuucgucgaccucgagcaguucaaccagcagcucuccaccaccauccaggaggaguucuaccgcgucuaccccuaccucugccgcgcccucaagaccuucgucaaggaccgcaaggagaucccccucgccaaggacuucuacgucgccuuccaggaccuccccacccgccacaagauccgcgagcucaccuccucccgcaucggccuccucacccgcaucuccggccaggucguccgcacccaccccguccaccccgagcucgucuccggcaccuuccucugccucgacugccagaccgucauccgcgacgucgagcagcaguucaaguacacccagcccaacaucugccgcaaccccgucugcgccaaccgccgccgcuuccuccucgacaccaacaagucccgcuucgucgacuuccagaagguccgcauccaggagacccaggccgagcucccccgcggcuccaucccccgcucccucgaggucauccuccgcgccgaggccgucgaguccgcccaggccggcgacaagugcgacuucaccggcacccucaucgucguccccgacgucuccaagcucuccacccccggcgcccgcgccgagaccaacucccgcgucuccggcgucgacggcuacgagaccgagggcauccgcggccuccgcgcccucggcguccgcgaccucuccuaccgccucgucuuccucgccugcugcgucgcccccaccaacccccgcuucggcggcaaggagcuccgcgacgaggagcagaccgccgaguccaucaagaaccagaugaccgucaaggagugggagaaggucuucgagaugucccaggacaagaaccucuaccacaaccucugcaccucccucuuccccaccauccacggcaacgacgaggucaagcgcggcguccuccucaugcucuucggcggcguccccaagaccaccggcgagggcaccucccuccgcggcgacaucaacgucugcaucgucggcgaccccuccaccgccaagucccaguuccucaagcacgucgaggaguucuccccccgcgccgucuacaccuccggcaaggccuccuccgccgccggccucaccgccgccgucguccgcgacgaggagucccacgaguucgucaucgaggccggcgcccucaugcucgccgacaacggcgucugcugcaucgacgaguucgacaagauggacguccgcgaccaggucgccauccacgaggccauggagcagcagaccaucuccaucaccaaggccggcgucaaggccacccucaacgcccgcaccuccauccucgccgccgccaaccccaucuccggccacuacgaccgcuccaagucccucaagcagaacaucaaccucuccgcccccaucaugucccgcuucgaccucuucuucauccucgucgacgagugcaacgaggucaccgacuacgccaucgcccgccgcaucgucgaccuccacucccgcaucgaggaguccaucgaccgcgucuacucccucgacgacauccgccgcuaccuccucuucgcccgccaguucaagcccaagaucuccaaggaguccgaggacuucaucgucgagcaguacaagcaccuccgccagcgcgacggcuccggcgucaccaaguccuccuggcgcaucaccguccgccagcucgaguccaugauccgccucuccgaggccauggcccgcaugcacugcugcgacgagguccagcccaagcacgucaaggaggccuuccgccuccucaacaaguccaucauccgcgucgagacccccgacgucaaccucgaccaggaggaggagauccagauggaggucgacgagggcgccggcggcaucaacggccacgccgacucccccgcccccgucaacggcaucaacggcuacaacgaggacaucaaccaggaguccgcccccaaggccucccuccgccucggcuucuccgaguacugccgcaucuccaaccucaucguccuccaccuccgcaaggucgaggaggaggaggacgaguccgcccucaagcgcuccgagcucgucaacugguaccucaaggagaucgaguccgagaucgacuccgaggaggagcucaucaacaagaagcgcaucaucgagaaggucauccaccgccucacccacuacgaccacguccucaucgagcucacccaggccggccucaagggcuccaccgagggcuccgaguccuacgaggaggaccccuaccucgucgucaaccccaacuaccuccucgaggacuga

SEQ ID NO: 45843 - RNA, 2160 nt, Artificial Sequence
  derived and/or modified sequence opt2 from MCM7__Homo_sapiens__NP_005907
auggcccucaaggacuacgcccucgagaaggagaaggucaagaaguuccuccaggaguucuaccaggacgacgagcucggcaagaagcaguucaaguacggcaaccagcucguccgccucgcccaccgcgagcaggucgcccucuacgucgaccucgacgacgucgccgaggacgaccccgagcucgucgacuccaucugcgagaacgcccgccgcuacgccaagcucuucgccgacgccguccaggagcuccucccccaguacaaggagcgcgaggucgucaacaaggacguccucgacgucuacaucgagcaccgccucaugauggagcagcgcucccgcgaccccggcaugguccgcuccccccagaaccaguaccccgccgagcucaugcgccgcuucgagcucuacuuccagggccccuccuccaacaagccccgcgucauccgcgagguccgcgccgacuccgucggcaagcucgucaccguccgcggcaucgucacccgcgucuccgaggucaagcccaagauggucgucgccaccuacaccugcgaccagugcggcgccgagaccuaccagcccauccagucccccaccuucaugccccucaucaugugccccucccaggagugccagaccaaccgcuccggcggccgccucuaccuccagacccgcggcucccgcuucaucaaguuccaggagaugaagaugcaggagcacuccgaccagguccccgucggcaacaucccccgcuccaucaccguccucgucgagggcgagaacacccgcaucgcccagcccggcgaccacgucuccgucaccggcaucuuccuccccauccuccgcaccggcuuccgccaggucguccagggccuccucuccgagaccuaccucgaggcccaccgcaucgucaagaugaacaaguccgaggacgacgaguccggcgccggcgagcucacccgcgaggagcuccgccagaucgccgaggaggacuucuacgagaagcucgccgccuccaucgcccccgagaucuacggccacgaggacgucaagaaggcccuccuccuccuccucgucggcggcgucgaccaguccccccgcggcaugaagauccgcggcaacaucaacaucugccucaugggcgaccccggcgucgccaagucccagcuccucuccuacaucgaccgccucgccccccgcucccaguacaccaccggccgcggcuccuccggcgucggccucaccgccgccguccuccgcgacuccgucuccggcgagcucacccucgagggcggcgcccucguccucgccgaccagggcgucugcugcaucgacgaguucgacaagauggccgaggccgaccgcaccgccauccacgaggucauggagcagcagaccaucuccaucgccaaggccggcauccucaccacccucaacgcccgcugcuccauccucgccgccgccaaccccgccuacggccgcuacaacccccgccgcucccucgagcagaacauccagcuccccgccgcccuccucucccgcuucgaccuccucuggcucauccaggaccgccccgaccgcgacaacgaccuccgccucgcccagcacaucaccuacguccaccagcacucccgccagccccccucccaguucgagccccucgacaugaagcucaugcgccgcuacaucgccaugugccgcgagaagcagcccaugguccccgagucccucgccgacuacaucaccgccgccuacgucgagaugcgccgcgaggccugggccuccaaggacgccaccuacaccuccgcccgcacccuccucgccauccuccgccucuccaccgcccucgcccgccuccgcauggucgacgucgucgagaaggaggacgucaacgaggccauccgccucauggagauguccaaggacucccuccucggcgacaagggccagaccgcccgcacccagcgccccgccgacgucaucuucgccaccguccgcgagcucgucuccggcggccgcuccguccgcuucuccgaggccgagcagcgcugcgucucccgcggcuucacccccgcccaguuccaggccgcccucgacgaguacgaggagcucaacgucuggcaggucaacgccucccgcacccgcaucaccuucgucuga

SEQ ID NO: 45844 - RNA, 2523 nt, Artificial Sequence
  derived and/or modified sequence opt2 from MCM8__Homo_sapiens__NP_001268449
augaacggcgaguaccgcggccgcggcuucggccgcggccgcuuccaguccuggaagcgcggccgcggcggcggcaacuucuccggcaaguggcgcgagcgcgagcaccgccccgaccucuccaagaccaccggcaagcgcaccuccgagcagaccccccaguuccuccucuccaccaagaccccccaguccaugcaguccacccucgaccgcuucauccccuacaagggcuggaagcucuacuucuccgaggucuacuccgacuccuccccccucaucgagaagauccaggccuucgagaaguucuucacccgccacaucgaccucuacgacaaggacgagaucgagcgcaagggcuccauccucgucgacuucaaggagcucaccgagggcggcgaggucaccaaccucauccccgacaucgccaccgagcuccgcgacgcccccgagaagacccucgccugcaugggccucgccauccaccagguccucaccaaggaccucgagcgccacgccgccgagcuccaggcccaggagggccucuccaacgacggcgagaccauggucaacgucccccacauccacgcccgcgucuacaacuacgagccccucacccagcucaagaacguccgcgccaacuacuacggcaaguacaucgcccuccgcggcaccgucguccgcgucuccaacaucaagccccucugcaccaagauggccuuccucugcgccgccugcggcgagauccaguccuucccccuccccgacggcaaguacucccuccccaccaagugccccguccccgucugccgcggccgcuccuucaccgcccuccgcuccuccccccucaccgucaccauggacuggcaguccaucaagauccaggagcucauguccgacgaccagcgcgaggccggccgcaucccccgcaccaucgagugcgagcucguccacgaccucgucgacuccugcguccccggcgacaccgucaccaucaccggcaucgucaaggucuccaacgccgaggagggcucccgcaacaagaacgacaagugcauguuccuccucuacaucgaggccaacuccaucuccaacuccaagggccagaagaccaaguccuccgaggacggcugcaagcacggcaugcucauggaguucucccucaaggaccucuacgccauccaggagauccaggccgaggagaaccucuucaagcucaucgucaacucccucugccccgucaucuucggccacgagcucgucaaggccggccucgcccucgcccucuucggcggcucccagaaguacgccgacgacaagaaccgcauccccauccgcggcgacccccacauccucgucgucggcgaccccggccucggcaagucccagaugcuccaggccgccugcaacgucgccccccgcggcgucuacgucugcggcaacaccaccaccaccuccggccucaccgucacccucuccaaggacuccuccuccggcgacuucgcccucgaggccggcgcccucguccucggcgaccagggcaucugcggcaucgacgaguucgacaagaugggcaaccagcaccaggcccuccucgaggccauggagcagcaguccaucucccucgccaaggccggcgucgucugcucccuccccgcccgcaccuccaucaucgccgccgccaaccccgucggcggccacuacaacaaggccaagaccgucuccgagaaccucaagaugggcuccgcccuccucucccgcuucgaccucgucuucauccuccucgacacccccaacgagcaccacgaccaccuccucuccgagcacgucaucgccauccgcgccggcaagcagcgcaccaucuccuccgccaccgucgcccgcaugaacucccaggacuccaacaccuccguccucgaggucgucuccgagaagccccucuccgagcgccucaaggucguccccggcgagaccaucgaccccaucccccaccagcuccuccgcaaguacaucggcuacgcccgccaguacgucuacccccgccucuccaccgaggccgcccgcguccuccaggacuucuaccucgagcuccgcaagcagucccagcgccucaacuccucccccaucaccacccgccagcucgagucccucauccgccucaccgaggcccgcgcccgccucgagcuccgcgaggaggccaccaaggaggacgccgaggacaucgucgagaucaugaaguacuccaugcucggcaccuacuccgacgaguucggcaaccucgacuucgagcgcucccagcacggcuccggcauguccaaccgcuccaccgccaagcgcuucaucuccgcccucaacaacgucgccgagcgcaccuacaacaacaucuuccaguuccaccagcuccgccagaucgccaaggagcucaacauccaggucgccgacuucgagaacuucaucggcucccucaacgaccagggcuaccuccucaagaagggccccaaggucuaccagcuccagaccauguga

SEQ ID NO: 45845 - RNA, 3432 nt, Artificial Sequence
  derived and/or modified sequence opt2 from MCM9__Homo_sapiens__NP_060166
augaacuccgaccaggucacccucgucggccaggucuucgaguccuacgucuccgaguaccacaagaacgacauccuccucauccucaaggagcgcgacgaggacgcccacuaccccgucgucgucaacgccaugacccucuucgagaccaacauggagaucggcgaguacuucaacauguuccccuccgagguccucaccaucuucgacuccgcccuccgccgcuccgcccucaccauccuccagucccucucccagcccgaggccgucuccaugaagcagaaccuccacgcccgcaucuccggccuccccgucugccccgagcucguccgcgagcacauccccaagaccaaggacgucggccacuuccucuccgucaccggcaccgucauccgcaccucccucgucaagguccucgaguucgagcgcgacuacaugugcaacaagugcaagcacgucuucgucaucaaggccgacuucgagcaguacuacaccuucugccgccccuccuccugccccucccucgaguccugcgacuccuccaaguucaccugccucuccggccucuccuccucccccacccgcugccgcgacuaccaggagaucaagauccaggagcagguccagcgccucuccgucggcuccaucccccgcuccaugaaggucauccucgaggacgaccucgucgacuccugcaaguccggcgacgaccucaccaucuacggcaucgucaugcagcgcuggaagcccuuccagcaggacguccgcugcgaggucgagaucguccucaaggccaacuacauccaggucaacaacgagcaguccuccggcaucaucauggacgaggagguccagaaggaguucgaggacuucugggaguacuacaaguccgaccccuucgccggccgcaacgucauccucgccucccucugcccccaggucuucggcauguaccucgucaagcucgccgucgccaugguccucgccggcggcauccagcgcaccgacgccaccggcacccgcguccgcggcgagucccaccuccuccucgucggcgaccccggcaccggcaagucccaguuccucaaguacgccgccaagaucaccccccgcuccguccucaccaccggcaucggcuccaccuccgccggccucaccgucaccgccgucaaggacuccggcgaguggaaccucgaggccggcgcccucguccucgccgacgccggccucugcugcaucgacgaguucaacucccucaaggagcacgaccgcaccuccauccacgaggccauggagcagcagaccaucuccgucgccaaggccggccucgucugcaagcucaacacccgcaccaccauccucgccgccaccaaccccaagggccaguacgacccccaggaguccgucuccgucaacaucgcccucggcuccccccuccucucccgcuucgaccucauccucguccuccucgacaccaagaacgaggacugggaccgcaucaucuccuccuucauccucgagaacaagggcuaccccuccaaguccgagaagcucugguccauggagaagaugaagaccuacuucugccucauccgcaaccuccagcccacccucuccgacgucggcaaccagguccuccuccgcuacuaccagaugcagcgccaguccgacugccgcaacgccgcccgcaccaccauccgccuccucgagucccucauccgccucgccgaggcccacgcccgccucauguuccgcgacaccgucacccucgaggacgccaucaccgucgucuccgucauggaguccuccaugcagggcggcgcccuccucggcggcgucaacgcccuccacaccuccuuccccgagaaccccggcgagcaguaccagcgccagugcgagcucauccucgagaagcucgagcuccagucccuccucuccgaggagcuccgccgccucgagcgccuccagaaccaguccguccaccagucccagccccgcguccucgaggucgagaccacccccggcucccuccgcaacggccccggcgaggaguccaacuuccgcaccuccucccagcaggagaucaacuacuccacccacaucuucucccccggcggcucccccgagggcucccccguccucgacccccccccccaccucgagcccaaccgcuccaccucccgcaagcacuccgcccagcacaagaacaaccgcgacgacucccucgacugguucgacuucauggccacccaccaguccgagcccaagaacaccgucgucgucuccccccaccccaagaccuccggcgagaacauggccuccaagaucuccaacuccaccucccagggcaaggagaaguccgagcccggccagcgcuccaaggucgacaucggccuccuccccucccccggcgagaccggcguccccuggcgcgccgacaacgucgaguccaacaagaagaagcgccucgcccucgacuccgaggccgccgucuccgccgacaagcccgacuccguccucacccaccacgucccccgcaaccuccagaagcucugcaaggagcgcgcccagaagcucugccgcaacuccacccgcguccccgcccagugcaccguccccucccacccccaguccacccccguccacucccccgaccgcaugcucgacucccccaagcgcaagcgccccaagucccucgcccaggucgaggagcccgccaucgagaacgucaagccccccggcucccccgucgccaagcucgccaaguucaccuucaagcagaaguccaagcucauccacuccuucgaggaccacucccacgucucccccggcgccaccaagaucgccguccacucccccaagaucucccagcgccgcacccgccgcgacgccgcccuccccgucaagcgccccggcaagcucaccuccacccccggcaaccagaucuccucccagccccagggcgagaccaaggaggucucccagcagccccccgagaagcacggcccccgcgagaaggucaugugcgcccccgagaagcgcaucauccagcccgagcucgagcucggcaacgagaccggcugcgcccaccucaccugcgagggcgacaagaaggaggaggucuccggcuccaacaaguccggcaagguccacgccugcacccucgcccgccucgccaacuucugcuucaccccccccuccgaguccaaguccaagucccccccccccgagcgcaagaaccgcggcgagcgcggccccuccuccccccccaccaccaccgcccccaugcgcgucuccaagcgcaaguccuuccagcuccgcggcuccaccgagaagcucaucgucuccaaggagucccucuucacccuccccgagcucggcgacgaggccuucgacugcgacugggacgaggagaugcgcaagaaguccuga

SEQ ID NO: 45846 - RNA, 1923 nt, Artificial Sequence
  derived and/or modified sequence opt2 from MCMBP__Homo_sapiens__NP_001243307
augcccugcggcgaggacuggcucucccacccccucggcaucguccagggcuucuucgcccagaacggcgucaaccccgacugggagaagaaggucaucgaguacuucaaggagaagcucaaggagaacaacgcccccaaguggguccccucccucaacgaggucccccuccacuaccucaagcccaacuccuucgucaaguuccgcugcaugauccaggacauguucgaccccgaguucuacaugggcgucuacgagaccgucaaccagaacaccaaggcccacguccuccacuucggcaaguaccgcgacgucgccgagugcggcccccagcaggagcucgaccucaacuccccccgcaacaccacccucgagcgccagaccuucuacugcguccccguccccggcgaguccaccugggucaaggaggccuacgucaacgccaaccaggcccgcgucucccccuccaccuccuacacccccucccgccacaagcgcuccuacgaggacgacgacgacauggaccuccagcccaacaagcagaaggaccagcacgccggcgcccgccaggccggcuccgucggcggccuccaguggugcggcgagcccaagcgccucgagaccgaggccuccaccggccagcagcucaacucccucaaccucuccucccccuucgaccucaacuucccccuccccggcgagaagggccccgccugccucgucaaggucuacgaggacugggacugcuucaaggucaacgacauccucgagcucuacggcauccucuccgucgaccccguccucuccauccucaacaacgacgagcgcgacgccuccgcccuccucgaccccauggagugcaccgacaccgccgaggagcagcgcguccacuccccccccgccucccucgucccccgcauccacgucauccucgcccagaagcuccagcacaucaacccccuccuccccgccugccucaacaaggaggaguccaagaccuucgucuccuccuucauguccgagcucucccccguccgcgccgagcuccucggcuuccucacccacgcccuccucggcgacucccucgccgccgaguaccucauccuccaccucaucuccaccgucuacacccgccgcgacguccucccccucggcaaguucaccgucaaccucuccggcugcccccgcaacuccaccuucaccgagcaccucuaccgcaucauccagcaccucguccccgccuccuuccgccuccagaugaccaucgagaacaugaaccaccucaaguucaucccccacaaggacuacaccgccaaccgccucgucuccggccuccuccagcuccccuccaacaccucccucgucaucgacgagacccuccucgagcagggccagcucgacacccccggcguccacaacgucaccgcccucuccaaccucaucaccuggcagaaggucgacuacgacuucuccuaccaccagauggaguuccccugcaacaucaacgucuucaucaccuccgagggccgcucccuccuccccgccgacugccagauccaccuccagccccagcucaucccccccaacauggaggaguacaugaacucccuccucuccgccguccuccccuccguccucaacaaguuccgcaucuaccucacccuccuccgcuuccucgaguacuccaucuccgacgagaucaccaaggccgucgaggacgacuucgucgagaugcgcaagaacgacccccaguccaucaccgccgacgaccuccaccagcuccucgucgucgcccgcugccucucccucuccgccggccagaccacccucucccgcgagcgcuggcuccgcgccaagcagcucgagucccuccgccgcacccgccuccagcagcagaagugcgucaacggcaacgagcucuga

SEQ ID NO: 45847 - RNA, 1743 nt, Artificial Sequence
  derived and/or modified sequence opt2 from MCOLN1__Homo_sapiens__NP_065394
augaccgcccccgccggcccccgcggcuccgagaccgagcgccuccucacccccaaccccggcuacggcacccaggccggccccucccccgccccccccaccccccccgaggaggaggaccuccgccgccgccucaaguacuucuucaugucccccugcgacaaguuccgcgccaagggccgcaagcccugcaagcucaugcuccaggucgucaagauccucgucgucaccguccagcucauccucuucggccucuccaaccagcucgccgucaccuuccgcgaggagaacaccaucgccuuccgccaccucuuccuccucggcuacuccgacggcgccgacgacaccuucgccgccuacacccgcgagcagcucuaccaggccaucuuccacgccgucgaccaguaccucgcccuccccgacgucucccucggccgcuacgccuacguccgcggcggcggcgaccccuggaccaacggcuccggccucgcccucugccagcgcuacuaccaccgcggccacgucgaccccgccaacgacaccuucgacaucgaccccauggucgucaccgacugcauccaggucgacccccccgagcgccccccccccccccccuccgacgaccucacccuccucgaguccuccuccuccuacaagaaccucacccucaaguuccacaagcucgucaacgucaccauccacuuccgccucaagaccaucaaccuccagucccucaucaacaacgagauccccgacugcuacaccuucuccguccucaucaccuucgacaacaaggcccacuccggccgcauccccaucucccucgagacccaggcccacauccaggagugcaagcaccccuccgucuuccagcacggcgacaacuccuuccgccuccucuucgacgucgucgucauccucaccugcucccucuccuuccuccucugcgcccgcucccuccuccgcggcuuccuccuccagaacgaguucgucggcuucauguggcgccagcgcggccgcgucaucucccucugggagcgccucgaguucgucaacggcugguacauccuccucgucaccuccgacguccucaccaucuccggcaccaucaugaagaucggcaucgaggccaagaaccucgccuccuacgacgucugcuccauccuccucggcaccuccacccuccucgucugggucggcgucauccgcuaccucaccuucuuccacaacuacaacauccucaucgccacccuccgcgucgcccuccccuccgucaugcgcuucugcugcugcgucgccgucaucuaccucggcuacugcuucugcggcuggaucguccucggccccuaccacgucaaguuccgcucccucuccauggucuccgagugccucuucucccucaucaacggcgacgacauguucgucaccuucgccgccaugcaggcccagcagggccgcuccucccucgucuggcucuucucccagcucuaccucuacuccuucaucucccucuucaucuacaugguccucucccucuucaucgcccucaucaccggcgccuacgacaccaucaagcaccccggcggcgccggcgccgaggaguccgagcuccaggccuacaucgcccagugccaggacucccccaccuccggcaaguuccgccgcggcuccggcuccgccugcucccuccucugcugcugcggccgcgaccccuccgaggagcacucccuccucgucaacuga

SEQ ID NO: 45848 - RNA, 1734 nt, Artificial Sequence
  derived and/or modified sequence opt2 from MCOLN3__Homo_sapiens__XP_011540041
auggagggccgccgcgccggcgccggccgcgagaugcagcucuuccgcgccgcccccaagccccccgccgagauggccgaccccgaggucgucgucuccuccugcuccucccacgaggaggagaaccgcugcaacuucaaccagcagaccucccccuccgaggagcuccuccucgaggaccagaugcgccgcaagcucaaguucuucuucaugaaccccugcgagaaguucugggcccgcggccgcaagcccuggaagcucgccauccagauccucaagaucgccauggucaccauccagcucguccucuucggccucuccaaccagauggucgucgccuucaaggaggagaacaccaucgccuucaagcaccucuuccucaagggcuacauggaccgcauggacgacaccuacgccgucuacacccaguccgacgucuacgaccagcucaucuucgccgucaaccaguaccuccagcucuacaacgucuccgucggcaaccacgccuacgagaacaagggcaccaagcaguccgccauggccaucugccagcacuucuacaagcgcggcaacaucuaccccggcaacgacaccuucgacaucgaccccgagaucgagaccgagugcuucuucgucgagcccgacgagcccuuccacaucggcacccccgccgagaacaagcucaaccucacccucgacuuccaccgccuccucaccgucgagcuccaguucaagcucaaggccaucaaccuccagaccguccgccaccaggagcuccccgacugcuacgacuucacccucaccaucaccuucgacaacaaggcccacuccggccgcaucaagaucucccucgacaacgacaucuccauccgcgagugcaaggacuggcacgucuccggcuccauccagaagaacacccacuacaugaugaucuucgacgccuucgucauccucaccugccucgucucccucauccucugcauccgcuccgucauccgcggccuccagcuccagcaggaguucgucaacuucuuccuccuccacuacaagaaggaggucuccgucuccgaccagauggaguucgucaacggcugguacaucaugaucaucaucuccgacauccucaccaucaucggcuccauccucaagauggagauccaggccaagucccucaccuccuacgacgucugcuccauccuccucggcaccuccaccaugcucgucuggcucggcgucauccgcuaccucggcuucuucgccaaguacaaccuccucauccucacccuccaggccgcccuccccaacgucauccgcuucugcugcugcgccgccaugaucuaccucggcuacugcuucugcggcuggaucguccucggccccuaccacgacaaguuccgcucccucaacauggucuccgagugccucuucucccucaucaacggcgacgacauguucgccaccuucgccaagaugcagcagaaguccuaccucgucuggcucuucucccgcaucuaccucuacuccuucaucucccucuucaucuacaugauccucucccucuucaucgcccucaucaccgacaccuacgagaccaucaagcaguaccagcaggacggcuuccccgagaccgagcuccgcaccuucaucuccgagugcaaggaccuccccaacuccggcaaguaccgccucgaggacgacccccccgucucccucuucugcugcugcaagaaguga

SEQ ID NO: 45849 - RNA, 1833 nt, Artificial Sequence
  derived and/or modified sequence opt2 from MCPH1__Homo_sapiens__NP_001166045
auggccgcccccauccucaaggacgucgucgccuacgucgaggucugguccuccaacggcaccgagaacuacuccaagaccuucaccacccagcucgucgacaugggcgccaaggucuccaagaccuucaacaagcaggucacccacgucaucuucaaggacggcuaccaguccaccugggacaaggcccagaagcgcggcgucaagcucgucuccguccucugggucgagaagugccgcaccgccggcgcccacaucgacgagucccucuuccccgccgccaacaugaacgagcaccucuccucccucaucaagaagaagcgcaagugcaugcagcccaaggacuucaacuucaagacccccgagaacgacaagcgcuuccagaagaaguucgagaagauggccaaggagcuccagcgccagaagaccaaccucgacgacgacguccccauccuccucuucgaguccaacggcucccucaucuacacccccaccaucgagaucaacuccucccaccacuccgccauggagaagcgccuccaggagaugaaggagaagcgcgagaaccucucccccaccuccucccagaugauccagcagucccacgacaaccccuccaacucccucugcgaggccccccucaacaucucccgcgacacccucugcuccgacgaguacuucgccggcggccuccacuccuccuucgacgaccucugcggcaacuccggcugcggcaaccaggagcgcaagcucgagggcuccaucaacgacaucaaguccgacgucugcaucuccucccucguccucaaggccaacaacauccacuccucccccuccuucacccaccucgacaaguccuccccccagaaguuccucuccaaccucuccaaggaggagaucaaccuccagcgcaacaucgccggcaaggucgucacccccgaccagaagcaggccgccggcaugucccaggagaccuucgaggagaaguaccgccucucccccacccucuccuccaccaagggccaccuccucauccacucccgcccccgcuccuccuccgucaagcgcaagcgcgucucccacggcucccacuccccccccaaggagaagugcaagcgcaagcgcuccacccgccgcuccaucaugccccgccuccagcucugccgcuccgaggaccgccuccagcacgucgccggccccgcccucgaggcccucuccugcggcgaguccuccuacgacgacuacuucucccccgacaaccucaaggagcgcuacuccgagaaccucccccccgagucccagcuccccuccucccccgcccagcucuccugccgcucccucuccaagaaggagcgcaccuccaucuucgagauguccgacuucuccugcgucggcaagaagacccgcaccgucgacaucaccaacuucaccgccaagaccaucuccuccccccgcaagaccggcaacggcgagggccgcgccaccuccuccugcgucaccuccgcccccgaggaggcccuccgcugcugccgccaggccggcaaggaggacgccugccccgagggcaacggcuucuccuacaccaucgaggaccccgcccuccccaagggccacgacgacgaccucaccccccucgagggcucccucgaggagaugaaggaggccgucggccucaaguccacccagaacaagggcaccaccuccaagaucuccaacuccuccgagggcgaggcccaguccgagcacgagcccugcuucaucgucgacugcaacauggagaccuccaccgaggagaaggagaaccuccccggcggcuacuccggcuccauguga

SEQ ID NO: 45850 - RNA, 1428 nt, Artificial Sequence
  derived and/or modified sequence opt2 from MCRS1__Homo_sapiens__NP_001012300
augacccgcggcaccggcggcaccgcccagcgcggccgcuccggccccgacucccagggccuccucgacuccucccucauggccuccggcaccgccucccgcuccgaggacgaggagucccucgccggccagaagcgcgccuccucccaggcccucggcaccauccccaagcgccgcuccuccucccgcuucaucaagcgcaagaaguucgacgacgagcucgucgaguccucccucgccaaguccuccacccgcgccaagggcgccuccggcgucgagcccggccgcugcuccggcuccgagcccuccuccuccgagaagaagaaggucuccaaggcccccuccacccccgucccccccucccccgcccccgcccccggccucaccaagcgcgucaagaaguccaagcagccccuccaggucaccaaggaccucggccgcuggaagcccgccgacgaccuccuccucaucaacgccguccuccagaccaacgaccucaccuccguccaccucggcgucaaguucuccugccgcuucacccuccgcgagguccaggagcgcugguacgcccuccucuacgaccccgucaucuccaagcucgccugccaggccaugcgccagcuccaccccgaggccaucgccgccauccaguccaaggcccucuucuccaaggccgaggagcagcuccucuccaaggucggcuccaccucccagcccacccucgagaccuuccaggaccuccuccaccgccaccccgacgccuucuaccucgcccgcaccgccaaggcccuccaggcccacuggcagcucaugaagcaguacuaccuccucgaggaccagaccguccagccccuccccaagggcgaccagguccucaacuucuccgacgccgaggaccucaucgacgacuccaagcucaaggacaugcgcgacgagguccucgagcacgagcucauggucgccgaccgccgccagaagcgcgagauccgccagcucgagcaggagcuccacaaguggcagguccucgucgacuccaucaccggcauguccucccccgacuucgacaaccagacccucgccguccuccgcggccgcaugguccgcuaccucaugcgcucccgcgagaucacccucggccgcgccaccaaggacaaccagaucgacgucgaccucucccucgagggccccgccuggaagaucucccgcaagcagggcgucaucaagcucaagaacaacggcgacuucuucaucgccaacgagggccgccgccccaucuacaucgacggccgccccguccucugcggcuccaaguggcgccucuccaacaacuccgucgucgagaucgccucccuccgcuucgucuuccucaucaaccaggaccucaucgcccucauccgcgccgaggccgccaagaucaccccccaguga

SEQ ID NO: 45851 - RNA, 2337 nt, Artificial Sequence
  derived and/or modified sequence opt2 from MCTP1__Homo_sapiens__NP_001002796
augcucgacuccugcaagcucaaguccgccugcaaccuccccuucaucugcaacaagaagaucaucaacaccgccggcaccuccaacgccgaggucccccucgccgaccccggcauguaccagcucgacaucacccuccgccgcggccagucccucgccgcccgcgaccgcggcggcaccuccgaccccuacgucaaguucaagaucggcggcaaggaggucuuccgcuccaagaucauccacaagaaccucaaccccgucugggaggagaaggccugcauccucgucgaccaccuccgcgagccccucuacaucaaggucuucgacuacgacuucggccuccaggacgacuucaugggcuccgccuuccucgaccucacccagcucgagcucaaccgccccaccgacgucacccucacccucaaggacccccacuaccccgaccacgaccucggcaucauccuccucuccgucauccucacccccaaggagggcgagucccgcgacgucaccaugcucaugcgcaaguccuggaagcgcuccuccaaggagcucuccgagaacgaggucgucggcuccuacuucuccgucaagucccucuucuggcgcaccugcggccgccccgcccuccccguccucggcuucugccgcgccgagcuccagaaccccuacugcaagaacguccaguuccagacccagucccuccgccucuccgaccuccaccgcaagucccaccucuggcgcggcaucgucuccaucacccucaucgagggccgcgaccucaaggccauggacuccaacggccucuccgaccccuacgucaaguuccgccucggccaccagaaguacaaguccaagaucaugcccaagacccucaacccccaguggcgcgagcaguucgacuuccaccucuacgaggagcgcggcggcgucaucgacaucaccgccugggacaaggacgccggcaagcgcgacgacuucaucggccgcugccaggucgaccucuccgcccucucccgcgagcagacccacaagcucgagcuccagcucgaggagggcgagggccaccucguccuccucgucacccucaccgccuccgccaccgucuccaucuccgaccucuccgucaacucccucgaggaccagaaggagcgcgaggagauccucaagcgcuacuccccccuccgcaucuuccacaaccucaaggacgucggcuuccuccaggucaaggucauccgcgccgagggccucauggccgccgacgucaccggcaaguccgaccccuucugcgucgucgagcucaacaacgaccgccuccucacccacaccgucuacaagaaccucaaccccgaguggaacaaggucuucaccuucaacaucaaggacauccacuccguccucgaggucaccgucuacgacgaggaccgcgaccgcuccgccgacuuccucggcaaggucgccaucccccuccucuccauccagaacggcgagcagaaggccuacguccucaagaacaagcagcucaccggccccaccaagggcgucaucuaccucgagaucgacgucaucuucaacgccgucaaggccucccuccgcacccucauccccaaggagcagaaguacaucgaggaggagaaccgccucuccaagcagcuccuccuccgcaacuucauccgcaugaagcgcugcgucaugguccucgucaacgccgccuacuacgucaacuccugcuucgacugggacucccccccccgcucccucgccgccuucguccucuuccucuucgucgucuggaacuucgagcucuacaugaucccccucguccuccuccuccuccucaccuggaacuacuuccucaucaucuccggcaaggacaaccgccagcgcgacaccgucgucgaggacaugcucgaggacgaggaggaggaggacgacaaggacgacaaggacuccgagaagaagggcuucaucaacaagaucuacgccauccaggaggucugcgucuccguccagaacauccucgacgaggucgccuccuucggcgagcgcaucaagaacaccuucaacuggaccguccccuuccucuccuggcucgccaucgucgcccucugcgucuucaccgccauccucuacugcaucccccuccgcuacaucguccucgucuggggcaucaacaaguucaccaagaagcuccgcucccccuacgccaucgacaacaacgagcuccucgacuuccucucccgcguccccuccgacguccaggucguccaguaccaggagcucaagcccgaccccucccacucccccuacaagcgcaagaagaacaaccucggcuga

SEQ ID NO: 45852 - RNA, 2472 nt, Artificial Sequence
  derived and/or modified sequence opt2 from MCTP2__Homo_sapiens__NP_001153115
auggaccucgacaagcccuccgucuggggcucccucaagcagcgcacccgcccccuccucaucaaccucuccaagaagaaggucaagaagaaccccuccaagccccccgaccuccgcgcccgccaccaccucgaccgccgccucucccucuccguccccgaccuccucgaggccgaggcccucgcccccgagggccgccccuacuccggcccccaguccuccuacaccuccguccccuccucccucuccaccgccggcaucuuccccaaguccuccuccuccucccucaagcaguccgaggaggagcucgacuggucccaggaggaggccucccaccuccacgucgucgagaccgacuccgaggaggccuacgccucccccgccgagcgccgccgcgucuccuccaacggcaucuucgaccuccagaagaccucccucggcggcgacgcccccgaggagcccgagaagcucugcggcuccuccgaccucaacgccuccaugaccucccagcacuucgaggagcaguccguccccggcgaggccuccgacggccucuccaaccuccccucccccuucgccuaccuccucaccauccaccucaaggagggccgcaaccucgucguccgcgaccgcugcggcaccuccgaccccuacgucaaguucaagcucaacggcaagacccucuacaaguccaaggucaucuacaagaaccucaaccccgucugggacgagaucgucguccuccccauccagucccucgaccagaagcuccgcgucaaggucuacgaccgcgaccucaccaccuccgacuucaugggcuccgccuucgucauccucuccgaccucgagcucaaccgcaccaccgagcacauccucaagcucgaggaccccaacucccucgaggacgacaugggcgucaucguccucaaccucaaccucgucgucaagcagggcgacuucaagcgccaccgcugguccaaccgcaagcgccucuccgccuccaaguccucccucauccgcaaccuccgccucuccgagucccucaagaagaaccagcucuggaacggcaucaucuccaucacccuccucgagggcaagaacgucuccggcggcuccaugaccgagauguucguccagcucaagcucggcgaccagcgcuacaaguccaagacccucugcaaguccgccaacccccaguggcaggagcaguucgacuuccacuacuucuccgaccgcaugggcauccucgacaucgaggucuggggcaaggacaacaagaagcacgaggagcgccucggcaccugcaaggucgacaucuccgcccucccccucaagcaggccaacugccucgagcucccccucgacuccugccucggcgcccuccucaugcucgucacccucacccccugcgccggcgucuccgucuccgaccucugcgucugcccccucgccgaccucuccgagcgcaagcagaucacccagcgcuacugccuccagaacucccucaaggacgucaaggacgucggcauccuccaggucaagguccucaaggccgccgaccuccucgccgccgacuucuccggcaaguccgaccccuucugccuccucgagcucggcaacgaccgccuccagacccacaccgucuacaagaaccucaaccccgaguggaacaaggucuucaccuuccccaucaaggacauccacgacguccucgaggucaccgucuucgacgaggacggcgacaagccccccgacuuccucggcaaggucgccaucccccuccucuccauccgcgacggccagcccaacugcuacguccucaagaacaaggaccucgagcaggccuucaagggcgucaucuaccucgagauggaccucaucuacaaccccgucaaggccuccauccgcaccuucaccccccgcgagaagcgcuucgucgaggacucccgcaagcucuccaagaagauccucucccgcgacgucgaccgcgucaagcgcaucaccauggccaucuggaacaccaugcaguuccucaaguccugcuuccagugggaguccacccuccgcuccaccaucgccuucgccgaguccgagaagaagggccucaucgagcgcaucuacaugguccaggacaucgucuccaccguccagaacguccucgaggagaucgccuccuucggcgagcgcaucaagaacaccuucaacuggaccguccccuuccucuccucccucgccugccucauccucgccgccgccaccaucauccucuacuucaucccccuccgcuacaucauccucaucuggggcaucaacaaguucaccaagaagcuccgcaaccccuacuccaucgacaacaacgagcuccucgacuuccucucccgcguccccuccgacguccagaagguccaguacgccgagcucaagcucugcuccucccacuccccccuccgcaagaagcgcuccgcccucuga

SEQ ID NO: 45853 - RNA, 549 nt, Artificial Sequence
  derived and/or modified sequence opt2 from MCTS1__Homo_sapiens__NP_001131026
augggcaagggccgcuucgacgagaaggagaacgucuccaacugcauccagcucaagaccuccgucaucaagggcaucaagaaccagcucaucgagcaguuccccggcaucgagcccuggcucaaccagaucaugcccaagaaggaccccgucaagaucguccgcugccacgagcacaucgagauccucaccgucaacggcgagcuccucuucuuccgccagcgcgagggccccuucuaccccacccuccgccuccuccacaaguaccccuucauccucccccaccagcaggucgacaagggcgccaucaaguucguccucuccggcgccaacaucaugugccccggccucaccucccccggcgccaagcucuaccccgccgccgucgacaccaucgucgccaucauggccgagggcaagcagcacgcccucugcgucggcgucaugaagauguccgccgaggacaucgagaaggucaacaagggcaucggcaucgagaacauccacuaccucaacgacggccucuggcacaugaagaccuacaaguga

SEQ ID NO: 45854 - RNA, 993 nt, Artificial Sequence
  derived and/or modified sequence opt2 from MCU__Homo_sapiens__NP_001257608
auggccgccgccgccggccgcucccuccuccuccuccucuccucccgcggcggcggcggcggcggcgccggcggcugcggcgcccucaccgccggcugcuuccccggccucggcgucucccgccaccgccagcagcagcaccaccgcaccguccaccagcgcaucgccuccuggcagaaccucggcgccgucuacugcuccaccgucguccccuccgacgacgucaccgucgucuaccagaacggccuccccgucaucuccguccgccuccccucccgccgcgagcgcugccaguucacccucaagcccaucuccgacuccgucggcgucuuccuccgccagcuccaggaggaggaccgcggcaucgaccgcgucgccaucuacucccccgacggcguccgcgucgccgccuccaccggcaucgaccuccuccuccucgacgacuucaagcucgucaucaacgaccucaccuaccacguccgcccccccaagcgcgucgagaugggcuucugccacgucggccagaacggcuucgagcuccucaccuccuccuaccuccccgccuccgccucccaguccgccgagaucaucgccguccgcaucgagaucucccgcaaggccgagaagcgcaccacccucguccucuggggcggccucgccuacauggccacccaguucggcauccucgcccgccucaccuggugggaguacuccugggacaucauggagcccgucaccuacuucaucaccuacggcuccgccauggccauguacgccuacuucgucaugacccgccaggaguacgucuaccccgaggcccgcgaccgccaguaccuccucuucuuccacaagggcgccaagaagucccgcuucgaccucgagaaguacaaccagcucaaggacgccaucgcccaggccgagauggaccucaagcgccuccgcgacccccuccagguccaccucccccuccgccagaucggcgagaaggacuga

SEQ ID NO: 45855 - RNA, 1080 nt, Artificial Sequence
  derived and/or modified sequence opt2 from MCUR1__Homo_sapiens__NP_001026883
auggacugcggcuccgucggcggccagcgcacccagcgccuccccggccgccagcgccuccucuuccuccccgucggccucuccggccgccccggcggcuccgagaccuccgcccgccgcugccucuccgcccucuccgacggccucggcgcccuccgcccccgcgcccccgccgcccgcggcggcgucucccgcgccuccccccuccuccuccuccuccucguccccuccccccgccucgccgccgccgccccccgccgccagcucggcgacugggagcgcucccgccucggcuacgccgccccccccgccggccgcuccuccgccuggcgcugcucccccggcgucgccgccgccgccggcgcccucccccaguaccacggccccgcccccgcccucgucuccugccgccgcgagcucucccucuccgccggcucccuccagcucgagcgcaagcgccgcgacuucaccuccuccggcucccgcaagcucuacuucgacacccacgcccucgucugccuccucgaggacaacggcuucgccacccagcaggccgagaucaucgucuccgcccucgucaagauccucgaggccaacauggacaucgucuacaaggacauggucaccaagaugcagcaggagaucaccuuccagcaggucaugucccagaucgccaacgucaagaaggacaugaucauccucgagaaguccgaguucuccgcccuccgcgccgagaacgagaagaucaagcucgagcuccaccagcucaagcagcaggucauggacgaggucaucaagguccgcaccgacaccaagcucgacuucaaccucgagaagucccgcgucaaggagcucuacucccucaacgagaagaagcuccucgagcuccgcaccgagaucgucgcccuccacgcccagcaggaccgcgcccucacccagaccgaccgcaagaucgagaccgaggucgccggccucaagaccaugcucgagucccacaagcucgacaacaucaaguaccucgccggcuccaucuucaccugccucaccgucgcccucggcuucuaccgccucuggaucuga

SEQ ID NO: 45856 - RNA, 6270 nt, Artificial Sequence
  derived and/or modified sequence opt2 from MDC1__Homo_sapiens__NP_055456
auggaggacacccaggccaucgacugggacgucgaggaggaggaggagaccgagcaguccuccgagucccuccgcugcaacgucgagcccgucggccgccuccacaucuucuccggcgcccacggccccgagaaggacuucccccuccaccucggcaagaacgucgucggccgcaugcccgacugcuccgucgcccuccccuuccccuccaucuccaagcagcacgccgagaucgagauccucgccugggacaaggcccccauccuccgcgacugcggcucccucaacggcacccagauccuccgcccccccaagguccucucccccggcgucucccaccgccuccgcgaccaggagcucauccucuucgccgaccuccucugccaguaccaccgccucgacgucucccuccccuucgucucccgcggcccccucaccgucgaggagaccccccgcguccagggcgagacccagccccagcgccuccuccucgccgaggacuccgaggaggaggucgacuuccucuccgagcgccgcauggucaagaagucccgcaccaccuccuccuccgucaucguccccgaguccgacgaggagggccacucccccguccucggcggccucggcccccccuucgccuucaaccucaacuccgacaccgacgucgaggagggccagcagcccgccaccgaggaggccuccuccgccgcccgccgcggcgccaccgucgaggccaagcaguccgaggccgaggucgucaccgagauccagcucgagaaggaccagccccucgucaaggagcgcgacaacgacaccaaggucaagcgcggcgccggcaacggcgucguccccgccggcgucauccucgagcgcucccagccccccggcgaggacuccgacaccgacgucgacgacgacucccgcccccccggccgccccgccgagguccaccucgagcgcgcccagcccuucggcuucaucgacuccgacaccgacgccgaggaggagcgcauccccgccacccccgucgucauccccaugaagaagcgcaagaucuuccacggcgucggcacccgcggccccggcgcccccggccucgcccaccuccaggagucccaggccggcuccgacaccgacgucgaggagggcaaggccccccaggccgucccccucgagaagucccaggccuccauggucaucaacuccgacaccgacgacgaggaggaggucuccgccgcccucacccucgcccaccucaaggagucccagcccgccaucuggaaccgcgacgccgaggaggacaugccccagcgcgucguccuccuccagcgcucccagaccaccaccgagcgcgacuccgacaccgacgucgaggaggaggagcuccccgucgagaaccgcgaggccguccucaaggaccacaccaagauccgcgcccucguccgcgcccacuccgagaaggaccagccccccuucggcgacuccgacgacuccgucgaggccgacaaguccucccccggcauccaccucgagcgcucccaggccuccaccaccgucgacaucaacacccaggucgagaaggaggucccccccggcuccgccaucauccacaucaagaagcaccaggucuccgucgagggcaccaaccagaccgacgucaaggccgucggcggccccgccaagcuccucgucgucucccucgaggaggccuggccccuccacggcgacugcgagaccgacgccgaggagggcaccucccucaccgccuccgucgucgccgacguccgcaagucccagcuccccgccgagggcgacgccggcgccgagugggccgccgccguccucaagcaggagcgcgcccacgaggucggcgcccagggcggcccccccgucgcccaggucgagcaggaccuccccaucucccgcgagaaccucaccgaccucgucgucgacaccgacacccucggcgaguccacccagccccagcgcgagggcgcccagguccccaccggccgcgagcgcgagcagcacgucggcggcaccaaggacuccgaggacaacuacggcgacuccgaggaccucgaccuccaggccacccagugcuuccucgagaaccagggccucgaggccguccaguccauggaggacgagcccacccaggccuucaugcucacccccccccaggagcucggccccucccacugcuccuuccagaccaccggcacccucgacgagcccugggagguccucgccacccagcccuucugccuccgcgaguccgaggacuccgagacccagcccuucgacacccaccucgaggccuacggccccugccucucccccccccgcgccauccccggcgaccagcaccccgagucccccguccacaccgagcccaugggcauccagggccgcggccgccagaccgucgacaaggucaugggcauccccaaggagaccgccgagcgcgucggccccgagcgcggcccccucgagcgcgagaccgagaagcuccuccccgagcgccagaccgacgucaccggcgaggaggagcucaccaagggcaagcaggaccgcgagcagaagcagcuccucgcccgcgacacccagcgccaggaguccgacaagaacggcgaguccgccucccccgagcgcgaccgcgagucccucaaggucgagaucgagaccuccgaggagauccaggagaagcagguccagaagcagacccuccccuccaaggccuucgagcgcgaggucgagcgccccgucgccaaccgcgagugcgaccccgccgagcucgaggagaagguccccaaggucauccucgagcgcgacacccagcgcggcgagcccgagggcggcucccaggaccagaagggccaggccuccucccccacccccgagcccggcgucggcgccggcgaccuccccggccccaccuccgcccccguccccuccggcucccaguccggcggccgcggcucccccgucuccccccgccgccaccagaagggccuccucaacugcaagaugccccccgccgagaaggccucccgcauccgcgccgccgagaaggucucccgcggcgaccaggagucccccgacgccugccucccccccaccguccccgaggcccccgcccccccccagaagccccucaacucccagucccagaagcaccucgccccccccccccuccucuccccccuccuccccuccaucaagcccaccguccgcaagacccgccaggacggcucccaggaggcccccgaggccccccucuccuccgagcucgagcccuuccaccccaagcccaagauccgcacccgcaaguccucccgcaugacccccuuccccgccaccuccgccgcccccgagccccaccccuccaccuccaccgcccagcccgucacccccaagcccaccucccaggccacccgcucccgcaccaaccgcuccuccgucaagacccccgagcccgucguccccaccgcccccgagcuccagcccuccaccuccaccgaccagcccgucaccuccgagcccaccucccaggucacccgcggccgcaagucccgcuccuccgucaagacccccgagaccgucguccccaccgcccucgagcuccagcccuccaccuccaccgaccgccccgucaccuccgagcccaccucccaggccacccgcggccgcaagaaccgcuccuccgucaagacccccgagcccgucguccccaccgcccccgagcuccagcccuccaccuccaccgaccagcccgucaccuccgagcccaccuaccaggccacccgcggccgcaagaaccgcuccuccgucaagacccccgagcccgucguccccaccgcccccgagcuccgccccuccaccuccaccgaccgccccgucacccccaagcccaccucccgcaccacccgcucccgcaccaacauguccuccgucaagacccccgagaccgucguccccaccgcccccgagcuccagaucuccaccuccaccgaccagcccgucacccccaagcccaccucccgcaccacccgcucccgcaccaacauguccuccgucaagaaccccgaguccaccguccccaucgcccccgagcucccccccuccaccuccaccgagcagcccgucacccccgagcccaccucccgcgccacccgcggccgcaagaaccgcuccuccggcaagacccccgagacccucguccccaccgcccccaagcucgagcccuccaccuccaccgaccagcccgucacccccgagcccaccucccaggccacccgcggccgcaccaaccgcuccuccgucaagacccccgagaccgucguccccaccgcccccgagcuccagcccuccaccuccaccgaccagcccgucacccccgagcccaccucccaggccacccgcggccgcaccgaccgcuccuccgucaagacccccgagaccgucguccccaccgcccccgagcuccaggccuccgccuccaccgaccagcccgucaccuccgagcccaccucccgcaccacccgcggccgcaagaaccgcuccuccgucaagacccccgagaccgucguccccgccgcccccgagcuccagcccuccaccuccaccgaccagcccgucacccccgagcccaccucccgcgccacccgcggccgcaccaaccgcuccuccgucaagacccccgaguccaucguccccaucgcccccgagcuccagcccuccaccucccgcaaccagcucgucacccccgagcccaccucccgcgccacccgcugccgcaccaaccgcuccuccgucaagacccccgagcccgucguccccaccgcccccgagccccaccccaccaccuccaccgaccagcccgucacccccaagcucaccucccgcgccacccgccgcaagaccaaccgcuccuccgucaagacccccaagcccgucgagcccgccgccuccgaccucgagcccuucacccccaccgaccaguccgucacccccgaggccaucgcccagggcggccaguccaagacccuccgcuccuccaccguccgcgccaugcccguccccaccacccccgaguuccagucccccgucaccaccgaccagcccaucucccccgagcccaucacccagcccuccugcaucaagcgccagcgcgccgccggcaaccccggcucccucgccgcccccaucgaccacaagcccugcuccgccccccucgagcccaagucccaggccucccgcaaccagcgcuggggcgccguccgcgccgccgagucccucaccgccauccccgagcccgccuccccccagcuccucgagacccccauccacgccucccagauccagaaggucgagcccgccggccgcucccgcuucacccccgagcuccagcccaaggccucccagucccgcaagcgcucccucgccaccauggacucccccccccaccagaagcagccccagcgcggcgaggucucccagaagaccgucaucaucaaggaggaggaggaggacaccgccgagaagcccggcaaggaggaggacgucgucacccccaagcccggcaagcgcaagcgcgaccaggccgaggaggagcccaaccgcauccccucccgcucccuccgccgcaccaagcucaaccaggaguccaccgcccccaagguccucuucaccggcgucgucgacgcccgcggcgagcgcgccguccucgcccucggcggcucccucgccggcuccgccgccgaggccucccaccucgucaccgaccgcauccgccgcaccgucaaguuccucugcgcccucggccgcggcauccccauccucucccucgacuggcuccaccagucccgcaaggccggcuucuuccucccccccgacgaguacgucgucaccgaccccgagcaggagaagaacuucggcuucucccuccaggacgcccucucccgcgcccgcgagcgccgccuccucgagggcuacgagaucuacgucacccccggcguccagcccccccccccccagaugggcgagaucaucuccugcugcggcggcaccuaccuccccuccaugccccgcuccuacaagccccagcgcgucgucaucaccugcccccaggacuucccccacugcuccaucccccuccgcgucggccucccccuccucucccccgaguuccuccucaccggcguccucaagcaggaggccaagcccgaggccuucguccucuccccccucgagauguccuccaccuga

SEQ ID NO: 45857 - RNA, 741 nt, Artificial Sequence
  derived and/or modified sequence opt2 from MDFIC__Homo_sapiens__NP_001159817
auguccggcgccggcgaggcccucgcccccggccccgucggcccccagcgcgucgccgaggccggcggcggccagcucggcuccaccgcccagggcaagugcgacaaggacaacaccgagaaggacaucacccaggccaccaacucccacuucacccacggcgagaugcaggaccaguccaucuggggcaaccccuccgacggcgagcucauccgcacccagccccagcgccucccccagcuccagaccuccgcccagguccccuccggcgaggagaucggcaagaucaagaacggccacaccggccucuccaacggcaacggcauccaccacggcgccaagcacggcuccgccgacaaccgcaagcucuccgcccccgucucccagaagaugcaccgcaagauccaguccucccucuccgucaacuccgacaucuccaagaaguccaaggucaacgccgucuucucccagaagaccggcuccucccccgaggacugcugcguccacugcauccucgccugccucuucugcgaguuccucacccucugcaacaucguccucggccaggccuccugcggcaucugcaccuccgaggccugcugcugcugcugcggcgacgagaugggcgacgacugcaacugccccugcgacauggacugcggcaucauggacgccugcugcgaguccuccgacugccucgagaucugcauggagugcugcggcaucugcuuccccuccuga

SEQ ID NO: 45858 - RNA, 741 nt, Artificial Sequence
  derived and/or modified sequence opt2 from MDFI__Homo_sapiens__NP_001287733
auguaccaggucuccggccagcgccccuccggcugcgacgcccccuacggcgcccccuccgccgcccccggccccgcccagacccucucccuccuccccggccucgaggucgucaccggcuccacccaccccgccgaggccgcccccgaggagggcucccucgaggaggccgccacccccaugccccagggcaacggccccggcaucccccagggccucgacuccaccgaccucgacguccccaccgaggccgucaccugccagccccagggcaacccccucggcugcaccccccuccuccccaacgacuccggccaccccuccgagcucggcggcacccgccgcgccggcaacggcgcccucggcggccccaaggcccaccgcaagcuccagacccaccccucccucgccucccagggcuccaagaaguccaaguccuccuccaaguccaccaccucccagaucccccuccaggcccaggaggacugcugcguccacugcauccucuccugccucuucugcgaguuccucacccucugcaacaucguccucgacugcgccaccugcggcuccugcuccuccgaggacuccugccucugcugcugcugcugcggcuccggcgagugcgccgacugcgaccuccccugcgaccucgacugcggcauccucgacgccugcugcgaguccgccgacugccucgagaucugcauggagugcugcggccucugcuucuccuccuga

SEQ ID NO: 45859 - RNA, 2868 nt, Artificial Sequence
  derived and/or modified sequence opt2 from MDGA1__Homo_sapiens__NP_705691
auggaggucaccugccuccuccuccucgcccucauccccuuccacugccgcggccagggcgucuacgcccccgcccaggcccagaucguccacgccggccaggccugcgucgucaaggaggacaacaucuccgagcgcgucuacaccauccgcgagggcgacacccucaugcuccagugccucgucaccggccacccccgcccccagguccgcuggaccaagaccgccggcuccgccuccgacaaguuccaggagaccuccgucuucaacgagacccuccgcaucgagcgcaucgcccgcacccagggcggccgcuacuacugcaaggccgagaacggcgucggcguccccgccaucaaguccauccgcgucgacguccaguaccucgacgagcccaugcucaccguccaccagaccgucuccgacguccgcggcaacuucuaccaggagaagaccgucuuccuccgcugcaccgucaacuccaacccccccgcccgcuucaucuggaagcgcggcuccgacacccucucccacucccaggacaacggcgucgacaucuacgagccccucuacacccagggcgagaccaagguccucaagcucaagaaccuccgcccccaggacuacgccuccuacaccugccaggucuccguccgcaacgucugcggcauccccgacaaggccaucaccuuccgccucaccaacaccaccgccccccccgcccucaagcucuccgucaacgagacccucgucgucaaccccggcgagaacgucaccguccagugccuccucaccggcggcgacccccucccccagcuccaguggucccacggccccggcccccucccccucggcgcccucgcccagggcggcacccucuccauccccuccguccaggcccgcgacuccggcuacuacaacugcaccgccaccaacaacgucggcaaccccgccaagaagaccgucaaccuccucguccgcuccaugaagaacgccaccuuccagaucacccccgacgucaucaaggaguccgagaacauccagcucggccaggaccucaagcucuccugccacgucgacgccgucccccaggagaaggucaccuaccagugguucaagaacggcaagcccgcccgcauguccaagcgccuccucgucacccgcaacgaccccgagcuccccgccgucaccuccucccucgagcucaucgaccuccacuucuccgacuacggcaccuaccucugcauggccuccuuccccggcgcccccguccccgaccucuccgucgaggucaacaucuccuccgagaccgucccccccaccaucuccguccccaagggccgcgccgucgucaccguccgcgagggcucccccgccgagcuccagugcgagguccgcggcaagccccgcccccccguccucuggucccgcgucgacaaggaggccgcccuccuccccuccggccucccccucgaggagacccccgacggcaagcuccgccucgagcgcgucucccgcgacauguccggcaccuaccgcugccagaccgcccgcuacaacggcuucaacguccgcccccgcgaggcccagguccagcucaacguccaguucccccccgaggucgagcccuccucccaggacguccgccaggcccucggccgccccguccuccuccgcugcucccuccuccgcggcuccccccagcgcaucgccuccgccgucuggcgcuucaagggccagcuccucccccccccccccgucguccccgccgccgccgaggcccccgaccacgccgagcuccgccucgacgccgucacccgcgacuccuccggcuccuacgagugcuccgucuccaacgacgucggcuccgccgccugccucuuccaggucuccgccaaggccuacucccccgaguucuacuucgacacccccaaccccacccgcucccacaagcucuccaagaacuacuccuacguccuccaguggacccagcgcgagcccgacgccgucgaccccguccucaacuaccgccucuccauccgccagcucaaccagcacaacgccgucgucaaggccauccccguccgccgcgucgagaagggccagcuccucgaguacauccucaccgaccuccgcgucccccacuccuacgagguccgccucacccccuacaccaccuucggcgccggcgacauggccucccgcaucauccacuacaccgagcccaucaacucccccaaccucuccgacaacaccugccacuucgaggacgagaagaucugcggcuacacccaggaccucaccgacaacuucgacuggacccgccagaacgcccucacccagaaccccaagcgcucccccaacaccggcccccccaccgacaucuccggcacccccgagggcuacuacauguucaucgagaccucccgcccccgcgagcucggcgaccgcgcccgccucgucuccccccucuacaacgccuccgccaaguucuacugcgucuccuucuucuaccacauguacggcaagcacaucggcucccucaaccuccucguccgcucccgcaacaagggcgcccucgacacccacgccuggucccucuccggcaacaagggcaacgucuggcagcaggcccacguccccaucucccccuccggccccuuccagaucaucuucgagggcguccgcggccccggcuaccucggcgacaucgccaucgacgacgucacccucaagaagggcgagugcccccgcaagcagaccgaccccaacaaggucgucgucaugcccggcuccggcgcccccugccaguccuccccccagcucuggggccccauggccaucuuccuccucgcccuccagcgcuga

SEQ ID NO: 45860 - RNA, 2871 nt, Artificial Sequence
  derived and/or modified sequence opt2 from MDGA2__Homo_sapiens__NP_001106970
auggaccuccucuacggccucgucuggcuccucaccguccuccucgagggcaucuccggccagggcgucuacgccccccccaccguccgcaucguccacuccggccucgccugcaacaucgaggaggagcgcuacuccgagcgcgucuacaccauccgcgagggcgagacccucgagcucaccugccucgucaccggccacccccgcccccagauccgcuggaccaagaccgccggcuccgccuccgaccgcuuccaggacuccuccgucuucaacgagacccuccgcaucaccaacauccagcgccaccagggcggccgcuacuacugcaaggccgagaacggccucggcucccccgccaucaaguccauccgcgucgacgucuacuaccucgacgaccccgucgucaccguccaccaguccaucggcgaggccaaggagcaguucuacuacgagcgcaccgucuuccuccgcugcgucgccaacuccaacccccccguccgcuacuccuggcgccgcggccaggagguccuccuccagggcuccgacaagggcgucgagaucuacgagcccuucuucacccagggcgagaccaagauccucaagcucaagaaccuccgcccccaggacuacgccaacuacuccugcaucgccuccguccgcaacgucugcaacauccccgacaagauggucuccuuccgccucuccaacaagaccgccucccccuccaucaagcuccucgucgacgaccccaucgucgucaaccccggcgaggccaucacccucgucugcgucaccaccggcggcgagcccgcccccucccucaccuggguccgcuccuucggcacccuccccgagaagaccguccucaacggcggcacccucaccauccccgccaucaccuccgacgacgccggcaccuacuccugcaucgccaacaacaacgucggcaaccccgccaagaaguccaccaacaucaucguccgcgcccucaagaagggccgcuucuggaucacccccgaccccuaccacaaggacgacaacauccagaucggccgcgaggucaagaucuccugccaggucgaggccguccccuccgaggagcucaccuucuccugguucaagaacggccgcccccuccgcuccuccgagcgcauggucaucacccagaccgaccccgacgucucccccggcaccaccaaccucgacaucaucgaccucaaguucaccgacuucggcaccuacaccugcgucgccucccucaagggcggcggcaucuccgacaucuccaucgacgucaacaucuccuccuccaccgucccccccaaccucaccgucccccaggagaaguccccccucgucacccgcgagggcgacaccaucgagcuccagugccaggucaccggcaagcccaagcccaucauccucuggucccgcgccgacaaggaggucgccaugcccgacggcuccaugcagauggaguccuacgacggcacccuccgcaucgucaacgucucccgcgagauguccggcauguaccgcugccagaccucccaguacaacggcuucaacgucaagccccgcgaggcccucguccagcucaucguccaguacccccccgccgucgagcccgccuuccucgagauccgccagggccaggaccgcuccgucaccauguccugccgcguccuccgcgccuaccccauccgcguccucaccuacgaguggcgccucggcaacaagcuccuccgcaccggccaguucgacucccaggaguacaccgaguacgccgucaagucccucuccaacgagaacuacggcgucuacaacugcuccaucaucaacgaggccggcgccggccgcugcuccuuccucgucaccggcaaggccuacgcccccgaguucuacuacgacaccuacaaccccgucuggcagaaccgccaccgcgucuacuccuacucccuccaguggacccagaugaaccccgacgccgucgaccgcaucgucgccuaccgccucggcauccgccaggccggccagcagcgcuggugggagcaggagaucaagaucaacggcaacauccagaagggcgagcucaucaccuacaaccucaccgagcucaucaagcccgaggccuacgagguccgccucaccccccucaccaaguucggcgagggcgacuccaccauccgcgucaucaaguacuccgcccccgucaacccccaccuccgcgaguuccacugcggcuucgaggacggcaacaucugccucuucacccaggacgacaccgacaacuucgacuggaccaagcaguccaccgccacccgcaacaccaaguacacccccaacaccggccccaacgccgaccgcuccggcuccaaggagggcuucuacauguacaucgagaccucccgcccccgccucgagggcgagaaggcccgccuccucucccccgucuucuccaucgcccccaagaaccccuacggccccaccaacaccgccuacugcuucuccuucuucuaccacauguacggccagcacaucggcguccucaacgucuaccuccgccucaagggccagaccaccaucgagaacccccucugguccuccuccggcaacaagggccagcgcuggaacgaggcccacgucaacaucuaccccaucaccuccuuccagcucaucuucgagggcauccgcggccccggcaucgagggcgacaucgccaucgacgacgucuccaucgccgagggcgagugcgccaagcaggaccucgccaccaagaacuccgucgacggcgccgucggcauccucguccacaucuggcucuuccccaucaucguccucaucuccauccucuccccccgccgcuga

SEQ ID NO: 45861 - RNA, 1059 nt, Artificial Sequence
  derived and/or modified sequence opt2 from MDH1__Homo_sapiens__NP_001186040
augcgccgcugcuccuacuuccccaaggacgucaccgucuucgacaaggacgacaaguccgagcccauccgcguccucgucaccggcgccgccggccagaucgccuacucccuccucuacuccaucggcaacggcuccgucuucggcaaggaccagcccaucauccucguccuccucgacaucacccccaugaugggcguccucgacggcguccucauggagcuccaggacugcgcccucccccuccucaaggacgucaucgccaccgacaaggaggacgucgccuucaaggaccucgacgucgccauccucgucggcuccaugccccgccgcgagggcauggagcgcaaggaccuccucaaggccaacgucaagaucuucaagucccagggcgccgcccucgacaaguacgccaagaaguccgucaaggucaucgucgucggcaaccccgccaacaccaacugccucaccgccuccaaguccgcccccuccauccccaaggagaacuucuccugccucacccgccucgaccacaaccgcgccaaggcccagaucgcccucaagcucggcgucaccgccaacgacgucaagaacgucaucaucuggggcaaccacuccuccacccaguaccccgacgucaaccacgccaaggucaagcuccagggcaaggaggucggcgucuacgaggcccucaaggacgacuccuggcucaagggcgaguucgucaccaccguccagcagcgcggcgccgccgucaucaaggcccgcaagcucuccuccgccauguccgccgccaaggccaucugcgaccacguccgcgacaucugguucggcacccccgagggcgaguucgucuccaugggcgucaucuccgacggcaacuccuacggcguccccgacgaccuccucuacuccuuccccgucgucaucaagaacaagaccuggaaguucgucgagggccuccccaucaacgacuucucccgcgagaagauggaccucaccgccaaggagcucaccgaggagaaggaguccgccuucgaguuccucuccuccgccuga

SEQ ID NO: 45862 - RNA, 1017 nt, Artificial Sequence
  derived and/or modified sequence opt2 from MDH2__Homo_sapiens__NP_005909
augcucuccgcccucgcccgccccgccuccgccgcccuccgccgcuccuucuccaccuccgcccagaacaacgccaaggucgccguccucggcgccuccggcggcaucggccagccccucucccuccuccucaagaacuccccccucgucucccgccucacccucuacgacaucgcccacacccccggcgucgccgccgaccucucccacaucgagaccaaggccgccgucaagggcuaccucggccccgagcagcuccccgacugccucaagggcugcgacgucgucgucauccccgccggcgucccccgcaagcccggcaugacccgcgacgaccucuucaacaccaacgccaccaucgucgccacccucaccgccgccugcgcccagcacugccccgaggccaugaucugcgucaucgccaaccccgucaacuccaccauccccaucaccgccgaggucuucaagaagcacggcgucuacaaccccaacaagaucuucggcgucaccacccucgacaucguccgcgccaacaccuucgucgccgagcucaagggccucgaccccgcccgcgucaacguccccgucaucggcggccacgccggcaagaccaucaucccccucaucucccagugcacccccaaggucgacuucccccaggaccagcucaccgcccucaccggccgcauccaggaggccggcaccgaggucgucaaggccaaggccggcgccggcuccgccacccucuccauggccuacgccggcgcccgcuucgucuucucccucgucgacgccaugaacggcaaggagggcgucgucgagugcuccuucgucaagucccaggagaccgagugcaccuacuucuccaccccccuccuccucggcaagaagggcaucgagaagaaccucggcaucggcaaggucuccuccuucgaggagaagaugaucuccgacgccauccccgagcucaaggccuccaucaagaagggcgaggacuucgucaagacccucaaguga

SEQ ID NO: 45863 - RNA, 264 nt, Artificial Sequence
  derived and/or modified sequence opt2 from MDK__Homo_sapiens__NP_001257481
augcagcaccgcggcuuccuccuccucacccuccucgcccuccucgcccucaccuccgccgucgccaagaagaaggccgacugcaaguacaaguucgagaacuggggcgccugcgacggcggcaccggcaccaagguccgccagggcacccucaagaaggcccgcuacaacgcccagugccaggagaccauccgcgucaccaagcccugcacccccaagaccaaggccaaggccaaggccaagaagggcaagggcaaggacuga

SEQ ID NO: 45864 - RNA, 2040 nt, Artificial Sequence
  derived and/or modified sequence opt2 from MDM1__Homo_sapiens__NP_001191957
augcccguccgcuucaagggccucuccgaguaccagcgcaacuuccucuggaagaaguccuaccucuccgaguccugcaacuccuccgucggccgcaaguaccccugggccggccuccgcuccgaccagcucggcaucaccaaggagcccuccuucaucuccaagcgccgcguccccuaccacgacccccagaucuccaagucccucgaguggaacggcgccaucuccgaguccaacgucgucgccucccccgagcccgaggcccccgagacccccaagucccaggaggccgagcagaaggacgucacccaggagcgcguccacucccucgaggccucccgcguccccaagcgcacccgcucccacuccgccgacucccgcgccgagggcgccuccgacgucgagaacaacgagggcgucaccaaccacacccccgucaacgagaacgucgagcucgagcacuccaccaagguccucuccgagaacgucgacaacggcgucuuccacaacaagucccaguucgucccccccuucaagggcaacuccgucauccacgagaccgaguacaagcgcaacuucaagggccucucccccgucaaggagcccaagcuccgcaacgaccuccgcgagaaccgcaaccucgagaccgucucccccgagcgcaaguccaacaagaucgacgaccgccucaagcucgaggccgagauggagcucaaggaccuccaccagcccaagcgcaagcucacccccuggaagcaccagcgccucggcaaggucaacuccgaguaccgcgccaaguuccucucccccgcccaguaccucuacaaggccggcgccuggacccacgucaagggcaacaugcccaaccagggcucccucaacgccaugugguacgccgaggucaaggagcuccgcgagaaggccgaguucuaccgcaagcgcguccagggcacccacuucucccgcgaccaccucaaccagauccucuccgacuccaacugcugcugggacgucuccuccaccaccuccuccgagggcaccgucuccuccaacauccgcgcccucgaccucgccggcgaccccaccucccacaagacccuccagaagugccccuccaccgagcccgaggagaagggcaacaucgucgaggagcagccccagaagaacaccaccgagaagcucggcgucuccgcccccaccauccccguccgccgccgccucgccugggacaccgagaacaccuccgaggacguccagaagcagcccggcgagaaggaggaggaggacgacaacgaggaggagggcgaccgcaagaccggcaagcaggccuucaugggcgagcaggagaagcucgacguccgcgagaaguccaaggccgacaagaugaaggagggcuccgacuccuccgucuccuccgagaagggcggccgccuccccacccccaagcuccgcgagcucggcggcauccagcgcacccaccacgaccucaccacccccgccgucggcggcgccguccucgucucccccuccaagaugaagccccccgcccccgagcagcgcaagcgcaugaccucccaggacugccucgagaccuccaagaacgacuucaccaagaaggagucccgcgccgucucccuccucaccucccccgccgccggcaucaagaccgucgacccccucccccuccgcgaggacuccgaggacaacauccacaaguucgccgaggccacccuccccgucuccaagauccccaaguaccccaccaacccccccggccagcuccccucccccccccacguccccuccuacuggcaccccucccgccgcauccagggcucccuccgcgaccccgaguuccagcacaacgucggcaaggcccgcaugaacaaccuccagcucccccagcacgaggccuucaacgacgaggacgaggaccgccucuccgagaucuccgcccgcuccgccgccuccucccuccgcgccuuccagacccucgcccgcgccaagaagcgcaaggagaacuucuggggcaagaccuga

SEQ ID NO: 45865 - RNA, 1335 nt, Artificial Sequence
  derived and/or modified sequence opt2 from MDM2__Homo_sapiens__NP_001138809
augugcaacaccaacauguccguccccaccgacggcgccgucaccaccucccagauccccgccuccgagcaggagacccucguccgccccaagccccuccuccucaagcuccucaaguccgucggcgcccagaaggacaccuacaccaugaaggagguccucuucuaccucggccaguacaucaugaccaagcgccucuacgacgagaagcagcagcacaucgucuacugcuccaacgaccuccucggcgaccucuucggcguccccuccuucuccgucaaggagcaccgcaagaucuacaccaugaucuaccgcaaccucgucgucgucaaccagcaggaguccuccgacuccggcaccuccgucuccgagaaccgcugccaccucgagggcggcuccgaccagaaggaccucguccaggagcuccaggaggagaagcccuccuccucccaccucgucucccgccccuccaccuccucccgccgccgcgccaucuccgagaccgaggagaacuccgacgagcucuccggcgagcgccagcgcaagcgccacaaguccgacuccaucucccucuccuucgacgagucccucgcccucugcgucauccgcgagaucugcugcgagcgcuccuccuccuccgaguccaccggcacccccuccaaccccgaccucgacgccggcgucuaccaggucaccgucuaccaggccggcgaguccgacaccgacuccuucgaggaggaccccgagaucucccucgccgacuacuggaagugcaccuccugcaacgagaugaaccccccccuccccucccacugcaaccgcugcugggcccuccgcgagaacuggcuccccgaggacaagggcaaggacaagggcgagaucuccgagaaggccaagcucgagaacuccacccaggccgaggagggcuucgacguccccgacugcaagaagaccaucgucaacgacucccgcgaguccugcgucgaggagaacgacgacaagaucacccaggccucccagucccaggaguccgaggacuacucccagcccuccaccuccuccuccaucaucuacuccucccaggaggacgucaaggaguucgagcgcgaggagacccaggacaaggaggaguccgucgaguccucccucccccucaacgccaucgagcccugcgucaucugccagggccgccccaagaacggcugcaucguccacggcaagaccggccaccucauggccugcuucaccugcgccaagaagcucaagaagcgcaacaagcccugccccgucugccgccagcccauccagaugaucguccucaccuacuuccccuga

SEQ ID NO: 45866 - RNA, 1323 nt, Artificial Sequence
  derived and/or modified sequence opt2 from MDM4__Homo_sapiens__NP_001191100
augaccuccuucuccaccuccgcccagugcuccaccuccgacuccgccugccgcaucucccccggccagaucaaccagguccgccccaagcucccccuccucaagauccuccacgccgccggcgcccagggcgagauguucaccgucaaggaggucaugcacuaccucggccaguacaucauggucaagcagcucuacgaccagcaggagcagcacauggucuacugcggcggcgaccuccucggcgagcuccucggccgccaguccuucuccgucaaggaccccuccccccucuacgacaugcuccgcaagaaccucgucacccucgccaccgccaccaccgacgccgcccagacccucgcccucgcccaggaccacuccauggacauccccucccaggaccagcucaagcaguccgccgaggaguccuccaccucccgcaagcgcaccaccgaggacgacauccccacccuccccaccuccgagcacaagugcauccacucccgcgaggacgaggaccucaucgagaaccucgcccaggacgagaccucccgccucgaccucggcuucgaggagugggacgucgccggccuccccuggugguuccucggcaaccuccgcuccaacuacaccccccgcuccaacggcuccaccgaccuccagaccaaccaggucaucgaggucggcaagaacgacgaccucgaggacuccaagucccucuccgacgacaccgacgucgaggucaccuccgaggacgaguggcagugcaccgagugcaagaaguucaacucccccuccaagcgcuacugcuuccgcugcugggcccuccgcaaggacugguacuccgacugcuccaagcucacccacucccucuccaccuccgacaucaccgccauccccgagaaggagaacgagggcaacgacguccccgacugccgccgcaccaucuccgcccccgucguccgccccaaggacgccuacaucaagaaggagaacuccaagcucuucgaccccugcaacuccgucgaguuccucgaccucgcccacuccuccgagucccaggagaccaucuccuccaugggcgagcagcucgacaaccucuccgagcagcgcaccgacaccgagaacauggaggacugccagaaccuccucaagcccugcucccucugcgagaagcgcccccgcgacggcaacaucauccacggccgcaccggccaccucgucaccugcuuccacugcgcccgccgccucaagaaggccggcgccuccugccccaucugcaagaaggagauccagcucgucaucaaggucuucaucgccuga

SEQ ID NO: 45867 - RNA, 1719 nt, Artificial Sequence
  derived and/or modified sequence opt2 from ME1__Homo_sapiens__NP_002386
auggagcccgaggccccccgccgccgccacacccaccagcgcggcuaccuccucacccgcaacccccaccucaacaaggaccucgccuucacccucgaggagcgccagcagcucaacauccacggccuccucccccccuccuucaacucccaggagauccagguccuccgcgucgucaagaacuucgagcaccucaacuccgacuucgaccgcuaccuccuccucauggaccuccaggaccgcaacgagaagcucuucuaccgcguccucaccuccgacaucgagaaguucaugcccaucgucuacacccccaccgucggccucgccugccagcaguacucccucgucuuccgcaagccccgcggccucuucaucaccauccacgaccgcggccacaucgccuccguccucaacgccuggcccgaggacgucaucaaggccaucgucgucaccgacggcgagcgcauccucggccucggcgaccucggcugcaacggcaugggcauccccgucggcaagcucgcccucuacaccgccugcggcggcaugaacccccaggagugccuccccgucauccucgacgucggcaccgagaacgaggagcuccucaaggacccccucuacaucggccuccgccagcgccgcguccgcggcuccgaguacgacgacuuccucgacgaguucauggaggccgucuccuccaaguacggcaugaacugccucauccaguucgaggacuucgccaacgucaacgccuuccgccuccucaacaaguaccgcaaccaguacugcaccuucaacgacgacauccagggcaccgccuccgucgccgucgccggccuccucgccgcccuccgcaucaccaagaacaagcucuccgaccagaccauccucuuccagggcgccggcgaggccgcccucggcaucgcccaccucaucgucauggcccucgagaaggagggccuccccaaggagaaggccaucaagaagaucuggcucgucgacuccaagggccucaucgucaagggccgcgccucccucacccaggagaaggagaaguucgcccacgagcacgaggagaugaagaaccucgaggccaucguccaggagaucaagcccaccgcccucaucggcgucgccgccaucggcggcgccuucuccgagcagauccucaaggacauggccgccuucaacgagcgccccaucaucuucgcccucuccaaccccaccuccaaggccgagugcuccgccgagcagugcuacaagaucaccaagggccgcgccaucuucgccuccggcucccccuucgaccccgucacccuccccaacggccagacccucuaccccggccagggcaacaacuccuacgucuuccccggcgucgcccucggcgucgucgccugcggccuccgccagaucaccgacaacaucuuccucaccaccgccgaggucaucgcccagcaggucuccgacaagcaccucgaggagggccgccucuaccccccccucaacaccauccgcgacgucucccucaagaucgccgagaagaucgucaaggacgccuaccaggagaagaccgccaccgucuaccccgagccccagaacaaggaggccuucguccgcucccagauguacuccaccgacuacgaccagauccuccccgacugcuacuccuggcccgaggagguccagaagauccagaccaaggucgaccaguga

SEQ ID NO: 45868 - RNA, 1440 nt, Artificial Sequence
  derived and/or modified sequence opt2 from ME2__Homo_sapiens__NP_001161807
augcucucccgccuccgcgucgucuccaccaccugcacccucgccugccgccaccuccacaucaaggagaagggcaagccccucaugcucaacccccgcaccaacaagggcauggccuucacccuccaggagcgccagaugcucggccuccagggccuccucccccccaagaucgagacccaggacauccaggcccuccgcuuccaccgcaaccucaagaagaugaccuccccccucgagaaguacaucuacaucaugggcauccaggagcgcaacgagaagcucuucuaccgcauccuccaggacgacaucgagucccucaugcccaucgucuacacccccaccgucggccucgccugcucccaguacggccacaucuuccgccgccccaagggccucuucaucuccaucuccgaccgcggccacguccgcuccaucgucgacaacuggcccgagaaccacgucaaggccgucgucgucaccgacggcgagcgcauccucggccucggcgaccucggcgucuacggcaugggcauccccgucggcaagcucugccucuacaccgccugcgccggcauccgccccgaccgcugccuccccgucugcaucgacgucggcaccgacaacaucgcccuccucaaggaccccuucuacaugggccucuaccagaagcgcgaccgcacccagcaguacgacgaccucaucgacgaguucaugaaggccaucaccgaccgcuacggccgcaacacccucauccaguucgaggacuucggcaaccacaacgccuuccgcuuccuccgcaaguaccgcgagaaguacugcaccuucaacgacgacauccagggcaccgccgccgucgcccucgccggccuccucgccgcccagaaggucaucuccaagcccaucuccgagcacaagauccucuuccucggcgccggcgaggccgcccucggcaucgccaaccucaucgucauguccauggucgagaacggccucuccgagcaggaggcccagaagaagaucuggauguucgacaaguacggccuccucgucaagggccgcaaggccaagaucgacuccuaccaggagcccuucacccacuccgcccccgaguccauccccgacaccuucgaggacgccgucaacauccucaagcccuccaccaucaucggcgucgccggcgccggccgccucuucacccccgacgucauccgcgccauggccuccaucaacgagcgccccgucaucuucgcccucuccaaccccaccgcccaggccgagugcaccgccgaggaggccuacacccucaccgagggccgcugccucuucgccuccggcucccccuucggccccgucaagcucaccgacggccgcgucuucacccccggccagggcaacaacgucuacaucuuccccggcuaccgcauccccaucugcuga

SEQ ID NO: 45869 - RNA, 1815 nt, Artificial Sequence
  derived and/or modified sequence opt2 from ME3__Homo_sapiens__NP_001155058
augggcgccgcccucggcaccggcacccgccucgcccccuggcccggccgcgccugcggcgcccucccccgcuggacccccaccgcccccgcccagggcugccacuccaagcccggccccgcccgccccgucccccucaagaagcgcggcuacgacgucacccgcaacccccaccucaacaagggcauggccuucacccucgaggagcgccuccagcucggcauccacggccucaucccccccugcuuccucucccaggacguccagcuccuccgcaucaugcgcuacuacgagcgccagcaguccgaccucgacaaguacaucauccucaugacccuccaggaccgcaacgagaagcucuucuaccgcguccucaccuccgacgucgagaaguucaugcccaucgucuacacccccaccgucggccucgccugccagcacuacggccucaccuuccgccgcccccgcggccucuucaucaccauccacgacaagggccaccucgccaccaugcucaacuccuggcccgaggacaacaucaaggccgucgucgucaccgacggcgagcgcauccucggccucggcgaccucggcugcuacggcaugggcauccccgucggcaagcucgcccucuacaccgccugcggcggcgucaacccccagcagugccuccccguccuccucgacgucggcaccaacaacgaggagcuccuccgcgacccccucuacaucggccucaagcaccagcgcguccacggcaaggccuacgacgaccuccucgacgaguucaugcaggccgucaccgacaaguucggcaucaacugccucauccaguucgaggacuucgccaacgccaacgccuuccgccuccucaacaaguaccgcaacaaguacugcauguucaacgacgacauccagggcaccgccuccgucgccgucgccggcauccucgccgcccuccgcaucaccaagaacaagcucuccaaccacgucuucgucuuccagggcgccggcgaggccgccaugggcaucgcccaccuccucgucauggcccucgagaaggagggcguccccaaggccgaggccacccgcaagaucuggauggucgacuccaagggccucaucgucaagggccgcucccaccucaaccacgagaaggagauguucgcccaggaccaccccgaggucaacucccucgaggaggucguccgccucgucaagcccaccgccaucaucggcgucgccgccaucgccggcgccuucaccgagcagauccuccgcgacauggccuccuuccacgagcgccccaucaucuucgcccucuccaaccccaccuccaaggccgagugcaccgccgagaagugcuaccgcgucaccgagggccgcggcaucuucgccuccggcucccccuucaaguccgucacccucgaggacggcaagaccuucauccccggccagggcaacaacgccuacgucuuccccggcgucgcccucggcgucaucgccggcggcauccgccacauccccgacgagaucuuccuccucaccgccgagcagaucgcccaggaggucuccgagcagcaccucucccagggccgccucuaccccccccucuccaccauccgcgacgucucccuccgcaucgccaucaagguccucgacuacgccuacaagcacaaccucgccuccuacuaccccgagcccaaggacaaggaggccuucguccgcucccucgucuacacccccgacuacgacuccuucacccucgacuccuacaccuggcccaaggaggccaugaacguccagaccgucuga

SEQ ID NO: 45870 - RNA, 558 nt, Artificial Sequence
  derived and/or modified sequence opt2 from MEA1__Homo_sapiens__NP_055438
augggccccgagcgccaccucuccggcgcccccgcccgcauggccaccgucguccucggcggcgacaccaugggccccgagcgcaucuuccccaaccagaccgaggagcucggccaccagggccccuccgagggcaccggcgacugguccuccgaggagcccgaggaggagcaggaggagaccggcuccggccccgccggcuacuccuaccagccccucaaccaggaccccgagcaggaggaggucgagcucgcccccgucggcgacggcgacgucgucgccgacauccaggaccgcauccaggcccucggccuccaccuccccgaccccccccucgaguccgaggacgaggacgaggagggcgccaccgcccucaacaaccacuccuccauccccauggaccccgagcacgucgagcucgucaagcgcaccauggccggcgucucccuccccgcccccggcguccccgccugggcccgcgagaucuccgacgcccagugggaggacgucguccagaaggcccuccaggcccgccaggccucccccgccuggaaguga

SEQ ID NO: 45871 - RNA, 3351 nt, Artificial Sequence
  derived and/or modified sequence opt2 from MECOM__Homo_sapiens__NP_001098547
augauccucgacgaguucuacaacgucaaguucugcaucgacgccucccagcccgacgucggcuccuggcucaaguacauccgcuucgccggcugcuacgaccagcacaaccucgucgccugccagaucaacgaccagaucuucuaccgcgucgucgccgacaucgcccccggcgaggagcuccuccucuucaugaaguccgaggacuacccccacgagaccauggcccccgacauccacgaggagcgccaguaccgcugcgaggacugcgaccagcucuucgaguccaaggccgagcucgccgaccaccagaaguuccccugcuccaccccccacuccgccuucuccauggucgaggaggacuuccagcagaagcucgaguccgagaacgaccuccaggagauccacaccauccaggagugcaaggagugcgaccaggucuuccccgaccuccagucccucgagaagcacaugcucucccacaccgaggagcgcgaguacaagugcgaccagugccccaaggccuucaacuggaaguccaaccucauccgccaccagaugucccacgacuccggcaagcacuacgagugcgagaacugcgccaagcaggucuucaccgaccccuccaaccuccagcgccacauccgcucccagcacgucggcgcccgcgcccacgccugccccgagugcggcaagaccuucgccaccuccuccggccucaagcagcacaagcacauccacuccuccgucaagcccuucaucugcgaggucugccacaaguccuacacccaguucuccaaccucugccgccacaagcgcaugcacgccgacugccgcacccagaucaagugcaaggacugcggccagauguucuccaccaccuccucccucaacaagcaccgccgcuucugcgagggcaagaaccacuucgccgccggcggcuucuucggccagggcaucucccuccccggcacccccgccauggacaagaccuccauggucaacaugucccacgccaaccccggccucgccgacuacuucggcgccaaccgccaccccgccggccucaccuuccccaccgcccccggcuucuccuucuccuuccccggccucuuccccuccggccucuaccaccgccccccccucauccccgccuccucccccgucaagggccucuccuccaccgagcagaccaacaagucccaguccccccucaugacccacccccagauccuccccgccacccaggacauccucaaggcccucuccaagcaccccuccgucggcgacaacaagcccgucgagcuccagcccgagcgcuccuccgaggagcgccccuucgagaagaucuccgaccaguccgaguccuccgaccucgacgacgucuccacccccuccggcuccgaccucgagaccaccuccggcuccgaccucgaguccgacaucgaguccgacaaggagaaguucaaggagaacggcaagauguucaaggacaaggucuccccccuccagaaccucgccuccaucaacaacaagaaggaguacuccaaccacuccaucuucucccccucccucgaggagcagaccgccgucuccggcgccgucaacgacuccaucaaggccaucgccuccaucgccgagaaguacuucggcuccaccggccucgucggccuccaggacaagaaggucggcgcccuccccuaccccuccauguucccccuccccuucuuccccgccuucucccaguccauguaccccuuccccgaccgcgaccuccgcucccucccccucaagauggagccccagucccccggcgaggucaagaagcuccagaagggcuccuccgagucccccuucgaccucaccaccaagcgcaaggacgagaagccccucacccccguccccuccaagccccccgucacccccgccaccucccaggaccagccccucgaccucuccaugggcucccgcucccgcgccuccggcaccaagcucaccgagccccgcaagaaccacgucuucggcggcaagaagggcuccaacgucgagucccgccccgccuccgacggcucccuccagcacgcccgccccacccccuucuucauggaccccaucuaccgcgucgagaagcgcaagcucaccgacccccucgaggcccucaaggagaaguaccuccgccccucccccggcuuccucuuccacccccaguuccagcuccccgaccagcgcaccuggauguccgccaucgagaacauggccgagaagcucgaguccuucuccgcccucaagcccgaggccuccgagcuccuccaguccguccccuccauguucaacuuccgcgccccccccaacgcccuccccgagaaccuccuccgcaagggcaaggagcgcuacaccugccgcuacugcggcaagaucuucccccgcuccgccaaccucacccgccaccuccgcacccacaccggcgagcagcccuaccgcugcaaguacugcgaccgcuccuucuccaucuccuccaaccuccagcgccacguccgcaacauccacaacaaggagaagcccuucaagugccaccucugcgaccgcugcuucggccagcagaccaaccucgaccgccaccucaagaagcacgagaacggcaacauguccggcaccgccaccuccuccccccacuccgagcucgaguccaccggcgccauccucgacgacaaggaggacgccuacuucaccgagauccgcaacuucaucggcaacuccaaccacggcucccaguccccccgcaacgucgaggagcgcaugaacggcucccacuucaaggacgagaaggcccucgucaccucccagaacuccgaccuccucgacgacgaggaggucgaggacgagguccuccucgacgaggaggacgaggacaacgacaucaccggcaagaccggcaaggagcccgucaccuccaaccuccacgagggcaaccccgaggacgacuacgaggagaccuccgcccucgagauguccugcaagaccucccccguccgcuacaaggaggaggaguacaaguccggccucuccgcccucgaccacauccgccacuucaccgacucccucaagaugcgcaagauggaggacaaccaguacuccgaggccgagcucuccuccuucuccaccucccacguccccgaggagcucaagcagccccuccaccgcaaguccaagucccaggccuacgccaugaugcucucccucuccgacaaggagucccuccacuccaccucccacuccuccuccaacgucuggcacuccauggcccgcgccgccgccgaguccuccgccauccaguccaucucccacgucuga

SEQ ID NO: 45872 - RNA, 1497 nt, Artificial Sequence
  derived and/or modified sequence opt2 from MECP2__Homo_sapiens__NP_001104262
auggccgccgccgccgccgccgcccccuccggcggcggcggcggcggcgaggaggagcgccucgaggagaaguccgaggaccaggaccuccagggccucaaggacaagccccucaaguucaagaaggucaagaaggacaagaaggaggagaaggagggcaagcacgagcccguccagcccuccgcccaccacuccgccgagcccgccgaggccggcaaggccgagaccuccgagggcuccggcuccgcccccgccguccccgaggccuccgccucccccaagcagcgccgcuccaucauccgcgaccgcggccccauguacgacgaccccacccuccccgagggcuggacccgcaagcucaagcagcgcaaguccggccgcuccgccggcaaguacgacgucuaccucaucaacccccagggcaaggccuuccgcuccaaggucgagcucaucgccuacuucgagaaggucggcgacaccucccucgaccccaacgacuucgacuucaccgucaccggccgcggcucccccucccgccgcgagcagaagccccccaagaagcccaagucccccaaggcccccggcaccggccgcggccgcggccgccccaagggcuccggcaccacccgccccaaggccgccaccuccgagggcguccaggucaagcgcguccucgagaagucccccggcaagcuccucgucaagaugcccuuccagaccucccccggcggcaaggccgagggcggcggcgccaccaccuccacccaggucauggucaucaagcgccccggccgcaagcgcaaggccgaggccgacccccaggccauccccaagaagcgcggccgcaagcccggcuccgucgucgccgccgccgccgccgaggccaagaagaaggccgucaaggaguccuccauccgcuccguccaggagaccguccuccccaucaagaagcgcaagacccgcgagaccgucuccaucgaggucaaggaggucgucaagccccuccucgucuccacccucggcgagaaguccggcaagggccucaagaccugcaagucccccggccgcaaguccaaggaguccucccccaagggccgcuccuccuccgccuccuccccccccaagaaggagcaccaccaccaccaccaccacuccgagucccccaaggcccccgucccccuccuccccccccuccccccccccccccccgagcccgaguccuccgaggaccccaccuccccccccgagccccaggaccucuccuccuccgucugcaaggaggagaagaugccccgcggcggcucccucgaguccgacggcugccccaaggagcccgccaagacccagcccgccgucgccaccgccgccaccgccgccgagaaguacaagcaccgcggcgagggcgagcgcaaggacaucgucuccuccuccaugccccgccccaaccgcgaggagcccgucgacucccgcacccccgucaccgagcgcgucuccuga

SEQ ID NO: 45873 - RNA, 6534 nt, Artificial Sequence
  derived and/or modified sequence opt2 from MED12__Homo_sapiens__NP_005111
auggccgccuucggcauccucuccuacgagcaccgcccccucaagcgcccccgccucggcccccccgacgucuacccccaggaccccaagcagaaggaggacgagcucaccgcccucaacgucaagcagggcuucaacaaccagcccgccgucuccggcgacgagcacggcuccgccaagaacgucuccuucaaccccgccaagaucuccuccaacuucuccuccaucaucgccgagaagcuccgcugcaacacccuccccgacaccggccgccgcaagccccaggucaaccagaaggacaacuucuggcucgucaccgcccgcucccaguccgccaucaacaccugguucaccgaccucgccggcaccaagccccucacccagcucgccaagaagguccccaucuucuccaagaaggaggaggucuucggcuaccucgccaaguacaccguccccgucaugcgcgccgccuggcucaucaagaugaccugcgccuacuacgccgccaucuccgagaccaaggucaagaagcgccacgucgaccccuucauggaguggacccagaucaucaccaaguaccucugggagcagcuccagaagauggccgaguacuaccgccccggccccgccggcuccggcggcugcggcuccaccaucggcccccucccccacgacgucgaggucgccauccgccagugggacuacaccgagaagcucgccauguucauguuccaggacggcaugcucgaccgccacgaguuccucaccuggguccucgagugcuucgagaagauccgccccggcgaggacgagcuccucaagcuccuccucccccuccuccuccgcuacuccggcgaguucguccaguccgccuaccucucccgccgccucgccuacuucugcacccgccgccucgcccuccagcucgacggcgucuccucccacuccucccacgucaucuccgcccaguccaccuccacccuccccaccacccccgccccccagccccccaccuccuccacccccuccacccccuucuccgaccuccucaugugcccccagcaccgcccccucgucuucggccucuccugcauccuccagaccauccuccucugcugccccuccgcccucgucuggcacuacucccucaccgacucccgcaucaagaccggcuccccccucgaccaccuccccaucgcccccuccaaccuccccaugcccgagggcaacuccgccuucacccagcagguccgcgccaagcuccgcgagaucgagcagcagaucaaggagcgcggccaggccgucgagguccgcugguccuucgacaagugccaggaggccaccgccggcuucaccaucggccgcguccuccacacccucgagguccucgacucccacuccuucgagcgcuccgacuucuccaacucccucgacucccucugcaaccgcaucuucggccucggccccuccaaggacggccacgagaucuccuccgacgacgacgccgucgucucccuccucugcgagugggccgucuccugcaagcgcuccggccgccaccgcgccauggucgucgccaagcuccucgagaagcgccaggccgagaucgaggccgagcgcugcggcgaguccgaggccgccgacgagaagggcuccaucgccuccggcucccucuccgcccccuccgcccccaucuuccaggacguccuccuccaguuccucgacacccaggcccccaugcucaccgacccccgcuccgaguccgagcgcgucgaguucuucaaccucguccuccucuucugcgagcucauccgccacgacgucuucucccacaacauguacaccugcacccucaucucccgcggcgaccucgccuucggcgcccccggcccccgcccccccucccccuucgacgaccccgccgacgaccccgagcacaaggaggccgagggcuccuccuccuccaagcucgaggaccccggccucuccgaguccauggacaucgaccccuccuccuccguccucuucgaggacauggagaagcccgacuucucccucuucucccccaccaugcccugcgagggcaagggcucccccucccccgagaagcccgacgucgagaaggaggucaagcccccccccaaggagaagaucgagggcacccucggcguccucuacgaccagccccgccacguccaguacgccacccacuuccccaucccccaggaggaguccugcucccacgagugcaaccagcgccucgucguccucuucggcgucggcaagcagcgcgacgacgcccgccacgccaucaagaagaucaccaaggacauccucaagguccucaaccgcaagggcaccgccgagaccgaccagcucgcccccaucgucccccucaaccccggcgaccucaccuuccucggcggcgaggacggccagaagcgccgccgcaaccgccccgaggccuuccccaccgccgaggacaucuucgccaaguuccagcaccucucccacuacgaccagcaccaggucaccgcccaggucucccgcaacguccucgagcagaucaccuccuucgcccucggcauguccuaccaccucccccucguccagcacguccaguucaucuucgaccucauggaguacucccucuccaucuccggccucaucgacuucgccauccagcuccucaacgagcucuccgucgucgaggccgagcuccuccucaaguccuccgaccucgucggcuccuacaccaccucccucugccucugcaucgucgccguccuccgccacuaccacgccugccucauccucaaccaggaccagauggcccaggucuucgagggccucugcggcgucgucaagcacggcaugaaccgcuccgacggcuccuccgccgagcgcugcauccucgccuaccucuacgaccucuacaccuccugcucccaccucaagaacaaguucggcgagcucuucuccgacuucugcuccaaggucaagaacaccaucuacugcaacgucgagcccuccgaguccaacaugcgcugggcccccgaguucaugaucgacacccucgagaaccccgccgcccacaccuucaccuacaccggccucggcaagucccucuccgagaaccccgccaaccgcuacuccuucgucugcaacgcccucaugcacgucugcgucggccaccacgaccccgaccgcgucaacgacaucgccauccucugcgccgagcucaccggcuacugcaagucccucuccgccgaguggcucggcguccucaaggcccucugcugcuccuccaacaacggcaccugcggcuucaacgaccuccucugcaacgucgacgucuccgaccucuccuuccacgacucccucgccaccuucgucgccauccucaucgcccgccagugccuccuccucgaggaccucauccgcugcgccgccauccccucccuccucaacgccgccugcuccgagcaggacuccgagcccggcgcccgccucaccugccgcauccuccuccaccucuucaagaccccccagcucaaccccugccaguccgacggcaacaagcccaccgucggcauccgcuccuccugcgaccgccaccuccucgccgccucccagaaccgcaucgucgacggcgccgucuucgccguccucaaggccgucuucguccucggcgacgccgagcucaagggcuccggcuucaccgucaccggcggcaccgaggagcuccccgaggaggagggcggcggcggcuccggcggccgccgccagggcggccgcaacaucuccgucgagaccgccucccucgacgucuacgccaaguacguccuccgcuccaucugccagcaggagugggucggcgagcgcugccucaagucccucugcgaggacuccaacgaccuccaggaccccguccucuccuccgcccaggcccagcgccucaugcagcucaucugcuacccccaccgccuccucgacaacgaggacggcgagaacccccagcgccagcgcaucaagcgcauccuccagaaccucgaccaguggaccaugcgccaguccucccucgagcuccagcucaugaucaagcagacccccaacaacgagaugaacucccuccucgagaacaucgccaaggccaccaucgaggucuuccagcaguccgccgagaccggcuccuccuccggcuccaccgccuccaacaugcccuccuccuccaagaccaagcccguccucuccucccucgagcgcuccggcgucuggcucgucgccccccucaucgccaagcuccccaccuccguccagggccacguccucaaggccgccggcgaggagcucgagaagggccagcaccucggcuccuccucccgcaaggagcgcgaccgccagaagcagaaguccaugucccuccucucccagcagcccuuccucucccucguccucaccugccucaagggccaggacgagcagcgcgagggccuccucaccucccucuacucccagguccaccagaucgucaacaacuggcgcgacgaccaguaccucgacgacugcaagcccaagcagcucaugcacgaggcccucaagcuccgccucaaccucgucggcggcauguucgacaccguccagcgcuccacccagcagaccaccgagugggccaugcuccuccucgagaucaucaucuccggcaccgucgacaugcaguccaacaacgagcucuucaccaccguccucgacaugcucuccguccucaucaacggcacccucgccgccgacauguccuccaucucccagggcuccauggaggagaacaagcgcgccuacaugaaccucgccaagaagcuccagaaggagcucggcgagcgccaguccgacucccucgagaagguccgccagcuccucccccuccccaagcagacccgcgacgucaucaccugcgagccccagggcucccucaucgacaccaagggcaacaagaucgccggcuucgacuccaucuucaagaaggagggccuccaggucuccaccaagcagaagaucucccccugggaccucuucgagggccucaagcccuccgccccccucuccuggggcugguucggcaccguccgcgucgaccgccgcgucgcccgcggcgaggagcagcagcgccuccuccucuaccacacccaccuccgcccccgcccccgcgccuacuaccucgagccccucccccucccccccgaggacgaggagccccccgcccccacccuccucgagcccgagaagaaggcccccgagccccccaagaccgacaagcccggcgccgccccccccuccaccgaggagcgcaagaagaaguccaccaagggcaagaagcgcucccagcccgccaccaagaccgaggacuacggcaugggccccggccgcuccggccccuacggcgucaccgucccccccgaccuccuccaccaccccaaccccggcuccaucacccaccucaacuaccgccagggcuccaucggccucuacacccagaaccagccccuccccgccggcggcccccgcgucgaccccuaccgccccguccgccuccccaugcagaagcuccccacccgccccaccuaccccggcguccuccccaccaccaugaccggcgucaugggccucgagcccuccuccuacaagaccuccgucuaccgccagcagcagcccgccgucccccagggccagcgccuccgccagcagcuccagcagucccagggcaugcucggccaguccuccguccaccagaugacccccuccuccuccuacggccuccagaccucccagggcuacacccccuacgucucccacgucggccuccagcagcacaccggccccgccggcaccauggucccccccuccuacuccucccagcccuaccaguccacccaccccuccaccaaccccacccucgucgaccccacccgccaccuccagcagcgccccuccggcuacguccaccagcaggcccccaccuacggccacggccucaccuccacccagcgcuucucccaccagacccuccagcagacccccaugaucuccaccaugacccccauguccgcccagggcguccaggccggcguccgcuccaccgccauccuccccgagcagcagcagcagcagcagcagcagcagcagcagcagcagcagcagcagcagcagcagcagcagcagcagcagcagcaguaccacauccgccagcagcagcagcagcagauccuccgccagcagcagcagcagcagcagcagcagcagcagcagcagcagcagcagcagcagcagcagcagcagcagcagcagcagcaccagcagcagcagcagcagcaggccgcccccccccagccccagccccagucccagccccaguuccagcgccagggccuccagcagacccagcagcagcagcagaccgccgcccucguccgccagcuccagcagcagcucuccaacacccagccccagcccuccaccaacaucuucggccgcuacuga

SEQ ID NO: 45874 - RNA, 6438 nt, Artificial Sequence
  derived and/or modified sequence opt2 from MED12L__Homo_sapiens__NP_443728
auggccgccuucggccuccucuccuacgagcagcgcccccucaagcgcccccgccucggcccccccgacgucuacccccaggaccccaagcagaaggaggacgagcucaccgccgucaacgucaagcagggcuucaacaaccagcccgccuucaccggcgacgagcacggcuccgcccgcaacaucgucaucaaccccuccaagaucggcgccuacuucuccuccauccucgccgagaagcucaagcucaacaccuuccaggacaccggcaagaagaagccccaggucaacgccaaggacaacuacuggcucgucaccgcccgcucccaguccgccauccacuccugguucuccgaccucgccggcaacaagccccucuccauccucgccaagaagguccccauccucuccaagaaggaggacgucuucgccuaccucgccaaguacuccguccccaugguccgcgccaccuggcucaucaagaugaccugcgccuacuacuccgccaucuccgaggccaagaucaagaagcgccaggcccccgaccccaaccucgaguggacccagaucuccacccgcuaccuccgcgagcagcucgccaagaucuccgacuucuaccacauggccuccuccaccggcgacggccccguccccgucccccccgaggucgagcaggccaugaagcagugggaguacaacgagaagcucgccuuccacauguuccaggagggcaugcucgagaagcacgaguaccucaccuggauccucgacguccucgagaagauccgccccauggacgacgaccuccucaagcuccuccucccccucaugcuccaguacuccgacgaguucguccaguccgccuaccucucccgccgccucgccuacuucugcgcccgccgccucucccuccuccucuccgacucccccaaccuccucgccgcccacuccccccacaugaugaucggccccaacaacuccuccaucggcgcccccucccccggcccccccggccccggcaugucccccguccagcucgccuucuccgacuuccucuccugcgcccagcacggcccccucgucuacggccucuccugcaugcuccagaccgucacccucugcugccccuccgcccucgucuggaacuacuccaccaacgagaacaaguccgccaaccccggcuccccccucgaccuccuccaggucgcccccuccucccuccccaugcccggcggcaacaccgccuucaaccagcagguccgcgcccgcaucuacgaggucgagcagcagaucaagcagcgcggccgcgccgucgagguccgcugguccuucgacaagugccaggaguccaccgccggcgucaccaucucccgcguccuccacacccucgagguccucgaccgccacugcuucgaccgcaccgacuccuccaacuccauggagacccucuaccacaagaucuucugggccaaccagaacaaggacaaccaggaggucgcccccaacgacgaggccgucgucacccuccucugcgagugggccgucuccugcaagcgcuccggcaagcaccgcgccauggccgucgccaagcuccucgagaagcgccaggccgagaucgaggccgagcgcugcggcgaguccgagguccucgacgagaaggaguccaucuccuccuccucccucgccggcuccucccuccccgucuuccagaacguccuccuccgcuuccucgacacccaggcccccucccucuccgaccccaacuccgagugcgagaaggucgaguucgucaaccucguccuccucuucugcgaguucauccgccacgacgucuucucccacgacgccuacaugugcacccucaucucccgcggcgaccucuccgucaccgccuccacccgcccccgcucccccgucggcgagaacgccgacgagcacuacuccaaggaccacgacgucaagauggagaucuucucccccaugcccggcgaguccugcgagaacgccaacaccucccucggccgccgcauguccgucaacugcgagaagcucgucaagcgcgagaagccccgcgagcucaucuuccccuccaacuacgaccuccuccgccaccuccaguacgccacccacuuccccaucccccucgacgaguccuccucccacgagugcaaccagcgcaccauccuccucuacggcgucggcaaggagcgcgacgaggcccgccaccagcucaagaagaucaccaaggacauccucaagauccucaacaagaaguccaccaccgagaccggcgucggcgacgagggccagaaggcccgcaagaacaagcaggagaccuuccccacccucgagaccgucuucaccaagcuccagcuccucuccuacuucgaccagcaccaggucaccucccagaucuccaacaacguccucgagcagaucaccuccuucgccuccggcaccuccuaccaccucccccucgcccaccacauccagcucaucuucgaccucauggagcccgcccucaacaucaacggccucaucgacuucgccauccagcuccucaacgagcucuccgucgucgaggccgagcuccuccucaaguccuccucccucgccggcuccuacaccaccggccucugcgucugcaucgucgccguccuccgccgcuaccacuccugccucauccucaaccccgaccagaccgcccaggucuucgagggccucugcggcgucgucaagcacgucgucaaccccuccgagugcuccucccccgagcgcugcauccucgccuaccucuacgaccucuacgucuccugcucccaccuccgcuccaaguucggcgaccucuucuccuccgccugcuccaaggucaagcagaccaucuacaacaacgucaugcccgccaacuccaaccuccgcugggaccccgacuucaugauggacuucaucgagaaccccuccgcccgcuccaucaacuacuccaugcucggcaagauccucuccgacaacgccgccaaccgcuacuccuucgucugcaacacccucaugaacgucugcaugggccaccaggacgccggccgcaucaacgacaucgccaacuucuccuccgagcucaccgccugcugcaccguccucuccuccgaguggcucggcguccucaaggcccucugcugcuccuccaaccacgucuggggcuucaacgacguccucugcaccgucgacgucuccgaccucuccuuccacgacucccucgccaccuucaucgccauccucaucgcccgccagugcuucucccucgaggacgucguccagcacgucgcccuccccucccuccucgccgccgccugcggcgacgccgacgccgagcccggcgcccgcaugaccugccgccuccuccuccaccucuuccgcgccccccaggccugcuuccucccccaggccaccggcaagcccuuccccggcauccgcuccuccugcgaccgccaccuccucgccgccgcccacaacuccaucgaggucggcgccgucuucgccguccucaaggccaucaugaugcucggcgacgccaagaucggcaacaacuccgucuccucccucaagaacgacgacuucaccaugcgcggccuccgcugcgacggcaacgccgacgacaucuggaccgccucccagaaccccaaguccugcggcaaguccaucuccaucgagaccgccaaccuccgcgaguacgcccgcuacguccuccgcaccaucugccagcaggagugggucggcgagcacugccucaaggagcccgagcgccucugcaccgacaaggagcucauccucgaccccguccucuccaacaugcaggcccagaagcuccuccagcucaucugcuacccccacggcaucaaggagugcaccgagggcgacaaccuccagcgccagcacaucaagcgcauccuccagaaccucgagcaguggacccuccgccaguccuggcucgagcuccagcucaugaucaagcagugccucaaggaccccggcuccggcuccgucgccgagaugaacaaccuccucgacaacaucgccaaggccaccaucgaggucuuccagcaguccgccgaccucaacaacuccuccaacuccggcaugucccucuucaaccccaacuccaucggcuccgccgacaccuccuccacccgccagaacggcaucaagaccuuccucuccuccuccgagcgccgcggcgucuggcucgucgccccccucaucgcccgccuccccaccuccguccagggccgcguccucaaggccgccggcgaggagcucgagaagggccagcaccucggcuccuccuccaagaaggagcgcgaccgccagaagcagaaguccaugucccuccucucccagcagcccuuccucucccucguccucaccugccucaagggccaggacgagcagcgcgagggccuccucaccucccuccagaaccaggucaaccagauccucuccaacuggcgcgaggagcgcuaccaggacgacaucaaggcccgccagaugaugcacgaggcccuccagcuccgccucaaccucgucggcggcauguucgacaccguccagcgcuccacccaguggaccaccgacugggcccuccuccuccuccagaucaucaccuccggcaccgucgacaugcacaccaacaacgagcucuucaccaccguccucgacaugcucggcguccucaucaacggcacccucgccuccgaccucuccaacgccucccccggcggcuccgaggagaacaagcgcgccuacaugaaccucgucaagaagcucaagaaggagcucggcgacaagcgcuccgaguccaucgacaagguccgccagcuccucccccuccccaagcagaccugcgacgucaucaccugcgagcccaugggcucccucaucgacaccaagggcaacaagaucgccggcuucgacuccaucgacaagaagcagggccuccaggucuccaccaagcagaaggucucccccugggaccucuucgagggccagaagaaccccgccccccucuccugggccugguucggcaccguccgcgucgaccgccgcgucaucaaguacgaggagcagcaccaccuccuccucuaccacacccaccccaugcccaagccccgcuccuacuaccuccagccccucccccucccccccgaggaggaggaggaggagcccaccucccccgucucccaggagcccgagcgcaaguccgccgagcucuccgaccagggcaagaccaccaccgacgaggagaagaagaccaagggccgcaagcgcaagaccaaguccuccucccgcgucgacgaguacccccaguccaacaucuaccgcgucccccccaacuacucccccaucuccucccagaugaugcaccacccccaguccacccucuggggcuacaaccucgucggccagccccagcagcccggcuucuuccuccagaaccagucccucacccccggcggcucccgccucgaccccgccggcuccuucguccccaccaacaccaagcaggcccucuccaacaugcuccagcgccgcuccggcgccaugaugcagccccccucccuccacgccaucaccucccagcagcagcucauccagaugaagcuccuccagcagcagcagcagcagcgccuccuccgccaggcccagacccgccccuuccagcagggccagcccggcgaccaggccgcccucuucgccgcccaggcccgccccuccccccagcucccccaguaccccggccuccagcaggcccagaccaugccccagggcuacaccauguacggcacccagaugccccuccagcagaccucccagcagcaggccggcuccgucguccucucccccuccuacaacucccgcgccuaccccgccgcccacuccaaccccguccucauggagcgccuccgccagauccagcagcagcccuccggcuacguccagcagcaggccucccccuaccuccagccccucaccggcucccagcgccucaaccaccaggcccuccagcaguccccccucgucggcggcggcaucgacgccguccucaccuccgcccaccccaaccuccccuccgucccccucccccaggaccccaugcgcccccgccagccccagguccgccagcagcagcgccuccuccagaugcagcagccccagcagccccagccccagcagcccccccagccccagcaguccucccagucccagucccagacccucggccuccaggccaugcagccccagcagccccucuucccccgccagggccuccagcagacccagcagcagcagcagaccgccgcccucguccgccagcuccagaagcagcucuccuccaaccagccccagcagggcgucacccccuacggccaccccucccacuucuga

SEQ ID NO: 45875 - RNA, 6525 nt, Artificial Sequence
  derived and/or modified sequence opt2 from MED13__Homo_sapiens__NP_005112
auguccgccuccuucguccccaacggcgccucccucgaggacugccacugcaaccucuucugccucgccgaccucaccggcaucaaguggaagaaguacgucuggcagggccccaccuccgcccccauccucuuccccgucaccgaggaggaccccauccucuccuccuucucccgcugccucaaggccgacguccucggcgucuggcgccgcgaccagcgccccggccgccgcgagcucuggaucuucugguggggcgaggaccccuccuucgccgaccucauccaccacgaccucuccgaggaggaggacggcgucugggagaacggccucuccuacgagugccgcacccuccucuucaaggccguccacaaccuccucgagcgcugccucaugaaccgcaacuucguccgcaucggcaagugguucgucaagcccuacgagaaggacgagaagcccaucaacaaguccgagcaccucuccugcuccuucaccuucuuccuccacggcgacuccaacgucugcaccuccgucgagaucaaccagcaccagcccgucuaccuccucuccgaggagcacaucacccucgcccagcaguccaacucccccuuccaggucauccucugccccuucggccucaacggcacccucaccggccaggccuucaagauguccgacuccgccaccaagaagcucaucggcgaguggaagcaguucuaccccaucuccugcugccucaaggagauguccgaggagaagcaggaggacauggacugggaggacgacucccucgccgccgucgagguccucgucgccggcguccgcaugaucuaccccgccugcuucguccucgucccccaguccgacauccccacccccucccccgucggcuccacccacugcuccuccuccugccucggcguccaccagguccccgccuccacccgcgaccccgccauguccuccgucacccucaccccccccaccucccccgaggagguccagaccgucgacccccaguccguccagaagugggucaaguucuccuccgucuccgacggcuucaacuccgacuccaccucccaccacggcggcaagaucccccgcaagcucgccaaccacgucgucgaccgcgucuggcaggagugcaacaugaaccgcgcccagaacaagcgcaaguacuccgccuccuccggcggccucugcgaggaggccaccgccgccaaggucgccuccugggacuucgucgaggccacccagcgcaccaacugcuccugccuccgccacaagaaccucaagucccgcaacgccggccagcagggccaggcccccucccucggccagcagcagcagauccuccccaagcacaagaccaacgagaagcaggagaaguccgagaagccccagaagcgcccccucacccccuuccaccaccgcgucuccgucuccgacgacgucggcauggacgccgacuccgccucccagcgccucgucaucuccgcccccgacucccagguccgcuucuccaacauccgcaccaacgacgucgccaagaccccccagaugcacggcaccgagauggccaacuccccccagccccccccccucuccccccaccccugcgacgucgucgacgagggcgucaccaagacccccuccaccccccagucccagcacuucuaccagaugcccacccccgacccccucguccccuccaagcccauggaggaccgcaucgacucccucucccaguccuuccccccccaguaccaggaggccgucgagcccaccgucuacgucggcaccgccgucaaccucgaggaggacgaggccaacaucgccuggaaguacuacaaguuccccaagaagaaggacgucgaguuccuccccccccagcuccccuccgacaaguucaaggacgaccccgucggccccuucggccaggaguccgucaccuccgucaccgagcucaugguccagugcaagaagccccucaaggucuccgacgagcucguccagcaguaccagaucaagaaccagugccucuccgccaucgccuccgacgccgagcaggagcccaagaucgaccccuacgccuucgucgagggcgacgaggaguuccucuuccccgacaagaaggaccgccagaacuccgagcgcgaggccggcaagaagcacaaggucgaggacggcaccuccuccgucaccguccucucccacgaggaggacgccaugucccucuucucccccuccaucaagcaggacgccccccgccccaccucccacgcccgcccccccuccaccucccucaucuacgacuccgaccucgccgucuccuacaccgaccucgacaaccucuucaacuccgacgaggacgagcucacccccggcuccaagaaguccgccaacggcuccgacgacaaggccuccugcaaggaguccaagaccggcaaccucgacccccucuccugcaucuccaccgccgaccuccacaagauguaccccaccccccccucccucgagcagcacaucaugggcuucucccccaugaacaugaacaacaaggaguacggcuccauggacaccacccccggcggcaccguccucgagggcaacuccuccuccaucggcgcccaguucaagaucgaggucgacgagggcuucugcucccccaagcccuccgagaucaaggacuucuccuacgucuacaagcccgagaacugccagauccucgucggcugcuccauguucgccccccucaagacccuccccucccaguaccucccccccaucaagcuccccgaggagugcaucuaccgccaguccuggaccgucggcaagcucgagcuccucuccuccggccccuccaugcccuucaucaaggagggcgacggcuccaacauggaccaggaguacggcaccgccuacaccccccagacccacaccuccuucggcaugccccccuccuccgccccccccuccaacuccggcgccggcauccuccccucccccuccaccccccgcuuccccaccccccgcaccccccgcaccccccgcaccccccgcggcgccggcggccccgccuccgcccagggcuccgucaaguacgagaacuccgaccucuacucccccgccuccacccccuccaccugccgcccccucaacuccgucgagcccgccaccguccccuccauccccgaggcccacucccucuacgucaaccucauccucuccgaguccgucaugaaccucuucaaggacugcaacuucgacuccugcugcaucugcgucugcaacaugaacaucaagggcgccgacgucggcgucuacauccccgaccccacccaggaggcccaguaccgcugcaccugcggcuucuccgccgucaugaaccgcaaguucggcaacaacuccggccucuuccucgaggacgagcucgacaucaucggccgcaacaccgacugcggcaaggaggccgagaagcgcuucgaggcccuccgcgccaccuccgccgagcacgucaacggcggccucaaggaguccgagaagcucuccgacgaccucauccuccuccuccaggaccagugcaccaaccucuucucccccuucggcgccgccgaccaggaccccuuccccaaguccggcgucaucuccaacuggguccgcgucgaggagcgcgacugcugcaacgacugcuaccucgcccucgagcacggccgccaguucauggacaacauguccggcggcaaggucgacgaggcccucgucaaguccuccugccuccaccccugguccaagcgcaacgacgucuccaugcagugcucccaggacauccuccgcaugcuccucucccuccagcccguccuccaggacgccauccagaagaagcgcaccguccgccccuggggcguccagggcccccucaccuggcagcaguuccacaagauggccggccgcggcuccuacggcaccgacgagucccccgagccccuccccauccccaccuuccuccucggcuacgacuacgacuaccucguccucucccccuucgcccuccccuacugggagcgccucaugcucgagcccuacggcucccagcgcgacaucgccuacgucguccucugccccgagaacgaggcccuccucaacggcgccaaguccuucuuccgcgaccucaccgccaucuacgaguccugccgccucggccagcaccgccccgucucccgccuccucaccgacggcaucaugcgcgucggcuccaccgccuccaagaagcucuccgagaagcucgucgccgagugguucucccaggccgccgacggcaacaacgaggccuucuccaagcucaagcucuacgcccaggucugccgcuacgaccucggccccuaccucgccucccucccccucgacuccucccuccucucccagcccaaccucgucgcccccaccucccagucccucaucacccccccccagaugaccaacaccggcaacgccaacacccccuccgccacccucgccuccgccgccuccuccaccaugaccgucaccuccggcgucgccaucuccaccuccgucgccaccgccaacuccacccucaccaccgccuccaccuccuccuccuccuccuccaaccucaacuccggcgucuccuccaacaagcuccccuccuucccccccuucggcuccaugaacuccaacgccgccggcuccauguccacccaggccaacaccguccaguccggccagcucggcggccagcagaccuccgcccuccagaccgccggcaucuccggcgaguccuccucccuccccacccagccccaccccgacgucuccgaguccaccauggaccgcgacaaggucggcauccccaccgacggcgacucccacgccgucaccuacccccccgccaucgucgucuacaucaucgaccccuucaccuacgagaacaccgacgaguccaccaacuccuccuccgucuggacccucggccuccuccgcugcuuccucgagaugguccagacccuccccccccacaucaaguccaccgucuccguccagaucauccccugccaguaccuccuccagcccgucaagcacgaggaccgcgagaucuacccccagcaccucaagucccucgccuucuccgccuucacccagugccgccgcccccuccccaccuccaccaacgucaagacccucaccggcuucggccccggccucgccauggagaccgcccuccgcucccccgaccgccccgagugcauccgccucuacgccccccccuucauccucgcccccgucaaggacaagcagaccgagcucggcgagaccuucggcgaggccggccagaaguacaacguccucuucgucggcuacugccucucccacgaccagcgcuggauccucgccuccugcaccgaccucuacggcgagcuccucgagaccugcaucaucaacaucgacguccccaaccgcgcccgccgcaagaaguccuccgcccgcaaguucggccuccagaagcucugggaguggugccucggccucguccagauguccucccuccccuggcgcgucgucaucggccgccucggccgcaucggccacggcgagcucaaggacugguccugccuccucucccgccgcaaccuccagucccucuccaagcgccucaaggacaugugccgcaugugcggcaucuccgccgccgacucccccuccauccucuccgccugccucgucgccauggagccccagggcuccuucgucaucaugcccgacuccgucuccaccggcuccgucuucggccgcuccaccacccucaacaugcagaccucccagcucaacaccccccaggacaccuccugcacccacauccucgucuuccccaccuccgccuccguccaggucgccuccgccaccuacaccaccgagaaccucgaccucgccuucaaccccaacaacgacggcgccgacggcaugggcaucuucgaccuccucgacaccggcgacgaccucgaccccgacaucaucaacauccuccccgccucccccaccggcucccccguccacucccccggcucccacuacccccacggcggcgacgccggcaagggccaguccaccgaccgccuccucuccaccgagccccacgaggagguccccaacauccuccagcagccccucgcccucggcuacuucgucuccaccgccaaggccggcccccuccccgacugguucugguccgccugcccccaggcccaguaccagugcccccucuuccucaaggccucccuccaccuccacguccccuccguccaguccgacgagcuccuccacuccaagcacucccacccccucgacuccaaccagaccuccgacguccuccgcuucguccucgagcaguacaacgcccucuccuggcucaccugcgaccccgccacccaggaccgccgcuccugccuccccauccacuucgucguccucaaccagcucuacaacuucaucaugaacaugcucuga

SEQ ID NO: 45876 - RNA, 6633 nt, Artificial Sequence
  derived and/or modified sequence opt2 from MED13L__Homo_sapiens__NP_056150
augaccgccgccgccaacugggucgccaacggcgccucccucgaggacugccacuccaaccucuucucccucgccgagcucaccggcaucaaguggcgccgcuacaacuucggcggccacggcgacugcggccccaucaucuccgcccccgcccaggacgaccccauccuccucuccuucauccgcugccuccaggccaaccuccucugcgucuggcgccgcgacgucaagcccgacugcaaggagcucuggaucuucugguggggcgacgagcccaaccucgucggcgucauccaccacgagcuccaggucgucgaggagggccucugggagaacggccucuccuacgagugccgcacccuccucuucaaggccauccacaaccuccucgagcgcugccucauggacaagaacuucguccgcaucggcaagugguucguccgccccuacgagaaggacgagaagcccgucaacaaguccgagcaccucuccugcgccuucaccuucuuccuccacggcgaguccaacgucugcaccuccgucgagaucgcccagcaccagcccaucuaccucaucaacgaggagcacauccacauggcccaguccucccccgcccccuuccagguccucgucucccccuacggccucaacggcacccucaccggccaggccuacaagauguccgaccccgccacccgcaagcucaucgaggaguggcaguacuucuaccccaugguccucaagaagaaggaggaguccaaggaggaggacgagcucggcuacgacgacgacuuccccgucgccgucgaggucaucgucggcggcguccgcauggucuaccccuccgccuucguccucaucucccagaacgacauccccgucccccaguccgucgccuccgccggcggccacaucgccgucggccagcagggccucggcuccgucaaggaccccuccaacugcggcaugccccucaccccccccaccucccccgagcaggccauccucggcgaguccggcggcaugcaguccgccgccucccaccucgucucccaggacggcggcaugaucaccaugcacucccccaagcgcuccggcaagaucccccccaagcuccacaaccacaugguccaccgcgucuggaaggagugcauccucaaccgcacccaguccaagcgcucccagauguccacccccacccucgaggaggagcccgccuccaaccccgccaccugggacuucgucgaccccacccagcgcgucuccugcuccugcucccgccacaagcuccucaagcgcugcgccgucggccccaaccgcccccccaccgucucccagcccggcuucuccgccggccccuccuccuccuccucccuccccccccccgccuccuccaagcacaagaccgccgagcgccaggagaagggcgacaagcuccagaagcgcccccucauccccuuccaccaccgccccuccgucgccgaggagcucugcauggagcaggacacccccggccagaagcucggccucgccggcaucgacuccucccucgaggucuccuccucccgcaaguacgacaagcagauggccguccccucccgcaacaccuccaagcagaugaaccucaaccccauggacuccccccacucccccaucuccccccucccccccacccucuccccccagccccgcggccaggagaccgagucccucgacccccccuccguccccgucaaccccgcccucuacggcaacggccucgagcuccagcagcucuccacccucgacgaccgcaccguccucgucggccagcgccucccccucauggccgaggucuccgagaccgcccucuacugcggcauccgccccuccaaccccgaguccuccgagaagugguggcacuccuaccgccucccccccuccgacgacgccgaguuccgcccccccgagcuccagggcgagcgcugcgacgccaagauggaggucaacuccgaguccaccgcccuccagcgccuccucgcccagcccaacaagcgcuucaagaucuggcaggacaagcagccccagcuccagccccuccacuuccucgacccccucccccucucccagcagcccggcgacucccucggcgaggucaacgaccccuacaccuucgaggacggcgacaucaaguacaucuucaccgccaacaagaagugcaagcagggcaccgagaaggacucccucaagaagaacaaguccgaggacggcuucggcaccaaggacgucaccacccccggccacuccacccccguccccgacggcaagaacgccauguccaucuucuccuccgccaccaagaccgacguccgccaggacaacgccgccggccgcgccggcuccuccucccucacccaggucaccgaccucgcccccucccuccacgaccucgacaacaucuucgacaacuccgacgacgacgagcucggcgccgucucccccgcccuccgcuccuccaagaugcccgccgucggcaccgaggaccgcccccucggcaaggacggccgcgccgccguccccuacccccccaccgucgccgaccuccagcgcauguuccccaccccccccucccucgagcagcaccccgccuucucccccgucaugaacuacaaggacggcaucuccuccgagaccgucaccgcccucggcaugauggagucccccauggucuccauggucuccacccagcucaccgaguucaagauggaggucgaggacggccucggcucccccaagcccgaggagaucaaggacuucuccuacguccacaagguccccuccuuccagcccuucgucggcuccuccauguucgccccccucaagaugcuccccucccacugccuccucccccucaagauccccgacgccugccucuuccgccccuccugggccaucccccccaagaucgagcagcuccccaugccccccgccgccaccuucauccgcgacggcuacaacaacguccccuccgucggcucccucgccgaccccgacuaccucaacaccccccagaugaacacccccgucacccucaacuccgccgcccccgccuccaacuccggcgccggcguccuccccucccccgccaccccccgcuucuccguccccaccccccgcaccccccgcaccccccgcaccccccgcggcggcggcaccgccuccggccagggcuccgucaaguacgacuccaccgaccagggcucccccgccuccacccccuccaccacccgcccccucaacuccgucgagcccgccaccaugcagcccauccccgaggcccacucccucuacgucacccucauccucuccgacuccgucaugaacaucuucaaggaccgcaacuucgacuccugcugcaucugcgccugcaacaugaacaucaagggcgccgacgucggccucuacauccccgacuccuccaacgaggaccaguaccgcugcaccugcggcuucuccgccaucaugaaccgcaagcucggcuacaacuccggccucuuccucgaggacgagcucgacaucuucggcaagaacuccgacaucggccaggccgccgagcgccgccucaugaugugccaguccaccuuccucccccaggucgagggcaccaagaagccccaggagccccccaucucccuccuccuccuccuccagaaccagcacacccagcccuucgccucccucaacuuccucgacuacaucuccuccaacaaccgccagacccuccccugcgucuccugguccuacgaccgcguccaggccgacaacaacgacuacuggaccgagugcuucaacgcccucgagcagggccgccaguacgucgacaaccccaccggcggcaaggucgacgaggcccucguccgcuccgccaccguccacuccuggccccacuccaacguccucgacaucuccaugcucuccucccaggacgucguccgcaugcuccucucccuccagcccuuccuccaggacgccauccagaagaagcgcaccggccgcaccugggagaacauccagcacguccagggcccccucaccuggcagcaguuccacaagauggccggccgcggcaccuacggcuccgaggagucccccgagccccuccccauccccacccuccucgucggcuacgacaaggacuuccucaccaucucccccuucucccuccccuucugggagcgccuccuccucgaccccuacggcggccaccgcgacgucgccuacaucgucgucugccccgagaacgaggcccuccucgagggcgccaagaccuucuuccgcgaccucuccgccgucuacgagaugugccgccucggccagcacaagcccaucugcaagguccuccgcgacggcaucaugcgcgucggcaagaccgucgcccagaagcucaccgacgagcucgucuccgagugguucaaccagcccugguccggcgaggagaacgacaaccacucccgccucaagcucuacgcccaggucugccgccaccaccucgcccccuaccucgccacccuccagcucgacuccucccuccucaucccccccaaguaccagaccccccccgccgccgcccagggccaggccacccccggcaacgccggcccccucgcccccaacggcuccgccgccccccccgccggcuccgccuucaaccccaccuccaacuccuccuccaccaaccccgccgccuccuccuccgccuccggcuccuccgucccccccgucuccuccuccgccuccgcccccggcaucucccagaucuccaccaccuccuccuccggcuucuccggcuccgucggcggccagaaccccuccaccggcggcaucuccgccgaccgcacccagggcaacaucggcugcggcggcgacaccgaccccggccaguccuccucccagcccucccaggacggccaggaguccgucaccgagcgcgagcgcaucggcauccccaccgagcccgacuccgccgacucccacgcccacccccccgccgucgucaucuacauggucgaccccuucaccuacgccgccgaggaggacuccaccuccggcaacuucuggcuccucucccucaugcgcugcuacaccgagaugcucgacaaccuccccgagcacaugcgcaacuccuucauccuccagaucguccccugccaguacaugcuccagaccaugaaggacgagcaggucuucuacauccaguaccucaaguccauggccuucuccgucuacugccagugccgccgcccccuccccacccagauccacaucaagucccucaccggcuucggccccgccgccuccaucgagaugacccucaagaaccccgagcgccccucccccauccagcucuacuccccccccuucauccucgcccccaucaaggacaagcagaccgagcucggcgagaccuucggcgaggccucccagaaguacaacguccucuucgucggcuacugccucucccacgaccagcgcuggcuccucgccuccugcaccgaccuccacggcgagcuccucgagaccugcgucgucaacaucgcccuccccaaccgcucccgccgcuccaaggucuccgcccgcaagaucggccuccagaagcucugggaguggugcaucggcaucguccagaugaccucccuccccuggcgcgucgucaucggccgccucggccgccucggccacggcgagcucaaggacugguccauccuccucggcgagugcucccuccagaccaucuccaagaagcucaaggacgucugccgcaugugcggcaucuccgccgccgacucccccuccauccucuccgccugccucgucgccauggagccccagggcuccuucgucgucaugcccgacgccgucaccaugggcuccgucuucggccgcuccaccgcccucaacaugcaguccucccagcucaacaccccccaggacgccuccugcacccacauccucgucuuccccaccuccuccaccauccaggucgcccccgccaacuaccccaacgaggacggcuucucccccaacaacgacgacauguucgucgaccuccccuuccccgacgacauggacaacgacaucggcauccucaugaccggcaaccuccacuccucccccaacuccucccccguccccucccccggcucccccuccggcaucggcgucggcucccacuuccagcacucccgcucccagggcgagcgccuccucucccgcgaggcccccgaggagcucaagcagcagccccucgcccucggcuacuucgucuccaccgccaaggccgagaaccucccccagugguucugguccuccugcccccaggcccagaaccagugcccccucuuccucaaggccucccuccaccaccacaucuccgucgcccagaccgacgagcuccuccccgcccgcaacucccagcgcgucccccacccccucgacuccaagaccaccuccgacguccuccgcuucguccucgagcaguacaacgcccucuccuggcucaccugcaaccccgccacccaggaccgcaccuccugccuccccguccacuucgucguccucacccagcucuacaacgccaucaugaacauccucuga

SEQ ID NO: 45877 - RNA, 4365 nt, Artificial Sequence
  derived and/or modified sequence opt2 from MED14__Homo_sapiens__NP_004220
auggcccccguccagcucgagaaccaccagcucgucccccccggcggcggcggcggcggcuccggcggcccccccuccgcccccgccccccccccccccggcgccgccgucgccgccgccgccgccgccgccgccucccccggcuaccgccucuccacccucaucgaguuccuccuccaccgcgccuacuccgagcucaugguccucaccgaccuccucccccgcaaguccgacgucgagcgcaagaucgagaucguccaguucgccucccgcacccgccagcucuucguccgccuccucgcccucgucaagugggccaacaacgccggcaaggucgagaagugcgccaugaucuccuccuuccucgaccagcaggccauccucuucgucgacaccgccgaccgccucgccucccucgcccgcgacgcccucguccacgcccgccuccccuccuucgccauccccuacgccaucgacguccucaccaccggcuccuacccccgccuccccaccugcauccgcgacaagaucaucccccccgaccccaucaccaagaucgagaagcaggccacccuccaccagcucaaccagauccuccgccaccgccucgucaccaccgaccuccccccccagcucgccaaccucaccgucgccaacggccgcgucaaguuccgcgucgagggcgaguucgaggccacccucaccgucaugggcgacgaccccgacguccccuggcgccuccucaagcucgagauccucgucgaggacaaggagaccggcgacggccgcgcccucguccacuccaugcagaucuccuucauccaccagcucguccagucccgccucuucgccgacgagaagccccuccaggacauguacaacugccuccacuccuucugccucucccuccagcucgagguccuccacucccagacccucaugcucauccgcgagcgcuggggcgaccucguccaggucgagcgcuaccacgccggcaagugccucucccucuccgucuggaaccagcagguccucggccgcaagaccggcaccgccuccguccacaaggucaccaucaagaucgacgagaacgacgucuccaagccccuccagaucuuccacgaccccccccuccccgccuccgacuccaagcucgucgagcgcgccaugaagaucgaccaccucuccaucgagaagcuccucaucgacuccguccacgcccgcgcccaccagaagcuccaggagcucaaggccauccuccgcggcuucaacgccaacgagaacuccuccaucgagaccgcccuccccgcccucgucguccccauccucgagcccugcggcaacuccgagugccuccacaucuucgucgaccuccacuccggcauguuccagcucaugcucuacggccucgaccaggccacccucgacgacauggagaaguccgucaacgacgacaugaagcgcaucauccccuggauccagcagcucaaguucuggcucggccagcagcgcugcaagcaguccaucaagcaccuccccaccaucuccuccgagacccuccagcucuccaacuacuccacccaccccaucggcaaccucuccaagaacaagcucuucaucaagcucacccgccucccccaguacuacaucgucgucgagaugcucgagguccccaacaagcccacccagcucuccuacaaguacuacuucauguccgucaacgccgccgaccgcgaggacucccccgccauggcccuccuccuccagcaguucaaggagaacauccaggaccucgucuuccgcaccaagaccggcaagcagacccgcaccaacgccaagcgcaagcucuccgacgaccccugccccgucgaguccaagaagaccaagcgcgccggcgagaugugcgccuucaacaagguccucgcccacuucgucgccaugugcgacaccaacaugcccuucgucggccuccgccucgagcucuccaaccucgagaucccccaccagggcguccaggucgagggcgacggcuucucccacgccauccgccuccucaagaucccccccugcaagggcaucaccgaggagacccagaaggcccucgaccgcucccuccucgacugcaccuuccgccuccagggccgcaacaaccgcaccugggucgccgagcucgucuucgccaacugcccccucaacggcaccuccacccgcgagcagggccccucccgccacgucuaccucaccuacgagaaccuccucuccgagcccgucggcggccgcaaggucgucgagauguuccucaacgacuggaacuccaucgcccgccucuacgagugcguccucgaguucgcccgcucccuccccgacauccccgcccaccucaacaucuucuccgagguccgcgucuacaacuaccgcaagcucauccucugcuacggcaccaccaagggcuccuccaucuccauccaguggaacuccauccaccagaaguuccacaucucccucggcaccgucggccccaacuccggcugcuccaacugccacaacaccauccuccaccagcuccaggagauguucaacaagacccccaacgucguccagcuccuccagguccucuucgacacccaggccccccucaacgccaucaacaagcuccccaccguccccaugcucggccucacccagcgcaccaacaccgccuaccagugcuucuccauccucccccaguccuccacccacauccgccucgccuuccgcaacauguacugcaucgacaucuacugccgcucccgcggcgucgucgccauccgcgacggcgccuacucccucuucgacaacuccaagcucgucgagggcuucuaccccgcccccggccucaagaccuuccucaacauguucgucgacuccaaccaggacgcccgccgccgcuccgucaacgaggacgacaacccccccucccccaucggcggcgacaugauggacucccucaucucccagcuccagccccccccccagcagcagcccuuccccaagcagcccggcaccuccggcgccuacccccucaccuccccccccaccuccuaccacuccaccgucaaccagucccccuccaugaugcacacccagucccccggcaaccuccacgccgccuccucccccuccggcgcccuccgcgcccccucccccgccuccuucguccccacccccccccccuccucccacggcaucuccaucggccccggcgccuccuucgccuccccccacggcacccucgaccccuccucccccuacaccauggucucccccuccggccgcgccggcaacuggcccggcuccccccaggucuccggccccucccccgccgcccgcaugcccggcaugucccccgccaaccccucccuccacucccccguccccgacgccucccacuccccccgcgccggcaccuccucccagaccaugcccaccaacaugccccccccccgcaagcucccccagcgcuccugggccgccuccauccccaccauccucacccacuccgcccucaacauccuccuccuccccucccccacccccggccucguccccggccucgccggcuccuaccucugcuccccccucgagcgcuuccucggcuccgucaucaugcgccgccaccuccagcgcaucauccagcaggagacccuccagcucaucaacuccaacgagcccggcgucaucauguucaagaccgacgcccucaagugccgcgucgcccucucccccaagaccaaccagacccuccagcucaaggucacccccgagaacgccggccaguggaagcccgacgagcuccagguccucgagaaguucuucgagacccgcgucgccggcccccccuucaaggccaacacccucaucgccuucaccaagcuccucggcgcccccacccacauccuccgcgacugcguccacaucaugaagcucgagcucuuccccgaccaggccacccagcucaaguggaacguccaguucugccucaccaucccccccuccgccccccccaucgccccccccggcacccccgccgucguccucaaguccaagaugcucuucuuccuccagcucacccagaagaccuccguccccccccaggagcccgucuccaucaucguccccaucaucuacgacauggccuccggcaccacccagcaggccgacaucccccgccagcagaacuccuccgucgccgcccccaugauggucuccaacauccucaagcgcuucgccgagaugaaccccccccgccagggcgagugcaccaucuucgccgccguccgcgaccucauggccaaccucacccucccccccggcggccgccccuga

SEQ ID NO: 45878 - RNA, 2367 nt, Artificial Sequence
  derived and/or modified sequence opt2 from MED15__Homo_sapiens__NP_001003891
auggacgucuccggccaggagaccgacuggcgcuccaccgccuuccgccagaagcucgucucccagaucgaggacgccaugcgcaaggccggcgucgcccacuccaaguccuccaaggacauggagucccacgucuuccucaaggccaagacccgcgacgaguaccucucccucgucgcccgccucaucauccacuuccgcgacauccacaacaagaagucccaggccuccgucuccgaccccaugaacgcccuccagucccucaccggcggccccgccgccggcgccgccggcaucggcaugcccccccgcggccccggccagucccucggcggcaugggcucccucggcgccaugggccagcccaugucccucuccggccagcccccccccggcaccuccggcauggccccccacuccauggccgucgucuccaccgccaccccccagacccagcuccagcuccagcaggucgcccuccagcagcagcagcagcagcagcaguuccagcagcagcagcaggccgcccuccagcagcagcagcagcagcagcagcagcagcaguuccaggcccagcaguccgccaugcagcagcaguuccaggccgucguccagcagcagcagcagcuccagcagcagcagcagcagcagcagcaccucaucaagcuccaccaccagaaccagcagcagauccagcagcagcagcagcagcuccagcgcaucgcccagcuccagcuccagcagcagcagcagcagcagcagcagcagcagcagcagcagcagcaggcccuccaggcccagccccccauccagcagccccccaugcagcagccccagcccccccccucccaggcccucccccagcagcuccagcagaugcaccacacccagcaccaccagccccccccccagccccagcagccccccgucgcccagaaccagcccucccagcuccccccccagucccagacccagccccucgucucccaggcccaggcccuccccggccagaugcucuacacccagcccccccucaaguucguccgcgcccccauggucguccagcagccccccguccagccccagguccagcagcagcagaccgccguccagaccgcccaggccgcccagauggucgcccccggcguccagaugaucaccgaggcccucgcccagggcggcaugcacauccgcgcccgcuucccccccaccaccgccgucuccgccauccccuccuccuccaucccccucggccgccagcccauggcccaggucucccaguccucccuccccaugcucuccucccccucccccggccagcagguccagaccccccaguccaugcccccccccccccagcccuccccccagcccggccagcccuccucccagcccaacuccaacgucuccuccggccccgcccccucccccuccuccuuccuccccucccccuccccccagcccucccagucccccgucaccgcccgcaccccccagaacuucuccguccccucccccggcccccucaacacccccgucaaccccuccuccgucaugucccccgccggcuccucccaggccgaggagcagcaguaccucgacaagcucaagcagcucuccaaguacaucgagccccuccgccgcaugaucaacaagaucgacaagaacgaggaccgcaagaaggaccucuccaagaugaagucccuccucgacauccucaccgaccccuccaagcgcugcccccucaagacccuccagaagugcgagaucgcccucgagaagcucaagaacgacauggccguccccacccccccccccccccccgucccccccaccaagcagcaguaccucugccagccccuccucgacgccguccucgccaacauccgcucccccgucuucaaccacucccucuaccgcaccuucguccccgccaugaccgccauccacggcccccccaucaccgcccccgucgucugcacccgcaagcgccgccucgaggacgacgagcgccaguccauccccuccguccuccagggcgaggucgcccgccucgaccccaaguuccucgucaaccucgaccccucccacugcuccaacaacggcaccguccaccucaucugcaagcucgacgacaaggaccuccccuccguccccccccucgagcucuccguccccgccgacuaccccgcccaguccccccucuggaucgaccgccaguggcaguacgacgccaaccccuuccuccaguccguccaccgcugcaugaccucccgccuccuccagcuccccgacaagcacuccgucaccgcccuccucaacaccugggcccaguccguccaccaggccugccucuccgccgccuga

SEQ ID NO: 45879 - RNA, 2634 nt, Artificial Sequence
  derived and/or modified sequence opt2 from MED16__Homo_sapiens__NP_005472
augugcgaccuccgccgccccgccgccggcggcaugauggaccucgccuacgucugcgagugggagaagugguccaaguccacccacugccccuccgucccccucgccugcgccugguccugccgcaaccucaucgccuucaccauggaccuccgcuccgacgaccaggaccucacccgcaugauccacauccucgacaccgagcaccccugggaccuccacuccauccccuccgagcaccacgaggccaucaccugccucgagugggaccaguccggcucccgccuccucuccgccgacgccgacggccagaucaagugcugguccauggccgaccaccucgccaacuccugggaguccuccgucggcucccucgucgagggcgaccccaucgucgcccucuccuggcuccacaacggcgucaagcucgcccuccacgucgagaaguccggcgccuccuccuucggcgagaaguucucccgcgucaaguucucccccucccucacccucuucggcggcaagcccauggagggcuggaucgccgucaccgucuccggccucgucaccgucucccuccucaagcccuccggccagguccucaccuccaccgagucccucugccgccuccgcggccgcgucgcccucgccgacaucgccuucaccggcggcggcaacaucgucgucgccaccgccgacggcuccuccgccucccccguccaguucuacaaggucugcgucuccgucgucuccgagaagugccgcaucgacaccgagauccuccccucccucuucaugcgcugcaccaccgaccucaaccgcaaggacaaguuccccgccaucacccaccucaaguuccucgcccgcgacauguccgagcagguccuccucugcgccuccucccagaccuccuccaucgucgagugcuggucccuccgcaaggagggccuccccgucaacaacaucuuccagcagaucucccccgucgucggcgacaagcagcccaccauccucaaguggcgcauccucuccgccaccaacgaccucgaccgcgucuccgccgucgcccuccccaagcuccccaucucccucaccaacaccgaccucaaggucgccuccgacacccaguucuaccccggccucggccucgcccucgccuuccacgacggcuccguccacaucguccaccgccucucccuccagaccauggccgucuucuacuccuccgccgccccccgccccgucgacgagcccgccaugaagcgcccccgcaccgccggccccgccguccaccucaaggccaugcagcucuccuggaccucccucgcccucgucggcaucgacucccacggcaagcucuccguccuccgccucucccccuccaugggccacccccucgaggucggccucgcccuccgccaccuccucuuccuccucgaguacugcauggucaccggcuacgacuggugggacauccuccuccacguccagcccuccaugguccagucccucgucgagaagcuccacgaggaguacacccgccagaccgccgcccuccagcagguccucuccacccgcauccucgccaugaaggccucccucugcaagcucucccccugcaccgucacccgcgucugcgacuaccacaccaagcucuuccucaucgccaucuccuccacccucaagucccuccuccgcccccacuuccucaacacccccgacaagucccccggcgaccgccucaccgagaucugcaccaagaucaccgacgucgacaucgacaaggucaugaucaaccucaagaccgaggaguucguccucgacaugaacacccuccaggcccuccagcagcuccuccagugggucggcgacuucguccucuaccuccucgccucccuccccaaccagggcucccuccuccgccccggccacuccuuccuccgcgacggcaccucccucggcaugcuccgcgagcucauggucgucauccgcaucuggggccuccucaagcccuccugccuccccgucuacaccgccaccuccgacacccaggacuccaugucccuccucuuccgccuccucaccaagcucuggaucugcugccgcgacgagggccccgccuccgagcccgacgaggcccucgucgacgagugcugccuccuccccucccagcuccucauccccucccucgacuggcuccccgccuccgacggccucgucucccgccuccagcccaagcagccccuccgccuccaguucggccgcgcccccacccuccccggcuccgccgccacccuccagcucgacggccucgcccgcgcccccggccagcccaagaucgaccaccuccgccgccuccaccucggcgccugccccaccgaggagugcaaggccugcacccgcugcggcugcgucaccaugcucaagucccccaaccgcaccaccgccgucaagcagugggagcagcgcuggaucaagaacugccucgccgucgagggccgcggccccgacgccugcgucaccucccgcgccuccgaggaggcccccgccuucguccagcucggcccccaguccacccaccacuccccccgcaccccccgcucccucgaccaccuccaccccgaggaccgccccuga

SEQ ID NO: 45880 - RNA, 1956 nt, Artificial Sequence
  derived and/or modified sequence opt2 from MED17__Homo_sapiens__NP_004259
auguccggcguccgcgccguccgcaucuccaucgaguccgccugcgagaagcagguccacgaggucggccucgacggcaccgagaccuaccuccccccccucuccaugucccagaaccucgcccgccucgcccagcgcaucgacuucucccagggcuccggcuccgaggaggaggaggccgccggcaccgagggcgacgcccaggaguggcccggcgccggcuccuccgccgaccaggacgacgaggagggcgucgucaaguuccagcccucccucuggcccugggacuccguccgcaacaaccuccgcuccgcccucaccgagaugugcguccucuacgacguccucuccaucguccgcgacaagaaguucaugacccucgaccccgucucccaggacgcccucccccccaagcagaacccccagacccuccagcucaucuccaagaagaagucccucgccggcgccgcccagauccuccucaagggcgccgagcgccucaccaaguccgucaccgagaaccaggagaacaagcuccagcgcgacuucaacuccgagcuccuccgccuccgccagcacuggaagcuccgcaaggucggcgacaagauccucggcgaccucuccuaccgcuccgccggcucccucuucccccaccacggcaccuucgaggucaucaagaacaccgaccucgaccucgacaagaagauccccgaggacuacugcccccucgacguccagauccccuccgaccucgagggcuccgccuacaucaaggucuccauccagaagcaggcccccgacaucggcgaccucggcaccgucaaccucuucaagcgcccccuccccaaguccaagcccggcuccccccacuggcagaccaagcucgaggccgcccagaacguccuccucugcaaggagaucuucgcccagcucucccgcgaggccguccagaucaagucccaggucccccacaucgucgucaagaaccagaucaucucccagcccuuccccucccuccagcucuccaucucccucugccacuccuccaacgacaagaagucccagaaguucgccaccgagaagcagugccccgaggaccaccucuacguccucgagcacaaccuccaccuccucauccgcgaguuccacaagcagacccucuccuccaucaugaugccccaccccgccuccgcccccuucggccacaagcgcaugcgccucuccggcccccaggccuucgacaagaacgagaucaacucccuccaguccuccgagggccuccucgagaagaucaucaagcaggccaagcacaucuuccuccgcucccgcgccgccgccaccaucgacucccucgccucccgcaucgaggacccccagauccaggcccacugguccaacaucaacgacgucuacgaguccuccgucaagguccucaucaccucccagggcuacgagcagaucugcaaguccauccagcuccagcucaacaucggcgucgagcagauccgcgucguccaccgcgacggccgcgucaucacccucuccuaccaggagcaggagcuccaggacuuccuccucucccagaugucccagcaccagguccacgccguccagcagcucgccaaggucaugggcuggcagguccucuccuucuccaaccacgucggccucggccccaucgaguccaucggcaacgccuccgccaucaccgucgccucccccuccggcgacuacgccaucuccguccgcaacggccccgaguccggcuccaagaucaugguccaguucccccgcaaccagugcaaggaccuccccaaguccgacguccuccaggacaacaaguggucccaccuccgcggccccuucaaggagguccaguggaacaagauggagggccgcaacuucgucuacaagauggagcuccucauguccgcccucucccccugccuccucuga

SEQ ID NO: 45881 - RNA, 636 nt, Artificial Sequence
  derived and/or modified sequence opt2 from MED19__Homo_sapiens__NP_703151
augaagaucaccaacggccgccacggcgacuccgccggcgccgagggcaccauggagaacuucaccgcccucuucggcgcccaggccgaccccccccccccccccaccgcccucggcuucggccccggcaagccccccccccccccccccccccccgccggcggcggccccggcaccgcccccccccccaccgccgccaccgccccccccggcgccgacaaguccggcgccggcugcggccccuucuaccucaugcgcgagcuccccggcuccaccgagcucaccggcuccaccaaccucaucacccacuacaaccucgagcaggccuacaacaaguucugcggcaagaaggucaaggagaagcucuccaacuuccuccccgaccuccccggcaugaucgaccuccccggcucccacgacaacuccucccuccgcucccucaucgagaagccccccauccucuccuccuccuucaaccccaucaccggcaccaugcucgccggcuuccgccuccacaccggcccccuccccgagcagugccgccucaugcacauccagccccccaagaagaagaacaagcacaagcacaagcagucccgcacccaggaccccgucccccccggcaagcccuccuga

SEQ ID NO: 45882 - RNA, 4746 nt, Artificial Sequence
  derived and/or modified sequence opt2 from MED1__Homo_sapiens__NP_004765
augaaggcccagggcgagaccgaggaguccgagaagcucuccaagauguccucccuccucgagcgccuccacgccaaguucaaccagaaccgccccugguccgagaccaucaagcucguccgccaggucauggagaagcgcgucgucauguccuccggcggccaccagcaccucgucuccugccucgagacccuccagaaggcccucaaggucaccucccuccccgccaugaccgaccgccucgaguccaucgcccgccagaacggccucggcucccaccucuccgccuccggcaccgagugcuacaucaccuccgacauguucuacgucgagguccagcucgaccccgccggccagcucugcgacgucaaggucgcccaccacggcgagaaccccgucuccugccccgagcucguccagcagcuccgcgagaagaacuucgacgaguucuccaagcaccucaagggccucgucaaccucuacaaccuccccggcgacaacaagcucaagaccaagauguaccucgcccuccagucccucgagcaggaccucuccaagauggccaucauguacuggaaggccaccaacgccggcccccucgacaagauccuccacggcuccgucggcuaccucaccccccgcuccggcggccaccucaugaaccucaaguacuacgucucccccuccgaccuccucgacgacaagaccgccucccccaucauccuccacgagaacaacgucucccgcucccucggcaugaacgccuccgucaccaucgagggcaccuccgccgucuacaagcuccccaucgccccccucaucaugggcucccaccccgucgacaacaaguggacccccuccuucuccuccaucaccuccgccaacuccgucgaccuccccgccugcuucuuccucaaguucccccagcccauccccgucucccgcgccuucguccagaagcuccagaacugcaccggcaucccccucuucgagacccagcccaccuacgccccccucuacgagcucaucacccaguucgagcucuccaaggaccccgaccccaucccccucaaccacaacaugcgcuucuacgccgcccuccccggccagcagcacugcuacuuccucaacaaggacgccccccuccccgacggccgcucccuccagggcacccucgucuccaagaucaccuuccagcaccccggccgcgucccccucauccucaaccucauccgccaccaggucgccuacaacacccucaucggcuccugcgucaagcgcaccauccucaaggaggacucccccggccuccuccaguucgaggucugcccccucuccgagucccgcuucuccgucuccuuccagcaccccgucaacgacucccucgucugcgucgucauggacguccaggacuccacccacgucuccugcaagcucuacaagggccucuccgacgcccucaucugcaccgacgacuucaucgccaaggucguccagcgcugcauguccauccccgucaccaugcgcgccauccgccgcaaggccgagaccauccaggccgacacccccgcccucucccucaucgccgagaccgucgaggacauggucaagaagaaccucccccccgccuccucccccggcuacggcaugaccaccggcaacaaccccauguccggcaccaccacccccaccaacaccuuccccggcggccccaucaccacccucuucaacauguccauguccaucaaggaccgccacgaguccgucggccacggcgaggacuucuccaaggucucccagaaccccauccucaccucccuccuccagaucaccggcaacggcggcuccaccaucggcuccucccccacccccccccaccacacccccccccccgucuccuccauggccggcaacaccaagaaccaccccaugcucaugaaccuccucaaggacaaccccgcccaggacuucuccacccucuacggcuccuccccccucgagcgccagaacuccuccuccggcuccccccgcauggagaucugcuccggcuccaacaagaccaagaagaagaaguccucccgccucccccccgagaagcccaagcaccagaccgaggacgacuuccagcgcgagcucuucuccauggacgucgacucccagaaccccaucuucgacgucaacaugaccgccgacacccucgacaccccccacaucacccccgcccccucccagugcuccaccccccccaccaccuacccccagcccgucccccacccccagcccuccauccagcgcaugguccgccucuccuccuccgacuccaucggccccgacgucaccgacauccucuccgacaucgccgaggaggccuccaagcuccccuccaccuccgacgacugccccgccaucggcaccccccuccgcgacuccuccuccuccggccacucccaguccacccucuucgacuccgacgucuuccagaccaacaacaacgagaaccccuacaccgaccccgccgaccucaucgccgacgccgccggcucccccuccuccgacucccccaccaaccacuucuuccacgacggcgucgacuucaaccccgaccuccucaacucccagucccaguccggcuucggcgaggaguacuucgacgaguccucccaguccggcgacaacgacgacuucaagggcuucgccucccaggcccucaacacccucggcguccccaugcucggcggcgacaacggcgagaccaaguucaagggcaacaaccaggccgacaccgucgacuucuccaucaucuccgucgccggcaaggcccucgcccccgccgaccucauggagcaccacuccggcucccagggcccccuccucaccaccggcgaccucggcaaggagaagacccagaagcgcgucaaggagggcaacggcaccuccaacuccacccucuccggccccggccucgacuccaagcccggcaagcgcucccgcacccccuccaacgacggcaaguccaaggacaagccccccaagcgcaagaaggccgacaccgagggcaagucccccucccacuccuccuccaaccgccccuucaccccccccaccuccaccggcggcuccaagucccccggcuccgccggccgcucccagaccccccccggcgucgccaccccccccauccccaagaucaccauccagauccccaagggcaccgucauggucggcaagcccuccucccacucccaguacaccuccuccggcuccgucuccuccuccggcuccaagucccaccacucccacuccuccuccuccuccuccuccgccuccaccuccggcaagaugaaguccuccaaguccgagggcuccuccuccuccaagcucuccuccuccauguacuccucccagggcuccuccggcuccucccaguccaagaacuccucccaguccggcggcaagcccggcuccucccccaucaccaagcacggccucuccuccggcuccuccuccaccaagaugaagccccagggcaagcccuccucccucaugaaccccucccucuccaagcccaacaucucccccucccacucccgcccccccggcggcuccgacaagcucgccucccccaugaagcccguccccggcaccccccccuccuccaaggccaagucccccaucuccuccggcuccggcggcucccacauguccggcaccuccuccuccuccggcaugaaguccuccuccggccucggcuccuccggcucccucucccagaagaccccccccuccuccaacuccugcaccgccuccuccuccuccuucuccuccuccggcuccuccauguccuccucccagaaccagcacggcuccuccaagggcaagucccccucccgcaacaagaagcccucccucaccgccgucaucgacaagcucaagcacggcgucgucaccuccggccccggcggcgaggacccccucgacggccagaugggcgucuccaccaacuccuccucccaccccauguccuccaagcacaacauguccggcggcgaguuccagggcaagcgcgagaaguccgacaaggacaaguccaaggucuccaccuccggcuccuccgucgacuccuccaagaagaccuccgaguccaagaacgucggcuccaccggcgucgccaagaucaucaucuccaagcacgacggcggcucccccuccaucaaggccaaggucacccuccagaagcccggcgaguccuccggcgagggccuccgcccccagauggccuccuccaagaacuacggcuccccccucaucuccggcuccacccccaagcacgagcgcggcucccccucccacuccaagucccccgccuacaccccccagaaccucgacuccgaguccgaguccggcuccuccaucgccgagaaguccuaccagaacucccccuccuccgacgacggcauccgcccccuccccgaguacuccaccgagaagcacaagaagcacaagaaggagaagaagaaggucaaggacaaggaccgcgaccgcgaccgcgacaaggaccgcgacaagaagaagucccacuccaucaagcccgaguccugguccaagucccccaucuccuccgaccagucccucuccaugaccuccaacaccauccucuccgccgaccgccccucccgccucucccccgacuucaugaucggcgaggaggacgacgaccucauggacgucgcccucaucggcaacuga

SEQ ID NO: 45883 - RNA, 603 nt, Artificial Sequence
  derived and/or modified sequence opt2 from MED22__Homo_sapiens__NP_598395
auggcccagcagcgcgcccucccccaguccaaggagacccuccuccaguccuacaacaagcgccucaaggacgacaucaaguccaucauggacaacuucaccgagaucaucaagaccgccaagaucgaggacgagacccaggucucccgcgccacccagggcgagcaggacaacuacgagaugcacguccgcgccgccaacaucguccgcgccggcgagucccucaugaagcucgucuccgaccucaagcaguuccucauccucaacgacuuccccuccgucaacgaggccaucgaccagcgcaaccagcagcuccgcacccuccaggaggagugcgaccgcaagcucaucacccuccgcgacgagaucuccaucgaccucuacgagcucgaggaggaguacuacuccuccuccuccucccucugcgaggccaacgaccucccccucugcgaggccuacggccgccucgaccucgacaccgacuccgccgacggccucuccgccccccuccucgccucccccgagcccuccgccggcccccuccaggucgccgcccccgcccacucccacgccggcggccccggccccaccgagcacgccuga

SEQ ID NO: 45884 - RNA, 4095 nt, Artificial Sequence
  derived and/or modified sequence opt2 from MED23__Homo_sapiens__NP_001257451
auggagacccagcuccaguccaucuucgaggaggucgucaagaccgaggucaucgaggaggccuuccccggcauguucauggacacccccgaggacgagaagaccaagcucaucuccugccucggcgccuuccgccaguucuggggcggccucucccaggagucccacgagcagugcauccaguggaucgucaaguucauccacggccagcacucccccaagcgcaucuccuuccucuacgacugccucgccauggccgucgagaccggccuccuccccccccgccucgucugcgagucccucaucaacuccgacacccucgagugggagcgcacccagcucugggcccucaccuucaagcucguccgcaagaucaucggcggcgucgacuacaagggcguccgcgaccuccucaaggucauccucgagaagauccucaccauccccaacaccgucuccuccgccgucguccagcagcuccucgccgcccgcgaggucaucgccuacauccucgagcgcaacgccugccuccuccccgccuacuucgccgucaccgagauccgcaagcucuaccccgagggcaagcucccccacuggcuccucggcaaccucgucuccgacuucgucgacaccuuccgccccaccgcccgcaucaacuccaucugcggccgcugcucccuccuccccgucgucaacaacuccggcgccaucugcaacuccuggaagcucgaccccgccacccuccgcuucccccucaagggccuccuccccuacgacaaggaccucuucgagccccagaccgcccuccuccgcuacguccucgagcagcccuacucccgcgacauggucugcaacaugcucggccucaacaagcagcacaagcagcgcugccccguccucgaggaccagcucgucgaccucgucgucuacgccauggagcgcuccgagaccgaggagaaguucgacgacggcggcaccucccagcuccucuggcagcaccucuccucccagcucaucuucuucguccucuuccaguucgccuccuucccccacaugguccucucccuccaccagaagcucgccggccgcggccucaucaagggccgcgaccaccucauguggguccuccuccaguucaucuccggcuccauccagaagaacgcccucgccgacuuccuccccgucaugaagcucuucgaccuccucuaccccgagaaggaguacauccccguccccgacaucaacaagccccaguccacccacgccuucgccaugaccugcaucuggauccaccucaaccgcaaggcccagaacgacaacuccaagcuccagauccccaucccccacucccuccgccuccaccacgaguuccuccagcagucccuccgcaacaagucccuccagaugaacgacuacaagaucgcccuccucugcaacgccuacuccaccaacuccgagugcuucacccuccccaugggcgcccucgucgagaccaucuacggcaacggcaucaugcgcaucccccuccccggcaccaacugcauggccuccggcuccaucaccccccuccccaugaaccuccucgacucccucaccguccacgccaagaugucccucauccacuccaucgccacccgcgucaucaagcucgcccacgccaaguccuccgucgcccucgcccccgcccucgucgagaccuacucccgccuccucgucuacauggagaucgagucccucggcaucaagggcuucaucucccagcuccuccccaccgucuucaagucccacgccuggggcauccuccacacccuccucgagauguucuccuaccgcaugcaccacauccagccccacuaccgcguccagcuccucucccaccuccacacccucgccgccgucgcccagaccaaccagaaccagcuccaccucugcgucgaguccaccgcccuccgccucaucaccgcccucggcuccuccgagguccagccccaguucacccgcuuccucuccgaccccaagaccguccucuccgccgaguccgaggagcucaaccgcgcccucauccucacccucgcccgcgccacccacgucaccgacuucuucaccggcuccgacuccauccagggcaccuggugcaaggacauccuccagaccaucauguccuucaccccccacaacugggccucccacacccucuccugcuuccccggcccccuccaggccuucuucaagcagaacaacgucccccaggagucccgcuucaaccucaagaagaacgucgaggaggaguaccgcaaguggaaguccauguccaacgagaacgacaucaucacccacuucuccaugcagggcucccccccccucuuccucugccuccucuggaagaugcuccucgagaccgaccacaucaaccagaucggcuaccgcguccucgagcgcaucggcgcccgcgcccucgucgcccacguccgcaccuucgccgacuuccucgucuacgaguucuccaccuccgccggcggccagcagcucaacaagugcaucgagauccucaacgacauggucuggaaguacaacaucgucacccucgaccgccucauccucugccucgccaugcgcucccacgagggcaacgaggcccaggucugcuacuucaucauccagcuccuccuccucaagcccaacgacuuccgcaaccgcgucuccgacuucgucaaggagaacucccccgagcacuggcuccagaacgacuggcacaccaagcacaugaacuaccacaagaaguaccccgagaagcucuacuucgagggccucgccgagcaggucgacccccccguccagauccagucccccuaccuccccaucuacuucggcaacgucugccuccgcuuccuccccgucuucgacaucgucauccaccgcuuccucgagcuccuccccgucuccaagucccucgagacccuccucgaccaccucggcggccucuacaaguuccacgaccgccccgucaccuaccucuacaacacccuccacuacuacgagaugcaccuccgcgaccgcgccuuccucaagcgcaagcucguccacgccaucaucggcucccucaaggacaaccgcccccagggcuggugccucuccgacaccuaccucaagugcgccaugaacgcccgcgaggagaaccccuggguccccgacgacaccuacuacugccgccucaucggccgccucgucgacaccauggccggcaagucccccggccccuuccccaacugcgacuggcgcuucaacgaguuccccaaccccgccgcccacgcccuccacgucaccugcgucgagcucauggcccucgccgucuccggcaaggaggucggcaacgcccuccucaacgucguccucaagucccagccccucgucccccgcgagaacaucaccgccuggaugaacgccaucggccucaucaucaccgcccuccccgagcccuacuggaucguccuccacgaccgcaucgucuccgucaucuccucccccucccucaccuccgagaccgagugggucggcuaccccuuccgccucuucgacuucaccgccugccaccaguccuacuccgagauguccugcuccuacacccucgcccucgcccacgccgucuggcaccacuccuccaucggccagcucucccucauccccaaguuccucaccgagguccuccuccccaucgucaagaccgaguuccagcuccucuacgucuaccaccucgucggccccuuccuccagcgcuuccagcaggagcgcacccgcugcaugaucgagaucggcgucgccuucuacgacaugcuccucaacgucgaccagugcuccacccaccucaacuacauggaccccaucugcgacuuccucuaccacaugaaguacauguucaccggcgacuccgucaaggagcaggucgagaagaucaucugcaaccucaagcccgcccucaagcuccgccuccgcuucaucacccacaucuccaagauggagcccgccgccguccccccccaggccaugaacuccggcucccccgccccccaguccaaccaggucgacacccucaccuga

SEQ ID NO: 45885 - RNA, 2931 nt, Artificial Sequence
  derived and/or modified sequence opt2 from MED24__Homo_sapiens__NP_001072986
augaaggucgucaaccucaagcaggccauccuccaggccuggaaggagcgcugguccgacuaccagugggccaucaacaugaagaaguucuuccccaagggcgccaccugggacauccucaaccucgccgacgcccuccucgagcaggccaugaucggccccucccccaacccccucauccucuccuaccucaaguacgccaucuccucccaguucgacgacuucucccgcgaccucugcguccaggcccuccucgacaucauggacauguucugcgaccgccucuccugccacggcaaggccgaggagugcaucggccucugccgcgcccuccucuccgcccuccacuggcuccuccgcugcaccgccgccuccgccgagcgccuccgcgagggccucgaggccggcacccccgccgccggcgagaagcagcucgccaugugccuccagcgccucgagaagacccucuccuccaccaagaaccgcgcccuccuccacaucgccaagcucgaggaggccuccuccuggaccgccaucgagcacucccuccucaagcucggcgagauccucgccaaccucuccaacccccagcuccgcucccaggccgagcagugcggcacccucauccgcuccauccccaccaugcucuccguccacgccgagcagaugcacaagaccggcuuccccaccguccacgccgucauccuccucgagggcaccaugaaccucaccggcgagacccagucccucgucgagcagcucaccauggucaagcgcaugcagcacauccccaccccccucuucguccucgagaucuggaaggccugcuucgucggccucaucgagucccccgagggcaccgaggagcucaaguggaccgccuucaccuuccucaagaucccccagguccucgucaagcucaagaaguacucccacggcgacaaggacuucaccgaggacgucaacugcgccuucgaguuccuccucaagcucaccccccuccucgacaaggccgaccagcgcugcaacugcgacugcaccaacuuccuccuccaggagugcggcaagcagggccuccucuccgaggccuccgucaacaaccucauggccaagcgcaaggccgaccgcgagcacgccccccagcagaaguccggcgagaacgccaacauccagcccaacauccagcucauccuccgcgccgagcccaccgucaccaacauccucaagaccauggacgccgaccacuccaagucccccgagggccuccucggcguccucggccacaugcucuccggcaagucccucgaccuccuccucgccgccgccgccgccaccggcaagcucaaguccuucgcccgcaaguucaucaaccucaacgaguucaccaccuacggcuccgaggaguccaccaagcccgccuccguccgcgcccuccucuucgacaucuccuuccucaugcucugccacgucgcccagaccuacggcuccgaggucauccucuccgagucccgcaccggcgccgagguccccuucuucgagaccuggaugcagaccugcaugcccgaggagggcaagauccucaaccccgaccaccccugcuuccgccccgacuccaccaaggucgagucccucgucgcccuccucaacaacuccuccgagaugaagcucguccagaugaaguggcacgaggccugccucuccaucuccgccgccauccucgagauccucaacgccugggagaacggcguccucgccuucgaguccauccagaagaucaccgacaacaucaagggcaaggucugcucccucgccgucugcgccgucgccuggcucgucgcccacguccgcaugcucggccucgacgagcgcgagaagucccuccagaugauccgccagcucgccggcccccucuucuccgagaacacccuccaguucuacaacgagcgcgucgucaucaugaacuccauccucgagcgcaugugcgccgacguccuccagcagaccgccacccagaucaaguuccccuccaccggcgucgacaccaugcccuacuggaaccuccucccccccaagcgccccaucaaggagguccucaccgacaucuucgccaagguccucgagaagggcugggucgacucccgcuccauccacaucuucgacacccuccuccacaugggcggcgucuacugguucugcaacaaccucaucaaggagcuccucaaggagacccgcaaggagcacacccuccgcgccgucgagcuccucuacuccaucuucugccucgacaugcagcaggucacccucguccuccucggccacauccuccccggccuccucaccgacuccuccaaguggcacucccucauggacccccccggcaccgcccucgccaagcucgccgucuggugcgcccucuccuccuacuccucccacaagggccaggccuccacccgccagaagaagcgccaccgcgaggacaucgaggacuacaucucccucuucccccucgacgacguccagcccuccaagcucaugcgccuccucuccuccaacgaggacgacgccaacauccucuccucccccaccgaccgcuccauguccuccucccucuccgccucccagcuccacaccgucaacaugcgcgacccccucaaccgcguccucgccaaccucuuccuccucaucuccuccauccucggcucccgcaccgccggcccccacacccaguucguccagugguucauggaggagugcgucgacugccucgagcagggcggccgcggcuccguccuccaguucaugcccuucaccaccgucuccgagcucgucaaggucuccgccauguccucccccaaggucguccucgccaucaccgaccucucccucccccucggccgccaggucgccgccaaggccaucgccgcccucuga

SEQ ID NO: 45886 - RNA, 2244 nt, Artificial Sequence
  derived and/or modified sequence opt2 from MED25__Homo_sapiens__NP_112235
augguccccggcuccgagggccccgcccgcgccggcuccgucgucgccgacgucgucuucgucaucgagggcaccgccaaccucggccccuacuucgagggccuccgcaagcacuaccuccuccccgccaucgaguacuucaacggcggcccccccgccgagaccgacuucggcggcgacuacggcggcacccaguacucccucgucgucuucaacaccgucgacugcgcccccgaguccuacguccagugccacgcccccaccuccuccgccuacgaguucgucaccuggcucgacggcaucaaguucaugggcggcggcggcgaguccugcucccucaucgccgagggccucuccaccgcccuccagcucuucgacgacuucaagaagaugcgcgagcagaucggccagacccaccgcgucugccuccucaucugcaacuccccccccuaccuccuccccgccgucgaguccaccaccuacuccggcugcaccaccgagaaccucguccagcagaucggcgagcgcggcauccacuucuccaucgucuccccccgcaagcuccccgcccuccgccuccucuucgagaaggccgccccccccgcccuccucgagccccuccagccccccaccgacgucucccaggacccccgccacaugguccucguccgcggccucguccuccccgucggcggcggcuccgcccccggcccccuccaguccaagcagcccgucccccucccccccgccgcccccuccggcgccacccucuccgccgccccccagcagccccucccccccguccccccccaguaccagguccccggcaaccucuccgccgcccaggucgccgcccagaacgccgucgaggccgccaagaaccagaaggccggccucggcccccgcuucucccccaucaccccccuccagcaggccgcccccggcgucggcccccccuucucccaggcccccgccccccagcucccccccggcccccccggcgcccccaagcccccccccgccucccagcccucccucgucuccaccgucgcccccggcuccggccucgcccccaccgcccagcccggcgcccccuccauggccggcaccgucgcccccggcggcgucuccggccccucccccgcccagcucggcgcccccgcccucggcggccagcaguccgucuccaacaagcuccucgccugguccggcguccucgaguggcaggagaagcccaagcccgccuccgucgacgccaacaccaagcucacccgcucccuccccugccaggucuacgucaaccacggcgagaaccucaagaccgagcaguggccccagaagcucaucaugcagcucaucccccagcagcuccucaccacccucggcccccucuuccgcaacucccgcaugguccaguuccacuucaccaacaaggaccucgagucccucaagggccucuaccgcaucaugggcaacggcuucgccggcugcguccacuucccccacaccgcccccugcgagguccgcguccucaugcuccucuacuccuccaagaagaagaucuucaugggccucauccccuacgaccaguccggcuucgucaacggcauccgccaggucaucaccaaccacaagcagguccagcagcagaagcucgagcagcagcagcgcggcaugggcggccagcaggccccccccggccucggccccauccucgaggaccaggcccgccccucccagaaccuccuccagcuccgccccccccagccccagccccagggcaccgucggcgccuccggcgccaccggccagccccagccccagggcaccgcccagcccccccccggcgccccccagggcccccccggcgccgccuccggcccccccccccccggccccauccuccgcccccagaaccccggcgccaacccccagcuccgcucccuccuccucaaccccccccccccccagaccggcgucccccccccccaggccucccuccaccaccuccagccccccggcgcccccgcccuccucccccccccccaccagggccucggccagccccagcucggccccccccuccuccaccccccccccgcccaguccuggcccgcccagcuccccccccgcgccccccuccccggccagaugcuccucuccggcggcccccgcggccccgucccccagcccggccuccagcccuccgucauggaggacgacauccucauggaccucaucuga

SEQ ID NO: 45887 - RNA, 537 nt, Artificial Sequence
  derived and/or modified sequence opt2 from MED28__Homo_sapiens__NP_079481
auggccgccccccucggcggcauguucuccggccagccccccggccccccccaggccccccccggccuccccggccaggccucccuccuccaggccgcccccggcgccccccgccccuccuccuccacccucgucgacgagcucgaguccuccuucgaggccugcuucgccucccucgucucccaggacuacgucaacggcaccgaccaggaggagauccgcaccggcgucgaccagugcauccagaaguuccucgacaucgcccgccagaccgagugcuucuuccuccagaagcgccuccagcucuccguccagaagcccgagcaggucaucaaggaggacgucuccgagcuccgcaacgagcuccagcgcaaggacgcccucguccagaagcaccucaccaagcuccgccacuggcagcagguccucgaggacaucaacguccagcacaagaagcccgccgacaucccccagggcucccucgccuaccucgagcaggccuccgccaacauccccgccccccucaagcccaccuga

SEQ ID NO: 45888 - RNA, 666 nt, Artificial Sequence
  derived and/or modified sequence opt2 from MED29__Homo_sapiens__NP_060062
augcucaaguccaacggcgagcgccgcucccgcaacgcccuccccgccgucuacgcccgcaagauggccgccucccagcagcaggccuccgccgccuccuccgccgccggcgucuccggccccuccuccgccggcggccccggcccccagcagcagccccagccccccgcccagcucgucggccccgcccaguccggccuccuccagcagcagcagcaggacuucgaccccguccagcgcuacaagaugcucaucccccagcucaaggagucccuccagacccucaugaaggucgccgcccagaaccucauccagaacaccaacaucgacaacggccagaaguccuccgacggccccauccagcgcuucgacaagugccucgaggaguucuacgcccucugcgaccagcucgagcucugccuccgccucgcccacgagugccucucccaguccugcgacuccgccaagcacucccccacccucguccccaccgccaccaagcccgacgccguccagcccgacucccuccccuacccccaguaccucgccgucaucaaggcccagaucuccugcgccaaggacauccacaccgcccuccucgacugcgccaacaaggucaccggcaagacccccgccccccccgccggccccggcggcacccucuga

SEQ ID NO: 45889 - RNA, 537 nt, Artificial Sequence
  derived and/or modified sequence opt2 from MED30__Homo_sapiens__NP_542382
auguccacccccccccucgccgccuccggcauggcccccggccccuucgccggcccccaggcccagcaggccgcccgcgaggucaacaccgccucccucugccgcaucggccaggagaccguccaggacaucgucuaccgcaccauggagaucuuccagcuccuccgcaacaugcagcuccccaacggcgucaccuaccacaccggcaccuaccaggaccgccucaccaagcuccaggacaaccuccgccagcucuccguccucuuccgcaagcuccgccucgucuacgacaagugcaacgagaacugcggcggcauggaccccauccccgucgagcagcucauccccuacgucgaggaggacggcuccaagaacgacgaccgcgccggccccccccgcuucgccuccgaggagcgccgcgagaucgccgaggucaacaagaagcucaagcagaagaaccagcagcucaagcagaucauggaccagcuccgcaaccucaucugggacaucaacgccaugcucgccaugcgcaacuga

SEQ ID NO: 45890 - RNA, 675 nt, Artificial Sequence
  derived and/or modified sequence opt2 from MED4__Homo_sapiens__NP_001257558
augcucgccaucucccgcaaccagaagcuccuccaggccggcgaggagaaccagguccucgagcuccucauccaccgcgacggcgaguuccaggagcucaugaagcucgcccucaaccagggcaagauccaccacgagaugcagguccucgagaaggaggucgagaagcgcgacuccgacauccagcagcuccagaagcagcucaaggaggccgagcagauccucgccaccgccgucuaccaggccaaggagaagcucaaguccaucgagaaggcccgcaagggcgccaucuccuccgaggagaucaucaaguacgcccaccgcaucuccgccuccaacgccgucugcgccccccucaccuggguccccggcgacccccgccgccccuaccccaccgaccucgagaugcgcuccggccuccucggccagaugaacaaccccuccaccaacggcgucaacggccaccuccccggcgacgcccucgccgccggccgccuccccgacguccucgccccccaguaccccuggcaguccaacgacauguccaugaacaugcucccccccaaccacuccuccgacuuccuccucgagccccccggccacaacaaggagaacgaggacgacgucgagaucauguccaccgacuccuccuccuccuccuccgaguccgacuga

SEQ ID NO: 45891 - RNA, 762 nt, Artificial Sequence
  derived and/or modified sequence opt2 from MED6__Homo_sapiens__NP_001271138
auggccgccgucgacauccgcgacaaccuccucggcaucuccugggucgacuccuccuggauccccauccucaacuccggcuccguccucgacuacuucuccgagcgcuccaaccccuucuacgaccgcaccugcaacaacgaggucgucaagaugcagcgccucacccucgagcaccucaaccagauggucggcaucgaguacauccuccuccacgcccaggagcccauccucuucaucauccgcaagcagcagcgccagucccccgcccaggucaucccccucgccgacuacuacaucaucgccggcgucaucuaccaggcccccgaccucggcuccgucaucaacucccgcgucucccucuucuccuucuacaagcucaccgccguccacggcauccaguccgccuucgacgaggccauguccuacugccgcuaccaccccuccaagggcuacugguggcacuucaaggaccacgaggagcaggacaagguccgccccaaggccaagcgcaaggaggagcccuccuccaucuuccagcgccagcgcgucgacgcccuccuccucgaccuccgccagaaguucccccccaaguucguccagcucaagcccggcgagaagcccguccccgucgaccagaccaagaaggaggccgagcccauccccgagaccgucaagcccgaggagaaggagaccaccaagaacguccagcagaccgucuccgccaagggcccccccgagaagcgcaugcgccuccaguga

SEQ ID NO: 45892 - RNA, 441 nt, Artificial Sequence
  derived and/or modified sequence opt2 from MED9__Homo_sapiens__NP_060489
auggccuccgccggcgucgccgccggccgccaggccgaggacguccucccccccaccuccgaccagccccuccccgacaccaagccccucccccccccccagcccccccccguccccgccccccagccccagcagucccccgccccccgcccccagucccccgcccgcgcccgcgaggaggagaacuacuccuuccucccccucguccacaacaucaucaagugcauggacaaggacucccccgagguccaccaggaccucaacgcccucaaguccaaguuccaggagaugcgcaagcucaucuccaccaugcccggcauccaccucucccccgagcagcagcagcagcagcuccagucccuccgcgagcagguccgcaccaagaacgagcuccuccagaaguacaagucccucugcauguucgagauccccaaggaguga

SEQ ID NO: 45893 - RNA, 1500 nt, Artificial Sequence
  derived and/or modified sequence opt2 from MEF2A__Homo_sapiens__NP_005578
augggccgcaagaagauccagaucacccgcaucauggacgagcgcaaccgccaggucaccuucaccaagcgcaaguucggccucaugaagaaggccuacgagcucuccguccucugcgacugcgagaucgcccucaucaucuucaacuccuccaacaagcucuuccaguacgccuccaccgacauggacaagguccuccucaaguacaccgaguacaacgagccccacgagucccgcaccaacuccgacaucgucgaggcccucaacaagaaggagcaccgcggcugcgacucccccgaccccgacaccuccuacguccucaccccccacaccgaggagaaguacaagaagaucaacgaggaguucgacaacaugaugcgcaaccacaagaucgcccccggccuccccccccagaacuucuccauguccgucaccguccccgucaccucccccaacgcccucuccuacaccaaccccggcuccucccucgucucccccucccucgccgccuccuccacccucaccgacuccuccaugcucucccccccccagaccacccuccaccgcaacgucucccccggcgccccccagcgcccccccuccaccggcaacgccggcggcaugcucuccaccaccgaccucaccguccccaacggcgccggcuccucccccgucggcaacggcuucgucaacucccgcgccucccccaaccucaucggcgccaccggcgccaacucccucggcaaggucaugcccaccaaguccccccccccccccggcggcggcaaccucggcaugaacucccgcaagcccgaccuccgcgucgucaucccccccuccuccaagggcaugaugcccccccucaacacccagcgcaucuccuccucccaggccacccagccccucgccacccccgucgucuccgucaccacccccucccuccccccccagggccucgucuacuccgccaugcccaccgccuacaacaccgacuacucccucaccuccgccgaccucuccgcccuccagggcuucaacucccccggcaugcucucccucggccaggucuccgccuggcagcagcaccaccucggccaggccgcccucuccucccucgucgccggcggccagcucucccagggcuccaaccucuccaucaacaccaaccagaacaucuccaucaaguccgagcccaucucccccccccgcgaccgcaugacccccuccggcuuccagcagcagcagcagcagcagcagcagcagcagccccccccccccccccagccccagccccagcccccccagccccagccccgccaggagaugggccgcucccccgucgacucccucuccuccuccuccuccuccuacgacggcuccgaccgcgaggacccccgcggcgacuuccacucccccaucguccucggccgcccccccaacaccgaggaccgcgagucccccuccgucaagcgcaugcgcauggacgccugggucaccuga

SEQ ID NO: 45894 - RNA, 1107 nt, Artificial Sequence
  derived and/or modified sequence opt2 from MEF2B__Homo_sapiens__NP_001139257
augggccgcaagaagauccagaucucccgcauccucgaccagcgcaaccgccaggucaccuucaccaagcgcaaguucggccucaugaagaaggccuacgagcucuccguccucugcgacugcgagaucgcccucaucaucuucaacuccgccaaccgccucuuccaguacgccuccaccgacauggaccgcguccuccucaaguacaccgaguacuccgagccccacgagucccgcaccaacaccgacauccucgagacccucaagcgccgcggcaucggccucgacggccccgagcucgagcccgacgagggccccgaggagcccggcgagaaguuccgccgccucgccggcgagggcggcgaccccgcccucccccgcccccgccucuaccccgccgcccccgccaugcccucccccgacgucgucuacggcgcccuccccccccccggcugcgaccccuccggccucggcgaggcccuccccgcccagucccgccccucccccuuccgccccgccgcccccaaggccggcccccccggccucguccacccccucuucucccccucccaccucaccuccaagaccccccccccccucuaccuccccaccgagggccgccgcuccgaccuccccggcggccucgccggcccccgcggcggccucaacaccucccgcucccucuacuccggccuccagaaccccugcuccaccgccacccccggccccccccucggcuccuuccccuuccuccccggcggcccccccgaguacggccucggcgaccccccccccccccccggccuccuccagccccccacccucgcccccuggcagcccucccgcggcgacggcccccccgccgucuccucccagcccuccggcggccgcucccucggcgaggagggcccccccacccgcggcgccuccccccccaccccccccgucuccaucaaguccgagcgccucucccccgcccccggcggccccggcgacuuccccaagaccuuccccuacccccuccuccucgcccgcucccucgccgagccccuccgccccggccccgcccuccgccgccucccccucgccgacggcuggccccgcuga

SEQ ID NO: 45895 - RNA, 1098 nt, Artificial Sequence
  derived and/or modified sequence opt2 from MEF2BNB-MEF2B__Homo_sapiens__NP_005910
augggccgcaagaagauccagaucucccgcauccucgaccagcgcaaccgccaggucaccuucaccaagcgcaaguucggccucaugaagaaggccuacgagcucuccguccucugcgacugcgagaucgcccucaucaucuucaacuccgccaaccgccucuuccaguacgccuccaccgacauggaccgcguccuccucaaguacaccgaguacuccgagccccacgagucccgcaccaacaccgacauccucgagacccucaagcgccgcggcaucggccucgacggccccgagcucgagcccgacgagggccccgaggagcccggcgagaaguuccgccgccucgccggcgagggcggcgaccccgcccucccccgcccccgccucuaccccgccgcccccgccaugcccucccccgacgucgucuacggcgcccuccccccccccggcugcgaccccuccggccucggcgaggcccuccccgcccagucccgccccucccccuuccgccccgccgcccccaaggccggcccccccggccucguccacccccucuucucccccucccaccucaccuccaagaccccccccccccucuaccuccccaccgagggccgccgcuccgaccuccccggcggccucgccggcccccgcggcggccucaacaccucccgcucccucuacuccggccuccagaaccccugcuccaccgccacccccggccccccccucggcuccuuccccuuccuccccggcggcccccccgucggcgccgaggccugggcccgccgcgucccccagcccgccgcccccccccgccgccccccccaguccgccuccucccucuccgccucccuccgcccccccggcgcccccgccaccuuccuccgccccucccccauccccugcuccucccccggccccuggcagucccucugcggccucggcccccccugcgccggcugccccuggcccaccgccggccccggccgccgcucccccggcggcaccucccccgagcgcucccccggcaccgcccgcgcccgcggcgaccccaccucccuccaggccuccuccgagaagacccagcaguga

SEQ ID NO: 45896 - RNA, 1392 nt, Artificial Sequence
  derived and/or modified sequence opt2 from MEF2C__Homo_sapiens__NP_001124477
augggccgcaagaagauccagaucacccgcaucauggacgagcgcaaccgccaggucaccuucaccaagcgcaaguucggccucaugaagaaggccuacgagcucuccguccucugcgacugcgagaucgcccucaucaucuucaacuccaccaacaagcucuuccaguacgccuccaccgacauggacaagguccuccucaaguacaccgaguacaacgagccccacgagucccgcaccaacuccgacaucgucgaggcccucaacaagaaggagaacaagggcugcgagucccccgaccccgacuccuccuacgcccucaccccccgcaccgaggagaaguacaagaagaucaacgaggaguucgacaacaugaucaagucccacaagauccccgccguccccccccccaacuucgagaugcccgucuccauccccgucuccucccacaacucccucgucuacuccaaccccgucuccucccucggcaaccccaaccuccucccccucgcccaccccucccuccagcgcaacuccaugucccccggcgucacccaccgcccccccuccgccggcaacaccggcggccucaugggcggcgaccucaccuccggcgccggcaccuccgccggcaacggcuacggcaacccccgcaacucccccggccuccucgucucccccggcaaccucaacaagaacaugcaggccaagucccccccccccaugaaccucggcaugaacaaccgcaagcccgaccuccgcguccucaucccccccggcuccaagaacaccaugcccuccgucaaccagcgcaucaacaacucccaguccgcccagucccucgccacccccgucgucuccgucgccacccccacccuccccggccagggcaugggcggcuaccccuccgccaucuccaccaccuacggcaccgaguacucccucuccuccgccgaccucuccucccucuccggcuucaacaccgccuccgcccuccaccucggcuccgucaccggcuggcagcagcagcaccuccacaacaugccccccuccgcccucucccagcucggcgccugcaccuccacccaccucucccaguccuccaaccucucccuccccuccacccagucccucaacaucaaguccgagcccgucucccccccccgcgaccgcaccaccacccccucccgcuacccccagcacacccgccacgaggccggccgcucccccgucgacucccucuccuccugcuccuccuccuacgacggcuccgaccgcgaggaccaccgcaacgaguuccacucccccaucggccucacccgccccucccccgacgagcgcgagucccccuccgucaagcgcaugcgccucuccgagggcugggccaccuga

SEQ ID NO: 45897 - RNA, 1566 nt, Artificial Sequence
  derived and/or modified sequence opt2 from MEF2D__Homo_sapiens__XP_005245226
augggccgcaagaagauccagauccagcgcaucaccgacgagcgcaaccgccaggucaccuucaccaagcgcaaguucggccucaugaagaaggccuacgagcucuccguccucugcgacugcgagaucgcccucaucaucuucaaccacuccaacaagcucuuccaguacgccuccaccgacauggacaagguccuccucaaguacaccgaguacaacgagccccacgagucccgcaccaacgccgacaucaucgagacccuccgcaagaagggcuucaacggcugcgacucccccgagcccgacggcgaggacucccucgagcaguccccccuccucgaggacaaguaccgccgcgccuccgaggagcucgacggccucuuccgccgcuacggcuccaccguccccgcccccaacuucgccaugcccgucaccguccccgucuccaaccaguccucccuccaguucuccaaccccuccggcucccucgucacccccucccucgucaccuccucccucaccgacccccgccuccucuccccccagcagcccgcccuccagcgcaacuccgucucccccggccucccccagcgccccgccuccgccggcgccaugcucggcggcgaccucaacuccgccaacggcgccugccccucccccgucggcaacggcuacgucuccgcccgcgccucccccggccuccuccccgucgccaacggcaacucccucaacaaggucauccccgccaaguccccccccccccccacccacuccacccagcucggcgcccccucccgcaagcccgaccuccgcgucaucaccucccaggccggcaagggccucaugcaccaccucaccgaggaccaccucgaccucaacaacgcccagcgccucggcgucucccaguccacccacucccucaccacccccgucgucuccgucgccacccccucccuccucucccagggccuccccuucuccuccaugcccaccgccuacaacaccgacuaccagcucaccuccgccgagcucuccucccuccccgccuucuccucccccggcggccucucccucggcaacgucaccgccuggcagcagccccagcagccccagcagccccagcagccccagcccccccagcagcagcccccccagccccagcagccccagccccagcagccccagcagccccagcagcccccccagcagcagucccaccucguccccgucucccucuccaaccucauccccggcuccccccucccccacgucggcgccgcccucaccgucaccacccacccccacaucuccaucaaguccgagcccgucucccccucccgcgagcgcucccccgccccccccccccccgccgucuuccccgccgcccgccccgagcccggcgacggccucuccucccccgccggcggcuccuacgagaccggcgaccgcgacgacggccgcggcgacuucggccccacccucggccuccuccgccccgcccccgagcccgaggccgagggcuccgccgucaagcgcaugcgccucgacaccuggacccucaaguga

SEQ ID NO: 45898 - RNA, 2346 nt, Artificial Sequence
  derived and/or modified sequence opt2 from MEFV__Homo_sapiens__NP_000234
auggccaagacccccuccgaccaccuccucuccacccucgaggagcucguccccuacgacuucgagaaguucaaguucaagcuccagaacaccuccguccagaaggagcacucccgcaucccccgcucccagauccagcgcgcccgccccgucaagauggccacccuccucgucaccuacuacggcgaggaguacgccguccagcucacccuccagguccuccgcgccaucaaccagcgccuccucgccgaggagcuccaccgcgccgccauccaggaguacuccacccaggagaacggcaccgacgacuccgccgccuccuccucccucggcgagaacaagccccgcucccucaagacccccgaccaccccgagggcaacgagggcaacggcccccgccccuacggcggcggcgccgccucccuccgcugcucccagcccgaggccggccgcggccucucccgcaagccccucuccaagcgccgcgagaaggccuccgagggccucgacgcccagggcaagccccgcacccgcucccccgcccuccccggcggccgcucccccggccccugccgcgcccucgagggcggccaggccgagguccgccuccgccgcaacgccuccuccgccggccgccuccagggccucgccggcggcgcccccggccagaaggagugccgccccuucgaggucuaccuccccuccggcaagaugcgcccccgcucccucgaggucaccaucuccaccggcgagaaggcccccgccaaccccgagauccuccucacccucgaggagaagaccgccgccaaccucgacuccgccaccgagccccgcgcccgccccacccccgacggcggcgccuccgccgaccucaaggagggccccggcaaccccgagcacuccgucaccggccgcccccccgacaccgccgccuccccccgcugccacgcccaggagggcgaccccgucgacggcaccugcguccgcgacuccugcuccuuccccgaggccgucuccggccacccccaggccuccggcucccgcucccccggcugcccccgcugccaggacucccacgagcgcaagucccccggcucccucuccccccagccccucccccagugcaagcgccaccucaagcagguccagcuccucuucugcgaggaccacgacgagcccaucugccucaucugcucccucucccaggagcaccagggccaccgcguccgccccaucgaggaggucgcccucgagcacaagaagaagauccagaagcagcucgagcaccucaagaagcuccgcaaguccggcgaggagcagcgcuccuacggcgaggagaaggccgucuccuuccucaagcagaccgaggcccucaagcagcgcguccagcgcaagcucgagcaggucuacuacuuccucgagcagcaggagcacuucuucgucgccucccucgaggacgucggccagauggucggccagauccgcaaggccuacgacacccgcgucucccaggacaucgcccuccucgacgcccucaucggcgagcucgaggccaaggagugccaguccgagugggagcuccuccaggacaucggcgacauccuccaccgcgccaagaccguccccguccccgagaaguggaccaccccccaggagaucaagcagaagauccagcuccuccaccagaaguccgaguucgucgagaaguccaccaaguacuucuccgagacccuccgcuccgagauggagauguucaacguccccgagcucaucggcgcccaggcccacgccgucaacgucauccucgacgccgagaccgccuaccccaaccucaucuucuccgacgaccucaaguccguccgccucggcaacaagugggagcgccuccccgacggcccccagcgcuucgacuccugcaucaucguccucggcucccccuccuuccucuccggccgccgcuacugggaggucgaggucggcgacaagaccgccuggauccucggcgccugcaagaccuccaucucccgcaagggcaacaugacccucucccccgagaacggcuacugggucgucaucaugaugaaggagaacgaguaccaggccuccuccgucccccccacccgccuccucaucaaggagccccccaagcgcgucggcaucuucgucgacuaccgcgucggcuccaucuccuucuacaacgucaccgcccgcucccacaucuacaccuucgccuccugcuccuucuccggcccccuccagcccaucuucucccccggcacccgcgacggcggcaagaacaccgccccccucaccaucugccccgucggcggccagggccccgacuga

SEQ ID NO: 45899 - RNA, 3423 nt, Artificial Sequence
  derived and/or modified sequence opt2 from MEGF10__Homo_sapiens__NP_115822
auggucaucucccucaacuccugccucuccuucaucugccuccuccucugccacuggaucggcaccgccuccccccucaaccucgaggaccccaacgucugcucccacugggaguccuacuccgucaccguccaggaguccuacccccaccccuucgaccagaucuacuacaccuccugcaccgacauccucaacugguucaagugcacccgccaccgcgucuccuaccgcaccgccuaccgccacggcgagaagaccauguaccgccgcaagucccagugcugccccggcuucuacgaguccggcgagaugugcgucccccacugcgccgacaagugcguccacggccgcugcaucgcccccaacaccugccagugcgagcccggcuggggcggcaccaacugcuccuccgccugcgacggcgaccacuggggcccccacugcaccucccgcugccagugcaagaacggcgcccucugcaaccccaucaccggcgccugccacugcgccgccggcuuccgcggcuggcgcugcgaggaccgcugcgagcagggcaccuacggcaacgacugccaccagcgcugccagugccagaacggcgccaccugcgaccacgucaccggcgagugccgcugcccccccggcuacaccggcgccuucugcgaggaccucugcccccccggcaagcacggcccccagugcgagcagcgcugccccugccagaacggcggcgucugccaccacgucaccggcgagugcuccugccccuccggcuggaugggcaccgucugcggccagcccugccccgagggccgcuucggcaagaacugcucccaggagugccagugccacaacggcggcaccugcgacgccgccaccggccagugccacugcucccccggcuacaccggcgagcgcugccaggacgagugccccgucggcaccuacggcguccucugcgccgagaccugccagugcgucaacggcggcaagugcuaccacgucuccggcgccugccucugcgaggccggcuucgccggcgagcgcugcgaggcccgccucugccccgagggccucuacggcaucaagugcgacaagcgcugccccugccaccucgagaacacccacuccugccaccccauguccggcgagugcgccugcaagcccggcugguccggccucuacugcaacgagaccugcucccccggcuucuacggcgaggccugccagcagaucugcuccugccagaacggcgccgacugcgacuccgucaccggcaagugcaccugcgcccccggcuucaagggcaucgacugcuccacccccugcccccucggcaccuacggcaucaacugcuccucccgcugcggcugcaagaacgacgccgucugcucccccgucgacggcuccugcaccugcaaggccggcuggcacggcgucgacugcuccauccgcugccccuccggcaccuggggcuucggcugcaaccucaccugccagugccucaacggcggcgccugcaacacccucgacggcaccugcaccugcgcccccggcuggcgcggcgagaagugcgagcuccccugccaggacggcaccuacggccucaacugcgccgagcgcugcgacugcucccacgccgacggcugccaccccaccaccggccacugccgcugccuccccggcugguccggcguccacugcgacuccgucugcgccgagggccgcuggggccccaacugcucccuccccugcuacugcaagaacggcgccuccugcucccccgacgacggcaucugcgagugcgcccccggcuuccgcggcaccaccugccagcgcaucugcucccccggcuucuacggccaccgcugcucccagaccugcccccagugcguccacuccuccggccccugccaccacaucaccggccucugcgacugccuccccggcuucaccggcgcccucugcaacgaggucugccccuccggccgcuucggcaagaacugcgccggcaucugcaccugcaccaacaacggcaccugcaaccccaucgaccgcuccugccagugcuaccccggcuggaucggcuccgacugcucccagcccugcccccccgcccacuggggccccaacugcauccacaccugcaacugccacaacggcgccuucugcuccgccuacgacggcgagugcaagugcacccccggcuggaccggccucuacugcacccagcgcugcccccucggcuucuacggcaaggacugcgcccucaucugccagugccagaacggcgccgacugcgaccacaucuccggccagugcaccugccgcaccggcuucaugggccgccacugcgagcagaagugccccuccggcaccuacggcuacggcugccgccagaucugcgacugccucaacaacuccaccugcgaccacaucaccggcaccugcuacugcucccccggcuggaagggcgcccgcugcgaccaggccggcgucaucaucgucggcaaccucaacucccucucccgcaccuccaccgcccuccccgccgacuccuaccagaucggcgccaucgccggcaucaucauccucguccucgucguccucuuccuccucgcccucuucaucaucuaccgccacaagcagaagggcaaggaguccuccaugcccgccgucaccuacacccccgccaugcgcgucgucaacgccgacuacaccaucuccggcacccucccccacuccaacggcggcaacgccaacucccacuacuucaccaaccccuccuaccacacccucacccagugcgccaccuccccccacgucaacaaccgcgaccgcaugaccgucaccaaguccaagaacaaccagcucuucgucaaccucaagaacgucaaccccggcaagcgcggccccgucggcgacugcaccggcacccuccccgccgacuggaagcacggcggcuaccucaacgagcucggcgccuucggccucgaccgcuccuacaugggcaagucccucaaggaccucggcaagaacuccgaguacaacuccuccaacugcucccucuccuccuccgagaaccccuacgccaccaucaaggacccccccguccucauccccaaguccuccgagugcggcuacgucgagaugaagucccccgcccgccgcgacucccccuacgccgagaucaacaacuccaccuccgccaaccgcaacgucuacgaggucgagcccaccgucuccgucguccagggcgucuucuccaacaacggccgccucucccaggaccccuacgaccuccccaagaacucccacauccccugccacuacgaccuccuccccguccgcgacuccuccuccucccccaagcaggaggacuccggcggcuccuccuccaacuccuccuccuccuccgaguga

SEQ ID NO: 45900 - RNA, 3135 nt, Artificial Sequence
  derived and/or modified sequence opt2 from MEGF11__Homo_sapiens__NP_115821
augguccucucccucaccggccucaucgccuucuccuuccuccaggccacccucgcccucaaccccgaggaccccaacgucugcucccacugggaguccuacgccgucaccguccaggaguccuacgcccaccccuucgaccagaucuacuacacccgcugcaccgacauccucaacugguucaagugcacccgccaccgcaucuccuacaagaccgccuaccgccgcggccuccgcaccauguaccgccgccgcucccagugcugccccggcuacuacgaguccggcgacuucugcaucccccucugcaccgaggagugcguccacggccgcugcgucucccccgacaccugccacugcgagcccggcuggggcggccccgacugcuccuccggcugcgacuccgaccacuggggcccccacugcuccaaccgcugccagugccagaacggcgcccucugcaaccccaucaccggcgccugcgucugcgccgccggcuuccgcggcuggcgcugcgaggagcucugcgcccccggcacccacggcaagggcugccagcuccccugccagugccgccacggcgccuccugcgacccccgcgccggcgagugccucugcgcccccggcuacaccggcgucuacugcgaggagcucugcccccccggcucccacggcgcccacugcgagcuccgcugccccugccagaacggcggcaccugccaccacaucaccggcgagugcgccugcccccccggcuggaccggcgccgucugcgcccagcccugcccccccggcaccuucggccagaacugcucccaggacugccccugccaccacggcggccagugcgaccacgucaccggccagugccacugcaccgccggcuacaugggcgaccgcugccaggaggagugccccuucggcuccuucggcuuccagugcucccagcacugcgacugccacaacggcggccagugcucccccaccaccggcgccugcgagugcgagcccggcuacaagggcccccgcugccaggagcgccucugccccgagggccuccacggccccggcugcacccuccccugccccugcgacgccgacaacaccaucuccugccaccccgucaccggcgccugcaccugccagcccggcugguccggccaccacugcaacgaguccugccccgucggcuacuacggcgacggcugccagcuccccugcaccugccagaacggcgccgacugccacuccaucaccggcggcugcaccugcgcccccggcuucaugggcgaggucugcgccgucuccugcgccgccggcaccuacggccccaacugcuccuccaucugcuccugcaacaacggcggcaccugcucccccgucgacggcuccugcaccugcaaggagggcuggcagggccucgacugcacccuccccugccccuccggcaccuggggccucaacugcaacgaguccugcaccugcgccaacggcgccgccugcucccccaucgacggcuccugcuccugcacccccggcuggcucggcgacaccugcgagcuccccugccccgacggcaccuucggccucaacugcuccgagcacugcgacugcucccacgccgacggcugcgaccccgucaccggccacugcugcugccucgccggcuggaccggcauccgcugcgacuccaccugcccccccggccgcuggggccccaacugcuccgucuccugcuccugcgagaacggcggcuccugcucccccgaggacggcuccugcgagugcgcccccggcuuccgcggcccccucugccagcgcaucugcccccccggcuucuacggccacggcugcgcccagcccugcccccucugcguccacuccucccgccccugccaccacaucuccggcaucugcgagugccuccccggcuucuccggcgcccucugcaaccaggucugcgccggcggcuacuucggccaggacugcgcccagcucugcuccugcgccaacaacggcaccugcucccccaucgacggcuccugccagugcuuccccggcuggaucggcaaggacugcucccaggccugcccccccggcuucuggggccccgccugcuuccacgccugcuccugccacaacggcgccuccugcuccgccgaggacggcgccugccacugcacccccggcuggaccggccucuucugcacccagcgcugccccgccgccuucuucggcaaggacugcggccgcgucugccagugccagaacggcgccuccugcgaccacaucuccggcaagugcaccugccgcaccggcuucaccggccagcacugcgagcagcgcugcgcccccggcaccuucggcuacggcugccagcagcucugcgagugcaugaacaacuccaccugcgaccacgucaccggcaccugcuacugcucccccggcuucaagggcauccgcugcgaccaggccgcccucaugauggaggagcucaaccccuacaccaagaucucccccgcccucggcgccgagcgccacuccgucggcgccgucaccggcaucaugcuccuccucuuccucaucgucguccuccucggccucuucgccuggcaccgccgccgccagaaggagaagggccgcgaccucgccccccgcgucuccuacacccccgccaugcgcaugaccuccaccgacuacucccucuccggcgccugcggcauggaccgccgccagaacaccuacaucauggacaagggcuucaaggacuacaugaaggaguccgucugcuccuccuccaccugcucccucaacuccuccgagaaccccuacgccaccaucaaggacccccccauccucaccugcaagcuccccgaguccuccuacgucgagaugaagucccccguccacaugggcucccccuacaccgacguccccucccucuccaccuccaacaagaacaucuacgaggucgagcccaccgucuccgucguccaggagggcugcggccacaacuccuccuacauccagaacgccuacgaccucccccgcaacucccacauccccggccacuacgaccuccuccccguccgccagucccccgccaacggccccucccaggacaagcaguccuga

SEQ ID NO: 45901 - RNA, 8538 nt, Artificial Sequence
  derived and/or modified sequence opt2 from MEGF8__Homo_sapiens__NP_001258867
auggcccucggcaagguccucgccauggcccucguccucgcccucgccguccucggcucccucucccccggcgcccgcgccggcgacugcaagggccagcgccagguccuccgcgaggcccccggcuucgucaccgacggcgccggcaacuacuccgucaacggcaacugcgaguggcucaucgaggcccccuccccccagcaccgcauccuccucgacuuccucuuccucgacaccgagugcaccuacgacuaccucuucgucuacgacggcgacuccccccgcggcccccuccucgccucccucuccggcuccacccgccccccccccaucgaggccuccuccggcaagaugcuccuccaccucuucuccgacgccaacuacaaccuccucggcuucaacgccuccuuccgcuucucccucugccccggcggcugccagucccacggccagugccagccccccggcgucugcgccugcgagcccggcuggggcggccccgacugcggccuccaggagugcuccgccuacugcggcucccacggcaccugcgccuccccccucggccccugccgcugcgagcccggcuuccucggccgcgccugcgaccuccaccucugggagaaccagggcgccggcugguggcacaacgucuccgcccgcgaccccgccuucuccgcccgcaucggcgccgccggcgccuuccucuccccccccggccuccucgccgucuucggcggccaggaccucaacaacgcccucggcgaccucguccucuacaacuucuccgccaacaccugggaguccugggaccucucccccgcccccgccgcccgccacucccacgucgccgucgccugggccggcucccucguccucaugggcggcgagcucgccgacggcucccucaccaacgacgucugggccuucuccccccucggccgcggccacugggagcuccucgccccccccgccuccuccuccuccggcccccccggccucgccggccacgccgccgcccucgucgacgacgucuggcucuacgucuccggcggccgcaccccccacgaccucuucuccuccggccucuuccgcuuccgccucgacuccaccuccggcggcuacugggagcaggucauccccgccggcggccgcccccccgccgccaccggccacuccauggucuuccacgcccccucccgcgcccuccucguccacggcggccaccgccccuccaccgcccgcuucuccguccgcgucaacuccaccgagcucuuccacgucgaccgccacgucuggaccacccucaagggccgcgacggccuccagggcccccgcgagcgcgccuuccacaccgccuccguccucggcaacuacauggucgucuacggcggcaacguccacacccacuaccaggaggagaagugcuacgaggacggcaucuucuucuaccaccucggcugccaccagugggucuccggcgccgagcucgccccccccggcacccccgagggccgcgccgccccccccuccggccgcuacucccacgucgccgccguccucggcggcuccguccuccucgucgccggcggcuacuccggccgcccccgcggcgaccucauggccuacaaggucccccccuucgucuuccaggcccccgcccccgacuaccaccucgacuacugcuccauguacaccgaccacuccgucugcucccgcgaccccgagugcuccuggugccagggcgccugccaggccgcccccccccccggcaccccccucggcgccugccccgccgccuccugccucggccucggccgccuccucggcgacugccaggccugccucgccuucuccucccccaccgcccccccccgcggccccggcacccucggcuggugcguccacaacgaguccugccucccccgccccgagcaggcccgcugccgcggcgagcagaucuccggcaccgucggcugguggggccccgcccccgucuucgucaccucccucgaggccugcgucacccaguccuuccuccccggccuccaccuccucaccuuccagcagccccccaacaccucccagcccgacaaggucuccaucguccgcuccaccaccaucacccucacccccuccgccgagaccgacgucucccucgucuaccgcggcuucaucuaccccaugcuccccggcggccccggcggccccggcgccgaggacgucgccgucuggacccgcgcccagcgccuccacguccucgcccgcauggcccgcggccccgacaccgagaacauggaggaggucggccgcugggucgcccaccaggagaaggagacccgccgccuccagcgccccggcuccgcccgccucuucccccuccccggccgcgaccacaaguacgccgucgagauccagggccagcucaacggcuccgccggccccggccacuccgagcucacccuccucugggaccgcaccggcguccccggcggcuccgagaucuccuucuucuuccucgagcccuaccgcuccuccuccugcaccuccuacuccuccugccucggcugccucgccgaccagggcugcggcuggugccucaccuccgccaccugccaccuccgccagggcggcgcccacugcggcgacgacggcgccggcggcucccuccucguccucguccccacccucugcccccucugcgaggagcaccgcgacugccacgccugcacccaggaccccuucugcgaguggcaccaguccaccucccgcaagggcgacgccgccugcucccgccgcggccgcggccgcggcgcccucaagucccccgaggagugccccccccucugcucccagcgccucaccugcgaggacugccucgccaacuccucccagugcgccuggugccaguccacccacaccugcuuccucuucgccgccuaccucgcccgcuacccccacggcggcugccgcggcugggacgacuccguccacuccgagccccgcugccgcuccugcgacggcuuccucaccugccacgagugccuccagucccacgagugcggcuggugcggcaacgaggacaaccccacccucggccgcugccuccagggcgacuucuccggcccccucggcggcggcaacugcucccucugggucggcgagggccucggccuccccgucgcccuccccgcccgcugggccuacgcccgcugccccgacgucgacgagugccgccucggccucgcccgcugccacccccgcgccaccugccucaacaccccccucuccuacgagugccacugccagcgcggcuaccagggcgacggcaucucccacugcaaccgcaccugccucgaggacugcggccacggcgucugcuccggcccccccgacuucaccugcgucugcgaccucggcuggaccuccgaccuccccccccccacccccgcccccggcccccccgccccccgcugcucccgcgacugcggcugcuccuuccacucccacugccgcaagcgcggccccggcuucugcgacgagugccaggacuggaccuggggcgagcacugcgagcgcugccgccccggcuccuucggcaacgccaccggcucccgcggcugccgccccugccagugcaacggccacggcgacccccgccgcggccacugcgacaaccucuccggccucugcuucugccaggaccacaccgagggcgcccacugccagcucugcucccccggcuacuacggcgacccccgcgccggcggcuccugcuuccgcgagugcggcggccgcgcccuccucaccaacgucuccuccgucgcccucggcucccgccgcgucggcggccuccucccccccggcggcggcgccgcccgcgccggccccggccucuccuacugcgucugggucgucuccgccaccgaggagcuccagcccugcgcccccggcacccucugccccccccucacccucaccuucucccccgacuccuccacccccugcacccucuccuacguccucgccuucgacggcuucccccgcuuccucgacaccggcgucguccaguccgaccgcucccucaucgccgccuucugcggccagcgccgcgaccgcccccucaccguccaggcccucuccggccuccucguccuccacugggaggccaacggcuccuccuccuggggcuucaacgccuccgucggcuccgcccgcugcggcuccggcggccccggcuccugccccgucccccaggagugcgucccccaggacggcgccgccggcgccggccucugccgcugcccccagggcugggccggcccccacugccgcauggcccucugccccgagaacugcaacgcccacaccggcgccggcaccugcaaccagucccucggcgucugcaucugcgccgagggcuucggcggccccgacugcgccaccaagcucgacggcggccagcucgucugggagacccucauggacucccgccucuccgccgacaccgccucccgcuuccuccaccgccucggccacaccauggucgacggccccgacgccacccucuggauguucggcggccucggccucccccagggccuccucggcaaccucuaccgcuacuccgucuccgagcgccgcuggacccagaugcucgccggcgccgaggacggcggccccggccccuccccccgcuccuuccacgccgccgccuacguccccgccggccgcggcgccauguaccuccucggcggccucaccgccggcggcgucacccgcgacuucuggguccucaaccucaccacccuccaguggcgccaggagaaggccccccagaccgucgagcuccccgccgucgccggccacacccucaccgcccgccgcggccucucccuccuccucgucggcggcuacucccccgagaacggcuucaaccagcagcuccucgaguaccagcucgccaccggcaccugggucuccggcgcccaguccggcaccccccccaccggccucuacggccacuccgccgucuaccacgaggccaccgacucccucuacgucuucggcggcuuccgcuuccacgucgagcucgccgcccccucccccgagcucuacucccuccacugccccgaccgcaccuggucccuccucgcccccucccagggcgccaagcgcgaccgcaugcgcaacguccgcggcuccucccgcggccucggccagguccccggcgagcagcccggcuccuggggcuuccgcgagguccgcaagaagauggcccucugggccgcccucgccggcaccggcggcuuccucgaggagaucuccccccaccucaaggagccccgcccccgccucuuccacgccuccgcccuccucggcgacaccauggucguccucggcggccgcuccgaccccgacgaguucuccuccgacguccuccucuaccaggucaacugcaacgccuggcuccuccccgaccucacccgcuccgccuccgucggcccccccauggaggaguccgucgcccacgccgucgccgccgucggcucccgccucuacaucuccggcggcuucggcggcgucgcccucggccgccuccucgcccucacccucccccccgaccccugccgccuccucuccucccccgaggccugcaaccaguccggcgccugcaccuggugccacggcgccugccucuccggcgaccaggcccaccgccucggcugcggcggcucccccugcucccccaugccccgcucccccgaggagugccgccgccuccgcaccugcuccgagugccucgcccgccacccccgcacccuccagcccggcgacggcgaggccuccaccccccgcugcaaguggugcaccaacugccccgagggcgccugcaucggccgcaacggcuccugcaccuccgagaacgacugccgcaucaaccagcgcgaggucuucugggccggcaacugcuccgaggccgccugcggcgccgccgacugcgagcagugcacccgcgagggcaagugcauguggacccgccaguucaagcgcaccggcgagacccgccgcauccucuccguccagcccaccuacgacuggaccugcuucucccacucccuccucaacgucucccccaugcccgucgaguccucccccccccuccccugccccacccccugccaccuccuccccaacugcaccuccugccucgacuccaagggcgccgacggcggcuggcagcacugcgucugguccuccucccuccagcagugccucucccccuccuaccucccccuccgcugcauggccggcggcugcggccgccuccuccgcggccccgaguccugcucccucggcugcgcccaggccacccagugcgcccucugccuccgccgcccccacugcggcuggugcgccuggggcggccaggacggcggcggccgcugcauggagggcggccucuccggcccccgcgacggccucaccugcggccgccccggcgccuccugggccuuccucuccugcccccccgaggacgagugcgccaacggccaccacgacugcaacgagacccagaacugccacgaccagccccacggcuacgagugcuccugcaagaccggcuacaccauggacaacaugaccggccucugccgccccgucugcgcccagggcugcgucaacggcuccugcgucgagcccgaccacugccgcugccacuucggcuucgucggccgcaacugcuccaccgagugccgcugcaaccgccacuccgagugcgccggcgucggcgcccgcgaccacugccuccucugccgcaaccacaccaagggcucccacugcgagcagugccucccccucuucgucggcuccgccgucggcggcggcaccugccgccccugccacgccuucugccgcggcaacucccacaucugcaucucccgcaaggagcuccagauguccaagggcgagcccaagaaguacucccucgaccccgaggagaucgagaacugggucaccgagggccccuccgaggacgaggccgucugcgucaacugccagaacaacuccuacggcgagaagugcgaguccugccuccagggcuacuuccuccucgacggcaagugcaccaagugccagugcaacggccacgccgacaccugcaacgagcaggacggcaccggcugccccugccagaacaacaccgagaccggcaccugccagggcuccucccccuccgaccgccgcgacugcuacaaguaccagugcgccaagugccgcgaguccuuccacggcuccccccucggcggccagcagugcuaccgccucaucuccgucgagcaggagugcugccucgaccccaccucccagaccaacugcuuccacgagcccaagcgccgcgcccucggccccggccgcaccguccucuucggcguccagcccaaguucaccaacgucgacauccgccucacccucgacgucaccuucggcgccgucgaccucuacgucuccaccuccuacgacaccuucgucguccgcgucgcccccgacaccggcguccacaccguccacauccagcccccccccgcccccccccccccccccccccccgccgacggcggcccccgcggcgccggcgaccccggcggcgccggcgccuccuccggccccggcgcccccgccgagccccgcguccgcgaggucuggccccgcggccucaucaccuacgucaccgucaccgagcccuccgccguccucgucguccgcggcguccgcgaccgccucgucaucaccuacccccacgagcaccacgcccucaaguccucccgcuucuaccuccuccuccucggcgucggcgaccccuccggccccggcgccaacggcuccgccgacucccagggccuccucuucuuccgccaggaccaggcccacaucgaccucuucgucuucuucuccgucuucuucuccugcuucuuccucuuccucucccucugcguccuccucuggaaggccaagcaggcccucgaccagcgccaggagcagcgccgccaccuccaggagaugaccaagauggccucccgccccuucgccaaggucaccgucugcuucccccccgaccccaccgcccccgccuccgccuggaagcccgccggccuccccccccccgccuuccgccgcuccgagcccuuccucgccccccuccuccucaccggcgccggcggccccuggggccccaugggcggcggcugcugcccccccgccauccccgccaccaccgccggccuccgcgccggccccaucacccucgagcccaccgaggacggcauggccggcgucgccacccuccuccuccagcuccccggcggcccccacgcccccaacggcgccugccucggcuccgcccucgucacccuccgccaccgccuccacgaguacugcggcggcggcggcggcgccggcggcuccggccacggcaccggcgccggccgcaagggccuccucucccaggacaaccucaccuccaugucccucuga

SEQ ID NO: 45902 - RNA, 1809 nt, Artificial Sequence
  derived and/or modified sequence opt2 from MEGF9__Homo_sapiens__NP_001073966
augaacggcggcgccgagcgcgccaugcgcucccuccccucccucggcggccucgcccuccucugcugcgccgccgccgccgccgccgccgccgucgccuccgccgccuccgccggcaacgucaccggcggcggcggcgccgccggccaggucgacgccucccccggccccggccuccgcggcgagcccucccaccccuucccccgcgccaccgcccccaccgcccaggccccccgcaccggccccccccgcgccaccguccaccgcccccucgccgccaccucccccgcccagucccccgagaccaccccccucugggccaccgccggccccuccuccaccaccuuccaggccccccucggccccucccccaccaccccccccgccgccgagcgcaccuccaccaccucccaggcccccacccgccccgcccccaccacccucuccaccaccaccggccccgcccccaccacccccgucgccaccaccguccccgcccccaccaccccccgcacccccacccccgaccuccccuccuccuccaacuccuccguccuccccaccccccccgccaccgaggcccccuccucccccccccccgaguacgucugcaacugcuccgucgucggcucccucaacgucaaccgcugcaaccagaccaccggccagugcgagugccgccccggcuaccagggccuccacugcgagaccugcaaggagggcuucuaccucaacuacaccuccggccucugccagcccugcgacugcuccccccacggcgcccucuccauccccugcaacuccuccggcaagugccagugcaaggucggcgucaucggcuccaucugcgaccgcugccaggacggcuacuacggcuucuccaagaacggcugccuccccugccagugcaacaaccgcuccgccuccugcgacgcccucaccggcgccugccucaacugccaggagaacuccaagggcaaccacugcgaggagugcaaggagggcuucuaccagucccccgacgccaccaaggagugccuccgcugccccugcuccgccgucaccuccaccggcuccugcuccaucaaguccuccgagcucgagcccgagugcgaccagugcaaggacggcuacaucggccccaacugcaacaagugcgagaacggcuacuacaacuucgacuccaucugccgcaagugccagugccacggccacgucgaccccgucaagacccccaagaucugcaagcccgaguccggcgagugcaucaacugccuccacaacaccaccggcuucuggugcgagaacugccucgagggcuacguccacgaccucgagggcaacugcaucaagaaggaggucauccuccccacccccgagggcuccaccauccucgucuccaacgccucccucaccaccuccguccccacccccgucaucaacuccaccuucacccccaccacccuccagaccaucuucuccgucuccaccuccgagaacuccaccuccgcccucgccgacgucuccuggacccaguucaacaucaucauccucaccgucaucaucaucgucgucguccuccucaugggcuucgucggcgccgucuacauguaccgcgaguaccagaaccgcaagcucaacgcccccuucuggaccaucgagcucaaggaggacaacaucuccuucuccuccuaccacgacuccauccccaacgccgacgucuccggccuccucgaggacgacggcaacgaggucgcccccaacggccagcucacccucaccacccccauccacaacuacaaggccuga

SEQ ID NO: 45903 - RNA, 3825 nt, Artificial Sequence
  derived and/or modified sequence opt2 from MEI1__Homo_sapiens__NP_689726
auggccguccgccaggccgccaccgccggcacccccggcccccgccgcgaggaggaggccgcccuccucuucgagcgcgcccacuaccgccacgacccccgcuggcuccuccccgucaccccccgccucugccucgccugcgcccucgagcuccuccccgaccccggcgucucccucguccgcaagaagcacaugcucuccugcuuccaggacgcccucguccgccacaccucccucgucacccagcucgucucccaggaccagcgcgucugcauccacuucaucuccguccucuucggccuccucugcuccauggaggacggcuccgucaccgaccucugcaucgagguccucauccagaucaccacccagcucaagcucgagcagaccauccgcugccuccucgacgagugccacaaggagcucugcaacaugcccuccaugcgcggcucccucgccacccucacccuccucggcaagcucgucgacgccauccccgcccucgccgacgagcucgucauggagcacggcaaccucauggagcaccuccuccgcggccucgucuaccccuccgagggcauccaggccuccgucugcuaccucuacggcaagcucuacuccucccccgucgccgccgagaugcucuccggccacuuccgcgagaagcucuucccccucuuccucuccauccucgacggcgcccagaccaaggagcuccagaucaacugccucggccuccuccgccagcuccucaaguacgaccucuucgucuccaugaucaugaaccaggacggccucggcgaguccgccaagaacaucgagggcuccuccggcaacaccucccucccccucguccucaagaagcuccuccucucccgcgacgagacccuccaggucgccuccgcccacugcaucaccgccguccucguccacucccccgccaagcacgccuccgccuucauccacgccgacauccccgaguuccucuucgagcaccucuccuccuccuccgagguccucgucugguccuccugcaacugccucacccuccucgucgaggagccccucuucuucuccaagugccacaccgucuacggcaucgaggccgucguccgcucccuccagggcucccucaagaugaacaacaucgagcuccacaagcagggccuccuccucuucgccgagauccucacccgccagcccgaggagaucaagcucuucaccuccuccgccaugugccgcgacgccggccgcgcccuccaggaggccgucuccucccccguccucgaggucgccgccgaggcccucaaggccaccuccgccuuccuccgcaaggaccaccaguccaccccccccguccaguacggcgagcuccaggcccuccucgaggccaugcucaaccgcugcgccgaguucucccagacccuccucucccgccgcccccucggccacgccuccucccgcgacuccgagaaggccauccuccagcgcggcaaguuccuccucuccacccucgagggcuuccgcuccgccugccgccucgccaucgaguuccaguccgagcccuccgcccaggagaaccccuucaccgcccccuccgccaagaaggaggacacccucgaggccuucuccgaguuccuccucuccgccugcgacucccucugcauccccauggucaugcgccaccucgagcagaccacccaccccgcccucauggaggucuuccucuccauccuccacaaccucuucgucaucgucccccacaugaaggagaaguucuccaagaagcucgccuccuccuccuucauccgccucacccucgagcucaaggcccgcuucugcuccggccucucccacuccgcccucaaccaggucugcuccaacuuccucuacuacaugugccucaaccuccucuccgcccccgagaagaccggcccccccuccaaggaggagcucuccgccgucuccgagcuccuccagcacggccucccccagaucuccucccgcucccccgagucccucgccuuccucuccgaccgccaguacauggagggcgccgcccgccagcgccaguacugcauccuccuccucuucuaccucgccuacauccacgaggaccgcuucgucuccgaggccgagcucuucgaggccguccaguccuuccuccucucccuccaggaccagggcgagcgccccccccucgucgucuucaaggccuccaucuaccuccucgccaucugccaggacaaggacaacacccuccgcgagaccauggucuccgccauccgcaaguuccucgagggcauccccgaccuccagcucgucuacacccaccacccccuccuccuccgcuucuuccuccucuaccccgagcucaugucccgcuacggccaccgcguccucgagcucugguucuucugggaggaguccuccuacgaggagcucgacgacgucaccuccgccggccagcccgcccuccccgccucccucgucguccucuuccagcuccuccgcuccauccccuccauccuccucauccuccucgaccucaucuacuccucccccgucgacaccgcccacaagguccucaucucccuccgcaccuuccuccgccgcaacgaggacauccaggucggcggccucauccgcggccacuuccuccucauccuccagcgccuccucgucgagcacggcgccucccccuccggcgccuccggcaaccucccccuccuccucucccuccucucccucaugcagcuccgcaacgucuccgagcaggagcucgacuccgucgccaugaagcuccuccaccaggucuccaagcucugcggcaagugcucccccaccgacgucgacauccuccagcccuccuucaacuuccucuacuggucccuccaccagaccacccccuccucccagaagcgcgccgccgccguccuccucuccuccaccggccucauggagcuccucgagaagaugcucgcccucacccucgccaaggccgacuccccccgcaccgcccuccucugcuccgccuggcuccucaccgccuccuucuccgcccagcagcacaagggcucccuccagguccaccagacccucuccgucgagauggaccagguccucaaggcccucuccuuccccaagaagaaggccgcccuccucuccgccgccauccucugcuuccuccgcaccgcccuccgccaguccuucuccuccgcccucgucgcccucguccccuccggcgcccagccccuccccgccaccaaggacaccguccucgccccccuccgcaugucccagguccgcucccucgucaucggccuccagaaccuccucguccagaaggacccccuccucucccaggccugcgucggcugccucgaggcccuccucgacuaccucgacgcccgcucccccgacaucgcccuccacgucgccucccagcccuggaaccgcuuccuccucuucacccuccucgacgccggcgagaacuccuuccuccgccccgagauccuccgccucaugacccucuucaugcgcuaccgcuccuccuccguccucucccacgaggaggucggcgacguccuccagggcgucgcccucgccgaccucuccacccucuccaacaccacccuccaggcccuccacggcuucuuccagcagcuccaguccaugggccaccucgccgaccacuccauggcccagacccuccaggccucccucgagggccucccccccuccaccuccuccggccagcccccccuccaggacaugcucugccucggcggcgucgccgucucccucucccacauccgcaacuga

SEQ ID NO: 45904 - RNA, 1173 nt, Artificial Sequence
  derived and/or modified sequence opt2 from MEIS1__Homo_sapiens__NP_002389
auggcccagcgcuacgacgaccucccccacuacggcggcauggacggcgucggcauccccuccaccauguacggcgacccccacgccgcccgcuccaugcagcccguccaccaccucaaccacggccccccccuccacucccaccaguacccccacaccgcccacaccaacgccauggcccccuccaugggcuccuccgucaacgacgcccucaagcgcgacaaggacgccaucuacggccacccccucuucccccuccucgcccucaucuucgagaagugcgagcucgccaccugcaccccccgcgagcccggcgucgccggcggcgacgucugcuccuccgaguccuucaacgaggacaucgccgucuucgccaagcagauccgcgccgagaagccccucuucuccuccaaccccgagcucgacaaccucaugauccaggccauccagguccuccgcuuccaccuccucgagcucgagaagguccacgagcucugcgacaacuucugccaccgcuacaucuccugccucaagggcaagaugcccaucgaccucgucaucgacgaccgcgagggcggcuccaaguccgacuccgaggacaucacccgcuccgccaaccucaccgaccagcccuccuggaaccgcgaccacgacgacaccgccuccacccgcuccggcggcacccccggccccuccuccggcggccacaccucccacuccggcgacaacuccuccgagcagggcgacggccucgacaacuccgucgccucccccuccaccggcgacgacgacgaccccgacaaggacaagaagcgccacaagaagcgcggcaucuuccccaaggucgccaccaacaucaugcgcgccuggcucuuccagcaccucacccaccccuaccccuccgaggagcagaagaagcagcucgcccaggacaccggccucaccauccuccaggucaacaacugguucaucaacgcccgccgccgcaucguccagcccaugaucgaccaguccaaccgcgccgucucccagggcacccccuacaaccccgacggccagcccaugggcggcuucgucauggacggccagcagcacaugggcauccgcgcccccggccccauguccggcaugggcaugaacaugggcauggagggccaguggcacuacauguga

SEQ ID NO: 45905 - RNA, 1146 nt, Artificial Sequence
  derived and/or modified sequence opt2 from MEIS2__Homo_sapiens__NP_002390
auggacggcgucggcguccccgccuccauguacggcgacccccacgccccccgccccaucccccccguccaccaccucaaccacggccccccccuccacgccacccagcacuacggcgcccacgccccccaccccaacgucaugcccgccuccaugggcuccgccgucaacgacgcccucaagcgcgacaaggacgccaucuacggccacccccucuucccccuccucgcccucgucuucgagaagugcgagcucgccaccugcaccccccgcgagcccggcgucgccggcggcgacgucugcuccuccgacuccuucaacgaggacaucgccgucuucgccaagcagguccgcgccgagaagccccucuucuccuccaaccccgagcucgacaaccucaugauccaggccauccagguccuccgcuuccaccuccucgagcucgagaagguccacgagcucugcgacaacuucugccaccgcuacaucuccugccucaagggcaagaugcccaucgaccucgucaucgacgagcgcgacggcuccuccaaguccgaccacgaggagcucuccggcuccuccaccaaccucgccgaccacaaccccuccuccuggcgcgaccacgacgacgccaccuccacccacuccgccggcacccccggccccuccuccggcggccacgccucccaguccggcgacaacuccuccgagcagggcgacggccucgacaacuccgucgccucccccggcaccggcgacgacgacgaccccgacaaggacaagaagcgccagaagaagcgcggcaucuuccccaaggucgccaccaacaucaugcgcgccuggcucuuccagcaccucacccaccccuaccccuccgaggagcagaagaagcagcucgcccaggacaccggccucaccauccuccaggucaacaacugguucaucaacgcccgccgccgcaucguccagcccaugaucgaccaguccaaccgcgccgucucccagggcgccgccuacucccccgagggccagcccaugggcuccuucguccucgacggccagcagcacaugggcauccgccccgccggccccauguccggcaugggcaugaacaugggcauggacggccaguggcacuacauguga

SEQ ID NO: 45906 - RNA, 1833 nt, Artificial Sequence
  derived and/or modified sequence opt2 from MELK__Homo_sapiens__NP_001243614
augaaggacuacgacgagcuccucaaguacuacgagcuccacgagaccaucggcaccggcggcuucgccaaggucaagcucgccugccacauccucaccggcgagauggucgccaucaagaucauggacaagaacacccucggcuccgaccucccccgcaucaagaccgagaucgaggcccucaagaaccuccgccaccagcacaucugccagcucuaccacguccucgagaccgccaacaagaucuucaugguccucgaguacugccccggcggcgagcucuucgacuacaucaucucccaggaccgccucuccgaggaggagacccgcgucgucuuccgccagaucgucuccgccgucgccuacguccacucccagggcuacgcccaccgcgaccucaagcccgagaaccuccucuucgacgaguaccacaagcucaagcucaucgacuucggccucugcgccaagcccaagggcaacaaggacuaccaccuccagaccugcugcggcucccucgccuacgccgcccccgagcucauccagggcaaguccuaccucggcuccgaggccgacgucugguccaugggcauccuccucuacguccucaugugcggcuuccuccccuucgacgacgacaacgucauggcccucuacaagaagaucaugcgcggcaaguacgacguccccaaguggcucucccccuccuccauccuccuccuccagcagaugcuccaggucgaccccaagaagcgcaucuccaugaagaaccuccucaaccaccccuggaucaugcaggacuacaacuaccccgucgaguggcaguccaagaaccccuucauccaccucgacgacgacugcgucaccgagcucuccguccaccaccgcaacaaccgccagaccauggaggaccucaucucccucuggcaguacgaccaccucaccgccaccuaccuccuccuccucgccaagaaggcccgcggcaagcccguccgccuccgccucuccuccuucuccugcggccaggccuccgccacccccuucaccgacaucaaguucaccaaguacuggaccgaguccaacggcgucgaguccaagucccucacccccgcccucugccgcacccccgccaacaagcucaagaacaaggagaacgucuacacccccaaguccgccgucaagaacgaggaguacuucauguuccccgagcccaagacccccgucaacaagaaccagcacaagcgcgagauccucaccacccccaaccgcuacaccacccccuccaaggcccgcaaccagugccucaaggagacccccaucaagauccccgucaacuccaccggcaccgacaagcucaugaccggcgucaucucccccgagcgccgcugccgcuccgucgagcucgaccucaaccaggcccacauggaggagacccccaagcgcaagggcgccaaggucuucggcucccucgagcgcggccucgacaaggucaucaccguccucacccgcuccaagcgcaagggcuccgcccgcgacggcccccgccgccucaagcuccacuacaacgucaccaccacccgccucgucaaccccgaccagcuccucaacgagaucauguccauccuccccaagaagcacgucgacuucguccagaagggcuacacccucaagugccagacccaguccgacuucggcaaggucaccaugcaguucgagcucgaggucugccagcuccagaagcccgacgucgucggcauccgccgccagcgccucaagggcgacgccugggucuacaagcgccucgucgaggacauccucuccuccugcaaggucuga

SEQ ID NO: 45907 - RNA, 825 nt, Artificial Sequence
  derived and/or modified sequence opt2 from MEMO1__Homo_sapiens__NP_001131074
auguccaaccgcgucgucugccgcgaggccucccacgccggcuccugguacaccgccuccggcccccagcucaacgcccagcucgagggcuggcucucccagguccaguccaccaagcgccccgcccgcgccaucaucgccccccgccgcaucuucauccucggccccucccaccacgucccccucucccgcugcgcccucuccuccgucgacaucuaccgcaccccccucuacgaccuccgcaucgaccagaagaucuacggcgagcucuggaagaccggcauguucgagcgcaugucccuccagaccgacgaggacgagcacuccaucgagaugcaccuccccuacaccgccaaggccauggagucccacaaggacgaguucaccaucauccccguccucgucggcgcccucuccgaguccaaggagcaggaguucggcaagcucuucuccaaguaccucgccgaccccuccaaccucuucgucgucuccuccgacuucugccacuggggccagcgcuuccgcuacuccuacuacgacgagucccagggcgagaucuaccgcuccaucgagcaccucgacaagaugggcauguccaucaucgagcagcucgaccccgucuccuucuccaacuaccucaagaaguaccacaacaccaucugcggccgccaccccaucggcguccuccucaacgccaucaccgagcuccagaagaacggcaugaacauguccuucuccuuccucaacuacgcccaguccucccagugccgcaacuggcaggacuccuccgucuccuacgccgccggcgcccucaccguccacuga

SEQ ID NO: 45908 - RNA, 1833 nt, Artificial Sequence
  derived and/or modified sequence opt2 from MEN1__Homo_sapiens__NP_570711
augggccucaaggccgcccagaagacccucuucccccuccgcuccaucgacgacgucguccgccucuucgccgccgagcucggccgcgaggagcccgaccucguccuccucucccucguccucggcuucgucgagcacuuccucgccgucaaccgcgucauccccaccaacguccccgagcucaccuuccagcccucccccgcccccgacccccccggcggccucaccuacuuccccgucgccgaccucuccaucaucgccgcccucuacgcccgcuucaccgcccagauccgcggcgccgucgaccucucccucuacccccgcgagggcggcgucuccucccgcgagcucgucaagaaggucuccgacgucaucuggaacucccucucccgcuccuacuucaaggaccgcgcccacauccagucccucuucuccuucaucaccggcaccaagcucgacuccuccggcgucgccuucgccgucgucggcgccugccaggcccucggccuccgcgacguccaccucgcccucuccgaggaccacgccugggucgucuucggccccaacggcgagcagaccgccgaggucaccuggcacggcaagggcaacgaggaccgccgcggccagaccgucaacgccggcgucgccgagcgcuccuggcucuaccucaagggcuccuacaugcgcugcgaccgcaagauggaggucgccuucauggucugcgccaucaaccccuccaucgaccuccacaccgacucccucgagcuccuccagcuccagcagaagcuccucuggcuccucuacgaccucggccaccucgagcgcuaccccauggcccucggcaaccucgccgaccucgaggagcucgagcccacccccggccgccccgacccccucacccucuaccacaagggcaucgccuccgccaagaccuacuaccgcgacgagcacaucuaccccuacauguaccucgccggcuaccacugccgcaaccgcaacguccgcgaggcccuccaggccugggccgacaccgccaccgucauccaggacuacaacuacugccgcgaggacgaggagaucuacaaggaguucuucgaggucgccaacgacgucauccccaaccuccucaaggaggccgccucccuccucgaggccggcgaggagcgccccggcgagcagucccagggcacccagucccagggcuccgcccuccaggaccccgagugcuucgcccaccuccuccgcuucuacgacggcaucugcaagugggaggagggcucccccacccccguccuccacgucggcugggccaccuuccucguccagucccucggccgcuucgagggccagguccgccagaagguccgcaucgucucccgcgaggccgaggccgccgaggccgaggagcccuggggcgaggaggcccgcgagggccgccgccgcggcccccgccgcgaguccaagcccgaggagccccccccccccaagaagcccgcccucgacaagggccucggcaccggccagggcgccgucuccggccccccccgcaagccccccggcaccgucgccggcaccgcccgcggccccgagggcggcuccaccgcccagguccccgcccccgccgccucccccccccccgagggccccguccucaccuuccaguccgagaagaugaagggcaugaaggagcuccucgucgccaccaagaucaacuccuccgccaucaagcuccagcucaccgcccagucccagguccagaugaagaagcagaaggucuccacccccuccgacuacacccucuccuuccucaagcgccagcgcaagggccucuga

SEQ ID NO: 45909 - RNA, 420 nt, Artificial Sequence
  derived and/or modified sequence opt2 from MEOX1__Homo_sapiens__NP_001035091
augggcaccuccucccucggccucgucgacaccaccggcggccccggcgacgacuacggcguccucggcuccaccgccaacgagaccgagaagaaguccucccgccgccgcaaggaguccuccgacaaccaggagaaccgcggcaagcccgagggcuccuccaaggcccgcaaggagcgcaccgccuucaccaaggagcagcuccgcgagcucgaggccgaguucgcccaccacaacuaccucacccgccuccgccgcuacgagaucgccgucaaccucgaccucuccgagcgccaggucaaggucugguuccagaaccgccgcaugaaguggaagcgcgucaagggcggccagcccaucucccccaacggccaggaccccgaggacggcgacuccaccgccucccccuccuccgaguga

SEQ ID NO: 45910 - RNA, 915 nt, Artificial Sequence
  derived and/or modified sequence opt2 from MEOX2__Homo_sapiens__NP_005915
auggagcacccccucuucggcugccuccgcuccccccacgccaccgcccagggccuccaccccuucucccaguccucccucgcccuccacggccgcuccgaccacauguccuaccccgagcucuccaccuccuccuccuccugcaucaucgccggcuaccccaacgaggagggcauguucgccucccagcaccaccgcggccaccaccaccaccaccaccaccaccaccaccaccaccaccagcagcagcagcaccaggcccuccagaccaacuggcaccucccccagauguccuccccccccuccgccgcccgccacucccucugccuccagcccgacuccggcggcccccccgagcucggcuccuccccccccguccucugcuccaacuccuccucccucggcuccuccacccccaccggcgccgccugcgcccccggcgacuacggccgccaggcccucucccccgccgaggccgagaagcgcuccggcggcaagcgcaaguccgacuccuccgacucccaggagggcaacuacaaguccgaggucaacuccaagccccgcaaggagcgcaccgccuucaccaaggagcagauccgcgagcucgaggccgaguucgcccaccacaacuaccucacccgccuccgccgcuacgagaucgccgucaaccucgaccucaccgagcgccaggucaaggucugguuccagaaccgccgcaugaaguggaagcgcgucaagggcggccagcagggcgccgccgcccgcgagaaggagcucgucaacgucaagaagggcacccuccuccccuccgagcucuccggcaucggcgccgccacccuccagcagaccggcgacuccaucgccaacgaggacucccacgacuccgaccacuccuccgagcacgcccaccucuga

SEQ ID NO: 45911 - RNA, 2241 nt, Artificial Sequence
  derived and/or modified sequence opt2 from MEP1A__Homo_sapiens__NP_005579
auggccuggauccgcuccaccugcauccucuucuucacccuccucuucgcccacaucgccgccguccccaucaaguaccuccccgaggagaacguccacgacgccgacuucggcgagcagaaggacaucuccgagaucaaccucgccgccggccucgaccucuuccagggcgacauccuccuccagaagucccgcaacggccuccgcgaccccaacacccgcuggaccuuccccauccccuacauccucgccgacaaccucggccucaacgccaagggcgccauccucuacgccuucgagauguuccgccucaaguccugcgucgacuucaagcccuacgagggcgaguccuccuacaucaucuuccagcaguucgacggcugcugguccgaggucggcgaccagcacgucggccagaacaucuccaucggccagggcugcgccuacaaggccaucaucgagcacgagauccuccacgcccucggcuucuaccacgagcagucccgcaccgaccgcgacgacuacgucaacaucuggugggaccagauccucuccggcuaccagcacaacuucgacaccuacgacgacucccucaucaccgaccucaacacccccuacgacuacgagucccucaugcacuaccagcccuucuccuucaacaagaacgccuccguccccaccaucaccgccaagauccccgaguucaacuccaucaucggccagcgccucgacuucuccgccaucgaccucgagcgccucaaccgcauguacaacugcaccaccacccacacccuccucgaccacugcaccuucgagaaggccaacaucugcggcaugauccagggcacccgcgacgacaccgacugggcccaccaggacuccgcccaggccggcgaggucgaccacacccuccucggccagugcaccggcgccggcuacuucaugcaguucuccaccuccuccggcuccgccgaggaggccgcccuccucgagucccgcauccucuaccccaagcgcaagcagcagugccuccaguucuucuacaagaugaccggcucccccuccgaccgccucgucgucuggguccgccgcgacgacuccaccggcaacguccgcaagcucgucaagguccagaccuuccagggcgacgacgaccacaacuggaagaucgcccacgucguccucaaggaggagcagaaguuccgcuaccucuuccagggcaccaagggcgacccccagaacuccaccggcggcaucuaccucgacgacaucacccucaccgagacccccugccccaccggcgucuggaccguccgcaacuucucccagguccucgagaacaccuccaagggcgacaagcuccaguccccccgcuucuacaacuccgagggcuacggcuucggcgucacccucuaccccaacucccgcgaguccuccggcuaccuccgccucgccuuccacgucugcuccggcgagaacgacgccauccucgaguggcccgucgagaaccgccaggucaucaucaccauccucgaccaggagcccgacguccgcaaccgcauguccuccuccauggucuucaccaccuccaagucccacaccucccccgccaucaacgacaccgucaucugggaccgccccucccgcgucggcaccuaccacaccgacugcaacugcuuccgcuccaucgaccucggcugguccggcuucaucucccaccagaugcucaagcgccgcuccuuccucaagaacgacgaccucaucaucuucgucgacuucgaggacaucacccaccucucccagaccgagguccccaccaagggcaagcgccucuccccccagggccucauccuccagggccaggagcagcaggucuccgaggagggcuccggcaaggccaugcucgaggaggcccuccccgucucccucucccagggccagcccucccgccagaagcgcuccgucgagaacaccggcccccucgaggaccacaacuggccccaguacuuccgcgaccccugcgaccccaaccccugccagaacgacggcaucugcgucaacgucaagggcauggccuccugccgcugcaucuccggccacgccuucuucuacaccggcgagcgcugccaggccguccagguccacggcuccguccucggcauggucaucggcggcaccgccggcgucaucuuccucaccuucuccaucaucgccauccucucccagcgcccccgcaaguga

SEQ ID NO: 45912 - RNA, 1578 nt, Artificial Sequence
  derived and/or modified sequence opt2 from MEPE__Homo_sapiens__NP_001171623
augcgcgucuucugcgucggccuccuccucuucuccgucaccugggccgcccccaccuuccagccccagaccgagaagaccaagcaguccugcgucgaggagcagcgccaggaggagaagaacaaggacaacaucggcuuccaccaccucggcaagcgcaucaaccaggagcucuccuccaaggagaacaucguccaggagcgcaagaaggaccucucccucuccgaggccuccgagaacaagggcuccuccaagucccagaacuacuucaccaaccgccagcgccucaacaaggaguacuccaucuccaacaaggagaacacccacaacggccuccgcauguccaucuaccccaaguccaccggcaacaagggcuucgaggacggcgacgacgccaucuccaagcuccacgaccaggaggaguacggcgccgcccucauccgcaacaacaugcagcacaucaugggccccgucaccgccaucaagcuccucggcgaggagaacaaggagaacaccccccgcaacguccucaacaucauccccgccuccaugaacuacgccaaggcccacuccaaggacaagaagaagccccagcgcgacucccaggcccagaagucccccgucaaguccaaguccacccaccgcauccagcacaacaucgacuaccucaagcaccucuccaaggucaagaagauccccuccgacuucgagggcuccggcuacaccgaccuccaggagcgcggcgacaacgacaucucccccuucuccggcgacggccagcccuucaaggacauccccggcaagggcgaggccaccggccccgaccucgagggcaaggacauccagaccggcuucgccggccccuccgaggccgaguccacccaccucgacaccaagaagcccggcuacaacgagauccccgagcgcgaggagaacggcggcaacaccaucggcacccgcgacgagaccgccaaggaggccgacgccgucgacgucucccucgucgagggcuccaacgacaucaugggcuccaccaacuucaaggagcuccccggccgcgagggcaaccgcgucgacgccggcucccagaacgcccaccagggcaaggucgaguuccacuacccccccgcccccuccaaggagaagcgcaaggagggcuccuccgacgccgccgaguccaccaacuacaacgagauccccaagaacggcaagggcuccacccgcaagggcgucgaccacuccaaccgcaaccaggccacccucaacgagaagcagcgcuuccccuccaagggcaagucccagggccuccccauccccucccgcggccucgacaacgagaucaagaacgagauggacuccuucaacggccccucccacgagaacaucaucacccacggccgcaaguaccacuacgucccccaccgccagaacaacuccacccgcaacaagggcaugccccagggcaagggcuccuggggccgccagccccacuccaaccgccgcuucuccucccgccgccgcgacgacuccuccgaguccuccgacuccggcuccuccuccgaguccgacggcgacuga

SEQ ID NO: 45913 - RNA, 3000 nt, Artificial Sequence
  derived and/or modified sequence opt2 from MERTK__Homo_sapiens__NP_006334
augggccccgccccccucccccuccuccucggccucuuccuccccgcccucuggcgccgcgccaucaccgaggcccgcgaggaggccaagcccuacccccucuuccccggccccuuccccggcucccuccagaccgaccacaccccccuccucucccucccccacgccuccggcuaccagcccgcccucauguucucccccacccagcccggccgcccccacaccggcaacgucgccaucccccaggucaccuccgucgaguccaagccccuccccccccucgccuucaagcacaccgucggccacaucauccucuccgagcacaagggcgucaaguucaacugcuccaucuccguccccaacaucuaccaggacaccaccaucuccugguggaaggacggcaaggagcuccucggcgcccaccacgccaucacccaguucuaccccgacgacgaggucaccgccaucaucgccuccuucuccaucaccuccguccagcgcuccgacaacggcuccuacaucugcaagaugaagaucaacaacgaggagaucgucuccgaccccaucuacaucgagguccagggccucccccacuucaccaagcagcccgaguccaugaacgucacccgcaacaccgccuucaaccucaccugccaggccgucggcccccccgagcccgucaacaucuucuggguccagaacuccucccgcgucaacgagcagcccgagaagucccccuccguccucaccguccccggccucaccgagauggccgucuucuccugcgaggcccacaacgacaagggccucaccgucuccaagggcguccagaucaacaucaaggccauccccuccccccccaccgaggucuccauccgcaacuccaccgcccacuccauccucaucuccuggguccccggcuucgacggcuacucccccuuccgcaacugcuccauccaggucaaggaggccgacccccucuccaacggcuccgucaugaucuucaacaccuccgcccucccccaccucuaccagaucaagcagcuccaggcccucgccaacuacuccaucggcgucuccugcaugaacgagaucggcugguccgccgucucccccuggauccucgccuccaccaccgagggcgcccccuccgucgccccccucaacgucaccgucuuccucaacgaguccuccgacaacgucgacauccgcuggaugaagccccccaccaagcagcaggacggcgagcucgucggcuaccgcaucucccacgucuggcaguccgccggcaucuccaaggagcuccucgaggaggucggccagaacggcucccgcgcccgcaucuccguccagguccacaacgccaccugcaccguccgcaucgccgccgucacccgcggcggcgucggccccuucuccgaccccgucaagaucuucauccccgcccacggcugggucgacuacgcccccuccuccacccccgcccccggcaacgccgaccccguccucaucaucuucggcugcuucugcggcuucauccucaucggccucauccucuacaucucccucgccauccgcaagcgcguccaggagaccaaguucggcaacgccuucaccgaggaggacuccgagcucgucgucaacuacaucgccaagaaguccuucugccgccgcgccaucgagcucacccuccacucccucggcgucuccgaggagcuccagaacaagcucgaggacgucgucaucgaccgcaaccuccucauccucggcaagauccucggcgagggcgaguucggcuccgucauggagggcaaccucaagcaggaggacggcaccucccucaaggucgccgucaagaccaugaagcucgacaacuccucccagcgcgagaucgaggaguuccucuccgaggccgccugcaugaaggacuucucccaccccaacgucauccgccuccucggcgucugcaucgagauguccucccagggcauccccaagcccauggucauccuccccuucaugaaguacggcgaccuccacaccuaccuccucuacucccgccucgagaccggccccaagcacaucccccuccagacccuccucaaguucauggucgacaucgcccucggcauggaguaccucuccaaccgcaacuuccuccaccgcgaccucgccgcccgcaacugcaugcuccgcgacgacaugaccgucugcgucgccgacuucggccucuccaagaagaucuacuccggcgacuacuaccgccagggccgcaucgccaagaugcccgucaaguggaucgccaucgagucccucgccgaccgcgucuacaccuccaaguccgacgucugggccuucggcgucaccaugugggagaucgccacccgcggcaugacccccuaccccggcguccagaaccacgagauguacgacuaccuccuccacggccaccgccucaagcagcccgaggacugccucgacgagcucuacgagaucauguacuccugcuggcgcaccgacccccucgaccgccccaccuucuccguccuccgccuccagcucgagaagcuccucgagucccuccccgacguccgcaaccaggccgacgucaucuacgucaacacccagcuccucgaguccuccgagggccucgcccagggcuccacccucgccccccucgaccucaacaucgaccccgacuccaucaucgccuccugcaccccccgcgccgccaucuccgucgucaccgccgagguccacgacuccaagccccacgagggccgcuacauccucaacggcggcuccgaggagugggaggaccucaccuccgcccccuccgccgccgucaccgccgagaagaacuccguccuccccggcgagcgccucguccgcaacggcgucuccuggucccacuccuccaugcucccccucggcuccucccuccccgacgagcuccucuucgccgacgacuccuccgagggcuccgagguccucauguga

SEQ ID NO: 45914 - RNA, 1089 nt, Artificial Sequence
  derived and/or modified sequence opt2 from MESDC1__Homo_sapiens__NP_072088
auggccuccggcuccgccggcaagcccaccggcgaggccgccucccccgcccccgccuccgccaucggcggcgccuccucccagccccgcaagcgccucgucuccgucugcgaccacugcaagggcaagaugcagcucgucgccgaccuccuccuccucuccuccgaggcccgccccguccucuucgagggccccgccuccuccggcgccggcgccgaguccuucgagcagugccgcgacaccaucaucgcccgcaccaagggccucuccauccucacccacgacguccagucccagcucaacaugggccgcuucggcgaggccggcgacucccucgucgagcucggcgaccucgucgucucccucaccgagugcuccgcccacgccgccuaccucgccgccgucgccacccccggcgcccagcccgcccagcccggccucgucgaccgcuaccgcgucacccgcugccgccacgaggucgagcagggcugcgccguccuccgcgccaccccccucgccgacaugaccccccagcuccuccucgaggucucccagggccucucccgcaaccucaaguuccucaccgacgccugcgcccucgccuccgacaagucccgcgaccgcuucucccgcgagcaguucaagcucggcgucaagugcauguccaccuccgccuccgcccuccucgccugcguccgcgaggucaaggucgcccccuccgagcucgcccgcucccgcugcgcccucuucuccggcccccucguccaggccgucuccgcccucgucggcuucgccaccgagccccaguuccucggccgcgccgccgccgucuccgccgagggcaaggccguccagaccgccauccucggcggcgccauguccgucgucuccgccugcguccuccucacccagugccuccgcgaccucgcccagcaccccgacggcggcgccaagauguccgaccaccgcgagcgccuccgcaacuccgccugcgccgucuccgagggcugcacccuccucucccaggcccuccgcgagcgcuccuccccccgcacccucccccccgucaacuccaacuccgucaacuga

SEQ ID NO: 45915 - RNA, 705 nt, Artificial Sequence
  derived and/or modified sequence opt2 from MESDC2__Homo_sapiens__NP_055969
auggccgccucccgcugggcccgcaaggccgucguccuccucugcgccuccgaccuccuccuccuccuccuccuccuccccccccccggcuccugcgccgccgagggcucccccggcacccccgacgaguccaccccccccccccgcaagaagaagaaggacauccgcgacuacaacgacgccgacauggcccgccuccucgagcagugggagaaggacgacgacaucgaggagggcgaccuccccgagcacaagcgccccuccgcccccgucgacuucuccaagaucgaccccuccaagcccgaguccauccucaagaugaccaagaagggcaagacccucaugauguucgucaccgucuccggcucccccaccgagaaggagaccgaggagaucaccucccucuggcagggcucccucuucaacgccaacuacgacguccagcgcuucaucgucggcuccgaccgcgccaucuucaugcuccgcgacggcuccuacgccugggagaucaaggacuuccucgucggccaggaccgcugcgccgacgucacccucgagggccaggucuaccccggcaagggcggcggcuccaaggagaagaacaagaccaagcaggacaagggcaagaagaagaaggagggcgaccucaagucccgcuccuccaaggaggagaaccgcgccggcaacaagcgcgaggaccucuga

SEQ ID NO: 45916 - RNA, 1194 nt, Artificial Sequence
  derived and/or modified sequence opt2 from MESP2__Homo_sapiens__NP_001035047
auggcccaguccccccccccccagucccuccucggccacgaccacuggaucuucgcccagggcuggggcugggccggccacugggacuccaccucccccgccuccuccuccgacuccuccggcuccugccccugcgacggcgcccgcggccucccccagccccagccccccuccugcuccucccgcgccgccgaggccgccgccaccaccccccgccgcgcccgcaccggccccgccggcggccagcgccaguccgccuccgagcgcgagaagcuccgcaugcgcacccucgcccgcgcccuccacgagcuccgccgcuuccucccccccucccucgcccccgccggccagucccucaccaagaucgagacccuccgccucgccauccgcuacaucggccaccucuccgccguccucggccucuccgaggagucccuccagugccgccgccgccagcgcggcgacgccggcucccccuggggcugcccccucugccccgaccgcggccccgccgaggcccagacccaggccgagggccagggccagggccagggccagggccagggccagggccagggccagggccagggccagggccagggccagggccagggccgccgccccggccucgucuccgccguccucgccgaggccuccuggggcucccccuccgccugccccggcgcccaggccgcccccgagcgccucggccgcggcguccacgacaccgaccccugggccaccccccccuacugccccaagauccaguccccccccuacuccucccagggcaccaccuccgacgccucccucuggacccccccccagggcugccccuggacccaguccucccccgagccccgcaacccccccguccccuggaccgccgcccccgccacccucgagcucgccgccgucuaccagggccucuccgucucccccgagcccugccucucccucggcgcccccucccuccucccccaccccuccugccagcgccuccagccccagacccccggccgcugcuggucccacuccgccgaggucguccccaacuccgaggaccagggccccggcgccgccuuccagcucuccgaggccucccccccccaguccuccggccuccgcuucuccggcugccccgagcucuggcaggaggaccucgagggcgcccgccucggcaucuucuacuga

SEQ ID NO: 45917 - RNA, 879 nt, Artificial Sequence
  derived and/or modified sequence opt2 from MEST__Homo_sapiens__NP_001240831
augcgcgagugguggguccaggucggccuccucgccgucccccuccucgccgccuaccuccacaucccccccccccagcucucccccgcccuccacuccuggaaguccuccggcaaguucuucaccuacaagggccuccgcaucuucuaccaggacuccgucggcgucgucggcucccccgagaucgucguccuccuccacggcuuccccaccuccuccuacgacugguacaagaucugggagggccucacccuccgcuuccaccgcgucaucgcccucgacuuccucggcuucggcuucuccgacaagccccgcccccaccacuacuccaucuucgagcaggccuccaucgucgaggcccuccuccgccaccucggccuccagaaccgccgcaucaaccuccucucccacgacuacggcgacaucgucgcccaggagcuccucuaccgcuacaagcagaaccgcuccggccgccucaccaucaagucccucugccucuccaacggcggcaucuuccccgagacccaccgcccccuccuccuccagaagcuccucaaggacggcggcguccucucccccauccucacccgccucaugaacuucuucgucuucucccgcggccuccuccaguacaucaaccagcgcaagaaguuccgccgccgcugggucggcgcccucgccuccgucaccauccccauccacuucaucuacggcccccucgaccccgucaaccccuaccccgaguuccucgagcucuaccgcaagacccucccccgcuccaccgucuccauccucgacgaccacaucucccacuacccccagcucgaggaccccaugggcuuccucaacgccuacaugggcuucaucaacuccuucuga

SEQ ID NO: 45918 - RNA, 1008 nt, Artificial Sequence
  derived and/or modified sequence opt2 from METAP1D__Homo_sapiens__NP_954697
auggccgcccccuccggcguccaccuccucguccgccgcggcucccaccgcaucuucuccuccccccucaaccacaucuaccuccacaagcaguccuccucccagcagcgccgcaacuucuucuuccgccgccagcgcgacaucucccacuccaucguccuccccgccgccgucuccuccgcccaccccguccccaagcacaucaagaagcccgacuacgucaccaccggcaucguccccgacuggggcgacuccaucgaggucaagaacgaggaccagauccagggccuccaccaggccugccagcucgcccgccacguccuccuccucgccggcaagucccucaaggucgacaugaccaccgaggagaucgacgcccucguccaccgcgagaucaucucccacaacgccuaccccuccccccucggcuacggcggcuuccccaaguccgucugcaccuccgucaacaacguccucugccacggcauccccgacucccgcccccuccaggacggcgacaucaucaacaucgacgucaccgucuacuacaacggcuaccacggcgacaccuccgagaccuuccucgucggcaacgucgacgagugcggcaagaagcucgucgaggucgcccgccgcugccgcgacgaggccaucgccgccugccgcgccggcgcccccuucuccgucaucggcaacaccaucucccacaucacccaccagaacggcuuccaggucugcccccacuucgucggccacggcaucggcuccuacuuccacggccaccccgagaucuggcaccacgccaacgacuccgaccuccccauggaggagggcauggccuucaccaucgagcccaucaucaccgagggcucccccgaguucaagguccucgaggacgccuggaccgucgucucccucgacaaccagcgcuccgcccaguucgagcacaccguccucaucaccucccgcggcgcccagauccucaccaagcucccccacgaggccuga

SEQ ID NO: 45919 - RNA, 1161 nt, Artificial Sequence
  derived and/or modified sequence opt2 from METAP1__Homo_sapiens__NP_055958
auggccgccgucgagacccgcgucugcgagaccgacggcugcuccuccgaggccaagcuccagugccccaccugcaucaagcucggcauccagggcuccuacuucugcucccaggagugcuucaagggcuccugggccacccacaagcuccuccacaagaaggccaaggacgagaaggccaagcgcgaggucuccuccuggaccgucgagggcgacaucaacaccgaccccugggccggcuaccgcuacaccggcaagcuccgcccccacuacccccucaugcccacccgccccguccccuccuacauccagcgccccgacuacgccgaccacccccucggcauguccgaguccgagcaggcccucaagggcaccucccagaucaagcuccucuccuccgaggacaucgagggcaugcgccucgucugccgccucgcccgcgagguccucgacgucgccgccggcaugaucaagcccggcgucaccaccgaggagaucgaccacgccguccaccucgccugcaucgcccgcaacugcuaccccuccccccucaacuacuacaacuuccccaaguccugcugcaccuccgucaacgaggucaucugccacggcauccccgaccgccgcccccuccaggagggcgacaucgucaacgucgacaucacccucuaccgcaacggcuaccacggcgaccucaacgagaccuucuucgucggcgaggucgacgacggcgcccgcaagcucguccagaccaccuacgagugccucaugcaggccaucgacgccgucaagcccggcguccgcuaccgcgagcucggcaacaucauccagaagcacgcccaggccaacggcuucuccgucguccgcuccuacugcggccacggcauccacaagcucuuccacaccgcccccaacgucccccacuacgccaagaacaaggccgucggcgucaugaaguccggccacgucuucaccaucgagcccaugaucugcgagggcggcuggcaggacgagaccuggcccgacggcuggaccgccgucacccgcgacggcaagcgcuccgcccaguucgagcacacccuccucgucaccgacaccggcugcgagauccucacccgccgccucgacuccgcccgcccccacuucaugucccaguucuga

SEQ ID NO: 45920 - RNA, 1437 nt, Artificial Sequence
  derived and/or modified sequence opt2 from METAP2__Homo_sapiens__NP_006829
auggccggcgucgaggaggucgccgccuccggcucccaccucaacggcgaccucgaccccgacgaccgcgaggagggcgccgccuccaccgccgaggaggccgccaagaagaagcgccgcaagaagaagaaguccaagggccccuccgccgccggcgagcaggagcccgacaaggaguccggcgccuccgucgacgaggucgcccgccagcucgagcgcuccgcccucgaggacaaggagcgcgacgaggacgacgaggacggcgacggcgacggcgacggcgccaccggcaagaagaagaagaagaagaagaagaagcgcggccccaagguccagaccgacccccccuccguccccaucugcgaccucuaccccaacggcgucuuccccaagggccaggagugcgaguacccccccacccaggacggccgcaccgccgccuggcgcaccaccuccgaggagaagaaggcccucgaccaggccuccgaggagaucuggaacgacuuccgcgaggccgccgaggcccaccgccagguccgcaaguacgucauguccuggaucaagcccggcaugaccaugaucgagaucugcgagaagcucgaggacugcucccgcaagcucaucaaggagaacggccucaacgccggccucgccuuccccaccggcugcucccucaacaacugcgccgcccacuacacccccaacgccggcgacaccaccguccuccaguacgacgacaucugcaagaucgacuucggcacccacaucuccggccgcaucaucgacugcgccuucaccgucaccuucaaccccaaguacgacacccuccucaaggccgucaaggacgccaccaacaccggcaucaagugcgccggcaucgacguccgccucugcgacgucggcgaggccauccaggaggucauggaguccuacgaggucgagaucgacggcaagaccuaccaggucaagcccauccgcaaccucaacggccacuccaucggccaguaccgcauccacgccggcaagaccguccccaucgucaagggcggcgaggccacccgcauggaggagggcgaggucuacgccaucgagaccuucggcuccaccggcaagggcgucguccacgacgacauggagugcucccacuacaugaagaacuucgacgucggccacguccccauccgccucccccgcaccaagcaccuccucaacgucaucaacgagaacuucggcacccucgccuucugccgccgcuggcucgaccgccucggcgaguccaaguaccucauggcccucaagaaccucugcgaccucggcaucgucgaccccuaccccccccucugcgacaucaagggcuccuacaccgcccaguucgagcacaccauccuccuccgccccaccugcaaggaggucgucucccgcggcgacgacuacuga

SEQ ID NO: 45921 - RNA, 4173 nt, Artificial Sequence
  derived and/or modified sequence opt2 from MET__Homo_sapiens__NP_000236
augaaggcccccgccguccucgcccccggcauccucguccuccucuucacccucguccagcgcuccaacggcgagugcaaggaggcccucgccaaguccgagaugaacgucaacaugaaguaccagcuccccaacuucaccgccgagacccccauccagaacgucauccuccacgagcaccacaucuuccucggcgccaccaacuacaucuacguccucaacgaggaggaccuccagaaggucgccgaguacaagaccggccccguccucgagcaccccgacugcuuccccugccaggacugcuccuccaaggccaaccucuccggcggcgucuggaaggacaacaucaacauggcccucgucgucgacaccuacuacgacgaccagcucaucuccugcggcuccgucaaccgcggcaccugccagcgccacgucuucccccacaaccacaccgccgacauccaguccgagguccacugcaucuucuccccccagaucgaggagcccucccagugccccgacugcgucgucuccgcccucggcgccaagguccucuccuccgucaaggaccgcuucaucaacuucuucgucggcaacaccaucaacuccuccuacuuccccgaccacccccuccacuccaucuccguccgccgccucaaggagaccaaggacggcuucauguuccucaccgaccaguccuacaucgacguccuccccgaguuccgcgacuccuaccccaucaaguacguccacgccuucgaguccaacaacuucaucuacuuccucaccguccagcgcgagacccucgacgcccagaccuuccacacccgcaucauccgcuucugcuccaucaacuccggccuccacuccuacauggagaugccccucgagugcauccucaccgagaagcgcaagaagcgcuccaccaagaaggaggucuucaacauccuccaggccgccuacgucuccaagcccggcgcccagcucgcccgccagaucggcgccucccucaacgacgacauccucuucggcgucuucgcccaguccaagcccgacuccgccgagcccauggaccgcuccgccaugugcgccuuccccaucaaguacgucaacgacuucuucaacaagaucgucaacaagaacaacguccgcugccuccagcacuucuacggccccaaccacgagcacugcuucaaccgcacccuccuccgcaacuccuccggcugcgaggcccgccgcgacgaguaccgcaccgaguucaccaccgcccuccagcgcgucgaccucuucaugggccaguucuccgagguccuccucaccuccaucuccaccuucaucaagggcgaccucaccaucgccaaccucggcaccuccgagggccgcuucaugcaggucgucgucucccgcuccggccccuccaccccccacgucaacuuccuccucgacucccaccccgucucccccgaggucaucgucgagcacacccucaaccagaacggcuacacccucgucaucaccggcaagaagaucaccaagaucccccucaacggccucggcugccgccacuuccaguccugcucccagugccucuccgccccccccuucguccagugcggcuggugccacgacaagugcguccgcuccgaggagugccucuccggcaccuggacccagcagaucugccuccccgccaucuacaaggucuuccccaacuccgccccccucgagggcggcacccgccucaccaucugcggcugggacuucggcuuccgccgcaacaacaaguucgaccucaagaagacccgcguccuccucggcaacgaguccugcacccucacccucuccgaguccaccaugaacacccucaagugcaccgucggccccgccaugaacaagcacuucaacauguccaucaucaucuccaacggccacggcaccacccaguacuccaccuucuccuacgucgaccccgucaucaccuccaucucccccaaguacggccccauggccggcggcacccuccucacccucaccggcaacuaccucaacuccggcaacucccgccacaucuccaucggcggcaagaccugcacccucaaguccgucuccaacuccauccucgagugcuacacccccgcccagaccaucuccaccgaguucgccgucaagcucaagaucgaccucgccaaccgcgagaccuccaucuucuccuaccgcgaggaccccaucgucuacgagauccaccccaccaaguccuucaucuccggcggcuccaccaucaccggcgucggcaagaaccucaacuccgucuccgucccccgcauggucaucaacguccacgaggccggccgcaacuucaccgucgccugccagcaccgcuccaacuccgagaucaucugcugcaccacccccucccuccagcagcucaaccuccagcucccccucaagaccaaggccuucuucaugcucgacggcauccucuccaaguacuucgaccucaucuacguccacaaccccgucuucaagcccuucgagaagcccgucaugaucuccaugggcaacgagaacguccucgagaucaagggcaacgacaucgaccccgaggccgucaagggcgagguccucaaggucggcaacaaguccugcgagaacauccaccuccacuccgaggccguccucugcaccguccccaacgaccuccucaagcucaacuccgagcucaacaucgaguggaagcaggccaucuccuccaccguccucggcaaggucaucguccagcccgaccagaacuucaccggccucaucgccggcgucgucuccaucuccaccgcccuccuccuccuccucggcuucuuccucuggcucaagaagcgcaagcagaucaaggaccucggcuccgagcucguccgcuacgacgcccgcguccacaccccccaccucgaccgccucgucuccgcccgcuccgucucccccaccaccgagauggucuccaacgaguccgucgacuaccgcgccaccuuccccgaggaccaguuccccaacuccucccagaacggcuccugccgccagguccaguacccccucaccgacaugucccccauccucaccuccggcgacuccgacaucuccuccccccuccuccagaacaccguccacaucgaccucuccgcccucaaccccgagcucguccaggccguccagcacgucgucaucggccccuccucccucaucguccacuucaacgaggucaucggccgcggccacuucggcugcgucuaccacggcacccuccucgacaacgacggcaagaagauccacugcgccgucaagucccucaaccgcaucaccgacaucggcgaggucucccaguuccucaccgagggcaucaucaugaaggacuucucccaccccaacguccucucccuccucggcaucugccuccgcuccgagggcuccccccucgucguccuccccuacaugaagcacggcgaccuccgcaacuucauccgcaacgagacccacaaccccaccgucaaggaccucaucggcuucggccuccaggucgccaagggcaugaaguaccucgccuccaagaaguucguccaccgcgaccucgccgcccgcaacugcaugcucgacgagaaguucaccgucaaggucgccgacuucggccucgcccgcgacauguacgacaaggaguacuacuccguccacaacaagaccggcgccaagcuccccgucaaguggauggcccucgagucccuccagacccagaaguucaccaccaaguccgacgucugguccuucggcguccuccucugggagcucaugacccgcggcgccccccccuaccccgacgucaacaccuucgacaucaccgucuaccuccuccagggccgccgccuccuccagcccgaguacugccccgacccccucuacgaggucaugcucaagugcuggcaccccaaggccgagaugcgccccuccuucuccgagcucgucucccgcaucuccgccaucuucuccaccuucaucggcgagcacuacguccacgucaacgccaccuacgucaacgucaagugcgucgcccccuaccccucccuccucuccuccgaggacaacgccgacgacgaggucgacacccgccccgccuccuucugggagaccuccuga

SEQ ID NO: 45922 - RNA, 882 nt, Artificial Sequence
  derived and/or modified sequence opt2 from METRN__Homo_sapiens__NP_076947
augggcuuccccgccgccgcccuccucugcgcccucugcugcggccuccucgcccccgccgcccgcgccggcuacuccgaggagcgcugcuccuggcgcggcuccggccucacccaggagcccggcuccgucggccagcucgcccucgccugcgccgagggcgccgucgaguggcucuaccccgccggcgcccuccgccucacccucggcggccccgacccccgcgcccgccccggcaucgccugccuccgccccguccgccccuucgccggcgcccaggucuucgccgagcgcgccggcggcgcccucgagcuccuccucgccgagggccccggccccgccggcggccgcugcguccgcuggggcccccgcgagcgccgcgcccucuuccuccaggccaccccccaccaggacaucucccgccgcgucgccgccuuccgcuucgagcuccgcgaggacggccgccccgagcuccccccccaggcccacggccucggcgucgacggcgccugccgccccugcuccgacgccgagcuccuccucgccgccugcaccuccgacuucgucauccacggcaucauccacggcgucacccacgacgucgagcuccaggaguccgucaucaccgucgucgccgcccgcguccuccgccagacccccccccucuuccaggccggccgcuccggcgaccagggccucaccuccauccgcaccccccuccgcugcggcguccaccccggccccggcaccuuccucuucaugggcuggucccgcuucggcgaggcccgccucggcugcgccccccgcuuccaggaguuccgccgcgccuacgaggccgcccgcgccgcccaccuccaccccugcgaggucgcccuccacuga

SEQ ID NO: 45923 - RNA, 1632 nt, Artificial Sequence
  derived and/or modified sequence opt2 from METTL13__Homo_sapiens__NP_001007240
augaaccuccuccccaaguccucccgcgaguucggcuccgucgacuacugggagaaguucuuccagcagcgcggcaagaaggccuucgagugguacggcaccuaccucgagcucugcggcguccuccacaaguacaucaagccccgcgagaagguccucgucaucggcugcggcaacuccgagcucuccgagcagcucuacgacgucggcuaccgcgacaucgucaacaucgacaucuccgaggucgucaucaagcagaugaaggagugcaacgccacccgccgcccccagauguccuuccucaagauggacaugacccagauggaguuccccgacgccuccuuccaggucguccucgacaagggcacccucgacgccguccucaccgacgaggaggagaagacccuccagcaggucgaccgcaugcucgccgaggucggccgcguccuccagggccgcgagaccgaguggcucuucggcauggacgagggccgcaagcagcucgccgccuccgccggcuuccgccgccucaucaccgucgcccuccaccgcggccagcaguacgaguccauggaccacauccaggccgagcucuccgcccgcgucauggagcucgcccccgccggcaugcccacccagcagcagguccccuuccucuccgucggcggcgacaucggcguccgcaccguccagcaccaggacugcuccccccucuccggcgacuacgucaucgaggacguccagggcgacgacaagcgcuacuuccgccgccucaucuuccucuccaaccgcaacgucguccaguccgaggcccgccuccucaaggacgucucccacaaggcccagaagaagcgcaagaaggaccgcaagaagcagcgccccgccgacgccgaggaccuccccgccgcccccggccaguccaucgacaaguccuaccucugcugcgagcaccacaaggccaugaucgccggccucgcccuccuccgcaaccccgagcuccuccucgagaucccccucgcccuccucgucgucggccucggcggcggcucccucccccucuucguccacgaccacuuccccaaguccugcaucgacgccgucgagaucgaccccuccaugcucgaggucgccacccagugguucggcuucucccaguccgaccgcaugaagguccacaucgccgacggccucgacuacaucgccucccucgccggcggcggcgaggcccgccccugcuacgacgucaucauguucgacgucgacuccaaggaccccacccucggcauguccugccccccccccgccuucgucgagcaguccuuccuccagaaggucaaguccauccucacccccgagggcgucuucauccucaaccucgucugccgcgaccucggccucaaggacuccguccucgccggccucaaggccgucuucccccuccucuacguccgccgcaucgagggcgaggucaacgagauccucuucugccagcuccaccccgagcagaagcucgccacccccgagcuccucgagaccgcccaggcccucgagcgcacccuccgcaagcccggccgcggcugggacgacaccuacguccucuccgacaugcucaagaccgucaagaucgucuga

SEQ ID NO: 45924 - RNA, 1689 nt, Artificial Sequence
  derived and/or modified sequence opt2 from METTL16__Homo_sapiens__NP_076991
auggcccucuccaaguccaugcacgcccgcaaccgcuacaaggacaagccccccgacuucgccuaccucgccuccaaguaccccgacuucaagcagcacguccagaucaaccucaacggccgcgucucccucaacuucaaggaccccgaggccguccgcgcccucaccugcacccuccuccgcgaggacuucggccucuccaucgacaucccccucgagcgccucauccccaccgucccccuccgccucaacuacauccacugggucgaggaccucaucggccaccaggacuccgacaaguccacccuccgccgcggcaucgacaucggcaccggcgccuccugcaucuacccccuccucggcgccacccucaacggcugguacuuccucgccaccgaggucgacgacaugugcuucaacuacgccaagaagaacgucgagcagaacaaccucuccgaccucaucaaggucgucaaggucccccagaagacccuccucauggacgcccucaaggaggaguccgagaucaucuacgacuucugcaugugcaacccccccuucuucgccaaccagcucgaggccaagggcgucaacucccgcaacccccgccgccccccccccuccuccgucaacaccggcggcaucaccgagaucauggccgagggcggcgagcucgaguucgucaagcgcaucauccacgacucccuccagcucaagaagcgccuccgcugguacuccugcaugcucggcaagaagugcucccucgccccccucaaggaggagcuccgcauccagggcguccccaaggucaccuacaccgaguucugccagggccgcaccaugcgcugggcccucgccugguccuucuacgacgacgucaccguccccuccccccccuccaagcgccgcaagcucgagaagccccgcaagcccaucaccuucgucguccucgccuccgucaugaaggagcucucccucaaggccuccccccuccgcuccgagaccgccgagggcaucgucgucgucaccaccuggaucgagaagauccucaccgaccucaagguccagcacaagcgcguccccugcggcaaggaggaggucucccucuuccucaccgccaucgagaacuccuggauccaccuccgccgcaagaagcgcgagcgcguccgccagcuccgcgaggucccccgcgcccccgaggacgucauccaggcccucgaggagaagaagcccacccccaaggaguccggcaacucccaggagcucgcccgcggcccccaggagcgcacccccugcggccccgcccuccgcgagggcgaggccgccgccgucgagggccccugccccucccaggagucccucucccaggaggagaaccccgagcccaccgaggacgagcgcuccgaggagaagggcggcgucgagguccucgaguccugccagggcuccuccaacggcgcccaggaccaggaggccuccgagcaguucggcucccccgucgccgagcgcggcaagcgccuccccggcgucgccggccaguaccucuucaagugccucaucaacgucaagaaggaggucgacgacgcccucgucgagaugcacugggucgagggccagaaccgcgaccucaugaaccagcucugcaccuacauccgcaaccagaucuuccgccucgucgccgucaacuga

SEQ ID NO: 45925 - RNA, 1437 nt, Artificial Sequence
  derived and/or modified sequence opt2 from METTL17__Homo_sapiens__NP_001025162
auggccgccgcccucaagugccuccucacccucggccgcuggugccccggccucggcgucgccccccaggcccgcgcccucgccgcccucguccccggcgucacccaggucgacaacaaguccggcuuccuccagaagcgcccccaccgccagcaccccggcauccucaagcucccccacguccgccucccccaggcccucgccaacggcgcccagcuccuccuccucggcuccgccggccccaccauggagaaccagguccagacccucaccuccuaccucuggucccgccaccuccccgucgagcccgaggagcuccagcgccgcgcccgccaccucgagaagaaguuccucgagaaccccgaccucucccagaccgaggagaagcuccgcggcgccguccuccacgcccuccgcaagaccaccuaccacuggcaggagcucuccuacaccgagggccucucccucgucuacauggccgcccgccucgacggcggcuucgccgccgucucccgcgccuuccacgagauccgcgcccgcaaccccgccuuccagccccagacccucauggacuucggcuccggcaccggcuccgucaccugggccgcccacuccaucuggggccagucccuccgcgaguacaugugcgucgaccgcuccgccgccaugcucguccucgccgagaagcuccucaagggcggcuccgaguccggcgagcccuacauccccggcgucuucuuccgccaguuccuccccgucucccccaagguccaguucgacgucgucgucuccgccuucucccucuccgagcuccccuccaaggccgaccgcaccgaggucguccagacccucuggcgcaagaccggccacuuccucguccucgucgagaacggcaccaaggccggccacucccuccucauggacgcccgcgaccucguccucaagggcaaggagaaguccccccucgacccccgccccggcuucgucuucgcccccugcccccacgagcuccccugcccccagcucaccaaccucgccugcuccuucucccaggccuaccaccccauccccuucuccuggaacaagaagcccaaggaggagaaguucuccauggucauccucgcccgcggcucccccgaggaggcccaccgcuggccccgcaucacccagcccguccucaagcgcccccgccacguccacugccaccucugcugccccgacggccacaugcagcacgccguccucaccgcccgccgccacggccgcuacggcggcugcgaccagaaccagugggacgucgccggcuccugcuccccccgccagcaccucuucccccagggcuucgucucccucugccccugccagcuccucggccgcuccuucaccugcgccuacuccgucugcgucuccuccaucuacggcuccggcucccucuga

SEQ ID NO: 45926 - RNA, 1119 nt, Artificial Sequence
  derived and/or modified sequence opt2 from METTL18__Homo_sapiens__NP_001307130
augaccuuccaguucaacuucaccaucgaggaccaccucgagaacgagcucacccccauccgcgacggcgcccucacccucgacuccuccaaggagcucuccgucuccgagucccagaagggcgaggagcgcgaccgcaagugcuccgccgagcaguucgaccucccccaggaccaccucugggagcacaaguccauggagaacgccgcccccucccaggacaccgacuccccccucuccgccgccuccuccucccgcaaccucgagccccacggcaagcagcccucccuccgcgccgccaaggagcacgccaugcccaaggaccucaagaagaugcucgagaacaaggucaucgagacccuccccggcuuccagcacgucaagcucuccgucgucaagaccauccuccucaaggagaacuuccccggcgagaacaucgucuccaaguccuucuccucccacuccgaccucaucaccggcgucuacgagggcggccucaagaucugggagugcaccuucgaccuccucgccuacuucaccaaggccaaggucaaguucgccggcaagaagguccucgaccucggcugcggcuccggccuccucggcaucaccgccuucaagggcggcuccaaggagauccacuuccaggacuacaacuccauggucaucgacgaggucacccuccccaacgucgucgccaacuccacccucgaggacgaggagaacgacgucaacgagcccgacgucaagcgcugccgcaagcccaaggucacccagcucuacaagugccgcuucuucuccggcgagugguccgaguucugcaagcucguccucuccuccgagaagcucuucgucaaguacgaccucauccucaccuccgagaccaucuacaaccccgacuacuacuccaaccuccaccagaccuuccuccgccuccucuccaagaacggccgcguccuccucgccuccaaggcccacuacuucggcgucggcggcggcguccaccucuuccagaaguucgucgaggagcgcgacgucuucaagacccgcauccucaagaucaucgacgagggccucaagcgcuucaucaucgagaucaccuucaaguuccccggcuga

SEQ ID NO: 45927 - RNA, 831 nt, Artificial Sequence
  derived and/or modified sequence opt2 from METTL1__Homo_sapiens__NP_005362
auggccgccgagacccgcaacgucgccggcgccgaggccccccccccccagaagcgcuacuaccgccagcgcgcccacuccaaccccauggccgaccacacccuccgcuaccccgucaagcccgaggagauggacugguccgagcucuaccccgaguucuucgccccccucacccagaaccagucccacgacgaccccaaggacaagaaggagaagcgcgcccaggcccaggucgaguucgccgacaucggcugcggcuacggcggccuccucgucgagcucuccccccucuuccccgacacccucauccucggccucgagauccgcgucaaggucuccgacuacguccaggaccgcauccgcgcccuccgcgccgcccccgccggcggcuuccagaacaucgccugccuccgcuccaacgccaugaagcaccuccccaacuucuucuacaagggccagcucaccaagauguucuuccucuuccccgacccccacuucaagcgcaccaagcacaaguggcgcaucaucucccccacccuccucgccgaguacgccuacguccuccgcgucggcggccucgucuacaccaucaccgacguccucgagcuccacgacuggaugugcacccacuucgaggagcacccccucuucgagcgcgucccccucgaggaccucuccgaggaccccgucgucggccaccucggcaccuccaccgaggagggcaagaagguccuccgcaacggcggcaagaacuuccccgccaucuuccgccgcauccaggaccccguccuccaggccgucaccucccagaccucccuccccggccacuga

SEQ ID NO: 45928 - RNA, 657 nt, Artificial Sequence
  derived and/or modified sequence opt2 from METTL21A__Homo_sapiens__NP_660323
auggcccucguccccuacgaggagaccaccgaguucggccuccagaaguuccacaagccccucgccaccuucuccuucgccaaccacaccauccagauccgccaggacuggcgccaccucggcgucgccgccgucgucugggacgccgccaucguccucuccaccuaccucgagaugggcgccgucgagcuccgcggccgcuccgccgucgagcucggcgccggcaccggccucgucggcaucgucgccgcccuccucggcgcccacgucaccaucaccgaccgcaaggucgcccucgaguuccucaaguccaacguccaggccaaccuccccccccacauccagaccaagaccgucgucaaggagcucaccuggggccagaaccucggcuccuucucccccggcgaguucgaccucauccucggcgccgacaucaucuaccucgaggagaccuucaccgaccuccuccagacccucgagcaccucugcuccaaccacuccgucauccuccucgccugccgcauccgcuacgagcgcgacaacaacuuccucgccaugcucgagcgccaguucaccguccgcaagguccacuacgaccccgagaaggacguccacaucuacgaggcccagaagcgcaaccagaaggaggaccucuga

SEQ ID NO: 45929 - RNA, 681 nt, Artificial Sequence
  derived and/or modified sequence opt2 from METTL21B__Homo_sapiens__NP_056248
auggccgaccccggccccgaccccgaguccgaguccgaguccgucuucccccgcgaggucggccucuucgccgacuccuacuccgagaagucccaguucugcuucugcggccacguccucaccaucacccagaacuucggcucccgccucggcgucgccgcccgcgucugggacgccgcccucucccucugcaacuacuucgagucccagaacgucgacuuccgcggcaagaaggucaucgagcucggcgccggcaccggcaucgucggcauccucgccgcccuccagggcggcgacgucaccaucaccgaccucccccucgcccucgagcagauccagggcaacguccaggccaacguccccgccggcggccaggcccagguccgcgcccucuccuggggcaucgaccaccacgucuuccccgccaacuacgaccucguccucggcgccgacaucgucuaccucgagcccaccuucccccuccuccucggcacccuccagcaccucugccgcccccacggcaccaucuaccucgccuccaagaugcgcaaggagcacggcaccgaguccuucuuccagcaccuccucccccagcacuuccagcucgagcucgcccagcgcgacgaggacgagaacgucaacaucuaccgcgcccgccaccgcgagccccgccccgccuga

SEQ ID NO: 45930 - RNA, 795 nt, Artificial Sequence
  derived and/or modified sequence opt2 from METTL21C__Homo_sapiens__NP_001010977
auggacgucugccucuccuccgcccagcagcccggccgccgcggcgagggccucuccucccccggcggcuggcucgaggccgagaagaagggcgccccccagaaggacuccaccggcggcguccucgaggaguccaacaagaucgagcccucccuccacucccuccagaaguucguccccaccgacuacgccuccuacacccaggagcacuaccgcuucgccggcaaggagaucgucauccaggaguccaucgaguccuacggcgccgucgucuggcccggcgccauggcccucugccaguaccucgaggagcacgccgaggagcucaacuuccaggacgccaagauccucgagaucggcgccggccccggccucgucuccaucgucgccuccauccucggcgcccaggucaccgccaccgaccuccccgacguccucggcaaccuccaguacaaccuccucaagaacacccuccagugcaccgcccaccuccccgaggucaaggagcucgucuggggcgaggaccucgacaagaacuuccccaaguccgccuucuacuacgacuacguccucgccuccgacgucgucuaccaccacuacuuccucgacaagcuccucaccaccauggucuaccucucccagcccggcaccguccuccucugggccaacaaguuccgcuucuccaccgacuacgaguuccucgacaaguucaagcaggucuucgacaccacccuccucgccgaguaccccgaguccuccgucaagcucuucaagggcauccucaagugggacuga

SEQ ID NO: 45931 - RNA, 1101 nt, Artificial Sequence
  derived and/or modified sequence opt2 from METTL24__Homo_sapiens__NP_001116836
auggcccgcgagcgcccccccggccgcggcugcggcguccuccgccgcugccuccucggcgccguccuccucuucggccuccgccucugcgccgagcuccgccgcgccggccccggcucccccacccgcuccgccccccccggccccgccuggcgcccccccggcccccaccucccccccgcccccggccagccccgcggcgccucccgccgccaggucaccuacguccgcuccggccgccgcgccccccccggcggcggcggcuccggcacccccgagcccggcugcugcgccccccgcggccgcccccgccgcaagggcccccgcuggcacaucgaccuccagcccugggccggcuccgcccagucccucgacgaggaggccuggcgcuuccuccgcuacaucuccaccacccagaucgccugcaaccacaugaacaccgacucccucgccaccgacuccucccccacccacaagcccugguccgucugccucgacgaccgcuucaaccucgcccaccagauccgcaacaagcagugccgccucuacucccucggccucggcuccgacgacacccacuucgaggucuccauggccaacaacggcugcgagguccaccgcuucgaccccuccgucaaguccgcccacauccucgagucccagcaccucugguaccaccgccucuccaucgacuggcgcgacccccaccccgccgucgccgcccagaagccccacuccaacacccgcaagcucggcuccauccucaacgaguucggccaccacaagaucgacguccucaaggccgaccucgaguccgccgaguggaagguccucgagaaccucauccucgaggacguccucgagcagaucggccagcucaucuucgagauccaccuccacuggcccggcuucgaggucuccggcuccgacuccuccgucguccgcuucugguacucccuccucaaggagcucgagcagaaggacuuccgccucuuccacuccuacaaggaccucuccaagccccagcucuuccucaagaaggacaucuucaacgccuccuccugcuacacccucuccugggucaacacccgcuggaaguga

SEQ ID NO: 45932 - RNA, 723 nt, Artificial Sequence
  derived and/or modified sequence opt2 from METTL6__Homo_sapiens__XP_005264927
auggccucccuccagcgcaagggccuccaggcccgcauccucaccuccgaggaggaggagaagcucaagcgcgaccagacccucgucuccgacuucaagcagcagaagcucgagcaggaggcccagaagaacugggaccucuucuacaagcgcaacuccaccaacuucuucaaggaccgccacuggaccacccgcgaguucgaggagcuccgcuccugccgcgaguucgaggaccagaagcucaccaugcucgaggccggcugcggcgucggcaacugccucuucccccuccucgaggaggaccccaacaucuucgccuacgccugcgacuucuccccccgcgccaucgaguacgucaagcagaacccccucuacgacaccgagcgcugcaaggucuuccagugcgaccucaccaaggacgaccuccucgaccacgucccccccgaguccgucgacgucgucaugcucaucuucguccucuccgccguccaccccgacaagaugcaccucguccuccagaacaucuacaagugccacggcugcuccuccgagcuccgccagcccugggacaaggacgacuucgccgucaccugggaccccuggucccccgccauccgcguccuccucugccacuccggcugguccgccgucgccuggaccuggcucaccgccgccuccaccuccugggcccaggccguccuccccccccagccccucaaguga

SEQ ID NO: 45933 - RNA, 735 nt, Artificial Sequence
  derived and/or modified sequence opt2 from METTL7A__Homo_sapiens__NP_054752
auggagcucaccaucuucauccuccgccucgccaucuacauccucaccuucccccucuaccuccucaacuuccucggccucugguccuggaucugcaagaagugguuccccuacuuccucguccgcuucaccgucaucuacaacgagcagauggccuccaagaagcgcgagcucuucuccaaccuccaggaguucgccggccccuccggcaagcucucccuccucgaggucggcugcggcaccggcgccaacuucaaguucuacccccccggcugccgcgucaccugcaucgaccccaaccccaacuucgagaaguuccucaucaaguccaucgccgagaaccgccaccuccaguucgagcgcuucgucgucgccgccggcgagaacaugcaccaggucgccgacggcuccgucgacgucgucgucugcacccucguccucugcuccgucaagaaccaggagcgcauccuccgcgaggucugccgcguccuccgccccggcggcgccuucuacuucauggagcacgucgccgccgagugcuccaccuggaacuacuucuggcagcagguccucgaccccgccuggcaccuccucuucgacggcugcaaccucacccgcgaguccuggaaggcccucgagcgcgccuccuucuccaagcucaagcuccagcacauccaggccccccucuccugggagcucguccgcccccacaucuacggcuacgccgucaaguga

SEQ ID NO: 45934 - RNA, 954 nt, Artificial Sequence
  derived and/or modified sequence opt2 from METTL9__Homo_sapiens__NP_001070648
augcgccuccucgccggcuggcucugccucucccucgccuccgucuggcucgcccgccgcauguggacccuccgcuccccccucacccgcucccucuacgucaacaugaccuccggccccggcggccccgccgccgccgccggcggccgcaaggagaaccaccagugguacgucugcaaccgcgagaagcucugcgagucccuccaggccgucuucguccaguccuaccucgaccagggcacccagaucuuccucaacaacuccaucgagaaguccggcuggcucuucauccagcucuaccacuccuucgucuccuccgucuucucccucuucaugucccgcaccuccaucaacggccuccucggccgcggcuccauguucgucuucucccccgaccaguuccagcgccuccucaagaucaaccccgacuggaagacccaccgccuccucgaccucggcgccggcgacggcgaggucaccaagaucauguccccccacuucgaggagaucuacgccaccgagcucuccgagaccaugaucuggcagcuccagaagaagaaguaccgcguccucggcaucaacgaguggcagaacaccggcuuccaguacgacgucaucuccugccucaaccuccucgaccgcugcgaccagccccucacccuccucaaggacauccgcuccguccucgagcccacccgcggccgcgucauccucgcccucguccuccccuuccaccccuacgucgagaacggcggcaagugggagaagcccuccgagauccucgagaucaagggccagaacugggaggagcaggucaacucccuccccgaggucuuccgcaaggccggcuucgucaucgaggccuucacccgccuccccuaccucugcgagggcgacauguacaacgacuacuacguccucgacgacgccgucuucguccucaagcccgucuga

SEQ ID NO: 45935 - RNA, 1710 nt, Artificial Sequence
  derived and/or modified sequence opt2 from MEX3B__Homo_sapiens__NP_115622
augcccuccucccucuucgccgaccucgagcgcaacggcuccggcggcggcggcggcggcuccuccggcggcggcgagacccucgacgaccagcgcgcccuccagcucgcccucgaccagcucucccuccucggccucgacuccgacgagggcgccucccucuacgacuccgagccccgcaagaaguccgucaacaugaccgagugcguccccguccccuccuccgagcacgucgccgagaucgucggccgccagggcugcaagaucaaggcccuccgcgccaagaccaacaccuacaucaagacccccguccgcggcgaggagcccgucuucgucgucaccggccgcaaggaggacgucgccauggcccgccgcgagaucaucuccgccgccgagcacuucuccaugauccgcgccucccgcaacaagaacaccgcccucaacggcgccguccccggcccccccaaccuccccggccagaccaccauccagguccgcguccccuaccgcgucgucggccucgucgucggccccaagggcgccaccaucaagcgcauccagcagcagacccacaccuacaucgucacccccucccgcgacaaggagcccgucuucgaggucaccggcaugcccgagaacgucgaccgcgcccgcgaggagaucgaggcccacaucgcccuccgcaccggcggcaucaucgagcucaccgacgagaacgacuuccacgccaacggcaccgacgucggcuucgaccuccaccacggcuccggcggcuccggccccggcucccucugguccaagcccacccccuccaucacccccacccccggccgcaagcccuucuccuccuaccgcaacgacuccuccuccucccucggcuccgccuccaccgacuccuacuucggcggcggcaccuccuccuccgccgccgccacccagcgccucgccgacuacuccccccccucccccgcccucuccuucgcccacaacggcaacaacaacaacaacggcaacggcuacaccuacaccgccggcggcgaggccuccguccccucccccgacggcugccccgagcuccagcccaccuucgaccccgcccccgcccccccccccggcgccccccucaucugggcccaguucgagcgcucccccggcggcggccccgccgcccccgucuccuccuccugcuccuccuccgccuccuccuccgccuccuccuccuccgucgucuuccccggcggcggcgccuccgcccccuccaacgccaaccucggccuccucguccaccgccgccuccaccccggcaccuccugcccccgccucucccccccccuccacauggcccccggcgccggcgagcaccaccucgcccgccgcguccgcuccgaccccggcggcggcggccucgccuacgccgccuacgccaacggccucggcgcccagcuccccggccuccagcccuccgacaccuccggcuccuccuccuccuccuccuccuccuccuccuccuccuccuccuccuccggccuccgccgcaagggcucccgcgacugcuccgucugcuucgaguccgaggucaucgccgcccucguccccugcggccacaaccucuucugcauggagugcgccaaccgcaucugcgagaaguccgagcccgagugccccgucugccacaccgccgucacccaggccauccgcaucuucuccuga

SEQ ID NO: 45936 - RNA, 1980 nt, Artificial Sequence
  derived and/or modified sequence opt2 from MEX3C__Homo_sapiens__NP_057710
augcccuccggcuccuccgccgcccucgcccucgccgccgcccccgccccccucccccagccccccccccccccccccccccccccccccccccuccccccccccuccggcggccccgagcucgagggcgacggccuccuccuccgcgagcgccucgccgcccucggccucgacgaccccucccccgccgagcccggcgcccccgcccuccgcgcccccgccgccgccgcccagggccaggcccgccgcgccgccgagcucucccccgaggagcgcgccccccccggccgccccggcgcccccgaggccgccgagcucgagcucgaggaggacgaggaggagggcgaggaggccgagcucgacggcgaccuccucgaggaggaggagcucgaggaggccgaggaggaggaccgcuccucccuccuccuccucuccccccccgccgccaccgccucccagacccagcagauccccggcggcucccucggcuccguccuccuccccgccgcccgcuucgacgcccgcgaggccgccgccgccgccgccgccgccggcguccucuacggcggcgacgacgcccagggcaugauggccgccaugcucucccacgccuacggccccggcggcugcggcgccgccgccgccgcccucaacggcgagcaggccgcccuccuccgccgcaaguccgucaacaccaccgagugcguccccguccccuccuccgagcacgucgccgagaucgucggccgccagggcugcaagaucaaggcccuccgcgccaagaccaacaccuacaucaagacccccguccgcggcgaggagcccaucuucgucgucaccggccgcaaggaggacgucgccauggccaagcgcgagauccucuccgccgccgagcacuucuccaugauccgcgccucccgcaacaagaacggccccgcccucggcggccucuccugcucccccaaccuccccggccagaccaccguccagguccgcguccccuaccgcgucgucggccucgucgucggccccaagggcgccaccaucaagcgcauccagcagcagacccacaccuacaucgucacccccucccgcgacaaggagcccgucuucgaggucaccggcaugcccgagaacgucgaccgcgcccgcgaggagaucgagaugcacaucgccaugcgcaccggcaacuacaucgagcucaacgaggagaacgacuuccacuacaacggcaccgacgucuccuucgagggcggcacccucggcuccgccuggcucuccuccaaccccgucccccccucccgcgcccgcaugaucuccaacuaccgcaacgacuccuccuccucccucggcuccggcuccaccgacuccuacuucggcuccaaccgccucgccgacuucucccccaccucccccuucuccaccggcaacuucugguucggcgacacccuccccuccgucggcuccgaggaccucgccgucgacucccccgccuucgacucccuccccaccuccgcccagaccaucuggacccccuucgagcccgucaacccccucuccggcuucggcuccgaccccuccggcaacaugaagacccagcgccgcggcucccagcccuccaccccccgccucucccccaccuuccccgaguccaucgagcacccccucgcccgccgcguccgcuccgacccccccuccaccggcaaccacgucggccuccccaucuacauccccgccuucuccaacggcaccaacuccuacuccuccuccaacggcggcuccaccuccuccuccccccccgagucccgccgcaagcacgacugcgucaucugcuucgagaacgaggucaucgccgcccucguccccugcggccacaaccucuucugcauggagugcgccaacaagaucugcgagaagcgcacccccuccugccccgucugccagaccgccgucacccaggccauccagauccacuccuga

SEQ ID NO: 45937 - RNA, 2001 nt, Artificial Sequence
  derived and/or modified sequence opt2 from MEX3D__Homo_sapiens__NP_001167589
augcccuccucccucggccagcccgacggcggcggcggcggcggcggcggcggcggcggcgucggcgccgccggcgaggaccccggccccggccccgcccccccccccgagggcgcccaggaggccgcccccgccccccgccccccccccgagcccgacgacgccgccgccgcccuccgccucgcccucgaccagcucuccgcccucggccucggcggcgccggcgacaccgacgaggagggcgccgccggcgacggcgccgccgccgccggcggcgccgacggcggcgccgcccccgagcccgucccccccgacggccccgaggccggcgccccccccacccucgcccccgccgucgcccccggcucccucccccuccucgaccccaacgccuccccccccccccccccccccccccgccccuccccccccgacgucuucgccggcuucgccccccaccccgccgcccucggcccccccacccuccucgccgaccagauguccgucaucggcucccgcaagaaguccgucaacaugaccgagugcguccccguccccuccuccgagcacgucgccgagaucgucggccgccagggcugcaagaucaaggcccuccgcgccaagaccaacaccuacaucaagacccccguccgcggcgaggagcccgucuucaucgucaccggccgcaaggaggacgucgagauggccaagcgcgagauccucuccgccgccgagcacuucuccaucauccgcgccacccgcuccaaggccggcggccuccccggcgccgcccagggcccccccaaccuccccggccagaccaccauccagguccgcguccccuaccgcgucgucggccucgucgucggccccaagggcgccaccaucaagcgcauccagcagcgcacccacaccuacaucgucacccccggccgcgacaaggagcccgucuucgccgucaccggcaugcccgagaacgucgaccgcgcccgcgaggagaucgaggcccacaucacccuccgcaccggcgccuucaccgacgccggccccgacuccgacuuccacgccaacggcaccgacgucugccucgaccuccucggcgccgccgccucccucugggccaagacccccaaccagggccgccgcccccccaccgccaccgccggccuccgcggcgacaccgcccucggcgcccccuccgcccccgaggccuucuacgccggcucccgcggcggccccuccguccccgaccccggccccgccucccccuacuccggcuccggcaacggcggcuucgccuucggcgccgagggccccggcgcccccgucggcaccgccgcccccgacgacugcgacuucggcuucgacuucgacuuccucgcccucgaccucaccguccccgccgccgccaccaucugggcccccuucgagcgcgccgccccccuccccgccuucuccggcugcuccaccgucaacggcgcccccggcccccccgccgccggcgcccgccgcuccuccggcgccggcaccccccgccacucccccacccuccccgagcccggcggccuccgccucgagcucccccucucccgccgcggcgcccccgaccccgucggcgcccucuccuggcgccccccccagggccccgucuccuuccccggcggcgccgccuucuccaccgccaccucccuccccuccucccccgccgccgccgccugcgccccccucgacuccggcgccuccgagaacucccgcaagccccccuccgccuccuccgcccccgcccucgcccgcgagugcgucgucugcgccgagggcgaggucauggccgcccucguccccugcggccacaaccucuucugcauggacugcgccguccgcaucugcggcaaguccgagcccgagugccccgccugccgcacccccgccacccaggccauccgcgucgagaccgagaccccccagcccggcggcgccuccgcccuccagcgccaguacuga

SEQ ID NO: 45938 - RNA, 651 nt, Artificial Sequence
  derived and/or modified sequence opt2 from MFAP3__Homo_sapiens__NP_001128509
auguccgucuacuacaugaucgucugccucaucgccuucaccaucacccucauccucaacgucacccgccucugcaugauguccucccaccuccgcaagaccgagaaggccaucaacgaguucuuccgcaccgagggcgccgagaagcuccagaaggccuucgagaucgccaagcgcauccccaucaucaccuccgccaagacccucgagcucgccaaggucacccaguucaagaccauggaguucgcccgcuacaucgaggagcucgcccgcuccgucccccuccccccccucauccucaacugccgcgccuucgucgaggagauguucgaggccguccgcgucgacgaccccgacgaccucggcgagcgcaucaaggagcgccccgcccucaacgcccagggcggcaucuacgucaucaaccccgagaugggccgcuccaacucccccggcggcgacuccgacgacggcucccucaacgagcagggccaggagaucgccguccaggucuccguccaccuccaguccgagaccaaguccaucgacaccgagucccagggcuccucccacuucuccccccccgacgacaucggcuccgccgaguccaacugcaacuacaaggacggcgccuacgagaacugccagcucuga

SEQ ID NO: 45939 - RNA, 840 nt, Artificial Sequence
  derived and/or modified sequence opt2 from MFAP4__Homo_sapiens__NP_001185624
augggcgagcucuccccccuccagcgcccccucgccaccgagggcaccaugaaggcccagggcguccuccucaagcucgcccuccucgcccucccccuccuccuccuccucuccaccccccccugcgccccccaggucuccggcauccgcggcgacgcccucgagcgcuucugccuccagcagccccucgacugcgacgacaucuacgcccagggcuaccaguccgacggcgucuaccucaucuaccccuccggccccuccguccccguccccgucuucugcgacaugaccaccgagggcggcaaguggaccgucuuccagaagcgcuucaacggcuccgucuccuucuuccgcggcuggaacgacuacaagcucggcuucggccgcgccgacggcgaguacuggcucggccuccagaacaugcaccuccucacccucaagcagaaguacgagcuccgcgucgaccucgaggacuucgagaacaacaccgccuacgccaaguacgccgacuucuccaucucccccaacgccgucuccgccgaggaggacggcuacacccucuucgucgccggcuucgaggacggcggcgccggcgacucccucuccuaccacuccggccagaaguucuccaccuucgaccgcgaccaggaccucuucguccagaacugcgccgcccucuccuccggcgccuucugguuccgcuccugccacuucgccaaccucaacggcuucuaccucggcggcucccaccucuccuacgccaacggcaucaacugggcccaguggaagggcuucuacuacucccucaagcgcaccgagaugaagauccgccgcgccuga

SEQ ID NO: 45940 - RNA, 492 nt, Artificial Sequence
  derived and/or modified sequence opt2 from MFAP5__Homo_sapiens__NP_001284638
augucccuccucggccccaagguccuccucuuccucgccgccuucaucaucaccuccgacuggaucccccucggcgucaacucccagcgcggcgacgacgucacccaggccacccccgagaccuucaccgaggaccccaaccucgucaacgaccccgccaccgacgagaccguccucgccguccucgccgacaucgcccccuccaccgacgaccucgagugcugggacgagaaguucaccugcacccgccucuacuccguccaccgccccgucaagcagugcauccaccagcucugcuucaccucccuccgccgcauguacaucgucaacaaggagaucugcucccgccucgucugcaaggagcacgaggccaugaaggacgagcucugccgccagauggccggccuccccccccgccgccuccgccgcuccaacuacuuccgccucccccccugcgagaacgucgaccuccagcgccccaacggccucuga

SEQ ID NO: 45941 - RNA, 1008 nt, Artificial Sequence
  derived and/or modified sequence opt2 from MFGE8__Homo_sapiens__NP_001108086
augccccgcccccgccuccucgccgcccucugcggcgcccuccucugcgcccccucccuccucgucgcccucgacaucugcuccaagaaccccugccacaacggcggccucugcgaggagaucucccaggagguccgcggcgacgucuuccccuccuacaccugcaccugccucaagggcuacgccggcaaccacugcgagaccaagugcgucgagccccucggccucgagaacggcaacaucgccaacucccagaucgccgccuccuccguccgcgucaccuuccucggccuccagcacuggguccccgagcucgcccgccucaaccgcgccggcauggucaacgccuggacccccuccuccaacgacgacaaccccuggauccaggucaaccuccuccgccgcaugugggucaccggcgucgucacccagggcgccucccgccucgccucccacgaguaccucaaggccuucaaggucgccuacucccucaacggccacgaguucgacuucauccacgacgucaacaagaagcacaaggaguucgucggcaacuggaacaagaacgccguccacgucaaccucuucgagacccccgucgaggcccaguacguccgccucuaccccaccuccugccacaccgccugcacccuccgcuucgagcuccucggcugcgagcucaacggcugcgccaacccccucggccucaagaacaacuccauccccgacaagcagaucaccgccuccuccuccuacaagaccuggggccuccaccucuucuccuggaaccccuccuacgcccgccucgacaagcagggcaacuucaacgccugggucgccggcuccuacggcaacgaccaguggcuccagaucuuccccggcaacugggacaaccacucccacaagaagaaccucuucgagacccccauccucgcccgcuacguccgcauccuccccgucgccuggcacaaccgcaucgcccuccgccucgagcuccucggcugcuga

SEQ ID NO: 45942 - RNA, 3159 nt, Artificial Sequence
  derived and/or modified sequence opt2 from MFHAS1__Homo_sapiens__NP_004216
auggccggcauggacuccggcaaccucaagaccgcccgccucuggcgcgacgccgcccuccgcgcccgcaagcuccgcuccaaccuccgccagcucacccucaccgccgccggcgccugccccggcgccggcgccgacgcccucgagucccccgccuccccccagcucguccuccccgccaaccucggcgacaucgaggcccucaaccucggcaacaacggccucgaggagguccccgagggccucggcuccgcccucggcucccuccgcguccucguccuccgccgcaaccgcuucgcccgccucccccccgccgucgccgagcucggccaccaccucaccgagcucgacgucucccacaaccgccucaccgcccucggcgccgaggucgucuccgcccuccgcgagcuccgcaagcucaaccucucccacaaccagcuccccgcccuccccgcccagcucggcgcccucgcccaccucgaggagcucgacgucuccuucaaccgccucgcccaccuccccgacucccucuccugccucucccgccuccgcacccucgacgucgaccacaaccagcucaccgccuucccccgccagcuccuccagcucgucgcccucgaggagcucgacgucuccuccaaccgccuccgcggccuccccgaggacaucuccgcccuccgcgcccucaagauccucuggcucuccggcgccgagcucggcacccuccccgccggcuucugcgagcucgccucccucgagucccucaugcucgacaacaacggccuccaggcccuccccgcccaguucuccugccuccagcgccucaagaugcucaaccucuccuccaaccucuucgaggaguuccccgccgcccuccucccccucgccggccucgaggagcucuaccucucccgcaaccagcucaccuccguccccucccucaucuccggccucggccgccuccucacccucuggcucgacaacaaccgcauccgcuaccuccccgacuccaucgucgagcucaccggccucgaggagcucguccuccagggcaaccagaucgccguccuccccgaccacuucggccagcucucccgcgucggccucuggaagaucaaggacaacccccucauccagccccccuacgaggucugcaugaagggcauccccuacaucgccgccuaccagaaggagcucgcccacucccagcccgccguccagccccgccucaagcuccuccucaugggccacaaggccgccggcaagacccuccuccgccacugccucaccgaggagcgcgucgagggcugccccggcggcggcgacaaggagaagugcuacccccccucccccccccccgucuccaagggcaucgaggucaccuccuggaccgccgacgccucccgcggccuccgcuucaucgucuacgaccucgccggcgacgaguccuacgaggucauccagcccuucuuccucucccccggcgcccucuacguccucgucgucaaccucgccaccuacgagccccgccacuuccccaccaccgucggcuccuuccuccaccgcgucggcgcccgcgucccccacgccgucgucugcaucgucggcacccacgccgaccucugcggcgagcgcgagcucgaggagaagugccucgacauccaccgccagaucgcccuccaggagaagcacgacgccgagggccucucccgccucgccaaggucgucgacgaggcccucgcccgcgacuucgagcuccgcuccgccuccccccacgccgccuacuacggcgucuccgacaagaaccuccgccgccgcaaggcccacuuccaguaccuccucaaccaccgccuccagauccucucccccguccuccccgucuccugccgcgacccccgccaccuccgccgccuccgcgacaagcuccucuccgucgccgagcaccgcgagaucuuccccaaccuccaccgcguccucccccgcuccuggcagguccucgaggagcuccacuuccagcccccccaggcccagcgccucuggcucuccuggugggacuccgcccgccucggccuccaggccggccucaccgaggaccgccuccaguccgcccucuccuaccuccacgaguccggcaagcuccucuacuucgaggacucccccgcccucaaggagcacgucuuccacaaccucacccgccucaucgacauccucaacgucuucuuccagcgcgaccccucccuccuccuccacaagcuccuccucggcaccuccggcgagggcaaggccgagggcgaguccuccccccccauggcccgcuccacccccucccaggagcuccuccgcgccacccagcuccaccaguacgucgagggcuuccuccuccacggccuccuccccgcccacgucauccgccuccuccucaagccccacguccaggcccagcaggaccuccagcuccuccucgagcuccucgagaagaugggccucugcuacugccucaacaagcccaagggcaagccccucaacggcuccaccgccugguacaaguuccccugcuacguccagaacgaggucccccacgccgaggccuggaucaacggcaccaaccucgccggccaguccuucgucgccgagcagcuccagaucgaguacuccuuccccuucaccuucccccucggccucuucgcccgcuacuccguccagaucaacucccacgucguccaccgcuccgacggcaaguuccagaucuucgccuaccgcggcaagguccccgucgucgucuccuaccgccccgcccgcggcguccuccagcccgacacccucuccaucgccucccacgccucccuccccaacaucuggaccgccuggcaggccaucaccccccucgucgaggagcucaacguccuccuccaggaguggcccggccuccacuacaccguccacauccucugcuccaagugccucaagcgcggcucccccaacccccacgccuuccccggcgagcuccucucccagccccgccccgagggcgucgccgagaucaucugccccaagaacggcuccgagcgcgucaacgucgcccucgucuacccccccacccccaccgucaucucccccugcuccaagaagaacgucggcgagaagcaccgcaaccaguga

SEQ ID NO: 45943 - RNA, 2217 nt, Artificial Sequence
  derived and/or modified sequence opt2 from MFI2__Homo_sapiens__NP_005920
augcgcggccccuccggcgcccucuggcuccuccucgcccuccgcaccguccucggcggcauggagguccgcuggugcgccaccuccgaccccgagcagcacaagugcggcaacauguccgaggccuuccgcgaggccggcauccagcccucccuccucugcguccgcggcaccuccgccgaccacugcguccagcucaucgccgcccaggaggccgacgccaucacccucgacggcggcgccaucuacgaggccggcaaggagcacggccucaagcccgucgucggcgaggucuacgaccaggaggucggcaccuccuacuacgccgucgccgucguccgccgcuccucccacgucaccaucgacacccucaagggcgucaaguccugccacaccggcaucaaccgcaccgucggcuggaacguccccgucggcuaccucgucgaguccggccgccucuccgucaugggcugcgacguccucaaggccgucuccgacuacuucggcggcuccugcguccccggcgccggcgagaccuccuacuccgagucccucugccgccucugccgcggcgacuccuccggcgagggcgucugcgacaaguccccccucgagcgcuacuacgacuacuccggcgccuuccgcugccucgccgagggcgccggcgacgucgccuucgucaagcacuccaccguccucgagaacaccgacggcaagacccuccccuccuggggccaggcccuccucucccaggacuucgagcuccucugccgcgacggcucccgcgccgacgucaccgaguggcgccagugccaccucgcccgcguccccgcccacgccgucgucguccgcgccgacaccgacggcggccucaucuuccgccuccucaacgagggccagcgccucuucucccacgagggcuccuccuuccagauguucuccuccgaggccuacggccagaaggaccuccucuucaaggacuccaccuccgagcucguccccaucgccacccagaccuacgaggccuggcucggccacgaguaccuccacgccaugaagggccuccucugcgaccccaaccgccucccccccuaccuccgcuggugcguccucuccacccccgagauccagaagugcggcgacauggccgucgccuuccgccgccagcgccucaagcccgagauccagugcgucuccgccaaguccccccagcacugcauggagcgcauccaggccgagcaggucgacgccgucacccucuccggcgaggacaucuacaccgccggcaagaccuacggccucguccccgccgccggcgagcacuacgcccccgaggacuccuccaacuccuacuacgucgucgccgucguccgccgcgacuccucccacgccuucacccucgacgagcuccgcggcaagcgcuccugccacgccggcuucggcucccccgccggcugggacguccccgucggcgcccucauccagcgcggcuucauccgccccaaggacugcgacguccucaccgccgucuccgaguucuucaacgccuccugcguccccgucaacaaccccaagaacuaccccuccucccucugcgcccucugcgucggcgacgagcagggccgcaacaagugcgucggcaacucccaggagcgcuacuacggcuaccgcggcgccuuccgcugccucgucgagaacgccggcgacgucgccuucguccgccacaccaccgucuucgacaacaccaacggccacaacuccgagcccugggccgccgagcuccgcuccgaggacuacgagcuccucugccccaacggcgcccgcgccgaggucucccaguucgccgccugcaaccucgcccagauccccccccacgccgucaugguccgccccgacaccaacaucuucaccgucuacggccuccucgacaaggcccaggaccucuucggcgacgaccacaacaagaacggcuucaagauguucgacuccuccaacuaccacggccaggaccuccucuucaaggacgccaccguccgcgccguccccgucggcgagaagaccaccuaccgcggcuggcucggccucgacuacgucgccgcccucgagggcauguccucccagcagugcuccggcgccgccgcccccgcccccggcgccccccuccucccccuccuccuccccgcccucgccgcccgccuccucccccccgcccucuga

SEQ ID NO: 45944 - RNA, 2226 nt, Artificial Sequence
  derived and/or modified sequence opt2 from MFN1__Homo_sapiens__XP_005247653
auggccgagcccgucuccccccucaagcacuucguccucgccaagaaggccaucaccgccaucuucgaccagcuccucgaguucgucaccgagggcucccacuucgucgaggccaccuacaagaaccccgagcucgaccgcaucgccaccgaggacgaccucgucgagaugcagggcuacaaggacaagcucuccaucaucggcgagguccucucccgccgccacaugaaggucgccuucuucggccgcaccuccuccggcaaguccuccgucaucaacgccaugcucugggacaagguccuccccuccggcaucggccacaucaccaacugcuuccucuccgucgagggcaccgacggcgacaaggccuaccucaugaccgagggcuccgacgagaagaaguccgucaagaccgucaaccagcucgcccacgcccuccacauggacaaggaccucaaggccggcugccucguccgcgucuucuggcccaaggccaagugcgcccuccuccgcgacgaccucguccucgucgacucccccggcaccgacgucaccaccgagcucgacuccuggaucgacaaguucugccucgacgccgacgucuucguccucgucgccaacuccgaguccacccucaugaacaccgagaagcacuucuuccacaaggucaacgagcgccucuccaagcccaacaucuucauccucaacaaccgcugggacgccuccgccuccgagcccgaguacauggaggacguccgccgccagcacauggagcgcugccuccacuuccucgucgaggagcucaaggucgucaacgcccucgaggcccagaaccgcaucuucuucgucuccgccaaggagguccucuccgcccgcaagcagaaggcccagggcaugcccgaguccggcgucgcccucgccgagggcuuccacgcccgccuccaggaguuccagaacuucgagcagaucuucgaggagugcaucucccaguccgccgucaagaccaaguucgagcagcacaccauccgcgccaagcagauccucgccaccgucaagaacaucauggacuccgucaaccucgccgccgaggacaagcgccacuacuccgucgaggagcgcgaggaccagaucgaccgccucgacuucauccgcaaccagaugaaccuccucacccucgacgucaagaagaagaucaaggaggucaccgaggaggucgccaacaaggucuccugcgccaugaccgacgagaucugccgccucuccguccucgucgacgaguucugcuccgaguuccaccccaaccccgacguccucaagaucuacaaguccgagcucaacaagcacaucgaggacggcaugggccgcaaccucgccgaccgcugcaccgacgaggucaacgcccucguccuccagacccagcaggagaucaucgagaaccucaagccccuccuccccgccggcauccaggacaagcuccacacccucauccccugcaagaaguucgaccucuccuacaaccucaacuaccacaagcucugcuccgacuuccaggaggacaucgucuuccgcuucucccucggcugguccucccucguccaccgcuuccucggcccccgcaacgcccagcgcguccuccucggccucuccgagcccaucuuccagcucccccgcucccucgccuccacccccaccgcccccaccacccccgccacccccgacaacgccucccaggaggagcucaugaucacccucgucaccggccucgccuccgucaccucccgcaccuccaugggcaucaucaucgucggcggcgucaucuggaagaccaucggcuggaagcuccucuccgucucccucaccauguacggcgcccucuaccucuacgagcgccucuccuggaccacccacgccaaggagcgcgccuucaagcagcaguucgucaacuacgccaccgagaagcuccgcaugaucgucuccuccaccuccgccaacugcucccaccaggucaagcagcagaucgccaccaccuucgcccgccucugccagcaggucgacaucacccagaagcagcucgaggaggagaucgcccgccuccccaaggagaucgaccagcucgagaagauccagaacaacuccaagcuccuccgcaacaaggccguccagcucgagaacgagcucgagaacuucaccaagcaguuccuccccuccuccaacgaggaguccuga

SEQ ID NO: 45945 - RNA, 1740 nt, Artificial Sequence
  derived and/or modified sequence opt2 from MFRP__Homo_sapiens__NP_113621
augaaggacuucuccgacgucauccucugcauggaggccaccgaguccuccaagaccgaguucugcaaccccgccuucgagcccgaguccggcccccccugccccccccccgucuuccccgaggacgccuccuacuccguccccgcccccuggcacggccgccgcccccgcggccuccgccccgacugccgcuucuccuggcucugcguccuccuccucuccucccuccuccuccuccuccucggccuccucgucgccaucauccucgcccagcuccaggccgccccccccuccggcgccucccacuccccccuccccgccggcggccucaccaccaccaccaccacccccaccaucaccaccucccaggccgccggcacccccaagggccagcaggaguccggcgucucccccuccccccaguccaccugcggcggccuccucuccggcccccgcggcuucuucuccucccccaacuaccccgaccccuacccccccaacacccacugcgucuggcacauccaggucgccaccgaccacgccauccagcucaagaucgaggcccucuccaucgaguccgucgccuccugccucuucgaccgccucgagcucucccccgagcccgagggcccccuccuccgcgucugcggccgcguccccccccccacccucaacaccaacgccucccaccuccucgucgucuucgucuccgacuccuccgucgagggcuucggcuuccacgccugguaccaggccauggcccccggccgcggcuccugcgcccacgacgaguuccgcugcgaccagcucaucugccuccuccccgacuccgucugcgacggcuucgccaacugcgccgacggcuccgacgagaccaacugcuccgccaaguucuccggcugcggcggcaaccucaccggccuccagggcaccuucuccacccccuccuaccuccagcaguacccccaccagcuccucugcaccuggcacaucuccguccccgccggccacuccaucgagcuccaguuccacaacuucucccucgaggcccaggacgagugcaaguucgacuacgucgaggucuacgagaccuccuccuccggcgccuucucccuccucggccgcuucugcggcgccgagccccccccccaccucgucuccucccaccacgagcucgccguccucuuccgcaccgaccacggcaucuccuccggcggcuucuccgccaccuaccucgccuucaacgccaccgagaaccccugcggccccuccgagcucuccugccaggccggcggcugcaagggcguccaguggaugugcgacauguggcgcgacugcaccgacggcuccgacgacaacugcuccggcccccucuuccccccccccgagcucgccugcgagcccguccaggucgagaugugccucggccucuccuacaacaccaccgccuuccccaacaucugggucggcaugaucacccaggaggaggucgucgagguccucuccggcuacaagucccucaccucccuccccugcuaccagcacuuccgccgccuccucugcggccuccucgucccccgcugcaccccccucggcuccguccucccccccugccgcuccgucugccaggaggccgagcaccagugccaguccggccucgcccuccucggcacccccuggcccuucaacugcaaccgccuccccgaggccgccgaccucgaggccugcgcccagcccuga

SEQ ID NO: 45946 - RNA, 1194 nt, Artificial Sequence
  derived and/or modified sequence opt2 from MFSD11__Homo_sapiens__NP_001229466
augucccccgaguccaagaagcucuucaacaucaucauccucggcgucgccuucauguucauguucaccgccuuccagaccugcggcaacgucgcccagaccgucauccgcucccucaaccgcaccgacuuccacggcuccggcuacaccuccauggccaucaucuacggcgucuucuccgccuccaaccucaucacccccuccgucgucgccaucgucggcccccagcucuccauguucgccuccggccucuucuacuccauguacaucgccgucuucauccagcccuuccccugguccuucuacaccgccuccgucuucaucggcaucgccgccgccgaguccgaccgccgcaccgucuucaucgcccucaccgucaucucccucgucggcaccguccucuucuuccucauccgcaagcccgacuccgagaacguccucggcgaggacgaguccuccgacgaccaggacauggaggucaacgaguccgcccagaacaaccucaccaaggccgucgacgccuucaagaaguccuucaagcucugcgucaccaaggagaugcuccuccucuccaucaccaccgccuacaccggccucgagcucaccuucuucuccggcgucuacggcaccugcaucggcgccaccaacaaguucggcgccgaggagaagucccucaucggccucuccggcaucuucaucggcaucggcgagauccucggcggcucccucuucggccuccucuccaagaacaaccgcuucggccgcaaccccgucguccuccucggcauccucguccacuucaucgccuucuaccucaucuuccucaacaugcccggcgacgcccccaucgcccccgucaagggcaccgacuccuccgccuacaucaaguccuccaaggaggucgccauccucugcuccuuccuccucggccucggcgacuccugcuucaacacccagcuccucuccauccucggcuuccucuacuccgaggacuccgcccccgccuucgccaucuucaaguucguccaguccaucugcgccgccgucgccuucuucuacuccaacuaccuccuccuccacuggcagcuccucgucauggucaucuucggcuucuucggcaccaucuccuucuucaccgucgagugggaggccgccgccuucgucgcccgcggcuccgacuaccgcuccaucuga

SEQ ID NO: 45947 - RNA, 1443 nt, Artificial Sequence
  derived and/or modified sequence opt2 from MFSD12__Homo_sapiens__NP_778148
augggccccggcccccccgccgccggcgccgcccccuccccccgcccccucucccucgucgcccgccucuccuacgccgucggccacuuccucaacgaccucugcgccuccaugugguucaccuaccuccuccucuaccuccacuccguccgcgccuacuccucccgcggcgccggccuccuccuccuccucggccaggucgccgacggccucugcaccccccucgucggcuacgaggccgaccgcgccgccuccugcugcgcccgcuacggcccccgcaaggccuggcaccucgucggcaccgucugcguccuccucuccuuccccuucaucuucucccccugccucggcugcggcgccgccacccccgagugggccgcccuccucuacuacggccccuucaucgucaucuuccaguucggcugggccuccacccagaucucccaccucucccucauccccgagcucgucaccaacgaccacgagaaggucgagcucaccgcccuccgcuacgccuucaccgucgucgccaacaucaccgucuacggcgccgccuggcuccuccuccaccuccagggcuccucccgcgucgagcccacccaggacaucuccaucuccgaccagcucggcggccaggacguccccgucuuccgcaaccucucccuccucgucgucggcgucggcgccgucuucucccuccucuuccaccucggcacccgcgagcgccgccgcccccacgccgaggagcccggcgagcacaccccccuccucgcccccgccaccgcccagccccuccuccucuggaagcacuggcuccgcgagcccgccuucuaccaggucggcauccucuacaugaccacccgccucaucgucaaccucucccagaccuacauggccauguaccucaccuacucccuccaccuccccaagaaguucaucgccaccaucccccucgucauguaccucuccggcuuccucuccuccuuccucaugaagcccaucaacaagugcaucggccgcaacaugaccuacuucuccggccuccucgucauccucgccuucgccgccugggucgcccucgccgagggccucggcgucgccgucuacgccgccgccguccuccucggcgccggcugcgccaccauccucgucaccucccucgccaugaccgccgaccucaucggcccccacaccaacuccggcgccuucgucuacggcuccauguccuuccucgacaaggucgccaacggccucgccgucauggccauccagucccuccaccccugccccuccgagcucugcugccgcgccugcgucuccuucuaccacugggccauggucgccgucaccggcggcgucggcgucgccgccgcccucugccucugcucccuccuccucuggcccacccgccuccgccgcugggaccgcgacgcccgccccuga

SEQ ID NO: 45948 - RNA, 1545 nt, Artificial Sequence
  derived and/or modified sequence opt2 from MFSD1__Homo_sapiens__NP_073573
augggcgucgcccuccgcgaccuccccggccgccacgucuccucccgcucccacgucaccgccguccucaccgucuuccacggccgcugcuuccuccccggcuucggcgucgucaccaccuuccccucccccucccccgccggcgccauggaggaggaggacgaggaggcccgcgcccuccucgccggcggccccgacgaggccgaccgcggcgcccccgccgcccccggcgcccuccccgcccucugcgaccccucccgccucgcccaccgccuccucguccuccuccucaugugcuuccucggcuucggcuccuacuucugcuacgacaaccccgccgcccuccagacccaggucaagcgcgacaugcaggucaacaccaccaaguucaugcuccucuacgccugguacuccuggcccaacgucguccucugcuucuucggcggcuuccucaucgaccgcgucuucggcauccgcuggggcaccaucaucuucuccugcuucgucugcaucggccaggucgucuucgcccucggcggcaucuucaacgccuucuggcucauggaguucggccgcuucgucuucggcaucggcggcgagucccucgccgucgcccagaacaccuacgccgucuccugguucaagggcaaggagcucaaccucgucuucggccuccagcucuccauggcccgcaucggcuccaccgucaacaugaaccucaugggcuggcucuacuccaagaucgaggcccuccucggcuccgccggccacaccacccucggcaucacccucaugaucggcggcaucaccugcauccucucccucaucugcgcccucgcccucgccuaccucgaccagcgcgccgagcgcauccuccacaaggagcagggcaagaccggcgaggucaucaagcucaccgacgucaaggacuucucccucccccucuggcucaucuucaucaucugcgucugcuacuacgucgccgucuuccccuucaucggccucggcaaggucuucuucaccgagaaguucggcuucuccucccaggccgccuccgccaucaacuccgucgucuacgucaucuccgcccccaugucccccgucuucggccuccucgucgacaagaccggcaagaacaucaucuggguccucugcgccgucgccgccacccucgucucccacaugaugcucgccuucaccauguggaaccccuggaucgccaugugccuccucggccucuccuacucccuccucgccugcgcccucuggcccauggucgccuucgucguccccgagcaccagcucggcaccgccuacggcuucaugcaguccauccagaaccucggccucgccaucaucuccaucaucgccggcaugauccucgacucccgcggcuaccucuuccucgaggucuucuucaucgccugcgucucccucucccuccucuccgucguccuccucuaccucgucaaccgcgcccagggcggcaaccucaacuacuccgcccgccagcgcgaggagaucaaguucucccacaccgaguga

SEQ ID NO: 45949 - RNA, 2376 nt, Artificial Sequence
  derived and/or modified sequence opt2 from MFSD6__Homo_sapiens__NP_060164
auggccgacgacaaggucgccauccucaccgacgacgaggaggagcagaagcgcaaguacguccucgccgaccccuucaacggcaucucccgcgagcccgagccccccuccaacgagacccccuccuccaccgagaccuccgccauccccgaggaggagaucgacuggaucgagaagcacugcgucaagaucaacaacgaccuccucaucuccaaggucuucuacuucuucuucuacuccgccuacggcucccucuacccccuccuccccgucuacuacaagcagcucggcaugucccccucccaguccggccuccucgucggcauccgcuacuucaucgaguucugcuccgcccccuucuggggcgucgucgccgaccgcuucaagaagggcaagaucguccuccucuucucccuccucugcuggguccucuucaaccucggcaucggcuucgucaagcccgccacccuccgcugcguccccaagauccgccccaccacccaccccaccaacgccucccaccagcucaccauccuccccaccaacuccuccuucaccuccuuccucaccaucucccccaagaugcgcgagaagcgcaaccuccucgagacccgccucaacgucuccgacaccgucacccuccccaccgcccccaacaugaacuccgagcccacccuccagccccagaccggcgagaucaccaaccgcaugauggaccucacccucaacuccuccaccgccacccccgucucccccggcuccgucaccaaggagaccaccaccgucaucgucaccaccaccaagucccuccccuccgaccaggucaugcucgucuacgaccagcaggaggucgaggccaucuuccucgucauccucgucgucgucaucaucggcgaguucuucuccgccuccuccgucaccaucgucgacaccgucacccuccaguaccucggcaagcaccgcgaccgcuacggccuccagcgcauguggggcucccucggcuggggccucgccaugcucuccgucggcaucggcaucgacuacacccacaucgagguccucaucgacggcaagggcugcaagccccccgaguaccgcaacuaccagaucgucuucaucgucuucggcguccucaugaccauggcccucaucgucgccacccaguuccgcuuccgcuacaaccacuucaagaacgacgacuccaagggcaaggaggucgagaucccccaggucgagcgcaacaacuccaccgaguccuccgaggagacccccaccaccaccucccacucccaggccuucaacuucugggaccucaucaagcuccucugcuccguccaguacggcuccguccucuucgucgccugguucaugggcuucggcuacggcuucgucuucaccuuccucuacuggcaccucgaggaccucaacggcaccaccacccucuucggcgucugcuccguccucucccacgucuccgagcucaccgccuacuucuucucccacaagcucaucgagcucaucggccacauccgcguccucuacaucggccucgccugcaacaccgcccgcuacaucuacaucuccuaccucgagaacgccuggaccguccuccccauggagguccuccagggcgucacccacgccgccaucugggccgccugcaucuccuaccucuccgccgccgucccccccgagcuccgcaccuccgcccagggcauccuccagggccuccaccucggccucggccgcggcugcggcgccaugaucggcggcguccucgucaacuacuucggcgccgccgccaccuuccgcggcaucggcauggccugccucgucauccuccuccucuucgcccucauccaguggcucgccguccccgacgaggaggaggacaagaccaugcucgccgagcgcauccccguccccuccucccccguccccaucgccaccaucgaccucguccagcagcagaccgaggacgucaugccccgcaucgagccccgccucccccccaagaagaccaagcaccaggaggagcaggaggacgucaacaagcccgccuggggcgucuccuccucccccugggucaccuucgucuacgcccucuaccagaucaaggagaugaugcagcucacccgcgacaaccgcgccuccgagauccagccccuccagggcaccaacgagaaccgcgagaacucccccgccggccgcgcccagcccguccccugcgagacccacuccgaccccucccgcaaccagcccucccccgacgccgccgccucccagacccagaccucccccgcccaccccuccgucgaccccugcaccgaggaguccgaggagcagcaggcccagcucgccgccggcggccacuga

SEQ ID NO: 45950 - RNA, 1683 nt, Artificial Sequence
  derived and/or modified sequence opt2 from MFSD7__Homo_sapiens__NP_001281270
auggccggccccaccgaggccgagaccggccucgccgagccccgcgcccucugcgcccagcgcggccaccgcaccuacgcccgccgcugggucuuccuccucgccaucucccuccucaacugcuccaacgccacccucuggcucuccuucgcccccgucgccgacgucaucgccgaggaccucguccucuccauggagcagaucaacuggcucucccucgucuaccucgucgucuccacccccuucggcgucgccgccaucuggauccucgacuccgucggccuccgcgccgccaccauccucggcgccuggcucaacuucgccggcuccguccuccgcaugguccccugcauggucgucggcacccagaaccccuucgccuuccucaugggcggccagucccucugcgcccucgcccagucccucgucaucuucucccccgccaagcucgccgcccucugguuccccgagcaccagcgcgccaccgccaacaugcucgccaccauguccaacccccucggcguccucgucgccaacguccucucccccguccucgucaagaagggcgaggacaucccccucaugcucggcgucuacaccauccccgccggcgucgucugccuccucuccaccaucugccucugggaguccgucccccccaccccccccuccgccggcgccgccuccuccaccuccgagaaguuccucgacggccucaagcuccagcucauguggaacaaggccuacgucauccucgccgucugccucggcggcaugaucggcaucuccgccuccuucuccgcccuccucgagcagauccucugcgccuccggccacuccuccggcuucuccggccucugcggcgcccucuucaucaccuucggcauccucggcgcccucgcccucggccccuacgucgaccgcaccaagcacuucaccgaggccaccaagaucggccucugccucuucucccucgccugcguccccuucgcccucgucucccagcuccagggccagacccucgcccucgccgccaccugcucccuccucggccucuucggcuucuccgucggccccgucgccauggagcucgccgucgagugcuccuuccccgucggcgagggcgccgccaccggcaugaucuucguccucggccaggccgagggcauccucaucaugcucgccaugaccgcccucaccguccgccgcuccgagcccucccucuccaccugccagcagggcgaggacccccucgacuggaccgucucccuccuccucauggccggccucugcaccuucuucuccugcauccucgccgucuucuuccacacccccuaccgccgccuccaggccgaguccggcgagccccccuccacccgcaacgccgucggcggcgccgacuccggccccggcgucgaccgcggcggcgccggccgcgccggcguccucggccccuccaccgccacccccgagugcaccgcccgcggcgccucccucgaggacccccgcggccccggcuccccccaccccgccugccaccgcgccaccccccgcgcccagggccccgccgccaccgacgcccccucccgccccggccgccucgccggccgcguccaggccucccgcuucaucgaccccgccggcucccacuccuccuucuccucccccugggucaucaccuga

SEQ ID NO: 45951 - RNA, 1557 nt, Artificial Sequence
  derived and/or modified sequence opt2 from MFSD8__Homo_sapiens__NP_689991
auggccggccuccgcaacgaguccgagcaggagccccuccucggcgacacccccggcucccgcgagugggacauccucgagaccgaggagcacuacaagucccgcuggcgcuccauccgcauccucuaccucaccauguuccucuccuccgucggcuucuccgucgucaugauguccaucuggcccuaccuccagaagaucgaccccaccgccgacaccuccuuccucggcugggucaucgccuccuacucccucggccagauggucgccucccccaucuucggccucugguccaacuaccgcccccgcaaggagccccucaucgucuccauccucaucuccgucgccgccaacugccucuacgccuaccuccacauccccgccucccacaacaaguacuacaugcucgucgcccgcggccuccucggcaucggcgccggcaacgucgccgucguccgcuccuacaccgccggcgccaccucccuccaggagcgcaccuccuccauggccaacaucuccaugugccaggcccucggcuucauccucggccccgucuuccagaccugcuucaccuuccucggcgagaagggcgucaccugggacgucaucaagcuccagaucaacauguacaccacccccguccuccucuccgccuuccucggcauccucaacaucauccucauccucgccauccuccgcgagcaccgcgucgacgacuccggccgccagugcaaguccaucaacuucgaggaggccuccaccgacgaggcccaggucccccagggcaacaucgaccaggucgccgucgucgccaucaacguccucuucuucgucacccucuucaucuucgcccucuucgagaccaucaucaccccccucaccauggacauguacgccuggacccaggagcaggccguccucuacaacggcaucauccucgccgcccucggcgucgaggccgucgucaucuuccucggcgucaagcuccucuccaagaagaucggcgagcgcgccauccuccucggcggccucaucgucgucugggucggcuucuucauccuccuccccuggggcaaccaguuccccaagauccagugggaggaccuccacaacaacuccauccccaacaccaccuucggcgagaucaucaucggccucuggaagucccccauggaggacgacaacgagcgccccaccggcugcuccaucgagcaggccuggugccucuacacccccgucauccaccucgcccaguuccucaccuccgccguccucaucggccucggcuaccccgucugcaaccucauguccuacacccucuacuccaagauccucggccccaagccccagggcgucuacaugggcuggcucaccgccuccggcuccggcgcccgcauccucggccccauguucaucucccaggucuacgcccacuggggcccccgcugggccuucucccucgucugcggcaucaucguccucaccaucacccuccucggcgucgucuacaagcgccucaucgcccucuccguccgcuacggccgcauccaggaguga

SEQ ID NO: 45952 - RNA, 8571 nt, Artificial Sequence
  derived and/or modified sequence opt2 from MGA__Homo_sapiens__NP_001074010
auggaggagaagcagcagaucauccucgccaaccaggacggcggcaccgucgccggcgccgcccccaccuucuucgucauccucaagcagcccggcaacggcaagaccgaccagggcauccucgucaccaaccaggacgccugcgcccucgccuccuccgucuccucccccgucaaguccaagggcaagaucugccuccccgccgacugcaccgucggcggcaucaccgucacccucgacaacaacuccauguggaacgaguucuaccaccgcuccaccgagaugauccucaccaagcagggccgccgcauguuccccuacugccgcuacuggaucaccggccucgacuccaaccucaaguacauccucgucauggacaucucccccgucgacaaccaccgcuacaaguggaacggccgcuggugggagcccuccggcaaggccgagccccacguccucggccgcgucuucauccaccccgagucccccuccaccggccacuacuggaugcaccagcccgucuccuucuacaagcucaagcucaccaacaacacccucgaccaggagggccacaucauccuccacuccaugcaccgcuaccucccccgccuccaccucguccccgccgagaaggccgucgaggucauccagcucaacggccccggcguccacaccuucaccuucccccagaccgaguucuucgccgucaccgccuaccagaacauccagaucacccagcucaagaucgacuacaaccccuucgccaagggcuuccgcgacgacggccucaacaacaagccccagcgcgacggcaagcagaagaacuccuccgaccaggagggcaacaacaucuccuccuccuccggccaccgcguccgccucaccgagggccagggcuccgagauccagcccggcgaccucgacccccucucccgcggccacgagaccuccggcaagggccucgagaagaccucccucaacaucaagcgcgacuuccucggcuucauggacaccgacuccgcccucuccgaggucccccagcucaagcaggagaucuccgagugccucaucgccuccuccuucgaggacgacucccgcgucgccuccccccucgaccagaacggcuccuucaacgucgucaucaaggaggagccccucgacgacuacgacuacgagcucggcgagugccccgagggcgucaccgucaagcaggaggagaccgacgaggagaccgacgucuacuccaacuccgacgacgaccccauccucgagaagcagcucaagcgccacaacaaggucgacaaccccgaggccgaccaccucuccuccaaguggcuccccuccucccccuccggcgucgccaaggccaagauguucaagcucgacaccggcaagaugcccgucgucuaccucgagcccugcgccgucacccgcuccaccgucaagaucuccgagcuccccgacaacaugcucuccaccucccgcaaggacaaguccuccaugcucgccgagcucgaguaccuccccaccuacaucgagaacuccaacgagaccgccuucugccucggcaaggaguccgagaacggccuccgcaagcacucccccgaccuccgcgucguccagaaguacccccuccucaaggagccccaguggaaguaccccgacaucuccgacuccaucuccaccgagcgcauccucgacgacuccaaggacuccgucggcgacucccucuccggcaaggaggaccucggccgcaagcgcaccaccaugcucaagaucgccaccgccgccaaggucgucaacgccaaccagaacgccucccccaacguccccggcaagcgcggccgcccccgcaagcucaagcucugcaaggccggccgcccccccaagaacaccggcaagucccucaucuccaccaagaacacccccgucucccccggcuccaccuuccccgacgucaagcccgaccucgaggacgucgacggcguccucuucgucuccuucgaguccaaggaggcccucgacauccacgccgucgacggcaccaccgaggaguccuccucccuccaggccuccaccaccaacgacuccggcuaccgcgcccgcaucucccagcucgagaaggagcucaucgaggaccucaagacccuccgccacaagcaggucauccaccccggccuccaggaggucggccucaagcucaacuccgucgaccccaccauguccaucgaccucaaguaccucggcguccagcucccccucgcccccgccaccuccuuccccuucuggaaccucaccggcaccaaccccgccucccccgacgccggcuuccccuucgucucccgcaccggcaagaccaacgacuucaccaagaucaagggcuggcgcggcaaguuccacuccgccuccgccucccgcaacgagggcggcaacuccgaguccucccucaagaaccgcuccgccuucugcuccgacaagcucgacgaguaccucgagaacgagggcaagcucauggagaccuccaugggcuucuccuccaacgcccccaccucccccgucgucuaccagcuccccaccaaguccaccuccuacguccgcacccucgacuccguccucaagaagcaguccaccaucucccccuccaccuccuacucccucaagccccacuccgucccccccgucucccgcaaggccaagucccagaaccgccaggccaccuucuccggccgcaccaaguccuccuacaaguccauccuccccuaccccgucucccccaagcagaaguacucccacgucauccucggcgacaaggucaccaagaacuccuccggcaucaucuccgagaaccaggccaacaacuucgucguccccacccucgacgagaacaucuuccccaagcagaucucccuccgccaggcccagcagcagcagcagcagcagcagggcucccgcccccccggccucuccaagucccaggucaagcucauggaccucgaggacugcgcccucugggagggcaagccccgcaccuacaucaccgaggagcgcgccgacgucucccucaccacccuccucaccgcccaggccucccucaagaccaagcccauccacaccaucauccgcaagcgcgccccccccugcaacaacgacuucugccgccucggcugcgucugcuccucccucgcccucgagaagcgccagcccgcccacugccgccgccccgacugcauguucggcugcaccugccucaagcgcaaggucguccucgucaagggcggcuccaagaccaagcacuuccagcgcaaggccgcccaccgcgaccccgucuucuacgacacccucggcgaggaggcccgcgaggaggaggagggcauccgcgaggaggaggagcagcucaaggagaagaagaagcgcaagaagcucgaguacaccaucugcgagaccgagcccgagcagcccguccgccacuacccccucugggucaaggucgagggcgaggucgaccccgagcccgucuacauccccacccccuccgucaucgagcccaugaagccccuccuccucccccagcccgagguccucucccccaccgucaagggcaagcuccucaccggcaucaaguccccccgcuccuacacccccaagcccaaccccgucauccgcgaggaggacaaggaccccgucuaccucuacuucgaguccaugaugaccugcgcccgcguccgcgucuacgagcgcaagaaggaggaccagcgccagcccuccuccuccuccucccccucccccuccuuccagcagcagaccuccugccacuccucccccgagaaccacaacaacgccaaggagcccgacuccgagcagcagccccucaagcagcucaccugcgaccucgaggacgacuccgacaagcuccaggagaaguccuggaaguccuccugcaacgagggcgaguccuccuccaccuccuacaugcaccagcgcucccccggcggccccaccaagcucaucgagaucaucuccgacugcaacugggaggaggaccgcaacaagauccucuccauccucucccagcacaucaacuccaacaugccccagucccucaaggucggcuccuucaucaucgagcucgccucccagcgcaagucccgcggcgagaagaacccccccgucuacuccucccgcgucaagaucuccaugcccuccugccaggaccaggacgacauggccgagaaguccggcuccgagacccccgacggcccccucucccccggcaagauggaggacaucucccccguccagaccgacgcccucgacuccguccgcgagcgccuccacggcggcaagggccuccccuucuacgccggccucucccccgccggcaagcucgucgccuacaagcgcaagcccuccuccuccaccuccggccucauccaggucgccuccaacgccaaggucgccgccucccgcaagccccgcacccuccuccccuccaccuccaacuccaagauggccuccuccuccggcaccgccaccaaccgccccggcaagaaccucaaggccuucguccccgccaagcgccccaucgagaacgccgcccagauccccgucgccaccccccaggucucccccaacaccgucaagcgcgccggcccccgccuccuccucauccccguccagcagggcucccccacccuccgccccgucuccaacacccagcuccagggccaccgcaugguccuccagcccguccgcucccccuccggcaugaaccucuuccgccaccccaacggccagaucguccagcuccucccccuccaccagcuccgcggcuccaacacccagcccaaccuccagcccgucauguuccgcaaccccggcuccgucaugggcauccgccuccccgcccccuccaagcccuccgagaccccccccuccuccaccuccuccuccgccuucuccgucaugaaccccgucauccaggccgucggcuccuccuccgccgucaacgucaucacccaggcccccucccuccucuccuccggcgccuccuucgucucccaggccggcacccucacccuccgcaucuccccccccgagccccaguccuucgccuccaagaccggcuccgagaccaagaucaccuacuccuccggcggccagcccgucggcaccgccucccucaucccccuccaguccggcuccuucgcccuccuccagcuccccggccagaagcccguccccuccuccauccuccagcacgucgccucccuccagaugaagcgcgagucccagaaccccgaccagaaggacgagaccaacuccaucaagcgcgagcaggagaccaagaagguccuccaguccgagggcgaggccgucgaccccgaggccaacgucaucaagcagaacuccggcgccgccaccuccgaggagacccucaacgacucccucgaggaccgcggcgaccaccucgacgaggagugccuccccgaggagggcugcgccaccgucaagcccuccgagcacuccugcaucaccggcucccacaccgaccaggacuacaaggacgucaacgaggaguacggcgcccgcaaccgcaaguccuccaaggagaaggucgccguccucgagguccgcaccaucuccgagaaggccuccaacaagaccguccagaaccucuccaagguccagcaccagaagcucggcgacgucaaggucgagcagcagaagggcuucgacaaccccgaggagaacuccuccgaguuccccgucaccuucaaggaggaguccaaguucgagcucuccggcuccaaggucauggagcagcaguccaaccuccagcccgaggccaaggagaaggagugcggcgacucccucgagaaggaccgcgagcgcuggcgcaagcaccucaagggcccccucacccgcaagugcgucggcgccucccaggagugcaagaaggaggccgacgagcagcucaucaaggagaccaagaccugccaggagaacuccgacgucuuccagcaggagcagggcaucuccgaccuccucggcaaguccggcaucaccgaggacgcccgcguccucaagaccgagugcgacuccuggucccgcaucuccaaccccuccgccuucuccaucgucccccgccgcgccgccaaguccucccgcggcaacggccacuuccagggccaccuccuccuccccggcgagcagauccagcccaagcaggagaagaagggcggccgcuccuccgccgacuucaccguccucgaccucgaggaggacgacgaggacgacaacgagaagaccgacgacuccaucgacgagaucgucgacgucgucuccgacuaccaguccgaggaggucgacgacgucgagaagaacaacugcgucgaguacaucgaggacgacgaggagcacgucgacaucgagaccgucgaggagcucuccgaggagaucaacgucgcccaccucaagaccaccgccgcccacacccaguccuucaagcagcccuccugcacccacaucuccgccgacgagaaggccgccgagcgcucccgcaaggccccccccaucccccucaagcucaagcccgacuacugguccgacaagcuccagaaggaggccgaggccuucgccuacuaccgccgcacccacaccgccaacgagcgccgccgccgcggcgagaugcgcgaccucuucgagaagcucaagaucacccucggccuccuccacuccuccaaggucuccaagucccucauccucacccgcgccuucuccgagauccagggccucaccgaccaggccgacaagcucaucggccagaagaaccuccucacccgcaagcgcaacauccucauccgcaaggucuccucccucuccggcaagaccgaggaggucguccucaagaagcucgaguacaucuacgccaagcagcaggcccucgaggcccagaagcgcaagaagaagaugggcuccgacgaguucgacaucuccccccgcaucuccaagcagcaggagggcuccuccgccuccuccgucgaccucggccagauguucaucaacaaccgccgcggcaagccccucauccucucccgcaagaaggaccaggccaccgagaacaccuccccccucaacaccccccacaccuccgccaaccucgucaugaccccccagggccagcuccucacccucaagggcccccucuucuccggccccgucgucgccgucucccccgaccuccucgaguccgaccucaagccccaggucgccggcuccgccgucgcccuccccgagaacgacgaccucuucaugaugccccgcaucgucaacgucaccucccucgccaccgagggcggccucgucgacaugggcggcuccaaguacccccacgagguccccgacuccaagcccuccgaccaccucaaggacaccguccgcaacgaggacaacucccucgaggacaagggccgcaucuccucccgcggcaaccgcgacggccgcgucacccucggccccacccaggucuuccucgccaacaaggacuccggcuacccccagaucgucgacgucuccaacaugcagaaggcccaggaguuccuccccaagaagaucuccggcgacaugcgcggcauccaguacaaguggaaggaguccgagucccgcggcgagcgcgucaaguccaaggacuccuccuuccacaagcucaagaugaaggaccucaaggacuccuccaucgagauggagcuccgcaaggucaccuccgccaucgaggaggccgcccucgacuccuccgagcuccucaccaacauggaggacgaggacgacaccgacgagacccucaccucccuccucaacgagaucgccuuccucaaccagcagcucaacgacgacuccgucggccucgccgagcuccccuccuccauggacaccgaguuccccggcgacgcccgccgcgccuucaucuccaaggucccccccggcucccgcgccaccuuccaggucgagcaccucggcaccggccucaaggagcuccccgacguccagggcgaguccgacuccaucuccccccuccuccuccaccucgaggacgacgacuucuccgagaacgagaagcagcucgccgagcccgccuccgagcccgacguccucaagaucgucaucgacuccgagaucaaggacucccuccucuccaacaagaaggccaucgacggcggcaagaacaccuccggccuccccgccgagcccgaguccgucuccuccccccccacccuccacaugaagaccggccucgagaacuccaacuccaccgacacccucuggcgccccaugcccaagcucgccccccucggccucaaggucgccaaccccuccuccgacgccgacggccagucccucaaggucaugcccugccucgcccccaucgccgccaaggucggcuccgucggccacaagaugaaccucaccggcaacgaccaggagggccgcgaguccaaggucaugcccacccucgcccccgucgucgccaagcucggcaacuccggcgccucccccuccuccgccggcaaguga

SEQ ID NO: 45953 - RNA, 5574 nt, Artificial Sequence
  derived and/or modified sequence opt2 from MGAM__Homo_sapiens__NP_004659
auggcccgcaagaagcucaagaaguucaccacccucgagaucguccucuccguccuccuccucguccucuucaucaucuccaucguccucaucguccuccucgccaaggagucccucaaguccaccgcccccgaccccggcaccaccggcacccccgaccccggcaccaccggcacccccgaccccggcaccaccggcaccacccacgcccgcaccaccggcccccccgaccccggcaccaccggcaccacccccgucuccgccgagugccccgucgucaacgagcucgagcgcaucaacugcauccccgaccagccccccaccaaggccaccugcgaccagcgcggcugcugcuggaacccccagggcgccgucuccguccccuggugcuacuacuccaagaaccacuccuaccacgucgagggcaaccucgucaacaccaacgccggcuucaccgcccgccucaagaaccuccccuccucccccgucuucggcuccaacgucgacaacguccuccucaccgccgaguaccagaccuccaaccgcuuccacuucaagcucaccgaccagaccaacaaccgcuucgaggucccccacgagcacguccaguccuucuccggcaacgccgccgccucccucaccuaccaggucgagaucucccgccagcccuucuccaucaaggucacccgccgcuccaacaaccgcguccucuucgacuccuccaucggcccccuccucuucgccgaccaguuccuccagcucuccacccgccuccccuccaccaacgucuacggccucggcgagcacguccaccagcaguaccgccacgacaugaacuggaagaccuggcccaucuucaaccgcgacaccacccccaacggcaacggcaccaaccucuacggcgcccagaccuucuuccucugccucgaggacgccuccggccucuccuucggcgucuuccucaugaacuccaacgccauggaggucguccuccagcccgcccccgccaucaccuaccgcaccaucggcggcauccucgacuucuacgucuuccucggcaacacccccgagcaggucguccaggaguaccucgagcucaucggccgccccgcccuccccuccuacugggcccucggcuuccaccucucccgcuacgaguacggcacccucgacaacaugcgcgaggucgucgagcgcaaccgcgccgcccagcuccccuacgacguccagcacgccgacaucgacuacauggacgagcgccgcgacuucaccuacgacuccgucgacuucaagggcuuccccgaguucgucaacgagcuccacaacaacggccagaagcucgucaucaucgucgaccccgccaucuccaacaacuccuccuccuccaagcccuacggccccuacgaccgcggcuccgacaugaagaucugggucaacuccuccgacggcgucaccccccucaucggcgaggucuggcccggccagaccgucuuccccgacuacaccaaccccaacugcgccgucugguggaccaaggaguucgagcucuuccacaaccaggucgaguucgacggcaucuggaucgacaugaacgaggucuccaacuucgucgacggcuccgucuccggcugcuccaccaacaaccucaacaacccccccuucaccccccgcauccucgacggcuaccucuucugcaagacccucugcauggacgccguccagcacuggggcaagcaguacgacauccacaaccucuacggcuacuccauggccgucgccaccgccgaggccgccaagaccgucuuccccaacaagcgcuccuucauccucacccgcuccaccuucgccggcuccggcaaguucgccgcccacuggcucggcgacaacaccgccaccugggacgaccuccgcugguccauccccggcguccucgaguucaaccucuucggcauccccauggucggccccgacaucugcggcuucgcccucgacacccccgaggagcucugccgccgcuggaugcagcucggcgccuucuaccccuucucccgcaaccacaacggccagggcuacaaggaccaggaccccgccuccuucggcgccgacucccuccuccucaacuccucccgccacuaccucaacauccgcuacacccuccuccccuaccucuacacccucuucuuccgcgcccacucccgcggcgacaccgucgcccgcccccuccuccacgaguucuacgaggacaacuccaccugggacguccaccagcaguuccucuggggccccggccuccucaucacccccguccucgacgagggcgccgagaaggucauggccuacguccccgacgccgucugguacgacuacgagaccggcucccagguccgcuggcgcaagcagaaggucgagauggagcuccccggcgacaagaucggccuccaccuccgcggcggcuacaucuuccccacccagcagcccaacaccaccacccucgccucccgcaagaacccccucggccucaucaucgcccucgacgagaacaaggaggccaagggcgagcucuucugggacaacggcgagaccaaggacaccgucgccaacaaggucuaccuccucugcgaguucuccgucacccagaaccgccucgaggucaacaucucccaguccaccuacaaggaccccaacaaccucgccuucaacgagaucaagauccucggcaccgaggagcccuccaacgucaccgucaagcacaacggcguccccucccagaccucccccaccgucaccuacgacuccaaccucaaggucgccaucaucaccgacaucgaccuccuccucggcgaggccuacaccgucgagugguccaucaagauccgcgacgaggagaagaucgacugcuaccccgacgagaacggcgccuccgccgagaacugcaccgcccgcggcugcaucugggaggccuccaacuccuccggcguccccuucugcuacuucgucaacgaccucuacuccgucuccgacguccaguacaacucccacggcgccaccgccgacaucucccucaaguccuccgucuacgccaacgccuuccccuccacccccgucaacccccuccgccucgacgucaccuaccacaagaacgagaugcuccaguucaagaucuacgaccccaacaagaaccgcuacgagguccccgucccccucaacauccccuccaugcccuccuccacccccgagggccagcucuacgacguccucaucaagaagaaccccuucggcaucgagauccgccgcaaguccaccggcaccaucaucugggacucccagcuccucggcuucaccuucuccgacauguucauccgcaucuccacccgccuccccuccaaguaccucuacggcuucggcgagaccgagcaccgcuccuaccgccgcgaccucgaguggcacaccuggggcauguucucccgcgaccagccccccggcuacaagaagaacuccuacggcguccaccccuacuacaugggccucgaggaggacggcuccgcccacggcguccuccuccucaacuccaacgccauggacgucaccuuccagccccuccccgcccucaccuaccgcaccaccggcggcguccucgacuucuacgucuuccucggccccacccccgagcucgucacccagcaguacaccgagcucaucggccgccccgucaugguccccuacuggucccucggcuuccagcucugccgcuacggcuaccagaacgacuccgagaucgccucccucuacgacgagauggucgccgcccagauccccuacgacguccaguacuccgacaucgacuacauggagcgccagcucgacuucacccucucccccaaguucgccggcuuccccgcccucaucaaccgcaugaaggccgacggcaugcgcgucauccucauccucgaccccgccaucuccggcaacgagacccagcccuaccccgccuucacccgcggcgucgaggacgacgucuucaucaaguaccccaacgacggcgacaucgucuggggcaaggucuggcccgacuuccccgacgucgucgucaacggcucccucgacugggacucccaggucgagcucuaccgcgccuacgucgccuuccccgacuucuuccgcaacuccaccgccaagugguggaagcgcgagaucgaggagcucuacaacaacccccagaaccccgagcgcucccucaaguucgacggcauguggaucgacaugaacgagcccuccuccuucgucaacggcgccgucucccccggcugccgcgacgccucccucaaccacccccccuacaugccccaccucgagucccgcgaccgcggccucuccuccaagacccucugcauggagucccagcagauccuccccgacggcucccucguccagcacuacaacguccacaaccucuacggcuggucccagacccgccccaccuacgaggccguccaggaggucaccggccagcgcggcgucgucaucacccgcuccaccuuccccuccuccggccgcugggccggccacuggcucggcgacaacaccgccgccugggaccagcucaagaaguccaucaucggcaugauggaguucucccucuucggcaucuccuacaccggcgccgacaucugcggcuucuuccaggacgccgaguacgagaugugcguccgcuggaugcagcucggcgccuucuaccccuucucccgcaaccacaacaccaucggcacccgccgccaggaccccgucuccugggacgucgccuucgucaacaucucccgcaccguccuccagacccgcuacacccuccuccccuaccucuacacccucaugcacaaggcccacaccgagggcgucaccgucguccgcccccuccuccacgaguucgucuccgaccaggucaccugggacaucgacucccaguuccuccucggccccgccuuccucgucucccccguccucgagcgcaacgcccgcaacgucaccgccuacuucccccgcgcccgcugguacgacuacuacaccggcgucgacaucaacgcccgcggcgaguggaagacccuccccgccccccucgaccacaucaaccuccacguccgcggcggcuacauccuccccuggcaggagcccgcccucaacacccaccucucccgccagaaguucaugggcuucaagaucgcccucgacgacgagggcaccgccggcggcuggcucuucugggacgacggccaguccaucgacaccuacggcaagggccucuacuaccucgccuccuucuccgccucccagaacaccaugcagucccacaucaucuucaacaacuacaucaccggcaccaacccccucaagcucggcuacaucgagaucuggggcgucggcuccguccccgucaccuccgucuccaucuccgucuccggcauggucaucacccccuccuucaacaacgaccccaccacccagguccucuccaucgacgucaccgaccgcaacaucucccuccacaacuucaccucccucaccuggaucuccacccucuga

SEQ ID NO: 45954 - RNA, 723 nt, Artificial Sequence
  derived and/or modified sequence opt2 from MGARP__Homo_sapiens__NP_116012
auguaccuccgccgcgccgucuccaagacccucgcccucccccuccgcgccccccccaaccccgccccccucggcaaggacgccucccuccgccgcauguccuccaaccgcuuccccggcuccuccggcuccaacaugaucuacuaccucgucgucggcgucaccgucuccgccggcggcuacuacgccuacaagaccgucaccuccgaccaggccaagcacaccgagcacaagaccaaccucaaggagaagaccaaggccgagauccaccccuuccagggcgagaaggagaacgucgccgagaccgagaaggccuccuccgaggcccccgaggagcucaucgucgaggccgaggucgucgacgccgaggagucccccuccgccaccgucgucgucaucaaggaggccuccgccugccccggccacgucgaggccgcccccgagaccaccgccgucuccgccgagaccggccccgaggucaccgacgccgccgcccgcgagaccaccgaggucaaccccgagaccacccccgaggucaccaacgccgcccucgacgaggccgucaccaucgacaacgacaaggacaccaccaagaacgagaccuccgacgaguacgccgagcucgaggaggagaacucccccgccgaguccgaguccuccgccggcgacgaccuccaggaggaggccuccgucggcuccgaggccgccuccgcccagggcuga

SEQ ID NO: 45955 - RNA, 1338 nt, Artificial Sequence
  derived and/or modified sequence opt2 from MGAT1__Homo_sapiens__XP_011532865
augcucaagaagcaguccgccggccucguccucuggggcgccauccucuucgucgccuggaacgcccuccuccuccucuucuucuggacccgccccgcccccggccgcccccccuccgucuccgcccucgacggcgaccccgccucccucacccgcgaggucauccgccucgcccaggacgccgaggucgagcucgagcgccagcgcggccuccuccagcagaucggcgacgcccucuccucccagcgcggccgcguccccaccgccgccccccccgcccagccccgcguccccgucacccccgcccccgccgucauccccauccucgucaucgccugcgaccgcuccaccguccgccgcugccucgacaagcuccuccacuaccgccccuccgccgagcucuuccccaucaucgucucccaggacugcggccacgaggagaccgcccaggccaucgccuccuacggcuccgccgucacccacauccgccagcccgaccucuccuccaucgccgucccccccgaccaccgcaaguuccagggcuacuacaagaucgcccgccacuaccgcugggcccucggccaggucuuccgccaguuccgcuuccccgccgccgucgucgucgaggacgaccucgaggucgcccccgacuucuucgaguacuuccgcgccaccuacccccuccucaaggccgaccccucccucuggugcgucuccgccuggaacgacaacggcaaggagcagauggucgacgccucccgccccgagcuccucuaccgcaccgacuucuuccccggccucggcuggcuccuccucgccgagcucugggccgagcucgagcccaaguggcccaaggccuucugggacgacuggaugcgccgccccgagcagcgccagggccgcgccugcauccgccccgagaucucccgcaccaugaccuucggccgcaagggcgucucccacggccaguucuucgaccagcaccucaaguucaucaagcucaaccagcaguucguccacuucacccagcucgaccucuccuaccuccagcgcgaggccuacgaccgcgacuuccucgcccgcgucuacggcgccccccagcuccaggucgagaagguccgcaccaacgaccgcaaggagcucggcgagguccgcguccaguacaccggccgcgacuccuucaaggccuucgccaaggcccucggcgucauggacgaccucaaguccggcgucccccgcgccggcuaccgcggcaucgucaccuuccaguuccgcggccgccgcguccaccucgcccccccccucaccugggagggcuacgaccccuccuggaacuga

SEQ ID NO: 45956 - RNA, 1344 nt, Artificial Sequence
  derived and/or modified sequence opt2 from MGAT2__Homo_sapiens__NP_002399
augcgcuuccgcaucuacaagcgcaagguccucauccucacccucgucgucgccgccugcggcuucguccucugguccuccaacggccgccagcgcaagaacgaggcccucgcccccccccuccucgacgccgagcccgcccgcggcgccggcggccgcggcggcgaccaccccuccgucgccgucggcauccgccgcgucuccaacgucuccgccgccucccucguccccgccgucccccagcccgaggccgacaaccucacccuccgcuaccgcucccucgucuaccagcucaacuucgaccagacccuccgcaacgucgacaaggccggcaccugggccccccgcgagcucguccucgucguccagguccacaaccgccccgaguaccuccgccuccuccucgacucccuccgcaaggcccagggcaucgacaacguccucgucaucuucucccacgacuucugguccaccgagaucaaccagcucaucgccggcgucaacuucugccccguccuccaggucuucuuccccuucuccauccagcucuaccccaacgaguuccccggcuccgacccccgcgacugcccccgcgaccuccccaagaacgccgcccucaagcucggcugcaucaacgccgaguaccccgacuccuucggccacuaccgcgaggccaaguucucccagaccaagcaccacuggugguggaagcuccacuucgucugggagcgcgucaagauccuccgcgacuacgccggccucauccucuuccucgaggaggaccacuaccucgcccccgacuucuaccacgucuucaagaagauguggaagcucaagcagcaggagugccccgagugcgacguccucucccucggcaccuacuccgccucccgcuccuucuacggcauggccgacaaggucgacgucaagaccuggaaguccaccgagcacaacaugggccucgcccucacccgcaacgccuaccagaagcucaucgagugcaccgacaccuucugcaccuacgacgacuacaacugggacuggacccuccaguaccucaccgucuccugccuccccaaguucuggaagguccucgucccccagaucccccgcaucuuccacgccggcgacugcggcaugcaccacaagaagaccugccgccccuccacccaguccgcccagaucgagucccuccucaacaacaacaagcaguacauguuccccgagacccucaccaucuccgagaaguucaccgucgucgccaucucccccccccgcaagaacggcggcuggggcgacauccgcgaccacgagcucugcaaguccuaccgccgccuccaguga

SEQ ID NO: 45957 - RNA, 1602 nt, Artificial Sequence
  derived and/or modified sequence opt2 from MGAT3__Homo_sapiens__NP_001091740
augaagaugcgccgcuacaagcucuuccucauguucugcauggccggccucugccucaucuccuuccuccacuucuucaagacccucuccuacgucaccuucccccgcgagcucgccucccucucccccaaccucgucuccuccuucuucuggaacaacgcccccgucaccccccaggccucccccgagcccggcggccccgaccuccuccgcaccccccucuacucccacuccccccuccuccagccccucccccccuccaaggccgccgaggagcuccaccgcgucgaccucguccuccccgaggacaccaccgaguacuucguccgcaccaaggccggcggcgucugcuucaagcccggcaccaagaugcucgagcgccccccccccggccgccccgaggagaagcccgagggcgccaacggcuccuccgcccgccgccccccccgcuaccuccucuccgcccgcgagcgcaccggcggccgcggcgcccgccgcaagugggucgagugcgucugccuccccggcuggcacggccccuccugcggcguccccaccgucguccaguacuccaaccuccccaccaaggagcgccucgucccccgcgaggucccccgccgcgucaucaacgccaucaacgucaaccacgaguucgaccuccucgacguccgcuuccacgagcucggcgacgucgucgacgccuucgucgucugcgaguccaacuucaccgccuacggcgagccccgcccccucaaguuccgcgagaugcucaccaacggcaccuucgaguacauccgccacaagguccucuacgucuuccucgaccacuucccccccggcggccgccaggacggcuggaucgccgacgacuaccuccgcaccuuccucacccaggacggcgucucccgccuccgcaaccuccgccccgacgacgucuucaucaucgacgacgccgacgagauccccgcccgcgacggcguccucuuccucaagcucuacgacggcuggaccgagcccuucgccuuccacaugcgcaagucccucuacggcuucuucuggaagcagcccggcacccucgaggucgucuccggcugcaccgucgacaugcuccaggccgucuacggccucgacggcauccgccuccgccgccgccaguacuacaccaugcccaacuuccgccaguacgagaaccgcaccggccacauccucguccaguggucccucggcuccccccuccacuucgccggcuggcacugcuccuggugcuucacccccgagggcaucuacuucaagcucgucuccgcccagaacggcgacuucccccgcuggggcgacuacgaggacaagcgcgaccucaacuacauccgcggccucauccgcaccggcggcugguucgacggcacccagcaggaguacccccccgccgaccccuccgagcacauguacgcccccaaguaccuccucaagaacuacgaccgcuuccacuaccuccucgacaaccccuaccaggagccccgcuccaccgccgccggcggcuggcgccaccgcggccccgagggccgcccccccgcccgcggcaagcucgacgaggccgaggucuga

SEQ ID NO: 45958 - RNA, 1272 nt, Artificial Sequence
  derived and/or modified sequence opt2 from MGAT4A__Homo_sapiens__NP_001153626
augaacuacuccaucaccgucuccaucgucaugggcauccccaccgucaagcgcgaggucaaguccuaccucaucgagacccuccacucccucaucgacaaccucuaccccgaggagaagcucgacugcgucaucgucgucuucaucggcgagaccgacaucgacuacguccacggcgucgucgccaaccucgagaaggaguucuccaaggagaucuccuccggccucgucgaggucaucuccccccccgaguccuacuaccccgaccucaccaaccucaaggagaccuucggcgacuccaaggagcgcguccgcuggcgcaccaagcagaaccucgacuacugcuuccucaugauguacgcccaggagaagggcaucuacuacauccagcucgaggacgacaucaucgucaagcagaacuacuucaacaccaucaagaacuucgcccuccagcucuccuccgaggaguggaugauccucgaguucucccagcucggcuucaucggcaagauguuccaggcccccgaccucacccucaucgucgaguucaucuucauguucuacaaggagaagcccaucgacuggcuccucgaccacauccucugggucaaggucugcaaccccgagaaggacgccaagcacugcgaccgccagaaggccaaccuccgcauccgcuuccgccccucccucuuccagcacgucggccuccacuccucccucuccggcaagauccagaagcucaccgacaaggacuacaugaagccccuccuccucaagauccacgucaacccccccgccgaggucuccaccucccucaaggucuaccagggccacacccucgagaagaccuacaugggcgaggacuucuucugggccaucacccccaucgccggcgacuacauccucuucaaguucgacaagcccgucaacgucgaguccuaccucuuccacuccggcaaccaggagcaccccggcgacauccuccucaacaccaccgucgagguccuccccuucaaguccgagggccucgagaucuccaaggagaccaaggacaagcgccucgaggacggcuacuuccgcaucggcaaguucgagaacggcgucgccgagggcauggucgaccccucccucaaccccaucuccgccuuccgccucuccgucauccagaacuccgccgucugggccauccucaacgagcagcgcgucuucuccggcugguggcagaagucccgcgacaaggccgagggcccccaggccccccuccucuucuga

SEQ ID NO: 45959 - RNA, 1647 nt, Artificial Sequence
  derived and/or modified sequence opt2 from MGAT4B__Homo_sapiens__NP_055090
augcgccuccgcaacggcaccuuccucacccuccuccucuucugccucugcgccuuccucucccucuccugguacgccgcccucuccggccagaagggcgacgucgucgacgucuaccagcgcgaguuccucgcccuccgcgaccgccuccacgccgccgagcaggagucccucaagcgcuccaaggagcucaaccucguccucgacgagaucaagcgcgccgucuccgagcgccaggcccuccgcgacggcgacggcaaccgcaccuggggccgccucaccgaggacccccgccucaagcccuggaacggcucccaccgccacguccuccaccuccccaccgucuuccaccaccucccccaccuccucgccaaggaguccucccuccagcccgccguccgcgucggccagggccgcaccggcgucuccgucgucaugggcauccccuccguccgccgcgagguccacuccuaccucaccgacacccuccacucccucaucuccgagcucuccccccaggagaaggaggacuccgucaucgucguccucaucgccgagaccgacucccaguacaccuccgccgucaccgagaacaucaaggcccucuuccccaccgagauccacuccggccuccucgaggucaucucccccuccccccacuucuaccccgacuucucccgccuccgcgaguccuucggcgaccccaaggagcgcguccgcuggcgcaccaagcagaaccucgacuacugcuuccucaugauguacgcccaguccaagggcaucuacuacguccagcucgaggacgacaucgucgccaagcccaacuaccucuccaccaugaagaacuucgcccuccagcagcccuccgaggacuggaugauccucgaguucucccagcucggcuucaucggcaagauguucaagucccucgaccucucccucaucgucgaguucauccucauguucuaccgcgacaagcccaucgacuggcuccucgaccacauccucugggucaaggucugcaaccccgagaaggacgccaagcacugcgaccgccagaaggccaaccuccgcauccgcuucaagcccucccucuuccagcacgucggcacccacuccucccucgccggcaagauccagaagcucaaggacaaggacuucggcaagcaggcccuccgcaaggagcacgucaacccccccgccgaggucuccaccucccucaagaccuaccagcacuucacccucgagaaggccuaccuccgcgaggacuucuucugggccuucacccccgccgccggcgacuucauccgcuuccgcuucuuccagccccuccgccucgagcgcuucuucuuccgcuccggcaacaucgagcaccccgaggacaagcucuucaacaccuccgucgagguccuccccuucgacaacccccaguccgacaaggaggcccuccaggagggccgcaccgccacccuccgcuacccccgcucccccgacggcuaccuccagaucggcuccuucuacaagggcgucgccgagggcgaggucgaccccgccuucggcccccucgaggcccuccgccucuccauccagaccgacucccccgucugggucauccucuccgagaucuuccucaagaaggccgacuga

SEQ ID NO: 45960 - RNA, 1437 nt, Artificial Sequence
  derived and/or modified sequence opt2 from MGAT4C__Homo_sapiens__NP_037376
auguucaaguuccaccagaugaagcacaucuucgagauccucgacaagaugcgcugccuccgcaagcgcuccaccgucuccuuccucggcguccucgucaucuuccuccucuucaugaaccucuacaucgaggacuccuacguccucgagggcgacaagcagcucauccgcgagaccuccacccaccagcucaacuccgagcgcuacguccacaccuucaaggaccucuccaacuucuccggcgccaucaacgucaccuaccgcuaccucgccgccaccccccuccagcgcaagcgcuaccucaccaucggccucuccuccgucaagcgcaagaagggcaacuaccuccucgagaccaucaaguccaucuucgagcaguccuccuacgaggagcucaaggagaucuccgucgucguccaccucgccgacuucaacuccuccuggcgcgacgccaugguccaggacaucacccagaaguucgcccaccacaucaucgccggccgccucauggucauccacgcccccgaggaguacuaccccauccucgacggccucaagcgcaacuacaacgaccccgaggaccgcgucaaguuccgcuccaagcagaacgucgacuacgccuuccuccucaacuucugcgccaacaccuccgacuacuacgucaugcucgaggacgacguccgcugcuccaagaacuuccucaccgccaucaagaaggucaucgccucccucgagggcaccuacugggucacccucgaguucuccaagcucggcuacaucggcaagcucuaccacucccacgaccucccccgccucgcccacuuccuccucauguucuaccaggagaugcccugcgacuggcuccucacccacuuccgcggccuccucgcccagaagaacgucauccgcuucaagcccucccucuuccagcacaugggcuacuacuccuccuacaagggcaccgagaacaagcucaaggacgacgacuucgaggaggaguccuucgacauccccgacaacccccccgccucccucuacaccaacaugaacgucuucgagaacuacgaggccuccaaggccuacuccuccgucgacgaguacuucuggggcaagccccccuccaccggcgacgucuucgucaucgucuucgagaaccccaucaucaucaagaagaucaaggucaacaccggcaccgaggaccgccagaacgacauccuccaccacggcgcccucgacgucggcgagaacgucaugcccuccaagcagcgccgccagugcuccaccuaccuccgccucggcgaguucaagaacggcaacuucgagauguccggcgucaaccagaagauccccuucgacauccacugcaugcgcaucuacgucaccaagacccagaaggaguggcucaucauccgcuccaucuccaucuggaccuccuga

SEQ ID NO: 45961 - RNA, 2379 nt, Artificial Sequence
  derived and/or modified sequence opt2 from MGAT5B__Homo_sapiens__NP_001186101
augaucaccgucaaccccgacggcaagaucaugguccgccgcugccucgucacccuccgccccuuccgccucuucguccucggcaucggcuucuucacccucugcuuccucaugaccucccucggcggccaguucuccgcccgccgccucggcgacucccccuucaccauccgcaccgaggucaugggcggccccgagucccgcggcguccuccgcaagauguccgaccuccucgagcucauggucaagcgcauggacgcccucgcccgccucgagaacuccuccgagcuccaccgcgccggcggcgaccuccacuuccccgccgaccgcaugccccccggcgccggccucauggagcgcauccaggccaucgcccagaacgucuccgacaucgccgucaaggucgaccagauccuccgccacucccuccuccuccacuccaaggucuccgagggccgccgcgaccagugcgaggcccccuccgaccccaaguuccccgacugcuccggcaaggucgaguggaugcgcgcccgcuggaccuccgaccccugcuacgccuucuucggcgucgacggcaccgagugcuccuuccucaucuaccucuccgaggucgagugguucugccccccccuccccuggcgcaaccagaccgccgcccagcgcgcccccaagccccuccccaagguccaggccgucuuccgcuccaaccucucccaccuccucgaccucaugggcuccggcaaggagucccucaucuucaugaagaagcgcaccaagcgccucaccgcccagugggcccucgccgcccagcgccucgcccagaagcucggcgccacccagcgcgaccagaagcagauccucguccacaucggcuuccucaccgaggaguccggcgacgucuucuccccccgcguccucaagggcggcccccucggcgagaugguccagugggccgacauccucaccgcccucuacguccucggccacggccuccgcgucaccgucucccucaaggagcuccaguccaaccucggcgucccccccggccgcggcuccugcccccucaccaugccccuccccuucgaccucaucuacaccgacuaccacggccuccagcagaugaagcgccacaugggccucuccuucaagaaguaccgcugccgcauccgcgucaucgacaccuucggcaccgagcccgccuacaaccacgaggaguacgccacccuccacggcuaccgcaccaacuggggcuacuggaaccucaaccccaagcaguucaugaccauguucccccacacccccgacaacuccuucaugggcuucgucuccgaggagcucaacgagaccgagaagcgccucaucaagggcggcaaggccuccaacauggccgucgucuacggcaaggaggccuccaucuggaagcuccagggcaaggagaaguuccucggcauccucaacaaguacauggagauccacggcaccgucuacuacgagucccagcgcccccccgagguccccgccuucgucaagaaccacggccuccucccccagcccgaguuccagcagcuccuccgcaaggccaagcucuucaucggcuucggcuuccccuacgagggccccgccccccucgaggccaucgccaacggcugcaucuuccuccagucccgcuucucccccccccacuccucccucaaccacgaguucuuccgcggcaagcccaccucccgcgaggucuucucccagcaccccuacgccgagaacuucaucggcaagccccacgucuggaccgucgacuacaacaacuccgaggaguucgaggccgccaucaaggccaucaugcgcacccaggucgaccccuaccuccccuacgaguacaccugcgagggcaugcucgagcgcauccacgccuacauccagcaccaggacuucugccgcgcccccgaccccgcccuccccgaggcccacgccccccagucccccuucguccucgcccccaacgccacccaccucgagugggcccgcaacaccucccucgcccccggcgccuggccccccgcccacgcccuccgcgccuggcucgccguccccggccgcgccugcaccgacaccugccucgaccacggccucaucugcgagcccuccuucuuccccuuccucaacucccaggacgccuuccucaagcuccagguccccugcgacuccaccgaguccgagaugaaccaccucuaccccgccuucgcccagcccggccaggagugcuaccuccagaaggagccccuccucuucuccugcgccggcuccaacaccaaguaccgccgccucugccccugccgcgacuuccgcaagggccaggucgcccucugccagggcugccucuga

SEQ ID NO: 45962 - RNA, 2226 nt, Artificial Sequence
  derived and/or modified sequence opt2 from MGAT5__Homo_sapiens__XP_011509505
auggcccucuucacccccuggaagcucuccucccagaagcucggcuucuuccucgucaccuucggcuucaucuggggcaugaugcuccuccacuucaccauccagcagcgcacccagcccgaguccuccuccaugcuccgcgagcagauccucgaccucuccaagcgcuacaucaaggcccucgccgaggagaaccgcaacgucgucgacggccccuacgccggcgucaugaccgccuacgaccucaagaagacccucgccguccuccucgacaacauccuccagcgcaucggcaagcucgaguccaaggucgacaaccucgucgucaacggcaccggcaccaacuccaccaacuccaccaccgccguccccucccucgucgcccucgagaagaucaacgucgccgacaucaucaacggcgcccaggagaagugcguccucccccccauggacggcuacccccacugcgagggcaagaucaaguggaugaaggacauguggcgcuccgaccccugcuacgccgacuacggcgucgacggcuccaccugcuccuucuucaucuaccucuccgaggucgagaacuggugcccccaccuccccuggcgcgccaagaaccccuacgaggaggccgaccacaacucccucgccgagauccgcaccgacuucaacauccucuacuccaugaugaagaagcacgaggaguuccgcuggaugcgccuccgcauccgccgcauggccgacgccuggauccaggccaucaagucccucgccgagaagcagaaccucgagaagcgcaagcgcaagaagguccucguccaccucggccuccucaccaaggaguccggcuucaagaucgccgagaccgccuucuccggcggcccccucggcgagcucguccagugguccgaccucaucaccucccucuaccuccucggccacgacauccgcaucuccgccucccucgccgagcucaaggagaucaugaagaaggucgucggcaaccgcuccggcugccccaccgucggcgaccgcaucgucgagcucaucuacaucgacaucgucggccucgcccaguucaagaagacccucggccccuccuggguccacuaccagugcaugcuccgcguccucgacuccuucggcaccgagcccgaguucaaccacgccaacuacgcccaguccaagggccacaagacccccuggggcaaguggaaccucaacccccagcaguucuacaccauguucccccacacccccgacaacuccuuccucggcuucgucgucgagcagcaccucaacuccuccgacauccaccacaucaacgagaucaagcgccagaaccagucccucgucuacggcaaggucgacuccuucuggaagaacaagaagaucuaccucgacaucauccacaccuacauggagguccacgccaccgucuacggcuccuccaccaagaacauccccuccuacgucaagaaccacggcauccucuccggccgcgaccuccaguuccuccuccgcgagaccaagcucuucgucggccucggcuuccccuacgagggccccgccccccucgaggccaucgccaacggcugcgccuuccucaaccccaaguucaacccccccaaguccuccaagaacaccgacuucuucaucggcaagcccacccuccgcgagcucaccucccagcaccccuacgccgaggucuucaucggccgcccccacgucuggaccgucgaccucaacaaccaggaggaggucgaggacgccgucaaggccauccucaaccagaagaucgagcccuacaugcccuacgaguucaccugcgagggcaugcuccagcgcaucaacgccuucaucgagaagcaggacuucugccacggccaggucauguggcccccccucuccgcccuccaggucaagcucgccgagcccggccaguccugcaagcaggucugccaggagucccagcucaucugcgagcccuccuucuuccagcaccucaacaaggacaaggacaugcucaaguacaaggucaccugccaguccuccgagcucgccaaggacauccucguccccuccuucgaccccaagaacaagcacugcgucuuccagggcgaccuccuccucuucuccugcgccggcgcccacccccgccaccagcgcgucugccccugccgcgacuucaucaagggccaggucgcccucugcaaggacugccucuga

SEQ ID NO: 45963 - RNA, 2592 nt, Artificial Sequence
  derived and/or modified sequence opt2 from MGEA5__Homo_sapiens__NP_001135906
augguccagaaggagucccaggccacccucgaggagcgcgaguccgagcucuccuccaaccccgccgccuccgccggcgccucccucgagccccccgccgcccccgcccccggcgaggacaaccccgccggcgccggcggcgccgccgucgccggcgccgccggcggcgcccgccgcuuccucugcggcgucgucgagggcuucuacggccgccccugggucauggagcagcgcaaggagcucuuccgccgccuccagaagugggagcucaacaccuaccucuacgcccccaaggacgacuacaagcaccgcauguucuggcgcgagauguacuccgucgaggaggccgagcagcucaugacccucaucuccgccgcccgcgaguacgagaucgaguucaucuacgccaucucccccggccucgacaucaccuucuccaaccccaaggaggucuccacccucaagcgcaagcucgaccaggucucccaguucggcugccgcuccuucgcccuccucuucgacgacaucgaccacaacaugugcgccgccgacaaggaggucuucuccuccuucgcccacgcccaggucuccaucaccaacgagaucuaccaguaccucggcgagcccgagaccuuccucuucugccccaccgaguacugcggcaccuucugcuaccccaacgucucccagucccccuaccuccgcaccgucggcgagaagcuccuccccggcaucgagguccucuggaccggccccaaggucgucuccaaggagauccccgucgaguccaucgaggaggucuccaagaucaucaagcgcgcccccgucaucugggacaacauccacgccaacgacuacgaccagaagcgccucuuccucggccccuacaagggccgcuccaccgagcucaucccccgccucaagggcguccucaccaaccccaacugcgaguucgaggccaacuacgucgccauccacacccucgccaccugguacaaguccaacaugaacggcguccgcaaggacgucgucaugucccgccaggucgcccacuccggcgccaaggccuccgucgucgacggcaccccccucgucgccgcccccucccucaacgccaccaccgucgucaccaccgucuaccaggagcccaucaugucccagggcgccgcccucuccggcgagcccaccacccucaccaaggaggaggagaagaagcagcccgacgaggagcccauggacauggucgucgagaagcaggaggagaccgaccacaagaacgacaaccagauccucuccgagaucgucgaggccaagauggccgaggagcucaagcccauggacaccgacaaggaguccaucgccgaguccaagucccccgagauguccaugcaggaggacugcaucuccgacaucgcccccaugcagaccgacgagcagaccaacaaggagcaguucguccccggccccaacgagaagccccucuacaccgccgagcccgucacccucgaggaccuccagcuccucgccgaccucuucuaccuccccuacgagcacggccccaagggcgcccagaugcuccgcgaguuccaguggcuccgcgccaacuccuccgucgucuccgucaacugcaagggcaaggacuccgagaagaucgaggaguggcgcucccgcgccgccaaguucgaggagaugugcggccucgucaugggcauguucacccgccucuccaacugcgccaaccgcaccauccucuacgacauguacuccuacgucugggacaucaaguccaucauguccauggucaaguccuucguccaguggcucggcugccgcucccacuccuccgcccaguuccucaucggcgaccaggagcccugggccuuccgcggcggccucgccggcgaguuccagcgccuccuccccaucgacggcgccaacgaccucuucuuccagccccccccccucacccccaccuccaaggucuacaccauccgccccuacuuccccaaggacgaggccuccgucuacaagaucugccgcgagauguacgacgacggcgucggccuccccuuccagucccagcccgaccucaucggcgacaagcucgucggcggccuccucucccucucccucgacuacugcuucguccucgaggacgaggacggcaucugcggcuacgcccucggcaccgucgacgucacccccuucaucaagaagugcaagaucuccuggauccccuucaugcaggagaaguacaccaagcccaacggcgacaaggagcucuccgaggccgagaagaucaugcucuccuuccacgaggagcaggagguccuccccgagaccuuccucgccaacuuccccucccucaucaagauggacauccacaagaaggucaccgaccccuccgucgccaaguccaugauggccugccuccucuccucccucaaggccaacggcucccgcggcgccuucugcgagguccgccccgacgacaagcgcauccucgaguucuacuccaagcucggcugcuucgagaucgccaagauggagggcuuccccaaggacgucgucauccucggccgcucccucuga

SEQ ID NO: 45964 - RNA, 912 nt, Artificial Sequence
  derived and/or modified sequence opt2 from MGLL__Homo_sapiens__NP_001003794
augcccgaggaguccuccccccgccgcaccccccaguccauccccuaccaggaccucccccaccucgucaacgccgacggccaguaccucuucugccgcuacuggaagcccaccggcacccccaaggcccucaucuucgucucccacggcgccggcgagcacuccggccgcuacgaggagcucgcccgcaugcucaugggccucgaccuccucgucuucgcccacgaccacgucggccacggccaguccgagggcgagcgcauggucgucuccgacuuccacgucuucguccgcgacguccuccagcacgucgacuccaugcagaaggacuaccccggccuccccgucuuccuccucggccacuccaugggcggcgccaucgccauccucaccgccgccgagcgccccggccacuucgccggcaugguccucaucuccccccucguccucgccaaccccgaguccgccaccaccuucaagguccucgccgccaagguccucaaccucguccuccccaaccucucccucggccccaucgacuccuccguccucucccgcaacaagaccgaggucgacaucuacaacuccgacccccucaucugccgcgccggccucaaggucugcuucggcauccagcuccucaacgccgucucccgcgucgagcgcgcccuccccaagcucaccguccccuuccuccuccuccagggcuccgccgaccgccucugcgacuccaagggcgccuaccuccucauggagcucgccaagucccaggacaagacccucaagaucuacgagggcgccuaccacguccuccacaaggagcuccccgaggucaccaacuccgucuuccacgagaucaacaugugggucucccagcgcaccgccaccgccggcaccgccuccccccccuga

SEQ ID NO: 45965 - RNA, 1035 nt, Artificial Sequence
  derived and/or modified sequence opt2 from MGME1__Homo_sapiens__NP_443097
augaagaugaagcucuuccagaccaucugccgccagcuccgcuccuccaaguucuccgucgaguccgccgcccucgucgccuucuccaccuccuccuacuccugcggccgcaagaagaaggucaaccccuacgaggaggucgaccaggagaaguacuccaaccucguccaguccguccucuccucccgcggcgucgcccagacccccggcuccgucgaggaggacgcccuccucugcggccccgucuccaagcacaagcuccccaaccagggcgaggaccgccgcgucccccagaacugguuccccaucuucaaccccgagcgcuccgacaagcccaacgccuccgaccccuccgucccccucaagaucccccuccagcgcaacgucauccccuccgucacccgcguccuccagcagaccaugaccaagcagcaggucuuccuccucgagcgcuggaagcagcgcaugauccucgagcucggcgaggacggcuucaaggaguacaccuccaacgucuuccuccagggcaagcgcuuccacgaggcccucgaguccauccucuccccccaggagacccucaaggagcgcgacgagaaccuccucaaguccggcuacaucgaguccguccagcacauccucaaggacgucuccggcguccgcgcccucgaguccgccguccagcacgagacccucaacuacaucggccuccucgacugcgucgccgaguaccagggcaagcucugcgucaucgacuggaagaccuccgagaagcccaagcccuucauccaguccaccuucgacaacccccuccaggucgucgccuacaugggcgccaugaaccacgacaccaacuacuccuuccagguccagugcggccucaucgucgucgccuacaaggacggcucccccgcccacccccacuucauggacgccgagcucugcucccaguacuggaccaaguggcuccuccgccucgaggaguacaccgagaagaagaagaaccagaacauccagaagcccgaguacuccgaguga

SEQ ID NO: 45966 - RNA, 717 nt, Artificial Sequence
  derived and/or modified sequence opt2 from MGMT__Homo_sapiens__NP_002403
augcucggccagcccgccccccucgagcgcuucgccucccgccgcccccagguccucgccguccgcaccgucugcgaccucguccucggcaagauggacaaggacugcgagaugaagcgcaccacccucgacuccccccucggcaagcucgagcucuccggcugcgagcagggccuccacgagaucaagcuccucggcaagggcaccuccgccgccgacgccgucgagguccccgcccccgccgccguccucggcggccccgagccccucaugcagugcaccgccuggcucaacgccuacuuccaccagcccgaggccaucgaggaguuccccguccccgcccuccaccaccccgucuuccagcaggaguccuucacccgccagguccucuggaagcuccucaaggucgucaaguucggcgaggucaucuccuaccagcagcucgccgcccucgccggcaaccccaaggccgcccgcgccgucggcggcgccaugcgcggcaaccccguccccauccucauccccugccaccgcgucgucugcuccuccggcgccgucggcaacuacuccggcggccucgccgucaaggaguggcuccucgcccacgagggccaccgccucggcaagcccggccucggcggcuccuccggccucgccggcgccuggcucaagggcgccggcgccaccuccggcuccccccccgccggccgcaacuga

SEQ ID NO: 45967 - RNA, 312 nt, Artificial Sequence
  derived and/or modified sequence opt2 from MGP__Homo_sapiens__NP_000891
augaagucccucauccuccucgccauccucgccgcccucgccgucgucacccucugcuacgagucccacgaguccauggaguccuacgagcucaaccccuucaucaaccgccgcaacgccaacaccuucaucuccccccagcagcgcuggcgcgccaagguccaggagcgcauccgcgagcgcuccaagcccguccacgagcucaaccgcgaggccugcgacgacuaccgccucugcgagcgcuacgccauggucuacggcuacaacgccgccuacaaccgcuacuuccgcaagcgccgcggcaccaaguga

SEQ ID NO: 45968 - RNA, 1665 nt, Artificial Sequence
  derived and/or modified sequence opt2 from MGRN1__Homo_sapiens__NP_001135761
augggcuccauccucucccgccgcaucgccggcgucgaggacaucgacauccaggccaacuccgccuaccgcuacccccccaaguccggcaacuacuucgccucccacuucuucaugggcggcgagaaguucgacaccccccaccccgagggcuaccucuucggcgagaacauggaccucaacuuccucggcucccgccccguccaguuccccuacgucacccccgccccccacgagcccgucaagacccuccgcucccucgucaacauccgcaaggacucccuccgccucguccgcuacaaggacgacgccgacucccccaccgaggacggcgacaagccccgcguccucuacucccucgaguucaccuucgacgccgacgcccgcgucgccaucaccaucuacugccaggccuccgaggaguuccucaacggccgcgccgucuacucccccaagucccccucccuccaguccgagaccguccacuacaagcgcggcgucucccagcaguucucccuccccuccuucaagaucgacuucuccgaguggaaggacgacgagcucaacuucgaccucgaccgcggcgucuuccccgucgucauccaggccgucgucgacgagggcgacgucgucgaggucaccggccacgcccacguccuccucgccgccuucgagaagcacauggacggcuccuucuccgucaagccccucaagcagaagcagaucgucgaccgcgucuccuaccuccuccaggagaucuacggcaucgagaacaagaacaaccaggagaccaagcccuccgacgacgagaacuccgacaacuccaacgagugcgucgucugccucuccgaccuccgcgacacccucauccuccccugccgccaccucugccucugcaccuccugcgccgacacccuccgcuaccaggccaacaacugccccaucugccgccuccccuuccgcgcccuccuccagauccgcgccguccgcaagaagcccggcgcccucucccccgucuccuucucccccguccucgcccagucccucgagcacgacgagcacuccaacuccgacuccgucccccccggcuacgagcccaucucccuccucgaggcccucaacggccuccgcgccgucucccccgccauccccuccgccccccucuacgaggagaucaccuacuccggcaucuccgacggccucucccaggccuccugcccccucgccgccaucgaccacauccucgacuccucccgccagaagggccgcccccaguccaaggcccccgacuccacccuccgcucccccuccucccccauccacgaggaggacgaggagaagcucuccgaggacgucgacgccccccccccccucggcggcgccgagcucgcccuccgcgaguccuccucccccgaguccuucaucaccgaggaggucgacgaguccuccuccccccagcagggcacccgcgccgccuccaucgagaacguccuccaggacuccucccccgagcacugcggccgcggcccccccgccgacaucuaccuccccggccgccccaccuccauggagaccgcccacggccucgccaccaccucccccaccuggcccccccucggcggccccucccccgaccccuccgccgccgagcucaccccccucuga

SEQ ID NO: 45969 - RNA, 468 nt, Artificial Sequence
  derived and/or modified sequence opt2 from MGST1__Homo_sapiens__NP_001247440
auggucgaccucacccaggucauggacgacgaggucuucauggccuucgccuccuacgccaccaucauccucuccaagaugaugcucauguccaccgccaccgccuucuaccgccucacccgcaaggucuucgccaaccccgaggacugcgucgccuucggcaagggcgagaacgccaagaaguaccuccgcaccgacgaccgcgucgagcgcguccgccgcgcccaccucaacgaccucgagaacaucauccccuuccucggcaucggccuccucuacucccucuccggccccgaccccuccaccgccauccuccacuuccgccucuucgucggcgcccgcaucuaccacaccaucgccuaccucaccccccucccccagcccaaccgcgcccucuccuucuucgucggcuacggcgucacccucuccauggccuaccgccuccucaaguccaagcucuaccucuga

SEQ ID NO: 45970 - RNA, 444 nt, Artificial Sequence
  derived and/or modified sequence opt2 from MGST2__Homo_sapiens__NP_001191295
auggccggcaacuccauccuccucgccgccgucuccauccucuccgccugccagcaguccuacuucgcccuccaggucggcaaggcccgccucaaguacaaggucaccccccccgccgucaccggcucccccgaguucgagcgcgucuuccgcgcccagcagaacugcgucgaguucuaccccaucuucaucaucacccucuggauggccggcugguacuucaaccaggucuucgccaccugccucggccucgucuacaucuacggccgccaccucuacuucuggggcuacuccgaggccgccaagaagcgcaucaccggcuuccgccucucccucggcauccucgcccuccucacccuccucggcgcccucggcaucgccaacuccuuccucgacgaguaccucgaccucaacaucgccaagaagcuccgccgccaguucuga

SEQ ID NO: 45971 - RNA, 459 nt, Artificial Sequence
  derived and/or modified sequence opt2 from MGST3__Homo_sapiens__NP_004519
auggccguccucuccaaggaguacggcuucguccuccucaccggcgccgccuccuucaucauggucgcccaccucgccaucaacgucuccaaggcccgcaagaaguacaaggucgaguaccccaucauguacuccaccgaccccgagaacggccacaucuucaacugcauccagcgcgcccaccagaacacccucgaggucuacccccccuuccucuucuuccucgccgucggcggcgucuaccacccccgcaucgccuccggccucggccucgccuggaucgucggccgcguccucuacgccuacggcuacuacaccggcgagcccuccaagcgcucccgcggcgcccucggcuccaucgcccuccucggccucgucggcaccaccgucugcuccgccuuccagcaccucggcugggucaaguccggccucggcuccggccccaagugcugccacuga

SEQ ID NO: 45972 - RNA, 1965 nt, Artificial Sequence
  derived and/or modified sequence opt2 from MIA2__Homo_sapiens__NP_473365
auggccaaguucggcguccaccgcauccuccuccucgccaucucccucaccaagugccucgaguccaccaagcuccucgccgaccucaagaagugcggcgaccucgagugcgaggcccucaucaaccgcgucuccgccaugcgcgacuaccgcggccccgacugccgcuaccucaacuucaccaagggcgaggagaucuccgucuacgucaagcucgccggcgagcgcgaggaccucugggccggcuccaagggcaaggaguucggcuacuucccccgcgacgccguccagaucgaggaggucuucaucuccgaggagauccagauguccaccaaggaguccgacuuccucugccuccucggcgucuccuacaccuucgacaacgaggacuccgagcucaacggcgacuacggcgagaacaucuaccccuacgaggaggacaaggacgagaaguccuccaucuacgaguccgacuuccagaucgagcccggcuucuacgccaccuacgaguccacccucuucgaggaccagguccccgcccucgaggcccccgaggacaucggcuccaccuccgaguccaaggacugggaggaggucgucgucgaguccauggagcaggaccgcauccccgagguccacgucccccccuccuccgccgucuccggcgucaaggagugguucggccucggcggcgagcaggccgaggagaaggccuucgaguccgucaucgagcccguccaggaguccuccuuccgcucccgcaagaucgccgucgaggacgagaacgaccucgaggagcucaacaacggcgagccccagaccgagcaccagcaggaguccgaguccgagaucgacuccguccccaagacccaguccgagcucgccuccgaguccgagcacauccccaagccccaguccaccggcugguucggcggcggcuucaccuccuaccucggcuucggcgacgaggacaccggccucgagcucaucgccgaggaguccaaccccccccuccaggacuuccccaacuccaucuccuccgacaaggaggccaccguccccugcaccgagauccucaccgagaagaaggacaccaucaccaacgacucccucucccucaagcccuccugguucgacuucggcuucgccauccucggcuucgccuacgccaaggaggacaagaucaugcucgacgaccgcaagaacgaggaggacggcggcgccgacgagcacgagcacccccucaccuccgagcucgaccccgagaaggagcaggagaucgagaccaucaagaucaucgagaccgaggaccagaucgacaagaagcccgucuccgagaagaccgacgaguccgacaccauccccuaccucaagaaguuccucuacaacuucgacaaccccuggaacuuccagaacauccccaaggagaccgagcuccccuuccccaagcagauccucgaccagaacaacgucaucgagaacgaggagaccggcgaguucuccaucgacaacuaccccaccgacaacaccaaggucaugaucuucaaguccuccuacucccucuccgacauggucuccaacaucgagcuccccacccgcauccacgaggaggucuacuucgagcccuccuccuccaaggacuccgacgagaacuccaagcccuccgucgacaccgagggccccgcccucgucgagaucgaccgcuccgucgagaacacccuccucaacucccagauggucuccaccgacaacucccucuccucccagaacuacaucucccagaaggaggacgccuccgaguuccagauccucaaguaccucuuccagaucgacgucuacgacuucaugaacuccgccuucucccccaucgucauccucaccgagcgcgucucccuccccuucaagcccuucgccaucauccuccccauccuccucaacauccgcgucgccaccaaguacgucuga

SEQ ID NO: 45973 - RNA, 2358 nt, Artificial Sequence
  derived and/or modified sequence opt2 from MIA3__Homo_sapiens__NP_001287796
auggacuccguccccgccaccguccccuccaucgccgccacccccggcgaccccgagcucgucggcccccucuccguccucuacgccgccuucaucgccaagcuccucgagcucgucgccacccuccccgacgacguccagcccggccccgacuucuacggccuccccuggaagcccgucuucaucaccgccuuccucggcaucgccuccuucgccaucuuccucuggcgcaccguccucgucgucaaggaccgcgucuaccaggucaccgagcagcagaucuccgagaagcucaagaccaucaugaaggagaacaccgagcucguccagaagcucuccaacuacgagcagaagaucaaggaguccaagaagcacguccaggagacccgcaagcagaacaugauccucuccgacgaggccaucaaguacaaggacaagaucaagacccucgagaagaaccaggagauccucgacgacaccgccaagaaccuccgcgucaugcucgaguccgagcgcgagcagaacgucaagaaccaggaccucaucuccgagaacaagaaguccaucgagaagcucaaggacgucaucuccaugaacgccuccgaguucuccgagguccagaucgcccucaacgaggccaagcucuccgaggagaaggucaaguccgagugccaccgcguccaggaggagaacgcccgccucaagaagaagaaggagcagcuccagcaggagaucgaggacugguccaagcuccacgccgagcucuccgagcagaucaaguccuucgagaagucccagaaggaccucgaggucgcccucacccacaaggacgacaacaucaacgcccucaccaacugcaucacccagcucaaccuccucgagugcgaguccgaguccgagggccagaacaagggcggcaacgacuccgacgagcucgccaacggcgaggucggcggcgaccgcaacgagaagaugaagaaccagaucaagcagaugauggacgucucccgcacccagaccgccaucuccgucgucgaggaggaccucaagcuccuccagcucaagcuccgcgccuccgucuccaccaagugcaaccucgaggaccaggucaagaagcucgaggacgaccgcaacucccuccaggccgccaaggccggccucgaggacgagugcaagacccuccgccagaaggucgagauccucaacgagcucuaccagcagaaggagauggcccuccagaagaagcucucccaggaggaguacgagcgccaggagcgcgagcaccgccucuccgccgccgacgagaaggccgucuccgccgccgaggaggucaagaccuacaagcgccgcaucgaggagauggaggacgagcuccagaagaccgagcgcuccuucaagaaccagaucgccacccacgagaagaaggcccacgagaacuggcucaaggcccgcgccgccgagcgcgccaucgccgaggagaagcgcgaggccgccaaccuccgccacaagcuccucgagcucacccagaagauggccaugcuccaggaggagcccgucaucgucaagcccaugcccggcaagcccaacacccagaaccccccccgccgcggcccccucucccagaacggcuccuucggccccucccccgucuccggcggcgagugcucccccccccucaccgucgagccccccguccgcccccucuccgccacccucaaccgccgcgacaugccccgcuccgaguucggcuccgucgacggcccccucccccacccccgcugguccgccgaggccuccggcaagcccucccccuccgaccccggcuccggcaccgccaccaugaugaacuccuccucccgcggcuccucccccacccgcguccucgacgagggcaaggucaacauggcccccaagggccccccccccuuccccggcgucccccucauguccacccccaugggcggccccguccccccccccauccgcuacggcccccccccccagcucugcggccccuucggcccccgcccccuccccccccccuucggccccggcaugcgccccccccucggccuccgcgaguucgcccccggcgucccccccggccgccgcgaccucccccuccacccccgcggcuuccuccccggccacgcccccuuccgcccccucggcucccucggcccccgcgaguacuucauccccggcacccgccuccccccccccacccacggcccccaggaguacccccccccccccgccguccgcgaccuccuccccuccggcucccgcgacgagcccccccccgccucccaguccaccucccaggacugcucccaggcccucaagcagucccccuga

SEQ ID NO: 45974 - RNA, 396 nt, Artificial Sequence
  derived and/or modified sequence opt2 from MIA__Homo_sapiens__NP_001189482
auggcccgcucccucgucugccucggcgucaucauccuccucuccgccuucuccggccccggcguccgcggcggccccaugcccaagcucgccgaccgcaagcucugcgccgaccaggagugcucccaccccaucuccauggccgucgcccuccaggacuacauggcccccgacugccgcuuccucaccauccaccgcggccaggucgucuacgucuucuccaagcucaagggccgcggccgccucuucuggggcggcuccguccagggcgacuacuacggcgaccucgccgcccgccucggcuacuuccccuccuccaucguccgcgaggaccagacccucaagcccggcaaggucgacgucaagaccgacaagugggacuucuacugccaguga

SEQ ID NO: 45975 - RNA, 3021 nt, Artificial Sequence
  derived and/or modified sequence opt2 from MIB1__Homo_sapiens__NP_065825
auguccaacucccgcaacaaccgcgucauggucgagggcgucggcgcccgcgucguccgcggccccgacuggaaguggggcaagcaggacggcggcgagggccacgucggcaccguccgcuccuucgagucccccgaggaggucgucgucgucugggacaacggcaccgccgccaacuaccgcugcuccggcgccuacgaccuccgcauccucgacuccgcccccaccggcaucaagcacgacggcaccaugugcgacaccugccgccagcagcccaucaucggcauccgcuggaagugcgccgagugcaccaacuacgaccucugcaccgucugcuaccacggcgacaagcaccaccuccgccaccgcuucuaccgcaucaccacccccggcuccgagcgcguccuccucgagucccgccgcaaguccaagaagaucaccgcccgcggcaucuucgccggcgcccgcgucguccgcggcgucgacuggcagugggaggaccaggacggcggcaacggccgccgcggcaaggucaccgagauccaggacugguccgccuccuccccccacuccgccgccuacguccucugggacaacggcgccaagaaccucuaccgcgucggcuucgagggcauguccgaccucaagugcguccaggacgccaagggcggcuccuucuaccgcgaccacugccccguccucggcgagcagaacggcaaccgcaaccccggcggccuccagaucggcgaccucgucaacaucgaccucgaccucgagaucguccagucccuccagcacggccacggcggcuggaccgacggcauguucgagacccucaccaccaccggcaccgucugcggcaucgacgaggaccacgacaucgucguccaguaccccuccggcaaccgcuggaccuucaaccccgccguccucaccaaggccaacaucguccgcuccggcgacgccgcccagggcgccgagggcggcaccucccaguuccaggucggcgaccucguccaggucugcuacgaccucgagcgcaucaagcuccuccagcgcggccacggcgagugggccgaggccaugcuccccacccucggcaaggucggccgcguccagcagaucuacuccgacuccgaccucaaggucgaggucugcggcaccuccuggaccuacaaccccgccgccgucuccaaggucgccuccgccggcuccgccaucuccaacgccuccggcgagcgccucucccagcuccucaagaagcucuucgagacccaggaguccggcgaccucaacgaggagcucgucaaggccgccgccaacggcgacgucgccaaggucgaggaccuccucaagcgccccgacgucgacgucaacggccagugcgccggccacaccgccaugcaggccgccucccagaacggccacgucgacauccucaagcuccuccucaagcagaacgucgacgucgaggccgaggacaaggacggcgaccgcgccguccaccacgccgccuucggcgacgagggcgccgucaucgagguccuccaccgcggcuccgccgaccucaacgcccgcaacaagcgccgccagaccccccuccacaucgccgucaacaagggccaccuccaggucgucaagacccuccucgacuucggcugccaccccucccuccaggacuccgagggcgacaccccccuccacgacgccaucuccaagaagcgcgacgacauccucgccguccuccucgaggccggcgccgacgucaccaucaccaacaacaacggcuucaacgcccuccaccacgccgcccuccgcggcaaccccuccgccaugcgcguccuccucuccaagcucccccgccccuggaucgucgacgagaagaaggacgacggcuacaccgcccuccaccucgccgcccucaacaaccacgucgaggucgccgagcuccucguccaccagggcaacgccaaccucgacauccagaacgucaaccagcagaccgcccuccaccucgccgucgagcgccagcacacccagaucguccgccuccucguccgcgccggcgccaagcucgacauccaggacaaggacggcgacaccccccuccacgaggcccuccgccaccacacccucucccagcuccgccagcuccaggacaugcaggacgucggcaaggucgacgccgccugggagcccuccaagaacacccucaucaugggccucggcacccagggcgccgagaagaaguccgccgccuccaucgccugcuuccucgccgccaacggcgccgaccucuccauccgcaacaagaagggccaguccccccucgaccucugccccgaccccaaccucugcaaggcccucgccaagugccacaaggagaaggucuccggccaggucggcucccgcucccccuccaugaucuccaacgacuccgagacccucgaggagugcauggucugcuccgacaugaagcgcgacacccucuucggccccugcggccacaucgccaccugcucccucugcuccccccgcgucaagaagugccucaucugcaaggagcagguccagucccgcaccaagaucgaggagugcgucgucugcuccgacaagaaggccgccguccucuuccagcccugcggccacaugugcgccugcgagaacugcgccaaccucaugaagaagugcguccagugccgcgccgucgucgagcgccgcguccccuucaucaugugcugcggcggcaaguccuccgaggacgccaccgacgacaucuccuccggcaacauccccguccuccagaaggacaaggacaacaccaacgucaacgccgacguccagaagcuccagcagcagcuccaggacaucaaggagcagaccaugugccccgucugccucgaccgccucaagaacaugaucuuccucugcggccacggcaccugccagcucugcggcgaccgcauguccgagugccccaucugccgcaaggccaucgagcgccgcauccuccucuacuga

SEQ ID NO: 45976 - RNA, 3804 nt, Artificial Sequence
  derived and/or modified sequence opt2 from MIB2__Homo_sapiens__XP_011539035
auggccggcgcccuccgccgcggccgcgcccucggcucccgccccuccggccccaccgucuccucccgccgcuccccccagugccccgucgcccaggagggccucggcgcccgcucccgcccccgcgucgccccccgcucccucgcccgcugcggccccuccucccgccucaugguccgcgccggcgccgaccuccuccccugguccuccgcccccucccccucccgcuccccccucuggcagaacgccuccgccguccgcuucccccucccccucgcccagcagccccgcgccggccucggcgucggcuccgcccgcgacggccucggccuccgcgcccagcgccgccgcggcgccuccugggagcucugguccggccacccccgcggcacccccgcccccggccgcccccgcgccgcccgcggccagcgccgcuggggccgccgcuggggccgccgccccggccgcgucggcugcggcgcccgccaggcccucuggcccggccucgccgccgccgagcaguccggccccgucggcggccucgagcgccgcgaccgccccaccgacggccucgccggcggccccgccccccccuccggcgccggcggcaccgagaccuccggcgucggcucccccgcccgccucgaggccucccccaaggucucccgccaccagggcugcucccccggcgccucccgccgccccggcggccgccucgacggccgcaccggccccgagcagcccggcccccccuggaccccccuccccaccggccccgagcagccccgccccaccuggacccagaccccccgccgcgccugccgcugggccugcggcuggugcgccgccuggaccggcuccggcgccucccgcaccgccgcccgcgccgccugggcccgcugguggucccucgccgccaccgccgccccccgccaccccaccgcccagugguccugcuccggcacccgcgcccgcgcccccaccaccgcccccgccacccgcgcccgcaccaccugcugcugcguccgccaccccaacaucaucugcgacugcugcaagaagcacggccuccgcggcaugcgcuggaagugccgcgucugccucgacuacgaccucugcacccagugcuacaugcacaacaagcacgagcucgcccacgccuucgaccgcuacgagaccgcccacucccgccccgucacccucuccccccgccagggccucccccgcaucccccuccgcggcaucuuccagggcgccaaggucguccgcggccccgacugggaguggggcucccaggacggcggcgagggcaagcccggccgcgucgucgacauccgcggcugggacgucgagaccggccgcuccgucgccuccgucaccugggccgacggcaccaccaacgucuaccgcgucggccacaagggcaaggucgaccucaagugcgucggcgaggccgccggcggcuucuacuacaaggaccaccucccccgccucggcaagcccgccgagcuccagcgccgcgucuccgccgacucccagcccuuccagcacggcgacaaggucaagugccuccucgacaccgacguccuccgcgagaugcaggagggccacggcggcuggaacccccgcauggccgaguucaucggccagaccggcaccguccaccgcaucaccgaccgcggcgacguccgcguccaguucaaccacgagacccgcuggaccuuccaccccggcgcccucaccaaggacacccgcaaggccggccagcuccgcggccgcgagggcggcggcugggccaagaugcuccuccaccacuccuucugggucggcgacgucguccgcgucaucggcgaccucgacaccgucaagcgccuccaggccggccacggcgaguggaccgacgacauggcccccgcccucggccgcgucggcaaggucgucaaggucuucggcgacggcaaccuccgcgucgccgucgccggccagcgcuggaccuucucccccuccugccucgucgccuaccgccccgaggaggacgccaaccucgacgucgccgagcgcgcccgcgagaacaaguccucccucuccgucgcccucgacaagcuccgcgcccagaaguccgaccccgagcaccccggccgccucgucgucgaggucgcccucggcaacgccgcccgcgcccucgaccuccuccgccgccgccccgagcaggucgacaccaagaaccagggccgcaccgcccuccaggucgccgccuaccucggccaggucgagcucauccgccuccuccuccaggcccgcgccggcgucgaccuccccgacgacgagggcaacaccgcccuccacuacgccgcccucggcaaccagcccgaggccacccgcguccuccucuccgccggcugccgcgccgacgccaucaacuccacccaguccaccgcccuccacgucgccguccagcgcggcuuccucgaggucguccgcgcccucugcgagcgcggcugcgacgucaaccuccccgacgcccacuccgacaccccccuccacuccgccaucuccgccggcaccggcgccuccggcaucgucgagguccucaccgagguccccaacaucgacgucaccgccaccaacucccagggcuucacccuccuccaccacgccucccucaagggccacgcccucgccguccgcaagauccucgcccgcgcccgccagcucgucgacgccaagaaggaggacggcuucaccgcccuccaccucgccgcccucaacaaccaccgcgaggucgcccagauccucauccgcgagggccgcugcgacgucaacguccgcaaccgcaagcuccaguccccccuccaccucgccguccagcaggcccacgucggccucgucccccuccucgucgacgccggcugcuccgucaacgccgaggacgaggagggcgacaccgcccuccacgucgcccuccagcgccaccagcuccucccccucgucgccgacggcgccggcggcgaccccggcccccuccagcuccucucccgcaccuggggcgccggcugcuggggcugccagguccccggcgacgccucccucggccccgcccccgcccccgcccucaccggcgucugccccgccgcccagcuccaggccuccggccuccccggcuccgccgagcucaccgucggcgccgccgucgccugcuuccucgcccucgagggcgccgacgucuccuacaccaaccaccgcggccgcuccccccucgaccucgccgccgagggccgcguccucaaggcccuccagggcugcgcccagcgcuuccgcgagcgccaggccggcggcggcgccgcccccggcccccgccagacccucggcacccccaacaccgucaccaaccuccacgucggcgccgcccccggccccgaggccgccgagugccucgucugcuccgagcucgcccuccucguccucuucucccccugccagcaccgcaccgucugcgaggagugcgcccgccgcaugaagaagugcauccgcugccaggucgucgucuccaagaagcuccgccccgacggcuccgaggucgccuccgccgcccccgcccccggccccccccgccagcucgucgaggagcuccagucccgcuaccgccagauggaggagcgcaucaccugccccaucugcaucgacucccacauccgccucgucuuccagugcggccacggcgccugcgcccccugcggcuccgcccucuccgccugccccaucugccgccagcccauccgcgaccgcauccagaucuucgucuga

SEQ ID NO: 45977 - RNA, 1152 nt, Artificial Sequence
  derived and/or modified sequence opt2 from MICA__Homo_sapiens__NP_000238
augggccucggccccgucuuccuccuccucgccggcaucuuccccuucgccccccccggcgccgccgccgagccccacucccuccgcuacaaccucaccguccucuccugggacggcuccguccaguccggcuuccucaccgagguccaccucgacggccagcccuuccuccgcugcgaccgccagaagugccgcgccaagccccagggccagugggccgaggacguccucggcaacaagaccugggaccgcgagacccgcgaccucaccggcaacggcaaggaccuccgcaugacccucgcccacaucaaggaccagaaggagggccuccacucccuccaggagauccgcgucugcgagauccacgaggacaacuccacccgcuccucccagcacuucuacuacgacggcgagcucuuccucucccagaaccucgagaccaaggaguggaccaugccccaguccucccgcgcccagacccucgccaugaacguccgcaacuuccucaaggaggacgccaugaagaccaagacccacuaccacgccaugcacgccgacugccuccaggagcuccgccgcuaccucaaguccggcgucguccuccgccgcaccgucccccccauggucaacgucacccgcuccgaggccuccgagggcaacaucaccgucaccugccgcgccuccggcuucuaccccuggaacaucacccucuccuggcgccaggacggcgucucccucucccacgacacccagcaguggggcgacguccuccccgacggcaacggcaccuaccagaccugggucgccacccgcaucugccagggcgaggagcagcgcuucaccugcuacauggagcacuccggcaaccacuccacccaccccguccccuccggcaagguccucguccuccagucccacuggcagaccuuccacgucuccgccgucgccgccgccgccaucuucgucaucaucaucuucuacguccgcugcugcaagaagaagaccuccgccgccgagggccccgagcucgucucccuccagguccucgaccagcaccccgucggcaccuccgaccaccgcgacgccacccagcucggcuuccagccccucauguccgaccucggcuccaccggcuccaccgagggcgccuga

SEQ ID NO: 45978 - RNA, 3375 nt, Artificial Sequence
  derived and/or modified sequence opt2 from MICAL2__Homo_sapiens__NP_001269592
augggcgagaacgaggacgagaagcaggcccaggccggccaggucuucgagaacuucguccaggccuccaccugcaagggcacccuccaggccuucaacauccucacccgccaccucgaccucgacccccucgaccaccgcaacuucuacuccaagcucaaguccaaggucaccaccuggaaggccaaggcccucugguacaagcucgacaagcgcggcucccacaaggaguacaagcgcggcaaguccugcaccaacaccaagugccucaucgucggcggcggccccugcggccuccgcaccgccaucgagcucgccuaccucggcgccaaggucgucgucgucgagaagcgcgacuccuucucccgcaacaacguccuccaccucuggcccuucaccauccacgaccuccgcggccucggcgccaagaaguucuacggcaaguucugcgccggcuccaucgaccacaucuccauccgccagcuccagcucauccucuucaaggucgcccucaugcucggcgucgagauccacgucaacgucgaguucgucaagguccucgagccccccgaggaccaggagaaccagaagaucggcuggcgcgccgaguuccuccccaccgaccacucccucuccgaguucgaguucgacgucaucaucggcgccgacggccgccgcaacacccucgagggcuuccgccgcaaggaguuccgcggcaagcucgccaucgccaucaccgccaacuucaucaaccgcaacuccaccgccgaggccaaggucgaggagaucuccggcgucgccuucaucuucaaccagaaguucuuccaggaccucaaggaggagaccggcaucgaccucgagaacaucgucuacuacaaggacugcacccacuacuucgucaugaccgccaagaagcagucccuccucgacaagggcgucaucaucaacgacuacaucgacaccgagaugcuccucugcgccgagaacgucaaccaggacaaccuccucuccuacgcccgcgaggccgccgacuucgccaccaacuaccagcuccccucccucgacuucgccaugaaccacuacggccagcccgacgucgccauguucgacuucaccugcauguacgccuccgagaacgccgcccucguccgcgagcgccaggcccaccagcuccucgucgcccucgucggcgacucccuccucgagcccuucuggcccaugggcaccggcugcgcccgcggcuuccucgccgccuucgacaccgccuggauggucaaguccuggaaccagggcacccccccccucgagcuccucgccgagcgcgagucccucuaccgccuccucccccagaccacccccgagaacaucaacaagaacuucgagcaguacacccucgaccccggcacccgcuaccccaaccucaacucccacugcguccgcccccaccaggucaagcaccucuacaucaccaaggagcucgagcacuacccccucgagcgccucggcuccguccgccgcuccgucaaccucucccgcaaggaguccgacauccgccccuccaagcuccucaccuggugccagcagcagaccgagggcuaccagcacgucaacgucaccgaccucaccaccuccuggcgcuccggccucgcccucugcgccaucauccaccgcuuccgccccgagcucaucaacuucgacucccucaacgaggacgacgccgucgagaacaaccagcucgccuucgacgucgccgagcgcgaguucggcaucccccccgucaccaccggcaaggagauggccuccgcccaggagcccgacaagcucuccauggucauguaccucuccaaguucuacgagcucuuccgcggcaccccccuccgccccgucgacuccuggcgcaagaacuacggcgagaacgccgaccucucccucgccaaguccuccaucuccaacaacuaccucaaccucaccuucccccgcaagcgcaccccccgcgucgacggccagaccggcgagaacgacaugaacaagcgccgccgcaagggcuucaccaaccucgacgagcccuccaacuucuccucccgcucccucggcuccaaccaggagugcggcuccuccaaggagggcggcaaccagaacaaggucaaguccauggccaaccagcuccucgccaaguucgaggaguccacccgcaaccccucccucaugaagcaggagcgccgcgucuccggcaucggcaagcccguccucugcuccuccuccggcccccccguccacuccugcugccccaagcccgaggaggccacccccucccccucccccccccucaagcgccaguuccccuccgucgucgucaccggccacguccuccgcgagcucaagcaggucuccgccggcuccgagugccucucccgccccuggcgcgcccgcgccaaguccgaccuccagcucggcggcaccgagaacuucgccacccuccccuccacccgcccccgcgcccaggcccucuccggcguccucuggcgccuccagcaggucgaggagaagauccuccagaagcgcgcccagaaccucgccaaccgcgaguuccacaccaagaacaucaaggagaaggccgcccaccucgccuccauguucggccacggcgacuucccccagaacaagcuccucuccaagggccucucccacacccacccccccuccccccccucccgccuccccucccccgaccccgccgccuccuccucccccuccaccgucgacuccgccucccccgcccgcaaggagaagaagucccccuccggcuuccacuuccaccccucccaccuccgcaccguccacccccagcucaccgucggcaaggucuccuccggcaucggcgccgccgccgagguccucgucaaccucuacaugaacgaccaccgccccaaggcccaggccaccucccccgaccucgaguccaugcgcaaguccuucccccucaaccucggcggcuccgacaccugcuacuucugcaagaagcgcgucuacgucauggagcgccucuccgccgagggccacuucuuccaccgcgagugcuuccgcugcuccaucugcgccaccacccuccgccucgccgccuacaccuucgacugcgacgagggcaaguucuacugcaagccccacuucauccacugcaagaccaacuccaagcagcgcaagcgccgcgccgagcucaagcagcagcgcgaggaggaggccaccuggcaggagcaggaggccccccgccgcgacacccccaccgaguccuccugcgccgucgccgccaucggcacccucgagggcuccccccccguccacuucucccuccccguccuccacccccuccucggcuga

SEQ ID NO: 45979 - RNA, 2088 nt, Artificial Sequence
  derived and/or modified sequence opt2 from MICALCL__Homo_sapiens__NP_116256
auguccccccccaaggaccccucccccucccucccccuccccuccuccuccucccacuccuccuccccccccuccuccuccuccaccuccgucuccggcaacgcccccgacggcuccucccccccccagaugaccgccuccgagccccucucccaggucucccgcggccaccccuccccccccacccccaacuuccgccgccgcgccgucgcccagggcgccccccgcgagaucccccucuaccucccccaccaccccaagcccgagugggccgaguacugccucgucucccccggcgaggacggccucuccgaccccgccgagaugaccuccgacgagugccagcccgccgaggccccccucggcgacaucggcuccaaccaccgcgacccccaccccaucuggggcaaggaccgcuccuggaccggccaggagcucuccccccucgccggcgaggaccgcgagaagggcuccaccggcgcccgcaaggaggaggagggcggccccguccucgucaaggagaagcucggccucaagaagcucguccucacccaggagcagaagaccaugcuccucgacuggaacgacuccauccccgaguccguccaccucaaggccggcgagcgcaucucccagaaguccgccgagaacggccgcggcggccgcguccucaagcccguccgcccccuccuccucccccgcgccgccggcgagccccuccccacccagcgcggcgcccaggagaagaugggcacccccgccgagcaggcccagggcgagcgcaacguccccccccccaaguccccccuccgccucaucgccaacgccauccgccgcucccucgagccccuccucuccaacuccgagggcggcaagaaggccugggccaagcaggaguccaagacccuccccgcccaggccugcacccgcuccuucucccuccgcaagaccaacuccaacaaggacggcgaccagcacucccccggccgcaaccaguccuccgccuucuccccccccgaccccgcccuccgcacccacucccuccccaaccgccccuccaaggucuuccccgcccuccgcuccccccccugcuccaagaucgaggacguccccacccuccucgagaaggucucccuccaggagaacuuccccgacgccuccaagccccccaagaagcgcaucucccucuucuccucccuccgccucaaggacaaguccuucgaguccuuccuccaggagucccgccagcgcaaggacauccgcgaccucuucggcucccccaagcgcaagguccuccccgaggacuccgcccaggcccucgagaagcuccuccagcccuucaaguccaccucccuccgccaggccgccccccccccccccccccccccccccccccccccccccccccccaccgccggcggcgccgacuccaagaacuucccccuccgcgcccaggucaccgaggccuccuccuccgccuccuccaccuccuccuccuccgccgacgaggaguucgacccccagcucucccuccagcucaaggagaagaagacccuccgccgccgcaagaagcucgagaaggccaugaagcagcucgucaagcaggaggagcucaagcgccucuacaaggcccaggccauccagcgccagcucgaggaggucgaggagcgccagcgcgccuccgagauccagggcguccgccucgagaaggcccuccgcggcgaggccgacuccggcacccaggacgaggcccagcuccuccaggagugguucaagcucguccucgagaagaacaagcucaugcgcuacgaguccgagcuccucaucauggcccaggagcucgagcucgaggaccaccagucccgccucgagcagaagcuccgcgagaagaugcucaaggaggagucccagaaggacgagaaggaccucaacgaggagcaggaggucuucaccgagcucaugcaggucaucgagcagcgcgacaagcucgucgacucccucgaggagcagcgcauccgcgagaaggccgaggaccagcacuucgaguccuucgucuucucccgcggcugccagcucucccgcaccuga

SEQ ID NO: 45980 - RNA, 1023 nt, Artificial Sequence
  derived and/or modified sequence opt2 from MICB__Homo_sapiens__NP_001276090
augggccucggccgcguccuccucuuccucgccgucgccuuccccuucgccccccccgccgccgccgccgagccccacucccuccgcuacaaccucaugguccucucccaggacggcuccguccaguccggcuuccucgccgagggccaccucgacggccagcccuuccuccgcuacgaccgccagaagcgccgcgccaagccccagggccagugggccgagaacguccucggcgccaagaccugggacaccgagaccgaggaccucaccgagaacggccaggaccuccgccgcacccucacccacaucaaggaccagaagggcgucccccaguccucccgcgcccagacccucgccaugaacgucaccaacuucuggaaggaggacgccaugaagaccaagacccacuaccgcgccaugcaggccgacugccuccagaagcuccagcgcuaccucaaguccggcgucgccauccgccgcaccgucccccccauggucaacgucaccugcuccgaggucuccgagggcaacaucaccgucaccugccgcgccuccuccuucuacccccgcaacaucacccucaccuggcgccaggacggcgucucccucucccacaacacccagcaguggggcgacguccuccccgacggcaacggcaccuaccagaccugggucgccacccgcauccgccagggcgaggagcagcgcuucaccugcuacauggagcacuccggcaaccacggcacccaccccguccccuccggcaaggcccucguccuccagucccagcgcaccgacuuccccuacgucuccgccgccaugcccugcuucgucaucaucaucauccucugcguccccugcugcaagaagaagaccuccgccgccgagggccccgagcucgucucccuccagguccucgaccagcaccccgucggcaccggcgaccaccgcgacgccgcccagcucggcuuccagccccucauguccgccaccggcuccaccggcuccaccgagggcaccuga

SEQ ID NO: 45981 - RNA, 1431 nt, Artificial Sequence
  derived and/or modified sequence opt2 from MICU1__Homo_sapiens__NP_001182447
auguuccgccucaacucccucuccgcccucgccgagcucgccgucggcucccgcugguaccacggcggcucccagcccauccagauccgccgccgccucaugauggucgccuuccucggcgccuccgccgucaccgccuccaccggccuccucuggaagcgcgcccacgccgaguccccccccugcgucgacaaccucaaguccgacaucggcgacaagggcaagaacaaggacgagggcgacgucugcaaccacgagaagaagaccgccgaccucgccccccaccccgaggagaagaagaagaagcgcuccggcuuccgcgaccgcaaggucauggaguacgagaaccgcauccgcgccuacuccacccccgacaagaucuuccgcuacuucgccacccucaaggucaucuccgagcccggcgaggccgaggucuucaugacccccgaggacuucguccgcuccaucacccccaacgagaagcagcccgagcaccucggccucgaccaguacaucaucaagcgcuucgacggcaagaagaucucccaggagcgcgagaaguucgccgacgagggcuccaucuucuacacccucggcgagugcggccucaucuccuucuccgacuacaucuuccucaccaccguccucuccaccccccagcgcaacuucgagaucgccuucaagauguucgaccucaacggcgacggcgaggucgacauggaggaguucgagcagguccaguccaucauccgcucccagaccuccaugggcaugcgccaccgcgaccgccccaccaccggcaacacccucaaguccggccucugcuccgcccucaccaccuacuucuucggcgccgaccucaagggcaagcucaccaucaagaacuuccucgaguuccagcgcaagcuccagcacgacguccucaagcucgaguucgagcgccacgaccccgucgacggccgcaucaccgagcgccaguucggcggcaugcuccucgccuacuccggcguccaguccaagaagcucaccgccaugcagcgccagcucaagaagcacuucaaggagggcaagggccucaccuuccaggaggucgagaacuucuucaccuuccucaagaacaucaacgacgucgacaccgcccucuccuucuaccacauggccggcgccucccucgacaaggucaccaugcagcaggucgcccgcaccgucgccaaggucgagcucuccgaccacgucugcgacgucgucuucgcccucuucgacugcgacggcaacggcgagcucuccaacaaggaguucgucuccaucaugaagcagcgccucaugcgcggccucgagaagcccaaggacaugggcuucacccgccucaugcaggccauguggaagugcgcccaggagaccgccugggacuucgcccuccccaagcaguga

SEQ ID NO: 45982 - RNA, 1593 nt, Artificial Sequence
  derived and/or modified sequence opt2 from MICU3__Homo_sapiens__NP_859074
auggccgcccuccgccgccuccucuggccccccccccgcgucucccccccccucugcgcccaccagccccuccucggccccuggggccgccccgccgucaccacccucggccuccccggccgccccuucuccucccgcgaggacgaggagcgcgccgucgccgaggccgccuggcgccgccgccgccgcuggggcgagcucuccgucgccgccgccgccggcggcggccucgucggccucgucugcuaccagcucuacggcgacccccgcgccggcucccccgccaccggccgccccuccaaguccgccgccaccgagcccgaggaccccccccgcggccgcggcaugcuccccauccccgucgccgccgccaaggagaccgucgccaucggccgcaccgacaucgaggaccucgaccucuacgccaccucccgcgagcgccgcuuccgccucuucgccuccaucgagugcgagggccagcucuucaugacccccuacgacuucauccucgccgucaccaccgacgagcccaaggucgccaagaccuggaagucccucuccaagcaggagcucaaccagaugcucgccgagaccccccccgucuggaagggcuccuccaagcucuuccgcaaccucaaggagaagggcgucaucuccuacaccgaguaccucuuccuccucugcauccucaccaagccccacgccggcuuccgcaucgccuucaacauguucgacaccgacggcaacgagauggucgacaagaaggaguuccucguccuccaggagaucuuccgcaagaagaacgagaagcgcgagaucaagggcgacgaggagaagcgcgccaugcuccgccuccagcucuacggcuaccacucccccaccaacuccguccucaagaccgacgccgaggagcucgucucccgcuccuacugggacacccuccgccgcaacaccucccaggcccucuucuccgaccucgccgagcgcgccgacgacaucaccucccucgucaccgacaccacccuccucguccacuucuucggcaagaagggcaaggccgagcucaacuucgaggacuucuaccgcuucauggacaaccuccagaccgagguccucgagaucgaguuccucuccuacuccaacggcaugaacaccaucuccgaggaggacuucgcccacauccuccuccgcuacaccaacgucgagaacaccuccgucuuccucgagaacguccgcuacuccauccccgaggagaagggcaucaccuucgacgaguuccgcuccuucuuccaguuccucaacaaccucgaggacuucgccaucgcccucaacauguacaacuucgccucccgcuccaucggccaggacgaguucaagcgcgccgucuacgucgccaccggccucaaguucuccccccaccucgucaacaccgucuucaagaucuucgacgucgacaaggacgaccagcucuccuacaaggaguucaucggcaucaugaaggaccgccuccaccgcggcuuccgcggcuacaagaccguccagaaguaccccaccuucaaguccugccucaagaaggagcuccacucccgcuga

SEQ ID NO: 45983 - RNA, 2004 nt, Artificial Sequence
  derived and/or modified sequence opt2 from MID1__Homo_sapiens__NP_001180206
auggagacccucgaguccgagcucaccugccccaucugccucgagcucuucgaggacccccuccuccuccccugcgcccacucccucugcuucaacugcgcccaccgcauccucgucucccacugcgccaccaacgaguccgucgaguccaucaccgccuuccagugccccaccugccgccacgucaucacccucucccagcgcggccucgacggccucaagcgcaacgucacccuccagaacaucaucgaccgcuuccagaaggccuccgucuccggccccaacucccccuccgagacccgccgcgagcgcgccuucgacgccaacaccaugaccuccgccgagaagguccucugccaguucugcgaccaggaccccgcccaggacgccgucaagaccugcgucaccugcgaggucuccuacugcgacgagugccucaaggccacccaccccaacaagaagcccuucaccggccaccgccucaucgagcccauccccgacucccacauccgcggccucaugugccucgagcacgaggacgagaaggucaacauguacugcgucaccgacgaccagcucaucugcgcccucugcaagcucgucggccgccaccgcgaccaccaggucgccgcccucuccgagcgcuacgacaagcucaagcagaaccucgaguccaaccucaccaaccucaucaagcgcaacaccgagcucgagacccuccucgccaagcucauccagaccugccagcacgucgaggucaacgccucccgccaggaggccaagcucaccgaggagugcgaccuccucaucgagaucauccagcagcgccgccagaucaucggcaccaagaucaaggagggcaaggucaugcgccuccgcaagcucgcccagcagaucgccaacugcaagcagugcaucgagcgcuccgccucccucaucucccaggccgagcacucccucaaggagaacgaccacgcccgcuuccuccagaccgccaagaacaucaccgagcgcgucuccauggccaccgccuccucccagguccucauccccgagaucaaccucaacgacaccuucgacaccuucgcccucgacuucucccgcgagaagaagcuccucgagugccucgacuaccucaccgcccccaacccccccaccauccgcgaggagcucugcaccgccuccuacgacaccaucaccguccacuggaccuccgacgacgaguucuccgucgucuccuacgagcuccaguacaccaucuucaccggccaggccaacgucgucucccucugcaacuccgccgacuccuggaugaucguccccaacaucaagcagaaccacuacaccguccacggccuccaguccggcaccaaguacaucuucauggucaaggccaucaaccaggccggcucccgcuccuccgagcccggcaagcucaagaccaacucccagcccuucaagcucgaccccaaguccgcccaccgcaagcucaaggucucccacgacaaccucaccgucgagcgcgacgaguccuccuccaagaagucccacacccccgagcgcuucaccucccagggcuccuacggcgucgccggcaacgucuucaucgacuccggccgccacuacugggaggucgucaucuccggcuccaccugguacgccaucggccucgccuacaaguccgcccccaagcacgaguggaucggcaagaacuccgccuccugggcccucugccgcugcaacaacaacugggucguccgccacaacuccaaggagauccccaucgagcccgccccccaccuccgccgcgucggcauccuccucgacuacgacaacggcuccaucgccuucuacgacgcccucaacuccauccaccucuacaccuucgacgucgccuucgcccagcccgucugccccaccuucaccgucuggaacaagugccucaccaucaucaccggccuccccauccccgaccaccucgacugcaccgagcagcuccccuga

SEQ ID NO: 45984 - RNA, 2208 nt, Artificial Sequence
  derived and/or modified sequence opt2 from MID2__Homo_sapiens__NP_036348
augggcgagucccccgccuccgucguccucaacgccuccggcggccucuucucccucaagauggagacccucgaguccgagcucaccugccccaucugccucgagcucuucgaggacccccuccuccuccccugcgcccacucccucugcuucuccugcgcccaccgcauccucgucuccuccugcuccuccggcgaguccaucgagcccaucaccgccuuccagugccccaccugccgcuacgucaucucccucaaccaccgcggccucgacggccucaagcgcaacgucacccuccagaacaucaucgaccgcuuccagaaggccuccgucuccggccccaacucccccuccgagucccgccgcgagcgcaccuaccgccccaccaccgccauguccuccgagcgcaucgccugccaguucugcgagcaggaccccccccgcgacgccgucaagaccugcaucaccugcgaggucuccuacugcgaccgcugccuccgcgccacccaccccaacaagaagcccuucaccucccaccgccucgucgagcccguccccgacacccaccuccgcggcaucaccugccucgaccacgagaacgagaaggucaacauguacugcgucuccgacgaccagcucaucugcgcccucugcaagcucgucggccgccaccgcgaccaccaggucgccucccucaacgaccgcuucgagaagcucaagcagacccucgagaugaaccucaccaaccucgucaagcgcaacuccgagcucgagaaccagauggccaagcucauccagaucugccagcaggucgaggucaacaccgccaugcacgaggccaagcucauggaggagugcgacgagcucgucgagaucauccagcagcgcaagcagaugaucgccgucaagaucaaggagaccaaggucaugaagcuccgcaagcucgcccagcaggucgccaacugccgccagugccucgagcgcuccaccguccucaucaaccaggccgagcacauccucaaggagaacgaccaggcccgcuuccuccaguccgccaagaacaucgccgagcgcgucgccauggccaccgccuccucccagguccucauccccgacaucaacuucaacgacgccuucgagaacuucgcccucgacuucucccgcgagaagaagcuccucgagggccucgacuaccucaccgcccccaacccccccuccauccgcgaggagcucugcaccgccucccacgacaccaucaccguccacuggaucuccgacgacgaguucuccaucuccuccuacgagcuccaguacaccaucuucaccggccaggccaacuucaucuccaaguccuggugcuccuggggccucuggcccgagauccgcaagugcaaggaggccgucuccugcucccgccucgccggcgccccccgcggccucuacaacuccgucgacuccuggaugaucguccccaacaucaagcagaaccacuacaccguccacggccuccaguccggcacccgcuacaucuucaucgucaaggccaucaaccaggccggcucccgcaacuccgagcccacccgccucaagaccaacucccagcccuucaagcucgaccccaagaugacccacaagaagcucaagaucuccaacgacggccuccagauggagaaggacgaguccucccucaagaagucccacacccccgagcgcuucuccggcaccggcugcuacggcgccgccggcaacaucuucaucgacuccggcugccacuacugggaggucgucaugggcuccuccaccugguacgccaucggcaucgccuacaaguccgcccccaagaacgaguggaucggcaagaacgccuccuccugggucuucucccgcugcaacuccaacuucgucguccgccacaacaacaaggagaugcucgucgacguccccccccaccucaagcgccucggcguccuccucgacuacgacaacaacaugcucuccuucuacgaccccgccaacucccuccaccuccacaccuucgacgucaccuucauccuccccgucugccccaccuucaccaucuggaacaagucccucaugauccucuccggccuccccgcccccgacuucaucgacuaccccgagcgccaggagugcaacugccgcccccaggagucccccuacgucuccggcaugaagaccugccacuga

SEQ ID NO: 45985 - RNA, 348 nt, Artificial Sequence
  derived and/or modified sequence opt2 from MIEN1__Homo_sapiens__NP_115715
auguccggcgagcccggccagaccuccgucgcccccccccccgaggaggucgagcccggcuccggcguccgcaucgucgucgaguacugcgagcccugcggcuucgaggccaccuaccucgagcucgccuccgccgucaaggagcaguaccccggcaucgagaucgagucccgccucggcggcaccggcgccuucgagaucgagaucaacggccagcucgucuucuccaagcucgagaacggcggcuuccccuacgagaaggaccucaucgaggccauccgccgcgccuccaacggcgagacccucgagaagaucaccaacucccgcccccccugcgucauccucuga

SEQ ID NO: 45986 - RNA, 1638 nt, Artificial Sequence
  derived and/or modified sequence opt2 from MIER2__Homo_sapiens__NP_060020
auggccgaggccuccucccucggccgccaguccccccgcgucgucuccugccucgagcacucccucugccccggcgagcccggccuccagaccaccgccgucgucuccaugggcuccggcgaccaccaguucaaccucgccgagauccucucccagaacuacuccguccgcggcgagugcgaggaggccucccgcugccccgacaagcccaaggaggagcucgagaaggacuucaucucccaguccaacgacaugcccuucgacgagcuccucgcccucuacggcuacgaggccuccgaccccaucuccgaccgcgaguccgagggcggcgacgucgcccccaaccuccccgacaugacccucgacaaggagcagaucgccaaggaccuccucuccggcgaggaggaggaggagacccaguccuccgccgacgaccucacccccuccgucaccucccacgaggccuccgaccucuuccccaaccgcuccggcucccgcuuccucgccgacgaggaccgcgagcccggcuccuccgccuccuccgacaccgaggaggacucccuccccgccaacaagugcaagaaggagaucauggucggcccccaguuccaggccgaccucuccaaccuccaccucaaccgccacugcgagaagaucuacgagaacgaggaccagcuccucugggaccccuccguccuccccgagcgcgaggucgaggaguuccucuaccgcgccgucaagcgccgcuggcacgagauggccggcccccagcuccccgagggcgaggccgucaaggacuccgagcaggcccucuacgagcucgucaagugcaacuucaacgucgaggaggcccuccgccgccuccgcuucaacgucaaggucauccgcgacggccucugcgccugguccgaggaggagugccgcaacuucgagcacggcuuccgcguccacggcaagaacuuccaccucauccaggccaacaagguccgcacccgcuccgucggcgagugcgucgaguacuacuaccucuggaagaaguccgagcgcuacgacuacuucgcccagcagacccgccucggccgccgcaaguacguccccuccggcaccaccgacgccgaccaggaccucgacggcuccgaccccgacggccccggccgcccccgccccgagcaggacacccucaccggcaugcgcaccgacccccucuccgucgacggcaccgccggcggccucgacgagcccggcgucgccuccgacggccuccccuccuccgagcccggccccugcuccuuccagcagcucgacgagucccccgccgucccccucucccaccgcccccccgcccucgccgaccccgccuccuaccagcccgccgucaccgcccccgagcccgacgccuccccccgccucgccgucgacuucgcccuccccaaggagcucccccucaucuccucccacgucgaccucuccggcgaccccgaggagaccgucgcccccgcccaggucgcccucuccgucaccgaguucggccucaucggcaucggcgacgucaaccccuuccucgccgcccaccccaccugccccgcccccggccuccacuccgagccccucucccacugcaacgucaugaccugcuga

SEQ ID NO: 45987 - RNA, 1653 nt, Artificial Sequence
  derived and/or modified sequence opt2 from MIER3__Homo_sapiens__NP_001284528
auggccgaggccuccuucggcuccuccucccccgucggcucccucuccuccgaggaccacgacuucgaccccaccgccgagaugcucguccacgacuacgacgacgagcgcacccucgaggaggaggagaugauggacgagggcaagaacuucuccuccgagaucgaggaccucgagaaggagggcaccaugccccucgaggaccuccucgccuucuacggcuacgagcccaccauccccgccgucgccaacuccuccgccaacuccucccccuccgagcucgccgacgagcuccccgacaugacccucgacaaggaggagaucgccaaggaccuccucuccggcgacgacgaggagacccaguccuccgccgacgaccucacccccuccgucaccucccacgagaccuccgacuucuucccccgcccccuccgcuccaacaccgccugcgacggcgacaaggaguccgaggucgaggacgucgagaccgacuccggcaacucccccgaggaccuccgcaaggagaucaugaucggccuccaguaccaggccgagaucccccccuaccucggcgaguacgacggcaacgagaaggucuacgagaacgaggaccagcuccucuggugccccgacgucguccucgaguccaaggucaaggaguaccucgucgagaccucccuccgcaccggcuccgagaagaucauggaccgcaucuccgccggcacccacacccgcgacaacgagcaggcccucuacgagcuccucaagugcaaccacaacaucaaggaggccaucgagcgcuacugcugcaacggcaaggccucccaggagggcaugaccgccuggaccgaggaggagugccgcuccuucgagcacgcccucaugcucuucggcaaggacuuccaccucauccagaagaacaagguccgcacccgcaccgucgccgagugcgucgccuucuacuacauguggaagaaguccgagcgcuacgacuacuucgcccagcagacccgcuucggcaagaagcgcuacaaccaccaccccggcgucaccgacuacauggaccgccucgucgacgagaccgaggcccucggcggcaccgucaacgccuccgcccucaccuccaaccgccccgagcccauccccgaccagcagcucaacauccucaacuccuucaccgccuccgaccucaccgcccucaccaacuccgucgccaccgucugcgaccccaccgacgucaacugccucgacgacuccuuccccccccucggcaacaccccccgcggccaggucaaccacguccccgucgucaccgaggagcuccucacccuccccuccaacggcgaguccgacugcuucaaccucuucgagaccggcuucuaccacuccgagcucaaccccaugaacaugugcuccgaggaguccgagcgccccgccaagcgccucaagaugggcaucgccguccccgaguccuucaugaacgaggucuccgucaacaaccucggcgucgacuucgagaaccacacccaccacaucaccuccgccaagauggccgucuccgucgccgacuucggcucccucuccgccaacgagaccaacggcuucaucuccgcccacgcccuccaccagcacgccgcccuccacuccgaguga

SEQ ID NO: 45988 - RNA, 348 nt, Artificial Sequence
  derived and/or modified sequence opt2 from MIF__Homo_sapiens__NP_002406
augcccauguucaucgucaacaccaacgucccccgcgccuccguccccgacggcuuccucuccgagcucacccagcagcucgcccaggccaccggcaagcccccccaguacaucgccguccacgucguccccgaccagcucauggccuucggcggcuccuccgagcccugcgcccucugcucccuccacuccaucggcaagaucggcggcgcccagaaccgcuccuacuccaagcuccucugcggccuccucgccgagcgccuccgcaucucccccgaccgcgucuacaucaacuacuacgacaugaacgccgccaacgucggcuggaacaacuccaccuucgccuga

SEQ ID NO: 45989 - RNA, 1158 nt, Artificial Sequence
  derived and/or modified sequence opt2 from MILR1__Homo_sapiens__XP_011522929
augcagaccuccuccaagcccuccgacuuccucaaccucgccaagaagaagcgcaaguucuccgagcuccucaccaccgucguccuccucugccuccucacccccuccuggaccuccaccggccgcauguggucccaccucaaccgccuccucuucugguccaucuucuccuccgucaccugccgcaaggccguccucgacugcgaggccaugaagaccaacgaguuccccucccccugccucgacuccaagaccaaggucgucaugaagggccagaacgucuccauguucugcucccacaagaacaagucccuccagaucaccuacucccucuuccgccgcaagacccaccucggcacccaggacggcaagggcgagcccgccaucuucaaccucuccaucaccgaggcccacgaguccggccccuacaagugcaaggcccaggucaccuccugcuccaaguacucccgcgacuucuccuucaccaucgucgaccccgucaccucccccguccucaacaucauggucauccagaccgagaccgaccgccacaucacccuccacugccucuccgucaacggcucccuccccaucaacuacaccuucuucgagaaccacgucgccaucucccccgccaucuccaaguacgaccgcgagcccgccgaguucaaccucaccaagaagaaccccggcgaggaggaggaguaccgcugcgaggccaagaaccgccuccccaacuacgccaccuacucccaccccgucaccaugcccuccaccggcggcgacuccugccccuucugccucaagcuccuccuccccggccuccuccuccuccucgucgucaucauccucauccucgccuucuggguccuccccaaguacaagacccgcaaggccaugcgcaacaacgucccccgcgaccgcggcgacaccgccauggaggucggcaucuacgccaacauccucgagaagcaggccaaggaggaguccguccccgaggucggcucccgccccugcgucuccaccgcccaggacgaggccaagcacucccaggagcuccaguacgccacccccgucuuccaggaggucgccccccgcgagcaggaggccugcgacuccuacaaguccggcuacgucuacuccgagcucaacuucuga

SEQ ID NO: 45990 - RNA, 1395 nt, Artificial Sequence
  derived and/or modified sequence opt2 from MINA__Homo_sapiens__NP_116167
augcccaagaaggccaagcccaccggcuccggcaaggaggagggccccgcccccugcaagcagaugaagcucgaggccgccggcggccccuccgcccucaacuucgacucccccuccucccucuucgagucccucaucucccccaucaagaccgagaccuucuucaaggaguucugggagcagaagccccuccucauccagcgcgacgaccccgcccucgccaccuacuacggcucccucuucaagcucaccgaccucaagucccucugcucccgcggcauguacuacggccgcgacgucaacgucugccgcugcgucaacggcaagaagaagguccucaacaaggacggcaaggcccacuuccuccagcuccgcaaggacuucgaccagaagcgcgccaccauccaguuccaccagccccagcgcuucaaggacgagcucuggcgcauccaggagaagcucgagugcuacuucggcucccucgucggcuccaacgucuacaucacccccgccggcucccagggccuccccccccacuacgacgacgucgaggucuucauccuccagcucgagggcgagaagcacuggcgccucuaccaccccaccgucccccucgcccgcgaguacuccgucgaggccgaggagcgcaucggccgccccguccacgaguucaugcucaagcccggcgaccuccucuacuucccccgcggcaccauccaccaggccgacacccccgccggccucgcccacuccacccacgucaccaucuccaccuaccagaacaacuccuggggcgacuuccuccucgacaccaucuccggccucgucuucgacaccgccaaggaggacgucgagcuccgcaccggcaucccccgccagcuccuccucgucgaguccaccaccgucgccacccgccgccucuccggcuuccuccgcacccucgccgaccgccucgagggcaccaaggagcuccucuccuccgacaugaagaaggacuucaucaugcaccgccucccccccuacuccgccggcgacggcgccgagcucuccacccccggcggcaagcucccccgccucgacuccgucguccgccuccaguucaaggaccacaucguccucaccguccuccccgaccaggaccaguccgacgaggcccaggagaagauggucuacaucuaccacucccucaagaacucccgcgagacccacaugaugggcaacgaggaggagaccgaguuccacggccuccgcuucccccucucccaccucgacgcccucaagcagaucuggaacucccccgccaucuccgucaaggaccucaagcucaccaccgacgaggagaaggagucccucguccucucccucuggaccgagugccucauccaggucgucuga

SEQ ID NO: 45991 - RNA, 3939 nt, Artificial Sequence
  derived and/or modified sequence opt2 from MINK1__Homo_sapiens__NP_001020108
augggcgaccccgcccccgcccgcucccucgacgacaucgaccucuccgcccuccgcgaccccgccggcaucuucgagcucgucgaggucgucggcaacggcaccuacggccaggucuacaagggccgccacgucaagaccggccagcucgccgccaucaaggucauggacgucaccgaggacgaggaggaggagaucaagcaggagaucaacaugcucaagaaguacucccaccaccgcaacaucgccaccuacuacggcgccuucaucaagaaguccccccccggcaacgacgaccagcucuggcucgucauggaguucugcggcgccggcuccgucaccgaccucgucaagaacaccaagggcaacgcccucaaggaggacugcaucgccuacaucugccgcgagauccuccgcggccucgcccaccuccacgcccacaaggucauccaccgcgacaucaagggccagaacguccuccucaccgagaacgccgaggucaagcucgucgacuucggcgucuccgcccagcucgaccgcaccgucggccgccgcaacaccuucaucggcacccccuacuggauggcccccgaggucaucgccugcgacgagaaccccgacgccaccuacgacuaccgcuccgacaucuggucccucggcaucaccgccaucgagauggccgagggcgcccccccccucugcgacaugcaccccaugcgcgcccucuuccucaucccccgcaacccccccccccgccucaaguccaagaagugguccaagaaguucaucgacuucaucgacaccugccucaucaagaccuaccucucccgcccccccaccgagcagcuccucaaguuccccuucauccgcgaccagcccaccgagcgccagguccgcauccagcucaaggaccacaucgaccgcucccgcaagaagcgcggcgagaaggaggagaccgaguacgaguacuccggcuccgaggaggaggacgacucccacggcgaggagggcgagcccuccuccaucaugaacguccccggcgaguccacccuccgccgcgaguuccuccgccuccagcaggagaacaaguccaacuccgaggcccucaagcagcagcagcagcuccagcagcagcagcagcgcgaccccgaggcccacaucaagcaccuccuccaccagcgccagcgccgcaucgaggagcagaaggaggagcgccgccgcgucgaggagcagcagcgccgcgagcgcgagcagcgcaagcuccaggagaaggagcagcagcgccgccucgaggacaugcaggcccuccgccgcgaggaggagcgccgccaggccgagcgcgagcaggaguacaagcgcaagcagcucgaggagcagcgccaguccgagcgccuccagcgccagcuccagcaggagcacgccuaccucaagucccuccagcagcagcagcagcagcagcagcuccagaagcagcagcagcagcagcuccuccccggcgaccgcaagccccucuaccacuacggccgcggcaugaaccccgccgacaagcccgccugggcccgcgaggucgaggagcgcacccgcaugaacaagcagcagaacuccccccucgccaaguccaagcccggcuccaccggccccgagccccccaucccccaggccucccccggcccccccggcccccucucccagaccccccccaugcagcgccccgucgagccccaggagggcccccacaagucccuccaggaccagcccacccgcaaccucgccgccuuccccgccucccacgaccccgaccccgccauccccgcccccaccgccacccccuccgcccgcggcgccgucauccgccagaacuccgaccccaccuccgagggccccggccccucccccaacccccccgccuggguccgccccgacaacgaggccccccccaaggucccccagcgcaccuccuccaucgccaccgcccucaacaccuccggcgccggcggcucccgccccgcccaggccguccgcgcccgcccccgcuccaacuccgccuggcagaucuaccuccagcgccgcgccgagcgcggcacccccaagccccccggcccccccgcccagccccccggcccccccaacgccuccuccaaccccgaccuccgccgcuccgaccccggcugggagcgcuccgacuccguccuccccgccucccacggccaccucccccaggccggcucccucgagcgcaaccgcgucggcgucuccuccaagcccgacuccucccccguccucucccccggcaacaaggccaagcccgacgaccaccgcucccgccccggccgccccgccgacuucguccuccucaaggagcgcacccucgacgaggccccccgcccccccaagaaggccauggacuacuccuccuccuccgaggaggucgaguccuccgaggacgacgaggaggagggcgagggcggccccgccgagggcucccgcgacacccccggcggccgcuccgacggcgacaccgacuccgucuccaccauggucguccacgacgucgaggagaucaccggcacccagccccccuacggcggcggcaccauggucguccagcgcacccccgaggaggagcgcaaccuccuccacgccgacuccaacggcuacaccaaccuccccgacgucguccagcccucccacucccccaccgagaacuccaagggccaguccccccccuccaaggacggcuccggcgacuaccagucccgcggccucgucaaggcccccggcaaguccuccuucaccauguucgucgaccucggcaucuaccagcccggcggcuccggcgacuccauccccaucaccgcccucgucggcggcgagggcacccgccucgaccagcuccaguacgacguccgcaagggcuccgucgucaacgucaaccccaccaacacccgcgcccacuccgagacccccgagauccgcaaguacaagaagcgcuucaacuccgagauccucugcgccgcccucuggggcgucaaccuccucgucggcaccgagaacggccucaugcuccucgaccgcuccggccagggcaaggucuacggccucaucggccgccgccgcuuccagcagauggacguccucgagggccucaaccuccucaucaccaucuccggcaagcgcaacaagcuccgcgucuacuaccucuccuggcuccgcaacaagauccuccacaacgaccccgaggucgagaagaagcagggcuggaccaccgucggcgacauggagggcugcggccacuaccgcgucgucaaguacgagcgcaucaaguuccucgucaucgcccucaaguccuccgucgaggucuacgccugggcccccaagcccuaccacaaguucauggccuucaaguccuucgccgaccucccccaccgcccccuccucgucgaccucaccgucgaggagggccagcgccucaaggucaucuacggcuccuccgccggcuuccacgccgucgacgucgacuccggcaacuccuacgacaucuacauccccguccacauccagucccagaucaccccccacgccaucaucuuccuccccaacaccgacggcauggagaugcuccucugcuacgaggacgagggcgucuacgucaacaccuacggccgcaucaucaaggacgucguccuccaguggggcgagaugcccaccuccgucgccuacaucugcuccaaccagaucaugggcuggggcgagaaggccaucgagauccgcuccgucgagaccggccaccucgacggcgucuucaugcacaagcgcgcccagcgccucaaguuccucugcgagcgcaacgacaaggucuucuucgccuccguccgcuccggcggcuccucccaggucuacuucaugacccucaaccgcaacugcaucaugaacugguga

SEQ ID NO: 45992 - RNA, 939 nt, Artificial Sequence
  derived and/or modified sequence opt2 from MINPP1__Homo_sapiens__NP_001171588
augcuccgcgcccccggcugccuccuccgcaccuccgucgcccccgccgccgcccucgccgccgcccuccucuccucccucgcccgcugcucccuccucgagccccgcgaccccgucgccuccucccucucccccuacuucggcaccaagacccgcuacgaggacgucaaccccguccuccucuccggccccgaggcccccuggcgcgaccccgagcuccucgagggcaccugcacccccguccagcucgucgcccucauccgccacggcacccgcuaccccaccgucaagcagauccgcaagcuccgccagcuccacggccuccuccaggcccgcggcucccgcgacggcggcgccuccuccaccggcucccgcgaccucggcgccgcccucgccgacuggccccucugguacgccgacuggauggacggccagcucgucgagaagggccgccaggacaugcgccagcucgcccuccgccucgccucccucuuccccgcccucuucucccgcgagaacuacggccgccuccgccucaucaccuccuccaagcaccgcugcauggacuccuccgccgccuuccuccagggccucuggcagcacuaccaccccggccuccccccccccgacgucgccgacauggaguucggcccccccaccgucaacgacaagcucaugcgcuucuucgaccacugcgagaaguuccucaccgaggucgagaagaacgccaccgcccucuaccacgucgaggccuucaagaccggccccgagaugcagaacauccucaagaaggucgccgccacccuccagguccccgucaacgaccucaacgccggccucucccaguuccuccuccaguccuccuccucccucgucaugcagcgccucuucuuccacugcuuccucuccugggccaccuccaagacccgcaaccccuga

SEQ ID NO: 45993 - RNA, 858 nt, Artificial Sequence
  derived and/or modified sequence opt2 from MIOX__Homo_sapiens__NP_060054
augaaggucaccgucggccccgaccccucccucgucuaccgccccgacgucgaccccgaggucgccaaggacaaggccuccuuccgcaacuacaccuccggcccccuccucgaccgcgucuucaccaccuacaagcucaugcacacccaccagaccgucgacuucguccgcuccaagcacgcccaguucggcggcuucuccuacaagaagaugaccgucauggaggccgucgaccuccucgacggccucgucgacgaguccgaccccgacgucgacuuccccaacuccuuccacgccuuccagaccgccgagggcauccgcaaggcccaccccgacaaggacugguuccaccucgucggccuccuccacgaccucggcaagguccucgcccucuucggcgagccccagugggccgucgucggcgacaccuuccccgucggcugccgcccccaggccuccgucgucuucugcgacuccaccuuccaggacaaccccgaccuccaggacccccgcuacuccaccgagcucggcauguaccagccccacugcggccucgaccgcguccucauguccuggggccacgacgaguacauguaccaggucaugaaguucaacaaguucucccucccccccgaggccuucuacaugauccgcuuccacuccuucuaccccuggcacaccggccgcgacuaccagcagcucugcucccagcaggaccucgccaugcuccccuggguccgcgaguucaacaaguucgaccucuacaccaagugccccgaccuccccgacgucgacaagcuccgccccuacuaccagggccucaucgacaaguacugccccggcauccucuccugguga

SEQ ID NO: 45994 - RNA, 2142 nt, Artificial Sequence
  derived and/or modified sequence opt2 from MIPEP__Homo_sapiens__NP_005923
augcucugcgucggccgccucggcggccucggcgcccgcgccgccgcccuccccccccgccgcgccggccgcggcucccucgaggccggcauccgcgcccgccgcgucuccaccuccuggucccccgucggcgccgccuucaacgucaagccccagggcucccgccucgaccucuucggcgagcgccgcggccucuucggcguccccgagcucuccgcccccgagggcuuccacaucgcccaggagaaggcccuccgcaagaccgagcuccucgucgaccgcgccugcuccaccccccccggcccccagaccguccucaucuucgacgagcucuccgacucccucugccgcgucgccgaccucgccgacuucgucaagaucgcccaccccgagcccgccuuccgcgaggccgccgaggaggccugccgcuccaucggcaccauggucgagaagcucaacaccaacgucgaccucuaccagucccuccagaagcuccucgccgacaagaagcucgucgacucccucgaccccgagacccgccgcgucgccgagcucuucauguucgacuucgagaucuccggcauccaccucgacaaggagaagcgcaagcgcgccgucgaccucaacgucaagauccucgaccucuccuccaccuuccucaugggcaccaacuuccccaacaagaucgagaagcaccuccuccccgagcacauccgccgcaacuucaccuccgccggcgaccacaucaucaucgacggccuccacgccgagucccccgacgaccucguccgcgaggccgccuacaagaucuuccucuaccccaacgccggccagcucaagugccucgaggagcuccucuccucccgcgaccuccucgccaagcucgucggcuacuccaccuucucccaccgcgcccuccagggcaccaucgccaagaaccccgagaccgucaugcaguuccucgagaagcucuccgacaagcucuccgagcgcacccucaaggacuucgagaugauccgcggcaugaagaugaagcucaacccccagaacuccgaggucaugcccugggacccccccuacuacuccggcgucauccgcgccgagcgcuacaacaucgagcccucccucuacugccccuucuucucccucggcgccugcauggagggccucaacauccuccucaaccgccuccucggcaucucccucuacgccgagcagcccgccaagggcgaggucugguccgaggacguccgcaagcucgccgucguccacgaguccgagggccuccucggcuacaucuacugcgacuucuuccagcgcgccgacaagccccaccaggacugccacuucaccauccgcggcggccgccucaaggaggacggcgacuaccagcuccccgucgucguccucaugcucaaccucccccgcuccucccgcuccucccccacccuccucacccccggcaugauggagaaccucuuccacgagaugggccacgccaugcacuccaugcucggccgcacccgcuaccagcacgucaccggcacccgcugccccaccgacuucgccgagguccccuccauccucauggaguacuucgccaacgacuaccgcgucgucaaccaguucgcccgccacuaccagaccggccagccccuccccaagaacauggucucccgccucugcgaguccaagaaggucugcgccgccgccgacaugcagcuccaggucuucuacgccacccucgaccagaucuaccacggcaagcacccccuccgcaacuccaccaccgacauccucaaggagacccaggagaaguucuacggccuccccuacguccccaacaccgccuggcagcuccgcuucucccaccucgucggcuacggcgcccgcuacuacuccuaccucaugucccgcgccgucgccuccauggucuggaaggagugcuuccuccaggaccccuucaaccgcgccgccggcgagcgcuaccgccgcgagaugcucgcccacggcggcggccgcgagcccaugcucauggucgagggcaugcuccagaagugccccuccgucgacgacuucgucuccgcccucgucuccgaccucgaccucgacuucgagaccuuccucauggacuccgaguga

SEQ ID NO: 45995 - RNA, 792 nt, Artificial Sequence
  derived and/or modified sequence opt2 from MIP__Homo_sapiens__NP_036196
augugggagcuccgcuccgccuccuucuggcgcgccaucuucgccgaguucuucgccacccucuucuacgucuucuucggccucggcuccucccuccgcugggcccccggcccccuccacguccuccaggucgccauggccuucggccucgcccucgccacccucguccaguccgucggccacaucuccggcgcccacgucaaccccgccgucaccuucgccuuccucgucggcucccagaugucccuccuccgcgccuucugcuacauggccgcccagcuccucggcgccgucgccggcgccgccguccucuacuccgucaccccccccgccguccgcggcaaccucgcccucaacacccuccaccccgccgucuccgucggccaggccaccaccgucgagaucuuccucacccuccaguucguccucugcaucuucgccaccuacgacgagcgccgcaacggccagcucggcuccgucgcccucgccgucggcuucucccucgcccucggccaccucuucggcauguacuacaccggcgccggcaugaaccccgcccgcuccuucgcccccgccauccucaccggcaacuucaccaaccacugggucuacugggucggccccaucaucggcggcggccucggcucccuccucuacgacuuccuccucuucccccgccucaaguccaucuccgagcgccucuccguccucaagggcgccaagcccgacgucuccaacggccagcccgaggucaccggcgagcccgucgagcucaacacccaggcccucuga

SEQ ID NO: 45996 - RNA, 1329 nt, Artificial Sequence
  derived and/or modified sequence opt2 from MIPOL1__Homo_sapiens__NP_620059
auggagaacugguccaaggacaucacccacuccuaccucgagcaggagaccaccggcaucaacaaguccacccagcccgacgagcagcucaccaugaacuccgagaaguccaugcaccgcaaguccaccgagcucgucaacgagaucaccugcgagaacaccgaguggcccggccagcgcuccaccaacuuccagaucaucuccuccuaccccgacgacgaguccgucuacugcaccaccgagaaguacaacgucauggagcaccgccacaacgacaugcacuacgagugcaugacccccugccaggucaccuccgacuccgacaaggagaagaccaucgccuuccuccucaaggagcucgacauccuccgcaccuccaacaagaagcuccagcagaagcucgccaaggaggacaaggagcagcgcaagcucaaguucaagcucgagcuccaggagaaggagaccgaggccaagaucgccgagaagaccgccgcccucgucgaggaggucuacuucgcccagaaggagcgcgacgaggccgucaugucccgccuccagcucgccaucgaggagcgcgacgaggccaucgcccgcgccaagcacauggagaugucccucaagguccucgagaacaucaaccccgaggagaacgacaugacccuccaggagcuccucaaccgcaucaacaacgccgacaccggcaucgccauccagaagaacggcgccaucaucgucgaccgcaucuacaagaccaaggagugcaagaugcgcaucaccgccgaggagauguccgcccucaucgaggagcgcgacgccgcccucuccaagugcaagcgccucgagcaggagcuccaccacgucaaggagcagaaccagaccuccgccaacaacaugcgccaccucaccgccgagaacaaccaggagcgcgcccucaaggccaagcuccucuccaugcagcaggcccgcgagaccgccguccagcaguacaagaagcucgaggaggagauccagacccuccgcgucuacuacucccuccacaagucccucucccaggaggagaaccucaaggaccaguucaacuacacccucuccaccuacgaggaggcccucaagaaccgcgagaacaucgucuccaucacccagcagcagaacgaggagcucgccacccagcuccagcaggcccucaccgagcgcgccaacauggagcuccagcuccagcacgcccgcgaggccucccaggucgccaacgagaagguccagaagcucgagcgccucgucgacguccuccgcaagaaggucggcaccggcaccaugcgcaccgucaucuga

SEQ ID NO: 45997 - RNA, 354 nt, Artificial Sequence
  derived and/or modified sequence opt2 from MIR1-1HG__Homo_sapiens__NP_848558
augcccuccugcuccugcgcccucauggcccccugcggccccgccgccggccccgccgccgucgagcgcacccagcaggucgcccgcggcgagcccggcuccgcccgcggccagcuccaggucucccccgagauguccaucacccacaaggagaaggagaacgcccaccucaaggagauccuccucuucgucaacgccgaggccuucucccagccccagccccacuccgcccccgucugcgagggccagcagcucaccggcaaguucuccaccuccguccucacccgcgccggcggcgacgccucccccugcuccugggagcgccuccucugcuacggcuggucccacugcuga

SEQ ID NO: 45998 - RNA, 3399 nt, Artificial Sequence
  derived and/or modified sequence opt2 from MIS18BP1__Homo_sapiens__XP_005267890
augaucgccaccccccucaagcacucccgcaucuaccucccccccgaggccuccucccagcgccgcaaccuccccauggacgccaucuucuucgacuccauccccuccggcacccucacccccgucaaggaccucgucaaguaccagaacuccucccucaagcucaacgaccacaagaagaaccaguuccucaagaugaccaccuucaacaacaagaacaucuuccaguccaccaugcucaccgaggccaccaccuccaacuccucccucgacaucuccgccaucaagcccaacaaggacggccucaagaacaaggccaacuacgagucccccggcaagaucuuccuccgcaugaaggagaagguccuccgcgacaagcaggagcagcccucccgcaacuccucccuccucgagccccagaaguccggcaacaacgagaccuucacccccaaccgcgucgagaagaagaagcuccagcacaccuaccucugcgaggagaaggagaacaacaaguccuuccaguccgacgacuccucccuccgcgccuccguccagggcgucccccucgaguccuccaacaacgacaucuuccuccccgucaagcagaagauccagugccagcaggagaagaaggccccccuccacaaccucaccuacgagcuccccacccucaaccaggagcaggagaacuuccucgccgucgaggcccgcaacaagacccucacccgcgcccagcucgccaagcagaucuuccacuccaaggaguccaucgucgccaccaccaaguccaagaaggacaccuucguccucgaguccgucgacuccgccgacgagcaguuccagaacaccaacgccgagacccucuccaccaacugcauccccaucaagaacggcucccuccucauggucuccgacuccgagcgcaccaccgagggcaccucccagcagaaggucaaggagggcaacggcaagaccguccccggcgagaccggccuccccggcuccaugaaggacaccugcaagaucguccucgccaccccccgccuccacaucaccaucccccgccgcuccaagcgcaacaucuccaagcucucccccccccgcaucuuccagaccgucaccaacggccucaagaagaaccaggucguccagcuccaggaguggaugaucaaguccaucaacaacaacaccgccaucugcgucgagggcaagcucaucgacgucaccaacaucuacuggcacuccaacgucaucaucgagcgcaucgagcacaacaagcuccgcaccaucuccggcaacgucuacauccucaagggcaugaucgaccagaucuccaugaaggaggccggcuaccccaacuaccucauccgcaaguucauguucggcuuccccgagaacuggaaggagcacaucgacaacuuccucgagcagcuccgcgccggcgagaagaaccgcgagaagaccaagcagaagcagaagaccggccgcuccguccgcgacauccgcaaguccaugaagaacgacgcccgcgagaaccagaccgacaccgcccagcgcgccaccaccaccuacgacuucgacugcgacaaccucgagcucaaguccaacaagcacuccgagucccccggcgccaccgagcucaacaugugccacuccaacugccagaacaagcccacccuccgcuuccccgacgaccaggucaacaacaccauccagaacggcggcggcgacgaccucuccaaccaggagcucaucggcaagaaggaguacaagauguccuccaagaagcucaagaucggcgagcgcaccaacgagcgcaucaucaagucccagaagcaggagaccaccgaggagcucgacgucuccaucgacauccucaccucccgcgagcaguucuucuccgacgaggagcgcaaguacauggccaucaaccagaagaaggccuacauccucgucaccccccucaagucccgcaaggucaucgagcagcgcugcaugcgcuacaaccucuccgccggcaccaucaaggccgucaccgacuucgucauccccgagugccagaagaagucccccaucuccaaguccaugggcacccucgagaacaccuucgagggccacaaguccaagaacaaggaggacugcgacgagcgcgaccuccucaccgucaaccgcaagaucaagaucuccaaccucgagaaggagcagaugcucaccuccgacuucaagaagaacacccgccuccuccccaagcucaagaagaucgagaaccaggucgccauguccuucuacaagcaccaguccucccccgaccucuccuccgaggaguccgagaccgagaaggagaucaagcgcaaggccgaggucaagaagaccaaggccggcaacaccaaggaggccgucguccaccuccgcaaguccacccgcaacaccuccaacauccccgucauccucgagcccgagaccgaggaguccgagaacgaguucuacaucaagcagaagaaggcccgccccuccgucaaggagacccuccagaaguccggcguccgcaaggaguuccccaucaccgaggccgucggcuccgacaagaccaaccgccacccccucgagugccuccccggccucauccaggacaaggaguggaacgagaaggagcuccagaagcuccacugcgccuucgccucccuccccaagcacaagcccggcuucugguccgaggucgccgccgccgucggcucccgcucccccgaggagugccagcgcaaguacauggagaacccccgcggcaagggcucccagaagcacgucaccaagaagaagcccgccaacuccaagggccagaacggcaagcgcggcgacgccgaccagaagcagaccaucaagaucaccgccaaggucggcacccucaagcgcaagcagcagaugcgcgaguuccucgagcagcuccccaaggacgaccacgacgacuucuucuccaccaccccccuccagcaccagcgcauccuccuccccuccuuccaggacuccgaggacgacgacgacauccuccccaacauggacaagaaccccaccacccccuccuccgucaucuucccccucgucaagaccccccagugccagcacgucucccccggcaugcucggcuccaucaaccgcaacgacugcgacaaguacgucuuccgcaugcagaaguaccacaaguccaacggcggcaucgucuggggcaacaucaagaagaagcucgucgagaccgacuucuccacccccaccccccgccgcaagacccccuucaacaccgaccucggcgagaacuccggcaucggcaagcucuucaccaacgccgucgagucccucgacgaggaggagaaggacuacuacuucuccaacuccgacuccgccuga

SEQ ID NO: 45999 - RNA, 1260 nt, Artificial Sequence
  derived and/or modified sequence opt2 from MITF__Homo_sapiens__NP_000239
augcucgagaugcucgaguacaaccacuaccagguccagacccaccucgagaaccccaccaaguaccacauccagcaggcccagcgccagcaggucaagcaguaccucuccaccacccucgccaacaagcacgccaaccagguccucucccuccccugccccaaccagcccggcgaccacgucaugccccccguccccggcuccuccgcccccaacucccccauggccaugcucacccucaacuccaacugcgagaaggagggcuucuacaaguucgaggagcagaaccgcgccgaguccgagugccccggcaugaacacccacucccgcgccuccugcaugcagauggacgacgucaucgacgacaucaucucccucgaguccuccuacaacgaggagauccucggccucauggaccccgcccuccagauggccaacacccuccccgucuccggcaaccucaucgaccucuacggcaaccagggccuccccccccccggccucaccaucuccaacuccugccccgccaaccuccccaacaucaagcgcgagcucaccgccugcaucuuccccaccgaguccgaggcccgcgcccucgccaaggagcgccagaagaaggacaaccacaaccucaucgagcgccgccgccgcuucaacaucaacgaccgcaucaaggagcucggcacccucauccccaaguccaacgaccccgacaugcgcuggaacaagggcaccauccucaaggccuccgucgacuacauccgcaagcuccagcgcgagcagcagcgcgccaaggagcucgagaaccgccagaagaagcucgagcacgccaaccgccaccuccuccuccgcauccaggagcucgagaugcaggcccgcgcccacggccucucccucauccccuccaccggccucugcucccccgaccucgucaaccgcaucaucaagcaggagcccguccucgagaacugcucccaggaccuccuccagcaccacgccgaccucaccugcaccaccacccucgaccucaccgacggcaccaucaccuucaacaacaaccucggcaccggcaccgaggccaaccaggccuacuccguccccaccaagaugggcuccaagcucgaggacauccucauggacgacacccucucccccgucggcgucaccgacccccuccucuccuccgucucccccggcgccuccaagaccuccucccgccgcuccuccauguccauggaggagaccgagcacaccugcuga

SEQ ID NO: 46000 - RNA, 723 nt, Artificial Sequence
  derived and/or modified sequence opt2 from MIXL1__Homo_sapiens__NP_001269331
auggccaccgccgagucccgcgcccuccaguucgccgagggcgccgccuuccccgccuaccgcgccccccacgccggcggcgcccuccuccccccccccucccccgccgccgcccuccuccccgccccccccgccggccccggccccgccaccuucgccggcuuccucggccgcgaccccggccccgccccccccccccccgccucccucggcucccccgccccccccaagggcgccgccgcccccuccgccucccagcgccgcaagcgcaccuccuucuccgccgagcagcuccagcuccucgagcucgucuuccgccgcacccgcuaccccgacauccaccuccgcgagcgccucgccgcccucacccuccuccccgagucccgcauccagcuccucuucuccccccucuuccaggucugguuccagaaccgccgcgccaagucccgccgccaguccggcaaguccuuccagccccucgcccgccccgagaucauccucaaccacugcgcccccggcaccgagaccaagugccucaagccccagcucccccucgaggucgacgucaacugccuccccgagcccaacggcgucggcggcggcaucuccgacuccuccucccagggccagaacuucgagaccugcuccccccucuccgaggacaucggcuccaagcucgacuccugggaggagcacaucuucuccgccuucggcaacuucuga

SEQ ID NO: 46001 - RNA, 8691 nt, Artificial Sequence
  derived and/or modified sequence opt2 from MKI67__Homo_sapiens__NP_001139438
auguggcccacccgccgccucgucaccaucaagcgcuccggcgucgacggcccccacuucccccucucccucuccaccugccucuucggccgcggcaucgagugcgacauccgcauccagcuccccgucgucuccaagcagcacugcaagaucgagauccacgagcaggaggccauccuccacaacuucuccuccaccaaccccacccaggucaacggcuccgucaucgacgagcccguccgccucaagcacggcgacgucaucaccaucaucgaccgcuccuuccgcuacgagaacgagucccuccagaacggccgcaaguccaccgaguucccccgcaagauccgcgagcaggagcccgcccgccgcgucucccgcuccuccuucuccuccgaccccgacgaguccgagggcaucccccucaagcgccgccgcgucuccuucggcggccaccuccgccccgagcucuucgacgagaaccucccccccaacaccccccucaagcgcggcgaggcccccaccaagcgcaagucccucgucaugcacaccccccccguccucaagaagaucaucaaggagcagccccagcccuccggcaagcaggaguccggcuccgagauccacgucgaggucaaggcccagucccucgucaucuccccccccgcccccuccccccgcaagacccccgucgccuccgaccagcgccgccgcuccugcaagaccgcccccgccuccuccuccaagucccagaccgagguccccaagcgcggcggccgcaaguccggcaaccuccccuccaagcgcgucuccaucucccgcucccagcacgacauccuccagaugaucugcuccaagcgccgcuccggcgccuccgaggccaaccucaucgucgccaaguccugggccgacgucgucaagcucggcgccaagcagacccagaccaaggucaucaagcacggcccccagcgcuccaugaacaagcgccagcgccgccccgccacccccaagaagcccgucggcgagguccacucccaguucuccaccggccacgccaacucccccugcaccaucaucaucggcaaggcccacaccgagaagguccacguccccgcccgccccuaccgcguccucaacaacuucaucuccaaccagaagauggacuucaaggaggaccucuccggcaucgccgagauguucaagacccccgucaaggagcagccccagcucaccuccaccugccacaucgccaucuccaacuccgagaaccuccucggcaagcaguuccagggcaccgacuccggcgaggagccccuccuccccaccuccgaguccuucggcggcaacgucuucuucuccgcccagaacgccgccaagcagcccuccgacaagugcuccgccucccccccccuccgccgccagugcauccgcgagaacggcaacgucgccaagaccccccgcaacaccuacaagaugaccucccucgagaccaagaccuccgacaccgagaccgagcccuccaagaccgucuccaccgccaaccgcuccggccgcuccaccgaguuccgcaacauccagaagcuccccgucgaguccaaguccgaggagaccaacaccgagaucgucgagugcauccucaagcgcggccagaaggccacccuccuccagcagcgccgcgagggcgagaugaaggagaucgagcgccccuucgagaccuacaaggagaacaucgagcucaaggagaacgacgagaagaugaaggccaugaagcgcucccgcaccuggggccagaagugcgcccccauguccgaccucaccgaccucaagucccuccccgacaccgagcucaugaaggacaccgcccgcggccagaaccuccuccagacccaggaccacgccaaggcccccaaguccgagaagggcaagaucaccaagaugcccugccagucccuccagcccgagcccaucaacacccccacccacaccaagcagcagcucaaggccucccucggcaaggucggcgucaaggaggagcuccucgccgucggcaaguucacccgcaccuccggcgagaccacccacacccaccgcgagcccgccggcgacggcaaguccauccgcaccuucaaggagucccccaagcagauccucgaccccgccgcccgcgucaccggcaugaagaaguggccccgcacccccaaggaggaggcccagucccucgaggaccucgccggcuucaaggagcucuuccagacccccggccccuccgaggaguccaugaccgacgagaagaccaccaagaucgccugcaagucccccccccccgaguccgucgacacccccaccuccaccaagcaguggcccaagcgcucccuccgcaaggccgacgucgaggaggaguuccucgcccuccgcaagcucacccccuccgccggcaaggccaugcucacccccaagcccgccggcggcgacgagaaggacaucaaggccuucaugggcacccccguccagaagcucgaccucgccggcacccuccccggcuccaagcgccagcuccagacccccaaggagaaggcccaggcccucgaggaccucgccggcuucaaggagcucuuccagacccccggccacaccgaggagcucgucgccgccggcaagaccaccaagauccccugcgacuccccccaguccgaccccgucgacacccccaccuccaccaagcagcgccccaagcgcuccauccgcaaggccgacgucgagggcgagcuccucgccugccgcaaccucaugcccuccgccggcaaggccaugcacacccccaagcccuccgucggcgaggagaaggacaucaucaucuucgucggcacccccguccagaagcucgaccucaccgagaaccucaccggcuccaagcgccgcccccagacccccaaggaggaggcccaggcccucgaggaccucaccggcuucaaggagcucuuccagacccccggccacaccgaggaggccgucgccgccggcaagaccaccaagaugcccugcgaguccuccccccccgaguccgccgacacccccaccuccacccgccgccagcccaagaccccccucgagaagcgcgacguccagaaggagcucuccgcccucaagaagcucacccagaccuccggcgagaccacccacaccgacaagguccccggcggcgaggacaaguccaucaacgccuuccgcgagaccgccaagcagaagcucgaccccgccgccuccgucaccggcuccaagcgccaccccaagaccaaggagaaggcccagccccucgaggaccucgccggccucaaggagcucuuccagacccccgucugcaccgacaagcccaccacccacgagaagaccaccaagaucgccugccgcucccagcccgaccccgucgacacccccaccuccuccaagccccaguccaagcgcucccuccgcaaggucgacgucgaggaggaguucuucgcccuccgcaagcgcacccccuccgccggcaaggccaugcacacccccaagcccgccgucuccggcgagaagaacaucuacgccuucaugggcacccccguccagaagcucgaccucaccgagaaccucaccggcuccaagcgccgccuccagacccccaaggagaaggcccaggcccucgaggaccucgccggcuucaaggagcucuuccagacccgcggccacaccgaggaguccaugaccaacgacaagaccgccaaggucgccugcaaguccucccagcccgaccccgacaagaaccccgccuccuccaagcgccgccucaagaccucccucggcaaggucggcgucaaggaggagcuccucgccgucggcaagcucacccagaccuccggcgagaccacccacacccacaccgagcccaccggcgacggcaaguccaugaaggccuucauggagucccccaagcagauccucgacuccgccgccucccucaccggcuccaagcgccagcuccgcacccccaagggcaaguccgagguccccgaggaccucgccggcuucaucgagcucuuccagacccccucccacaccaaggaguccaugaccaacgagaagaccaccaaggucuccuaccgcgccucccagcccgaccucgucgacacccccaccuccuccaagccccagcccaagcgcucccuccgcaaggccgacaccgaggaggaguuccucgccuuccgcaagcagacccccuccgccggcaaggccaugcacacccccaagcccgccgucggcgaggagaaggacaucaacaccuuccucggcacccccguccagaagcucgaccagcccggcaaccuccccggcuccaaccgccgccuccagacccgcaaggagaaggcccaggcccucgaggagcucaccggcuuccgcgagcucuuccagacccccugcaccgacaaccccaccaccgacgagaagaccaccaagaagauccucugcaaguccccccaguccgaccccgccgacacccccaccaacaccaagcagcgccccaagcgcucccucaagaaggccgacgucgaggaggaguuccucgccuuccgcaagcucacccccuccgccggcaaggccaugcacacccccaaggccgccgucggcgaggagaaggacaucaacaccuucgucggcacccccgucgagaagcucgaccuccucggcaaccuccccggcuccaagcgccgcccccagacccccaaggagaaggccaaggcccucgaggaccucgccggcuucaaggagcucuuccagacccccggccacaccgaggaguccaugaccgacgacaagaucaccgaggucuccugcaaguccccccagcccgaccccgucaagacccccaccuccuccaagcagcgccucaagaucucccucggcaaggucggcgucaaggaggagguccuccccgucggcaagcucacccagaccuccggcaagaccacccagacccaccgcgagaccgccggcgacggcaaguccaucaaggccuucaaggaguccgccaagcagaugcucgaccccgccaacuacggcaccggcauggagcgcuggccccgcacccccaaggaggaggcccagucccucgaggaccucgccggcuucaaggagcucuuccagacccccgaccacaccgaggaguccaccaccgacgacaagaccaccaagaucgccugcaagucccccccccccgaguccauggacacccccaccuccacccgccgccgccccaagaccccccucggcaagcgcgacaucgucgaggagcucuccgcccucaagcagcucacccagaccacccacaccgacaagguccccggcgacgaggacaagggcaucaacgucuuccgcgagaccgccaagcagaagcucgaccccgccgccuccgucaccggcuccaagcgccagccccgcacccccaagggcaaggcccagccccucgaggaccucgccggccucaaggagcucuuccagacccccaucugcaccgacaagcccaccacccacgagaagaccaccaagaucgccugccgcuccccccagcccgaccccgucggcacccccaccaucuucaagccccaguccaagcgcucccuccgcaaggccgacgucgaggaggagucccucgcccuccgcaagcgcacccccuccgucggcaaggccauggacacccccaagcccgccggcggcgacgagaaggacaugaaggccuucaugggcacccccguccagaagcucgaccuccccggcaaccuccccggcuccaagcgcuggccccagacccccaaggagaaggcccaggcccucgaggaccucgccggcuucaaggagcucuuccagacccccggcaccgacaagcccaccaccgacgagaagaccaccaagaucgccugcaaguccccccagcccgaccccgucgacacccccgccuccaccaagcagcgccccaagcgcaaccuccgcaaggccgacgucgaggaggaguuccucgcccuccgcaagcgcacccccuccgccggcaaggccauggacacccccaagcccgccgucuccgacgagaagaacaucaacaccuucgucgagacccccguccagaagcucgaccuccucggcaaccuccccggcuccaagcgccagccccagacccccaaggagaaggccgaggcccucgaggaccucgucggcuucaaggagcucuuccagacccccggccacaccgaggaguccaugaccgacgacaagaucaccgaggucuccugcaaguccccccagcccgaguccuucaagaccucccgcuccuccaagcagcgccucaagaucccccucgucaaggucgacaugaaggaggagccccucgccgucuccaagcucacccgcaccuccggcgagaccacccagacccacaccgagcccaccggcgacuccaaguccaucaaggccuucaaggagucccccaagcagauccucgaccccgccgccuccgucaccggcucccgccgccagcuccgcacccgcaaggagaaggcccgcgcccucgaggaccucgucgacuucaaggagcucuucuccgcccccggccacaccgaggaguccaugaccaucgacaagaacaccaagauccccugcaagucccccccccccgagcucaccgacaccgccaccuccaccaagcgcugccccaagacccgcccccgcaaggaggucaaggaggagcucuccgccgucgagcgccucacccagaccuccggccaguccacccacacccacaaggagcccgccuccggcgacgagggcaucaagguccucaagcagcgcgccaagaagaagcccaaccccgucgaggaggagcccucccgccgccgcccccgcgcccccaaggagaaggcccagccccucgaggaccucgccggcuucaccgagcucuccgagaccuccggccacacccaggagucccucaccgccggcaaggccaccaagauccccugcgagucccccccccucgaggucgucgacaccaccgccuccaccaagcgccaccuccgcacccgcguccagaagguccaggucaaggaggagcccuccgccgucaaguucacccagaccuccggcgagaccaccgacgccgacaaggagcccgccggcgaggacaagggcaucaaggcccucaaggaguccgccaagcagacccccgcccccgccgccuccgucaccggcucccgccgccgcccccgcgccccccgcgaguccgcccaggccaucgaggaccucgccggcuucaaggaccccgccgccggccacaccgaggaguccaugaccgacgacaagaccaccaagauccccugcaaguccucccccgagcucgaggacaccgccaccuccuccaagcgccgcccccgcacccgcgcccagaaggucgaggucaaggaggagcuccucgccgucggcaagcucacccagaccuccggcgagaccacccacaccgacaaggagcccgucggcgagggcaagggcaccaaggccuucaagcagcccgccaagcgcaagcucgacgccgaggacgucaucggcucccgccgccagccccgcgcccccaaggagaaggcccagccccucgaggaccucgccuccuuccaggagcucucccagacccccggccacaccgaggagcucgccaacggcgccgccgacuccuucaccuccgcccccaagcagacccccgacuccggcaagccccucaagaucucccgccgcguccuccgcgcccccaaggucgagcccgucggcgacgucgucuccacccgcgaccccgucaagucccaguccaaguccaacaccucccuccccccccuccccuucaagcgcggcggcggcaaggacggcuccgucaccggcaccaagcgccuccgcugcaugcccgcccccgaggagaucgucgaggagcuccccgccuccaagaagcagcgcgucgccccccgcgcccgcggcaaguccuccgagcccgucgucaucaugaagcgcucccuccgcaccuccgccaagcgcaucgagcccgccgaggagcucaacuccaacgacaugaagaccaacaaggaggagcacaagcuccaggacuccguccccgagaacaagggcaucucccuccgcucccgccgccagaacaagaccgaggccgagcagcagaucaccgaggucuucguccucgccgagcgcaucgagaucaaccgcaacgagaagaagcccaugaagaccucccccgagauggacauccagaaccccgacgacggcgcccgcaagcccaucccccgcgacaaggucaccgagaacaagcgcugccuccgcuccgcccgccagaacgaguccucccagcccaaggucgccgaggaguccggcggccagaaguccgccaagguccucaugcagaaccagaagggcaagggcgaggccggcaacuccgacuccaugugccuccgcucccgcaagaccaagucccagcccgccgccuccacccucgaguccaaguccguccagcgcgucacccgcuccgucaagcgcugcgccgagaaccccaagaaggccgaggacaacgucugcgucaagaagauccgcacccgcucccaccgcgacuccgaggacaucuga

SEQ ID NO: 46002 - RNA, 1713 nt, Artificial Sequence
  derived and/or modified sequence opt2 from MKKS__Homo_sapiens__NP_061336
augucccgccucgaggccaagaagcccucccucugcaaguccgagccccucaccaccgagcgcguccgcaccacccucuccguccucaagcgcaucgucaccuccugcuacggccccuccggccgccucaagcagcuccacaacggcuucggcggcuacgucugcaccaccucccaguccuccgcccuccucucccaccuccucgucacccaccccauccucaagauccucaccgccuccauccagaaccacgucuccuccuucuccgacugcggccucuucaccgccauccucugcugcaaccucaucgagaacguccagcgccucggccucacccccaccaccgucauccgccucaacaagcaccuccucucccucugcaucuccuaccucaaguccgagaccugcggcugccgcauccccgucgacuucuccuccacccagauccuccucugccucguccgcuccauccucaccuccaagcccgccugcaugcucacccgcaaggagaccgagcacgucuccgcccucauccuccgcgccuuccuccucaccauccccgagaacgccgagggccacaucauccucggcaagucccucaucgucccccucaagggccagcgcgucaucgacuccaccguccuccccggcauccucaucgagauguccgagguccagcucaugcgccuccuccccaucaagaaguccaccgcccucaaggucgcccucuucugcaccacccucuccggcgacaccuccgacaccggcgagggcaccgucgucgucuccuacggcgucucccucgagaacgccguccucgaccagcuccucaaccucggccgccagcucaucuccgaccacgucgaccucguccucugccagaaggucauccaccccucccucaagcaguuccucaacaugcaccgcaucaucgccaucgaccgcaucggcgucacccucauggagccccucaccaagaugaccggcacccagcccaucggcucccucggcuccaucugccccaacuccuacggcuccgucaaggacgucugcaccgccaaguucggcuccaagcacuucuuccaccucauccccaacgaggccaccaucugcucccuccuccucugcaaccgcaacgacaccgccugggacgagcucaagcucaccugccagaccgcccuccacguccuccagcucacccucaaggagcccugggcccuccucggcggcggcugcaccgagacccaccucgccgccuacauccgccacaagacccacaacgaccccgaguccauccucaaggacgacgagugcacccagaccgagcuccagcucaucgccgaggccuucugcuccgcccucgaguccgucgucggcucccucgagcacgacggcggcgagauccucaccgacaugaaguacggccaccucugguccguccaggccgacucccccugcgucgccaacuggcccgaccuccucucccagugcggcugcggccucuacaacucccaggaggagcucaacugguccuuccuccgcuccacccgccgccccuucgucccccaguccugccucccccacgaggccgucggcuccgccuccaaccucacccucgacugccucaccgccaagcucuccggccuccaggucgccgucgagaccgccaaccucauccucgaccucuccuacgucaucgaggacaagaacuga

SEQ ID NO: 46003 - RNA, 2796 nt, Artificial Sequence
  derived and/or modified sequence opt2 from MKL1__Homo_sapiens__NP_001269589
augcccccccucaagucccccgccgccuuccacgagcagcgccgcucccucgagcgcgcccgcaccgaggacuaccucaagcgcaagauccgcucccgccccgagcgcuccgagcucguccgcaugcacauccucgaggagaccuccgccgagcccucccuccaggccaagcagcucaagcucaagcgcgcccgccucgccgacgaccucaacgagaagaucgcccagcgccccggccccauggagcucgucgagaagaacauccuccccgucgaguccucccucaaggaggccaucaucgucggccaggucaacuaccccaaggucgccgacuccuccuccuucgacgaggacuccuccgacgcccucucccccgagcagcccgccucccacgagucccagggcuccguccccuccccccucgaggcccgcgucuccgagccccuccucuccgccaccuccgccucccccacccaggucgucucccagcuccccaugggccgcgacucccgcgagaugcucuuccucgccgagcagcccccccuccccccccccccccuccucccccccucccucaccaacggcaccaccauccccaccgccaaguccacccccacccucaucaagcagucccagcccaaguccgccuccgagaagucccagcgcuccaagaaggccaaggagcucaagcccaaggucaagaagcucaaguaccaccaguacaucccccccgaccagaagcaggaccgcggcgccccccccauggacuccuccuacgccaagauccuccagcagcagcagcucuuccuccagcuccagauccucaaccagcagcagcagcagcaccacaacuaccaggccauccuccccgccccccccaaguccgccggcgaggcccucggcuccuccggcaccccccccguccgcucccucuccaccaccaacuccuccuccuccuccggcgcccccggccccugcggccucgcccgccagaacuccaccucccucaccggcaagcccggcgcccuccccgccaaccucgacgacaugaaggucgccgagcucaagcaggagcucaagcuccgcucccuccccgucuccggcaccaagaccgagcucaucgagcgccuccgcgccuaccaggaccagaucucccccguccccggcgcccccaaggcccccgccgccaccuccauccuccacaaggccggcgaggucgucgucgccuuccccgccgcccgccucuccaccggccccgcccucgucgccgccggccucgcccccgccgaggucgucgucgccaccgucgccuccuccggcgucgucaaguucggcuccaccggcuccaccccccccgucucccccacccccuccgagcgcucccuccucuccaccggcgacgagaacuccacccccggcgacaccuucggcgagauggucaccuccccccucacccagcucacccuccaggccuccccccuccagauccucgucaaggaggagggcccccgcgccggcuccugcugccucucccccggcggccgcgccgagcucgagggccgcgacaaggaccagaugcuccaggagaaggacaagcagaucgaggcccucacccgcaugcuccgccagaagcagcagcucgucgagcgccucaagcuccagcucgagcaggagaagcgcgcccagcagcccgcccccgcccccgccccccucggcacccccgucaagcaggagaacuccuucuccuccugccagcucucccagcagccccucggccccgcccaccccuucaaccccucccucgccgcccccgccaccaaccacaucgaccccugcgccgucgcccccggcccccccuccgucgucgucaagcaggaggcccuccagcccgagcccgagcccguccccgccccccagcuccuccucggcccccagggccccucccucaucaagggcgucgccccccccacccucaucaccgacuccaccggcacccaccucguccucaccgucaccaacaagaacgccgacucccccggccucuccuccggcuccccccagcagcccuccucccagcccggcucccccgcccccgcccccuccgcccagauggaccucgagcacccccuccagccccucuucggcacccccaccucccuccucaagaaggagccccccggcuacgaggaggccaugucccagcagcccaagcagcaggagaacggcuccuccucccagcagauggacgaccucuucgacauccucauccaguccggcgagaucuccgccgacuucaaggagccccccucccuccccggcaaggagaagcccucccccaagaccgucugcggcuccccccucgccgcccagcccucccccuccgccgagcucccccaggccgccccccccccccccggcucccccucccuccccggccgccucgaggacuuccucgaguccuccaccggccucccccuccucaccuccggccacgacggccccgagccccucucccucaucgacgaccuccacucccagaugcucuccuccaccgccauccucgaccacccccccucccccauggacaccuccgagcuccacuucguccccgagcccuccuccaccaugggccucgaccucgccgacggccaccucgacuccauggacuggcucgagcucuccuccggcggccccguccucucccucgccccccucuccaccaccgcccccucccucuucuccaccgacuuccucgacggccacgaccuccagcuccacugggacuccugccucuga

SEQ ID NO: 46004 - RNA, 3150 nt, Artificial Sequence
  derived and/or modified sequence opt2 from MKL2__Homo_sapiens__NP_054767
auggaccacaccggcgccaucgacaccgaggacgaggucggcccccucgcccaccucgcccccuccccccaguccgaggccgucgcccacgaguuccaggagcucucccuccaguccucccagaaccuccccccccucaacgagcgcaagaacguccuccagcuccgccuccagcagcgccgcacccgcgagcagcucgucgaccagggcaucaugcccccccucaagucccccgccgccuuccacgagcagaucaagucccucgagcgcgcccgcaccgagaacuuccucaagcacaagauccgcucccgccccgaccgcuccgagcucguccgcaugcacauccucgaggagaccuucgccgagcccucccuccaggccacccagaugaagcucaagcgcgcccgccucgccgacgaccucaacgagaagaucgcccagcgccccggccccauggagcucgucgagaagaacauccuccccgucgacuccuccgucaaggaggccaucaucggcgucggcaaggaggacuacccccacacccagggcgacuucuccuucgacgaggacuccuccgacgcccucucccccgaccagcccgccucccaggagucccagggcuccgccgccucccccuccgagcccaaggucuccgagucccccucccccgucaccaccaacacccccgcccaguucgccuccgucucccccaccguccccgaguuccucaagaccccccccaccgccgaccagccccccccccgccccgccgcccccguccuccccaccaacaccgucuccuccgccaagcccggccccgcccucgucaagcagucccaccccaagaaccccaacgacaagcaccgcuccaagaagugcaaggaccccaagccccgcgucaagaagcucaaguaccaccaguacaucccccccgaccagaagggcgagaagaacgagccccagauggacuccaacuacgcccgccuccuccagcagcagcagcucuuccuccagcuccagauccucucccagcagaagcagcacuacaacuaccagaccauccuccccgcccccuucaagccccucaacgacaagaacuccaacuccggcaacuccgcccucaacaacgccacccccaacaccccccgccagaacaccuccacccccguccgcaagcccggcccccuccccuccucccucgacgaccucaaggucuccgagcucaagaccgagcucaagcuccgcggccuccccgucuccggcaccaagcccgaccucaucgagcgccucaagcccuaccaggaggucaacuccuccggccucgccgccggcggcaucgucgccgucuccuccuccgccaucgucaccuccaaccccgaggucaccgucgcccuccccgucaccacccuccacaacaccgucaccuccuccgucuccacccucaaggccgagcucccccccaccggcaccuccaacgccacccgcgucgagaacguccacuccccccuccccaucucccccucccccuccgagcaguccucccucuccaccgacgacaccaacauggccgacaccuucaccgagaucaugaccaugaugucccccucccaguuccucuccuccuccccccuccgcaugaccaacaacgaggacucccucucccccaccuccuccacccucuccaaccucgagcucgacgccgccgagaaggaccgcaagcuccaggagaaggagaagcagaucgaggagcucaagcgcaagcucgagcaggagcagaagcucgucgagguccucaagaugcagcucgaggucgagaagcgcggccagcagcagcgcccccucgaggcccagcccuccgcccccggccacuccgucaaguccgaccagaagcacggcucccucggcuccuccaucaaggacgaggccucccuccccgacugcuccuccucccgccagcccauccccgucgccucccacgccgucggccagcccgucuccaccggcggccagacccucgucgccaagaaggccgucgucaucaagcaggagguccccgucggccaggccgagcagcaguccgucgucucccaguucuacaccuccccccaggccggcaugcagacccagccccagaucgccaccgccgcccagauccccaccgccgcccucgccuccggccucgcccccaccgucccccagacccaggacaccuucccccagcacguccucucccagccccagcagguccgcaaggucuucaccaacuccgccuccuccaacaccguccuccccuaccagcgccaccccgcccccgccguccagcagcccuucaucaacaaggccuccaacuccguccuccagucccgcaacgccccccuccccucccuccagaacggccccaacacccccaacaagcccuccucccccccccccccccagcaguucgucguccagcacucccucuucggcucccccgucgccaagaccaaggaccccccccgcuacgaggaggccaucaagcagacccgcuccacccaggccccccuccccgagaucuccaacgcccacucccagcagauggacgaccucuucgacauccucaucaaguccggcgagaucucccuccccaucaaggaggagcccucccccaucuccaagaugcgccccgucaccgccuccaucaccaccaugcccgucaacaccgucgucucccgcccccccccccagguccagauggccccccccgucucccucgagcccaugggcucccucuccgccucccucgagaaccagcucgaggccuuccucgacggcacccuccccuccgccaacgagauccccccccuccaguccuccuccgaggaccgcgagcccuucucccucaucgaggaccuccagaacgaccuccucucccacuccggcaugcucgaccacucccacucccccauggagaccuccgagacccaguucgccgccggcacccccugccucucccucgaccucuccgacuccaaccucgacaacauggaguggcucgacaucaccaugcccaacuccuccuccggccucaccccccucuccaccaccgcccccuccauguucuccgccgacuuccucgacccccaggaccucccccuccccugggacuga

SEQ ID NO: 46005 - RNA, 2208 nt, Artificial Sequence
  derived and/or modified sequence opt2 from MKLN1__Homo_sapiens__NP_037387
auggccgccggcggcgccgucgccgccgcccccgagugccgccuccuccccuacgcccuccacaagugguccuccuucuccuccaccuaccuccccgagaacauccucgucgacaagcccaacgaccaguccucccgcugguccuccgaguccaacuaccccccccaguaccucauccucaagcucgagcgccccgccaucguccagaacaucaccuucggcaaguacgagaagacccacgucugcaaccucaagaaguucaaggucuucggcggcaugaacgaggagaacaugaccgagcuccucuccuccggccucaagaacgacuacaacaaggagaccuucacccucaagcacaagaucgacgagcagauguuccccugccgcuucaucaagaucgucccccuccucuccuggggccccuccuucaacuucuccaucugguacgucgagcucuccggcaucgacgaccccgacaucguccagcccugccucaacugguacuccaaguaccgcgagcaggaggccauccgccucugccucaagcacuuccgccagcacaacuacaccgaggccuucgagucccuccagaagaagaccaagaucgcccucgagcaccccaugcucaccgacauccacgacaagcucguccucaagggcgacuucgacgccugcgaggagcucaucgagaaggccgucaacgacggccucuucaaccaguacaucucccagcaggaguacaagccccgcuggucccagaucauccccaaguccaccaagggcgacggcgaggacaaccgccccggcaugcgcggcggccaccagauggucaucgacguccagaccgagaccgucuaccucuucggcggcugggacggcacccaggaccucgccgacuucugggccuacuccgucaaggagaaccaguggaccugcaucucccgcgacaccgagaaggagaacggccccuccgcccgcuccugccacaagaugugcaucgacauccagcgccgccagaucuacacccucggccgcuaccucgacuccuccguccgcaacuccaagucccucaaguccgacuucuaccgcuacgacaucgacaccaacaccuggaugcuccucuccgaggacaccgccgccgacggcggccccaagcucgucuucgaccaccagaugugcauggacuccgagaagcacaugaucuacaccuucggcggccgcauccucaccugcaacggcuccgucgacgacucccgcgccuccgagccccaguucuccggccucuucgccuucaacugccagugccagaccuggaagcuccuccgcgaggacuccugcaacgccggccccgaggacauccagucccgcaucggccacugcaugcucuuccacuccaagaaccgcugccucuacgucuucggcggccagcgcuccaagaccuaccucaacgacuucuucuccuacgacgucgacuccgaccacgucgacaucaucuccgacggcaccaagaaggacuccggcaugguccccaugaccggcuucacccagcgcgccaccaucgaccccgagcucaacgagauccacguccucuccggccucuccaaggacaaggagaagcgcgaggagaacguccgcaacuccuucuggaucuacgacaucguccgcaacuccugguccugcgucuacaagaacgaccaggccgccaaggacaaccccaccaagucccuccaggaggaggagcccugcccccgcuucgcccaccagcucgucuacgacgagcuccacaagguccacuaccucuucggcggcaaccccggcaaguccugcucccccaagaugcgccucgacgacuucuggucccucaagcucugccgccccuccaaggacuaccuccuccgccacugcaaguaccucauccgcaagcaccgcuucgaggagaaggcccaggucgacccccucuccgcccucaaguaccuccagaacgaccucuacaucaccgucgaccacuccgaccccgaggagaccaaggaguuccagcuccucgccuccgcccucuucaaguccggcuccgacuucaccgcccucggcuucuccgacgucgaccacaccuacgcccagcgcacccagcucuucgacacccucgucaacuucuuccccgacuccaugaccccccccaagggcaaccucgucgaccucaucacccucuga

SEQ ID NO: 46006 - RNA, 990 nt, Artificial Sequence
  derived and/or modified sequence opt2 from MKNK1__Homo_sapiens__XP_011540651
auggccaaguccaugcccuccaaguccucccgcaacaagcagggcaccgucggcgucggcugcuucgagcgcuggcgccgcugcaucuccguccgcgagaccuccuccauccucgcccacauccagaagcagaagcacuucaacgagcgcgaggccucccgcgucguccgcgacgucgccgccgcccucgacuuccuccacaccaagggcaucgcccaccgcgaccucaagcccgagaacauccucugcgagucccccgagaaggucucccccgucaagaucugcgacuucgaccucggcuccggcaugaagcucaacaacuccugcacccccaucaccacccccgagcucaccacccccugcggcuccgccgaguacauggcccccgaggucgucgaggucuucaccgaccaggccaccuucuacgacaagcgcugcgaccucuggucccucggcgucguccucuacaucaugcucuccggcuacccccccuucgucggccacugcggcgccgacugcggcugggaccgcggcgaggucugccgcgucugccagaacaagcucuucgaguccauccaggagggcaaguacgaguuccccgacaaggacugggcccacaucuccuccgaggccaaggaccucaucuccaagcuccucguccgcgacgccaagcagcgccucuccgccgcccagguccuccagcaccccuggguccagggccaggcccccgagaagggccuccccaccccccagguccuccagcgcaacuccuccaccauggaccucacccucuucgccgccgaggccaucgcccucaaccgccagcucucccagcacgaggagaacgagcucgccgaggagcccgaggcccucgccgacggccucugcuccaugaagcucuccccccccugcaagucccgccucgcccgccgccgcgcccucgcccaggccggccgcggcgaggaccgcuccccccccaccgcccucuga

SEQ ID NO: 46007 - RNA, 1245 nt, Artificial Sequence
  derived and/or modified sequence opt2 from MKNK2__Homo_sapiens__NP_060042
augguccagaagaagcccgccgagcuccagggcuuccaccgcuccuucaagggccagaaccccuucgagcucgccuucucccucgaccagcccgaccacggcgacuccgacuucggccuccagugcuccgcccgccccgacaugcccgccucccagcccaucgacauccccgacgccaagaagcgcggcaagaagaagaagcgcggccgcgccaccgacuccuucuccggccgcuucgaggacgucuaccagcuccaggaggacguccucggcgagggcgcccacgcccgcguccagaccugcaucaaccucaucaccucccaggaguacgccgucaagaucaucgagaagcagcccggccacauccgcucccgcgucuuccgcgaggucgagaugcucuaccagugccagggccaccgcaacguccucgagcucaucgaguucuucgaggaggaggaccgcuucuaccucgucuucgagaagaugcgcggcggcuccauccucucccacauccacaagcgccgccacuucaacgagcucgaggccuccgucgucguccaggacgucgccuccgcccucgacuuccuccacaacaagggcaucgcccaccgcgaccucaagcccgagaacauccucugcgagcaccccaaccaggucucccccgucaagaucugcgacuucgaccucggcuccggcaucaagcucaacggcgacugcucccccaucuccacccccgagcuccucacccccugcggcuccgccgaguacauggcccccgaggucgucgaggccuucuccgaggaggccuccaucuacgacaagcgcugcgaccucuggucccucggcgucauccucuacauccuccucuccggcuacccccccuucgucggccgcugcggcuccgacugcggcugggaccgcggcgaggccugccccgccugccagaacaugcucuucgaguccauccaggagggcaaguacgaguuccccgacaaggacugggcccacaucuccugcgccgccaaggaccucaucuccaagcuccucguccgcgacgccaagcagcgccucuccgccgcccagguccuccagcaccccuggguccagggcugcgcccccgagaacacccuccccacccccaugguccuccagcgcugggacucccacuuccuccuccccccccaccccugccgcauccacguccgccccggcggccucguccgcaccgucaccgucaacgaguga

SEQ ID NO: 46008 - RNA, 990 nt, Artificial Sequence
  derived and/or modified sequence opt2 from MKRN1__Homo_sapiens__NP_001138597
auggccgaggccgccacccccggcaccaccgccaccaccuccggcgccggcgccgccgccgccaccgccgccgccgccucccccacccccauccccaccgucaccgcccccucccucggcgccggcggcggcggcggcggcuccgacggcuccggcggcggcuggaccaagcaggucaccugccgcuacuucaugcacggcgucugcaaggagggcgacaacugccgcuacucccacgaccucuccgacucccccuacuccgucgucugcaaguacuuccagcgcggcuacugcaucuacggcgaccgcugccgcuacgagcacuccaagccccucaagcaggaggaggccaccgccaccgagcucaccaccaaguccucccucgccgccuccuccucccucuccuccaucgucggcccccucgucgagaugaacaccggcgaggccgagucccgcaacuccaacuucgccaccgucggcgccggcuccgaggacugggucaacgccaucgaguucguccccggccagcccuacugcggccgcaccgcccccuccugcaccgaggccccccuccagggcuccgucaccaaggaggaguccgagaaggagcagaccgccgucgagaccaagaagcagcucugccccuacgccgccgucggcgagugccgcuacggcgagaacugcgucuaccuccacggcgacuccugcgacaugugcggccuccagguccuccaccccauggacgccgcccagcgcucccagcacaucaaguccugcaucgaggcccacgagaaggacauggagcucuccuucgccguccagcgcuccaaggacauggucugcggcaucugcauggaggucgucuacgagaaggccaaccccuccgagcgccgcuucggcauccucuccaacugcaaccacaccuacugccucaagugcauccgcaaguggcgcuccgccaagcaguucgaguccaagaucaucaaguga

SEQ ID NO: 46009 - RNA, 1524 nt, Artificial Sequence
  derived and/or modified sequence opt2 from MKRN3__Homo_sapiens__NP_005655
auggaggagcccgccgcccccuccgaggcccacgaggccgccggcgcccaggccggcgccgaggccgcccgcgagggcgucuccggccccgaccuccccgucugcgagcccuccggcgaguccgccgcccccgacuccgcccucccccacgccgcccgcggcugggcccccuuccccgucgcccccguccccgcccaccuccgccgcggcggccuccgccccgcccccgccuccggcggcggcgccuggcccuccccccuccccucccgcuccuccggcaucuggaccaagcagaucaucugccgcuacuacauccacggccagugcaaggagggcgagaacugccgcuacucccacgaccucuccggccgcaagauggccaccgagggcggcgucuccccccccggcgccuccgccggcggcggccccuccaccgccgcccacaucgagccccccacccaggaggucgccgaggccccccccgccgccuccucccucucccuccccgucaucggcuccgccgccgagcgcggcuucuucgaggccgagcgcgacaacgccgaccgcggcgccgccggcggcgccggcgucgaguccugggccgacgccaucgaguucguccccggccagcccuaccgcggccgcugggucgccuccgcccccgaggccccccuccaguccuccgagaccgagcgcaagcagauggccgucggcuccggccuccgcuucugcuacuacgccucccgcggcgucugcuuccgcggcgaguccugcauguaccuccacggcgacaucugcgacaugugcggccuccagacccuccaccccauggacgccgcccagcgcgaggagcacaugcgcgccugcaucgaggcccacgagaaggacauggagcucuccuucgccguccagcgcggcauggacaaggucugcggcaucugcauggaggucgucuacgagaaggccaaccccaacgaccgccgcuucggcauccucuccaacugcaaccacuccuucugcauccgcugcauccgccgcuggcgcuccgcccgccaguucgagaaccgcaucgucaaguccugcccccagugccgcgucaccuccgagcucgucauccccuccgaguucugggucgaggaggaggaggagaagcagaagcucauccagcaguacaaggaggccauguccaacaaggccugccgcuacuucgccgagggccgcggcaacugccccuucggcgacaccugcuucuacaagcacgaguaccccgagggcuggggcgacgagccccccggccccggcggcggcuccuucuccgccuacuggcaccagcucgucgagcccguccgcaugggcgagggcaacaugcucuacaaguccaucaagaaggagcucgucguccuccgccucgccucccuccucuucaagcgcuuccucucccuccgcgacgagcuccccuucuccgaggaccagugggaccuccuccacuacgagcucgaggaguacuucaaccucauccucuga

SEQ ID NO: 46010 - RNA, 1650 nt, Artificial Sequence
  derived and/or modified sequence opt2 from MKS1__Homo_sapiens__NP_001159399
auggccguccccgucuccuccuucgcccagcgcacccgcucccgcuuccgcguccaccuccagcgcaucaccuccuccaacuuccuccacuaccagcccgccgccgagcucggcaaggaccucaucgaccucgccaccuuccgcccccagcccaccgccuccggccaccgccccgaggaggacgaggaggaggagaucgucaucggcuggcaggagaagcucuucucccaguucgaggucgaccucuaccagaacgagaccgccugccaguccccccucgacuaccaguaccgccaggagauccucaagcucgagaacuccggcggcaagaagaaccgccgcaucuucaccuacaccgacuccgaccgcuacaccaaccucgaggagcacugccagcgcaugaccaccgccgccuccgagguccccuccuuccucgucgagcgcauggccaacguccgccgccgccgccaggaccgccgcggcauggagggcggcauccucaagucccgcaucgucaccugggagcccuccgaggaguucguccgcaacaaccacgucaucaacaccccccuccagaccaugcacaucauggccgaccucggccccuacaagaagcucggcuacaagaaguacgagcacguccucugcacccucaaggucgacuccaacggcgucaucaccgucaagcccgacuucaccggccucaagggccccuaccgcaucgagaccgagggcgagaagcaggagcucuggaaguacaccaucgacaacgucuccccccacgcccagcccgaggaggaggagcgcgagcgccgcgucuucaaggaccucuacggccgccacaaggaguaccucuccucccucgucggcaccgacuucgagaugaccguccccggcgcccuccgccucuucgucaacggcgaggucgucuccgcccagggcuacgaguacgacaaccucuacguccacuucuucgucgagcuccccaccgcccacugguccucccccgccuuccagcagcucuccggcgucacccagaccugcaccaccaagucccucgccauggacaaggucgcccacuucuccuaccccuucaccuucgaggccuucuuccuccacgaggacgaguccuccgacgcccuccccgaguggcccguccucuacugcgagguccucucccucgacuucuggcagcgcuaccgcgucgagggcuacggcgccgucguccuccccgccacccccggcucccacacccucaccgucuccaccuggcgccccgucgagcucggcaccgucgccgagcuccgccgcuucuucaucggcggcucccucgagcucgaggaccucuccuacguccgcauccccggcuccuucaagggcgagcgccucucccgcuucggccuccgcaccgagaccaccggcaccgucaccuuccgccuccacugccuccagcagucccgcgccuucauggaguccuccucccuccagaagcgcaugcgcuccguccucgaccgccucgagggcuucucccagcaguccuccauccacaacguccucgaggccuuccgccgcgcccgccgccgcaugcaggaggcccgcgagucccucccccaggaccucgucucccccuccggcacccucgucuccuga

SEQ ID NO: 46011 - RNA, 357 nt, Artificial Sequence
  derived and/or modified sequence opt2 from MLANA__Homo_sapiens__NP_005502
augccccgcgaggacgcccacuucaucuacggcuaccccaagaagggccacggccacuccuacaccaccgccgaggaggccgccggcaucggcauccucaccgucauccucggcguccuccuccucaucggcugcugguacugccgccgccgcaacggcuaccgcgcccucauggacaagucccuccacgucggcacccagugcgcccucacccgccgcugcccccaggagggcuucgaccaccgcgacuccaaggucucccuccaggagaagaacugcgagcccgucguccccaacgccccccccgccuacgagaagcucuccgccgagcagucccccccccccuacucccccuga

SEQ ID NO: 46012 - RNA, 1134 nt, Artificial Sequence
  derived and/or modified sequence opt2 from MLC1__Homo_sapiens__NP_631941
augacccaggagcccuuccgcgaggagcucgccuacgaccgcaugcccacccucgagcgcggccgccaggaccccgccuccuacgcccccgacgccaagcccuccgaccuccagcucuccaagcgccucccccccugcuucucccacaagaccugggucuucuccguccucaugggcuccugccuccucgucaccuccggcuucucccucuaccucggcaacgucuuccccgccgagauggacuaccuccgcugcgccgccggcuccugcauccccuccgccaucgucuccuucaccgucucccgccgcaacgccaacgucauccccaacuuccagauccucuucgucuccaccuucgccgucaccaccaccugccucaucugguucggcugcaagcucguccucaaccccuccgccaucaacaucaacuucaaccucauccuccuccuccuccucgagcuccucauggccgccaccgucaucaucgccgcccgcuccuccgaggaggacugcaagaagaagaagggcuccauguccgacuccgccaacauccucgacgagguccccuuccccgcccgcguccucaaguccuacuccgucgucgaggucaucgccggcaucuccgccguccucggcggcaucaucgcccucaacgucgacgacuccgucuccggcccccaccucuccgucaccuucuucuggauccucgucgccugcuuccccuccgccaucgccucccacgucgccgccgagugccccuccaagugccucgucgagguccucaucgccaucuccucccucaccuccccccuccucuucaccgccuccggcuaccucuccuucuccaucaugcgcaucgucgagauguucaaggacuacccccccgccaucaagcccuccuacgacguccuccuccuccuccuccuccucguccuccuccuccaggccggccucaacaccggcaccgccauccagugcguccgcuucaaggucuccgcccgccuccagggcgccuccugggacacccagaacggcccccaggagcgccucgccggcgaggucgcccgcuccccccucaaggaguucgacaaggagaaggccuggcgcgccgucgucguccagauggcccaguga

SEQ ID NO: 46013 - RNA, 879 nt, Artificial Sequence
  derived and/or modified sequence opt2 from MLEC__Homo_sapiens__NP_055545
augcucggcgccugggccgucgagggcaccgccgucgcccuccuccgccuccuccuccuccuccucccccccgccauccgcggccccggccucggcgucgccggcgucgccggcgccgccggcgccggccuccccgaguccgucaucugggccgucaacgccggcggcgaggcccacgucgacguccacggcauccacuuccgcaaggacccccucgagggccgcgucggccgcgccuccgacuacggcaugaagcuccccauccuccgcuccaaccccgaggaccagauccucuaccagaccgagcgcuacaacgaggagaccuucggcuacgagguccccaucaaggaggagggcgacuacguccucguccucaaguucgccgaggucuacuucgcccagucccagcagaaggucuucgacguccgccucaacggccacgucgucgucaaggaccucgacaucuucgaccgcgucggccacuccaccgcccacgacgagaucauccccauguccauccgcaagggcaagcucuccguccagggcgaggucuccaccuucaccggcaagcucuacaucgaguucgucaagggcuacuacgacaaccccaaggucugcgcccucuacaucauggccggcaccgucgacgacguccccaagcuccagccccaccccggccucgagaagaaggaggaggaggaggaggaggaggaguacgacgagggcuccaaccucaagaagcagaccaacaagaaccgcguccaguccggcccccgcacccccaaccccuacgccuccgacaacuccucccucauguuccccauccucgucgccuucggcgucuucauccccacccucuucugccucugccgccucuga

SEQ ID NO: 46014 - RNA, 732 nt, Artificial Sequence
  derived and/or modified sequence opt2 from MLF1__Homo_sapiens__NP_001123629
augcgccagaugauccgcuccuucuccgagcccuucggccgcgaccuccucuccaucuccgacggccgcggccgcgcccacaaccgccgcggccacaacgacggcgaggacucccucacccacaccgacgucuccuccuuccagaccauggaccagauggucuccaacaugcgcaacuacaugcagaagcucgagcgcaacuucggccagcucuccgucgaccccaacggccacuccuucugcuccuccuccgucaugaccuacuccaagaucggcgacgagccccccaaggucuuccaggccuccacccagacccgccgcgcccccggcggcaucaaggagacccgcaaggccaugcgcgacuccgacuccggccucgagaagauggccaucggccaccacauccacgaccgcgcccacgucaucaagaaguccaagaacaagaagaccggcgacgaggaggucaaccaggaguucaucaacaugaacgaguccgacgcccacgccuucgacgaggaguggcaguccgagguccucaaguacaagcccggccgccacaaccucggcaacacccgcaugcgcuccgucggccacgagaaccccggcucccgcgagcucaagcgccgcgagaagccccagcagucccccgccaucgagcacggccgccgcuccaacguccucggcgacaagcuccacaucaagggcuccuccgucaaguccaacaagaaguga

SEQ ID NO: 46015 - RNA, 747 nt, Artificial Sequence
  derived and/or modified sequence opt2 from MLF2__Homo_sapiens__NP_005430
auguuccgcuucaugcgcgacgucgagcccgaggaccccauguuccucauggaccccuucgccauccaccgccagcacaugucccgcaugcucuccggcggcuucggcuacucccccuuccucuccaucaccgacggcaacaugcccggcacccgccccgccucccgccgcaugcagcaggccggcgccgucucccccuucggcaugcucggcauguccggcggcuucauggacauguucggcaugaugaacgacaugaucggcaacauggagcacaugaccgccggcggcaacugccagaccuucuccuccuccaccgucaucuccuacuccaacaccggcgacggcgcccccaaggucuaccaggagaccuccgagaugcgcuccgcccccggcggcauccgcgagacccgccgcaccguccgcgacuccgacuccggccucgagcagauguccaucggccaccacauccgcgaccgcgcccacauccuccagcgcucccgcaaccaccgcaccggcgaccaggaggagcgccaggacuacaucaaccucgacgaguccgaggccgccgccuucgacgacgaguggcgccgcgagaccucccgcuuccgccagcagcgcccccucgaguuccgccgccucgaguccuccggcgccggcggccgccgcgccgagggccccccccgccucgccauccagggccccgaggacucccccucccgccagucccgccgcuacgacugguga

SEQ ID NO: 46016 - RNA, 2271 nt, Artificial Sequence
  derived and/or modified sequence opt2 from MLH1__Homo_sapiens__NP_000240
auguccuucgucgccggcgucauccgccgccucgacgagaccgucgucaaccgcaucgccgccggcgaggucauccagcgccccgccaacgccaucaaggagaugaucgagaacugccucgacgccaaguccaccuccauccaggucaucgucaaggagggcggccucaagcucauccagauccaggacaacggcaccggcauccgcaaggaggaccucgacaucgucugcgagcgcuucaccaccuccaagcuccaguccuucgaggaccucgccuccaucuccaccuacggcuuccgcggcgaggcccucgccuccaucucccacgucgcccacgucaccaucaccaccaagaccgccgacggcaagugcgccuaccgcgccuccuacuccgacggcaagcucaaggccccccccaagcccugcgccggcaaccagggcacccagaucaccgucgaggaccucuucuacaacaucgccacccgccgcaaggcccucaagaaccccuccgaggaguacggcaagauccucgaggucgucggccgcuacuccguccacaacgccggcaucuccuucuccgucaagaagcagggcgagaccgucgccgacguccgcacccuccccaacgccuccaccgucgacaacauccgcuccaucuucggcaacgccgucucccgcgagcucaucgagaucggcugcgaggacaagacccucgccuucaagaugaacggcuacaucuccaacgccaacuacuccgucaagaagugcaucuuccuccucuucaucaaccaccgccucgucgaguccaccucccuccgcaaggccaucgagaccgucuacgccgccuaccuccccaagaacacccaccccuuccucuaccucucccucgagaucuccccccagaacgucgacgucaacguccaccccaccaagcacgagguccacuuccuccacgaggaguccauccucgagcgcguccagcagcacaucgaguccaagcuccucggcuccaacuccucccgcauguacuucacccagacccuccuccccggccucgccggccccuccggcgagauggucaaguccaccaccucccucaccuccuccuccaccuccggcuccuccgacaaggucuacgcccaccagaugguccgcaccgacucccgcgagcagaagcucgacgccuuccuccagccccucuccaagccccucuccucccagccccaggccaucgucaccgaggacaagaccgacaucuccuccggccgcgcccgccagcaggacgaggagaugcucgagcuccccgcccccgccgaggucgccgccaagaaccagucccucgagggcgacaccaccaagggcaccuccgagauguccgagaagcgcggccccaccuccuccaacccccgcaagcgccaccgcgaggacuccgacgucgagauggucgaggacgacucccgcaaggagaugaccgccgccugcaccccccgccgccgcaucaucaaccucaccuccguccucucccuccaggaggagaucaacgagcagggccacgagguccuccgcgagaugcuccacaaccacuccuucgucggcugcgucaacccccagugggcccucgcccagcaccagaccaagcucuaccuccucaacaccaccaagcucuccgaggagcucuucuaccagauccucaucuacgacuucgccaacuucggcguccuccgccucuccgagcccgccccccucuucgaccucgccaugcucgcccucgacucccccgaguccggcuggaccgaggaggacggccccaaggagggccucgccgaguacaucgucgaguuccucaagaagaaggccgagaugcucgccgacuacuucucccucgagaucgacgaggagggcaaccucaucggccucccccuccucaucgacaacuacguccccccccucgagggccuccccaucuucauccuccgccucgccaccgaggucaacugggacgaggagaaggagugcuucgagucccucuccaaggagugcgccauguucuacuccauccgcaagcaguacaucuccgaggaguccacccucuccggccagcaguccgagguccccggcuccauccccaacuccuggaaguggaccgucgagcacaucgucuacaaggcccuccgcucccacauccucccccccaagcacuucaccgaggacggcaacauccuccagcucgccaaccuccccgaccucuacaaggucuucgagcgcugcuga

SEQ ID NO: 46017 - RNA, 4290 nt, Artificial Sequence
  derived and/or modified sequence opt2 from MLH3__Homo_sapiens__NP_055196
augaucaagugccucuccgucgagguccaggccaagcuccgcuccggccucgccaucuccucccucggccagugcgucgaggagcucgcccucaacuccaucgacgccgaggccaagugcgucgccguccgcgucaacauggagaccuuccagguccaggucaucgacaacggcuucggcaugggcuccgacgacgucgagaaggucggcaaccgcuacuucaccuccaagugccacuccguccaggaccucgagaacccccgcuucuacggcuuccgcggcgaggcccucgccaacaucgccgacauggccuccgccgucgagaucuccuccaagaagaaccgcaccaugaagaccuucgucaagcucuuccaguccggcaaggcccucaaggccugcgaggccgacgucacccgcgccuccgccggcaccaccgucaccgucuacaaccucuucuaccagcuccccguccgccgcaagugcauggacccccgccucgaguucgagaagguccgccagcgcaucgaggcccucucccucaugcaccccuccaucuccuucucccuccgcaacgacgucuccggcuccaugguccuccagcuccccaagaccaaggacgucugcucccgcuucugccagaucuacggccucggcaagucccagaagcuccgcgagaucuccuucaaguacaaggaguucgagcucuccggcuacaucuccuccgaggcccacuacaacaagaacaugcaguuccucuucgucaacaagcgccucguccuccgcaccaagcuccacaagcucaucgacuuccuccuccgcaaggaguccaucaucugcaagcccaagaacggccccaccucccgccagaugaacuccucccuccgccaccgcuccacccccgagcucuacggcaucuacgucaucaacguccagugccaguucugcgaguacgacgucugcauggagcccgccaagacccucaucgaguuccagaacugggacacccuccucuucugcauccaggagggcgucaagauguuccucaagcaggagaagcucuucgucgagcucuccggcgaggacaucaaggaguucuccgaggacaacggcuucucccucuucgacgccacccuccagaagcgcgucaccuccgacgagcgcuccaacuuccaggaggccugcaacaacauccucgacuccuacgagauguucaaccuccaguccaaggccgucaagcgcaagaccaccgccgagaacgucaacacccaguccucccgcgacuccgaggccacccgcaagaacaccaacgacgccuuccucuacaucuacgaguccggcggccccggccacuccaagaugaccgagcccucccuccagaacaaggacuccuccugcuccgaguccaagaugcucgagcaggagaccaucgucgccuccgaggccggcgagaacgagaagcacaagaaguccuuccucgagcacuccucccucgagaaccccugcggcaccucccucgagauguuccucucccccuuccagacccccugccacuucgaggaguccggccaggaccucgagaucuggaaggaguccaccaccgucaacggcauggccgccaacauccucaagaacaaccgcauccagaaccagcccaagcgcuucaaggacgccaccgaggucggcugccagccccuccccuucgccaccacccucuggggcguccacuccgcccagaccgagaaggagaagaagaaggaguccuccaacugcggccgccgcaacgucuucuccuacggccgcgucaagcucugcuccaccggcuucaucacccacgucguccagaacgagaagaccaaguccaccgagaccgagcacuccuucaagaacuacguccgccccggccccacccgcgcccaggagaccuucggcaaccgcacccgccacuccgucgagacccccgacaucaaggaccucgccuccacccucuccaaggaguccggccagcuccccaacaagaagaacugccgcaccaacaucuccuacggccucgagaacgagcccaccgccaccuacaccauguucuccgccuuccaggagggcuccaagaagucccagaccgacugcauccucuccgacaccucccccuccuuccccugguaccgccacgucuccaacgacucccgcaagaccgacaagcucaucggcuucuccaagcccaucguccgcaagaagcucucccucuccucccagcucggcucccucgagaaguucaagcgccaguacggcaaggucgagaacccccucgacaccgaggucgaggaguccaacggcgucaccaccaaccucucccuccaggucgagcccgacauccuccucaaggacaagaaccgccucgagaacuccgacgucugcaagaucaccaccauggagcacuccgacuccgacuccuccugccagcccgccucccacauccucaacuccgagaaguuccccuucuccaaggacgaggacugccucgagcagcagaugcccucccuccgcgagucccccaugacccucaaggagcucucccucuucaaccgcaagccccucgaccucgagaaguccuccgagucccucgccuccaagcucucccgccucaagggcuccgagcgcgagacccagaccaugggcaugaugucccgcuucaacgagcuccccaacuccgacuccucccgcaaggacuccaagcucugcuccguccucacccaggacuucugcaugcucuucaacaacaagcacgagaagaccgagaacggcgucauccccaccuccgacuccgccacccaggacaacuccuucaacaagaacuccaagacccacuccaacuccaacaccaccgagaacugcgucaucuccgagaccccccucguccuccccuacaacaacuccaaggucaccggcaaggacuccgacguccucauccgcgccuccgagcagcagaucggcucccucgacucccccuccggcaugcucaugaaccccgucgaggacgccaccggcgaccagaacggcaucugcuuccaguccgaggaguccaaggcccgcgccugcuccgagaccgaggaguccaacaccugcugcuccgacuggcagcgccacuucgacgucgcccucggccgcauggucuacgucaacaagaugaccggccucuccaccuucaucgcccccaccgaggacauccaggccgccugcaccaaggaccucaccaccgucgccgucgacgucguccucgagaacggcucccaguaccgcugccagcccuuccgcuccgaccucguccuccccuuccucccccgcgcccgcgccgagcgcaccgucaugcgccaggacaaccgcgacaccgucgacgacaccgucuccuccgagucccuccagucccucuucuccgagugggacaaccccgucuucgcccgcuaccccgaggucgccgucgacgucuccuccggccaggccgagucccucgccgucaagauccacaacauccucuaccccuaccgcuucaccaagggcaugauccacuccaugcagguccuccagcaggucgacaacaaguucaucgccugccucauguccaccaagaccgaggagaacggcgaggccgacuccuacgagaagcagcaggcccagggcuccggccgcaagaagcuccucuccuccacccucauccccccccucgagaucaccgucaccgaggagcagcgccgccuccucuggugcuaccacaagaaccucgaggaccucggccucgaguucgucuuccccgacaccuccgacucccucguccucgucggcaaggucccccucugcuucgucgagcgcgaggccaacgagcuccgccgcggccgcuccaccgucaccaaguccaucgucgaggaguucauccgcgagcagcucgagcuccuccagaccaccggcggcauccagggcacccucccccucaccguccagaagguccucgccucccaggccugccacggcgccaucaaguucaacgacggccucucccuccaggaguccugccgccucaucgaggcccucuccuccugccagcuccccuuccagugcgcccacggccgccccuccaugcucccccucgccgacaucgaccaccucgagcaggagaagcagaucaagcccaaccucaccaagcuccgcaagauggcccaggccuggcgccucuucggcaaggccgagugcgacacccgccagucccuccagcaguccaugccccccugcgagccccccuga

SEQ ID NO: 46018 - RNA, 792 nt, Artificial Sequence
  derived and/or modified sequence opt2 from MLKL__Homo_sapiens__NP_001135969
auggagaaccucaagcacaucaucacccucggccaggucauccacaagcgcugcgaggagaugaaguacugcaagaagcagugccgccgccucggccaccgcguccucggccucaucaagccccucgagaugcuccaggaccagggcaagcgcuccguccccuccgagaagcucaccaccgccaugaaccgcuucaaggccgcccucgaggaggccaacggcgagaucgagaaguucuccaaccgcuccaacaucugccgcuuccucaccgccucccaggacaagauccucuucaaggacgucaaccgcaagcucuccgacgucuggaaggagcucucccuccuccuccaggucgagcagcgcaugcccgucucccccaucucccagggcgccuccugggcccaggaggaccagcaggacgccgacgaggaccgccgcgccuuccagaugcuccgccgcgacaacgagaagaucgaggccucccuccgccgccucgagaucaacaugaaggagaucaaggagacccuccgccagucccucgaguccuccuccggcaaguccccccucgagaucucccgcuucaaggucaagaacgucaagaccggcuccgccuccggcugcaacuccgagaagauccgcaagcucgucgccgucaagcgccagcaggagccccucggcgaggacugccccuccgagcuccgcgagaucaucgacgagugccgcgcccacgaccccuccguccgccccuccgucgacgagauccucaagaagcucuccaccuucuccaaguga

SEQ ID NO: 46019 - RNA, 3207 nt, Artificial Sequence
  derived and/or modified sequence opt2 from MLLT10__Homo_sapiens__NP_001182555
auggucuccuccgaccgccccgucucccucgaggacgaggucucccacuccaugaaggagaugaucggcggcugcugcgucugcuccgacgagcgcggcugggccgagaacccccucgucuacugcgacggccacggcugcuccgucgccguccaccaggccugcuacggcaucguccagguccccaccggccccugguucugccgcaagugcgagucccaggagcgcgccgcccgcguccgcugcgagcucugcccccacaaggacggcgcccucaagcgcaccgacaacggcggcugggcccacgucgucugcgcccucuacauccccgagguccaguucgccaacgucuccaccauggagcccaucguccuccaguccgucccccacgaccgcuacaacaagaccugcuacaucugcgacgagcagggccgcgaguccaaggccgccaccggcgccugcaugaccugcaacaagcacggcugccgccaggccuuccacgucaccugcgcccaguucgccggccuccucugcgaggaggagggcaacggcgccgacaacguccaguacugcggcuacugcaaguaccacuucuccaagcucaagaaguccaagcgcggcuccaaccgcuccuacgaccagucccucuccgacuccuccucccacucccaggacaagcaccacgagaaggagaagaagaaguacaaggagaaggacaagcacaagcagaagcacaagaagcagcccgagcccucccccgcccucguccccucccucaccgucaccaccgagaagaccuacaccuccaccuccaacaacuccaucuccggcucccucaagcgccucgaggacaccaccgcccgcuucaccaacgccaacuuccaggaggucuccgcccacaccuccuccggcaaggacgucuccgagacccgcggcuccgagggcaagggcaagaaguccuccgcccacuccuccggccagcgcggccgcaagcccggcggcggccgcaaccccggcaccaccgucuccgccgccucccccuucccccagggcuccuucuccggcacccccggcuccgucaaguccuccuccggcuccuccguccaguccccccaggacuuccucuccuucaccgacuccgaccuccgcaacgacuccuacucccacucccagcaguccuccgccaccaaggacguccacaagggcgaguccggcucccaggagggcggcgucaacuccuucuccacccucaucggccuccccuccaccuccgccgucaccucccagcccaaguccuucgagaacucccccggcgaccucggcaacuccucccuccccaccgccggcuacaagcgcgcccagaccuccggcaucgaggaggagaccgucaaggagaagaagcgcaagggcaacaagcaguccaagcacggccccggccgccccaagggcaacaagaaccaggagaacgucucccaccucuccgucuccuccgccucccccaccuccuccgucgccuccgccgccggcuccaucaccuccuccucccuccagaagucccccacccuccuccgcaacggcucccuccagucccucuccgucggcuccucccccgucggcuccgagaucuccaugcaguaccgccacgacggcgccugccccaccaccaccuucuccgagcuccucaacgccauccacaacggcaucuacaacuccaacgacgucgccgucuccuuccccaacgucgucuccggcuccggcuccuccacccccgucuccuccucccaccucccccagcaguccuccggccaccuccagcaggucggcgcccucucccccuccgccgucuccuccgccgcccccgccgucgccaccacccaggccaacacccucuccggcuccucccucucccaggcccccucccacauguacggcaaccgcuccaacuccuccauggccgcccucaucgcccaguccgagaacaaccagaccgaccaggaccucggcgacaacucccgcaaccucgucggccgcggcuccuccccccgcggcucccucuccccccgcucccccgucuccucccuccagauccgcuacgaccagcccggcaacuccucccucgagaaccucccccccgucgccgccuccaucgagcagcuccucgagcgccagugguccgagggccagcaguuccuccucgagcagggcacccccuccgacauccucggcaugcucaagucccuccaccagcuccaggucgagaaccgccgccucgaggagcagaucaagaaccucaccgccaagaaggagcgccuccagcuccucaacgcccagcucuccguccccuuccccaccaucaccgccaaccccucccccucccaccagauccacaccuucuccgcccagaccgcccccaccaccgacucccucaacuccuccaaguccccccacaucggcaacuccuuccuccccgacaacucccuccccguccucaaccaggaccucaccuccuccggccaguccaccuccuccuccuccgcccucuccacccccccccccgccggccagucccccgcccagcagggcuccggcgucuccggcguccagcaggucaacggcgucaccgucggcgcccucgccuccggcaugcagcccgucaccuccaccauccccgccgucuccgccgucggcggcaucaucggcgcccuccccggcaaccagcucgccaucaacggcaucgucggcgcccucaacggcgucaugcagacccccgucaccaugucccagaaccccaccccccucacccacaccaccgucccccccaacgccacccaccccaugcccgccacccucaccaacuccgccuccggccucggccuccucuccgaccagcagcgccagauccucauccaccagcagcaguuccagcagcuccucaacucccagcagcucacccccgagcagcaccaggccuuccucuaccagcucaugcagcaccaccaccagcagcaccaccagcccgagcuccagcagcuccagauccccggccccacccagauccccaucaacaaccuccucgccggcacccaggcccccccccuccacaccgccaccaccaaccccuuccucaccauccacggcgacaacgccucccagaaggucgcccgccucuccgacaagaccggccccgucgcccaggagaaguccuga

SEQ ID NO: 46020 - RNA, 1680 nt, Artificial Sequence
  derived and/or modified sequence opt2 from MLLT1__Homo_sapiens__NP_005925
auggacaaccagugcaccguccagguccgccucgagcucggccaccgcgcccagcuccgcaagaagcccaccaccgagggcuucacccacgacuggauggucuucguccgcggccccgagcagugcgacauccagcacuucgucgagaaggucgucuucuggcuccacgacuccuuccccaagccccgccgcgucugcaaggagccccccuacaaggucgaggaguccggcuacgccggcuucaucaugcccaucgagguccacuucaagaacaaggaggagccccgcaaggucugcuucaccuacgaccucuuccucaaccucgagggcaacccccccgucaaccaccuccgcugcgagaagcucaccuucaacaaccccaccaccgaguuccgcuacaagcuccuccgcgccggcggcgucauggucaugcccgagggcgccgacaccgucucccgccccucccccgacuaccccaugcuccccaccaucccccucuccgccuucuccgaccccaagaagaccaagcccucccacggcuccaaggacgccaacaaggaguccuccaagaccuccaagccccacaaggucaccaaggagcaccgcgagcgcccccgcaaggacuccgaguccaaguccuccuccaaggagcucgagcgcgagcaggccaaguccuccaaggacaccucccgcaagcucggcgagggccgccuccccaaggaggagaaggcccccccccccaaggccgccuucaaggagcccaagauggcccucaaggagaccaagcucgaguccaccucccccaagggcggcccccccccccccccccccccccccccccgcgccuccuccaagcgccccgccaccgccgacucccccaagcccuccgccaagaagcagaagaaguccuccuccaagggcucccgcuccgcccccggcaccuccccccgcaccuccuccuccuccuccuucuccgacaagaagcccgccaaggacaaguccuccacccgcggcgagaaggucaaggccgaguccgagccccgcgaggccaagaaggcccucgaggucgaggaguccaacuccgaggacgaggccuccuucaaguccgaguccgcccaguccucccccuccaacuccuccuccuccuccgacuccuccuccgacuccgacuucgagcccucccagaaccacucccagggcccccuccgcuccauggucgaggaccuccaguccgaggaguccgacgaggacgacuccuccuccggcgaggaggccgccggcaagaccaaccccggccgcgacucccgccucuccuucuccgacuccgaguccgacaacuccgccgacuccucccuccccucccgcgagcccccccccccccagaagccccccccccccaacuccaaggucuccggccgccgcucccccgaguccugcuccaagcccgagaagauccucaagaagggcaccuacgacaaggccuacaccgacgagcucgucgagcuccaccgccgccucauggcccuccgcgagcgcaacguccuccagcagaucgucaaccucaucgaggagaccggccacuucaacgucaccaacaccaccuucgacuucgaccucuucucccucgacgagaccaccguccgcaagcuccaguccugccucgaggccgucgccaccuga

SEQ ID NO: 46021 - RNA, 1698 nt, Artificial Sequence
  derived and/or modified sequence opt2 from MLLT3__Homo_sapiens__NP_001273620
augugcgccguccaggucaagcucgagcucggccaccgcgcccagguccgcaagaagcccaccgucgagggcuucacccacgacuggauggucuucguccgcggccccgagcacuccaacauccagcacuucgucgagaaggucgucuuccaccuccacgaguccuucccccgccccaagcgcgucugcaaggacccccccuacaaggucgaggaguccggcuacgccggcuucauccuccccaucgaggucuacuucaagaacaaggaggagccccgcaagguccgcuucgacuacgaccucuuccuccaccucgagggccacccccccgucaaccaccuccgcugcgagaagcucaccuucaacaaccccaccgaggacuuccgccgcaagcuccucaaggccggcggcgaccccaaccgcuccauccacaccuccuccuccuccuccuccuccuccuccuccuccuccuccuccuccuccuccuccuccuccuccuccuccuccuccuccuccuccuccuccuccuccuccuccuccuccuccuccuccuccuccuccaccuccuucuccaagccccacaagcucaugaaggagcacaaggagaagcccuccaaggacucccgcgagcacaaguccgccuucaaggagcccucccgcgaccacaacaaguccuccaaggaguccuccaagaagcccaaggagaacaagccccucaaggaggagaagaucguccccaagauggccuucaaggagcccaagcccauguccaaggagcccaagcccgacuccaaccuccucaccaucaccuccggccaggacaagaaggcccccuccaagcgcccccccaucuccgacuccgaggagcucuccgccaagaagcgcaagaaguccuccuccgaggcccucuucaaguccuucuccuccgcccccccccucauccucaccugcuccgccgacaagaagcagaucaaggacaagucccacgucaagaugggcaaggucaagaucgaguccgagaccuccgagaagaagaaguccacccucccccccuucgacgacaucgucgaccccaacgacuccgacgucgaggagaacaucuccuccaaguccgacuccgagcagcccucccccgccuccuccuccuccuccuccuccuccuccuucacccccucccagacccgccagcagggcccccuccgcuccaucaugaaggaccuccacuccgacgacaacgaggaggaguccgacgaggucgaggacaacgacaacgacuccgagauggagcgccccgucaaccgcggcggcucccgcucccgccgcgucucccucuccgacggcuccgacuccgaguccuccuccgccuccuccccccuccaccacgagcccccccccccccuccucaagaccaacaacaaccagauccucgaggucaagucccccaucaagcaguccaaguccgacaagcagaucaagaacggcgagugcgacaaggccuaccucgacgagcucgucgagcuccaccgccgccucaugacccuccgcgagcgccacauccuccagcagaucgucaaccucaucgaggagaccggccacuuccacaucaccaacaccaccuucgacuucgaccucugcucccucgacaagaccaccguccgcaagcuccaguccuaccucgagaccuccggcaccuccuga

SEQ ID NO: 46022 - RNA, 4956 nt, Artificial Sequence
  derived and/or modified sequence opt2 from MLLT4__Homo_sapiens__NP_001035089
auguccgccggcggccgcgacgaggagcgccgcaagcucgccgacaucauccaccacuggaacgccaaccgccucgaccucuucgagaucucccagcccaccgaggaccucgaguuccacggcgucaugcgcuucuacuuccaggacaaggccgccggcaacuucgccaccaagugcauccgcgucuccuccaccgccaccacccaggacgucaucgagacccucgccgagaaguuccgccccgacaugcgcaugcucuccucccccaaguacucccucuacgagguccacgucuccggcgagcgccgccucgacaucgacgagaagccccucgucguccagcucaacuggaacaaggacgaccgcgagggccgcuucguccucaagaacgagaacgacgccaucccccccaagaaggcccaguccaacggccccgagaagcaggagaaggagggcgucauccagaacuucaagcgcacccucuccaagaaggagaagaaggagaagaagaagcgcgagaaggaggcccuccgccaggccuccgacaaggacgaccgccccuuccagggcgaggacgucgagaacucccgccucgccgccgaggucuacaaggacaugcccgagaccuccuucacccgcaccaucuccaaccccgaggucgucaugaagcgccgccgccagcagaagcucgagaagcgcaugcaggaguuccgcuccuccgacggccgccccgacuccggcggcacccuccgcaucuacgccgacucccucaagcccaacauccccuacaagaccauccuccucuccaccaccgaccccgccgacuucgccgucgccgaggcccucgagaaguacggccucgagaaggagaaccccaaggacuacugcaucgcccgcgucaugcucccccccggcgcccagcacuccgacgagaagggcgccaaggagaucauccucgacgacgacgagugcccccuccagaucuuccgcgaguggcccuccgacaagggcauccucgucuuccagcucaagcgccgcccccccgaccacauccccaagaagaccaagaagcaccucgagggcaagacccccaagggcaaggagcgcgccgacggcuccggcuacggcuccacccucccccccgagaagcuccccuaccucgucgagcucucccccggccgccgcaaccacuucgccuacuacaacuaccacaccuacgaggacggcuccgacucccgcgacaagcccaagcucuaccgccuccagcucuccgucaccgaggucggcaccgagaagcucgacgacaacuccauccagcucuucggccccggcauccagccccaccacugcgaccucaccaacauggacggcgucgucaccgucaccccccgcuccauggacgccgagaccuacgucgagggccagcgcaucuccgagaccaccaugcuccaguccggcaugaagguccaguucggcgccucccacgucuucaaguucgucgaccccucccaggaccacgcccucgccaagcgcuccgucgacggcggccucauggucaagggcccccgccacaagcccggcaucguccaggagaccaccuucgaccucggcggcgacauccacuccggcaccgcccuccccaccuccaaguccaccacccgccucgacuccgaccgcgucuccuccgccuccuccaccgccgagcgcggcauggucaagcccaugauccgcgucgagcagcagcccgacuaccgccgccaggagucccgcacccaggacgccuccggccccgagcucauccuccccgccuccaucgaguuccgcgaguccuccgaggacuccuuccucuccgccaucaucaacuacaccaacuccuccaccguccacuucaagcucucccccaccuacguccucuacauggccugccgcuacguccucuccaaccaguaccgccccgacaucucccccaccgagcgcacccacaaggucaucgccgucgucaacaagauggucuccaugauggagggcgucauccagaagcagaagaacaucgccggcgcccucgccuucuggauggccaacgccuccgagcuccucaacuucaucaagcaggaccgcgaccucucccgcaucacccucgacgcccaggacguccucgcccaccucguccagauggccuucaaguaccucguccacugccuccaguccgagcucaacaacuacaugcccgccuuccucgacgaccccgaggagaacucccuccagcgccccaagaucgacgacguccuccacacccucaccggcgccaugucccuccuccgccgcugccgcgucaacgccgcccucaccauccagcucuucucccagcucuuccacuucaucaacauguggcucuucaaccgccucgucaccgaccccgacuccggccucugcucccacuacuggggcgccaucauccgccagcagcucggccacaucgaggccugggccgagaagcagggccucgagcucgccgccgacugccaccucucccgcaucguccaggccaccacccuccucaccauggacaaguacgcccccgacgacauccccaacaucaacuccaccugcuucaagcucaacucccuccagcuccaggcccuccuccagaacuaccacugcgcccccgacgagcccuucauccccaccgaccucaucgagaacgucgucaccgucgccgagaacaccgccgacgagcucgcccgcuccgacggccgcgagguccagcucgaggaggaccccgaccuccagcuccccuuccuccuccccgaggacggcuacuccugcgacgucguccgcaacauccccaacggccuccaggaguuccucgacccccucugccagcgcggcuucugccgccucaucccccacacccgcucccccggcaccuggaccaucuacuucgagggcgccgacuacgagucccaccuccuccgcgagaacaccgagcucgcccagccccuccgcaaggagcccgagaucaucaccgucacccucaagaagcagaacggcaugggccucuccaucgucgccgccaagggcgccggccaggacaagcucggcaucuacgucaaguccgucgucaagggcggcgccgccgacgucgacggccgccucgccgccggcgaccagcuccucuccgucgacggccgcucccucgucggccucucccaggagcgcgccgccgagcucaugacccgcaccuccuccgucgucacccucgaggucgccaagcagggcgccaucuaccacggccucgccacccuccucaaccagcccucccccaugaugcagcgcaucuccgaccgccgcggcuccggcaagccccgccccaaguccgagggcuucgagcucuacaacaacuccacccagaacggcucccccgaguccccccagcuccccugggccgaguacuccgagcccaagaagcuccccggcgacgaccgccucaugaagaaccgcgccgaccaccgcuccucccccaacgucgccaaccagccccccucccccggcggcaaguccgccuacgccuccggcaccaccgccaagaucaccuccgucuccaccggcaaccucugcaccgaggagcagaccccccccccccgccccgaggccuaccccauccccacccagaccuacacccgcgaguacuucaccuuccccgccuccaagucccaggaccgcauggcccccccccagaaccaguggcccaacuacgaggagaagccccacaugcacaccgacuccaaccacuccuccaucgccauccagcgcgucacccgcucccaggaggagcuccgcgaggacaaggccuaccagcucgagcgccaccgcaucgaggccgccauggaccgcaaguccgacuccgacauguggaucaaccaguccuccucccucgacuccuccaccuccucccaggagcaccucaaccacuccuccaaguccgucacccccgccuccacccucaccaaguccggccccggccgcuggaagacccccgccgccauccccgccacccccgucgccgucucccagcccauccgcaccgaccucccccccccccccccccccccccccguccacuacgccggcgacuucgacggcauguccauggaccucccccucccccccccccccuccgccaaccagaucggccuccccuccgcccaggucgccgccgccgagcgccgcaagcgcgaggagcaccagcgcugguacgagaaggagaaggcccgccucgaggaggagcgcgagcgcaagcgccgcgagcaggagcgcaagcucggccagaugcgcacccagucccucaaccccgcccccuucuccccccucaccgcccagcagaugaagcccgagaagcccuccacccuccagcgcccccaggagaccgucauccgcgagcuccagccccagcagcagccccgcaccaucgagcgccgcgaccuccaguacaucaccgucuccaaggaggagcucuccuccggcgacucccucucccccgaccccuggaagcgcgacgccaaggagaagcucgagaagcagcagcagaugcacaucgucgacaugcucuccaaggagauccaggagcuccaguccaagcccgaccgcuccgccgaggaguccgaccgccuccgcaagcucaugcucgaguggcaguuccagaagcgccuccaggaguccaagcagaaggacgaggacgacgaggaggaggaggacgacgacgucgacaccaugcucaucaugcagcgccucgaggccgagcgccgcgcccgcgacgaggagcgccgccgccagcagcagcucgaggagaugcgcaagcgcgaggccgaggaccgcgcccgccaggaggaggagcgccgccgccaggaggaggagcgcaccaagcgcgacgccgaggagaaggucaugguccucuga

SEQ ID NO: 46023 - RNA, 3282 nt, Artificial Sequence
  derived and/or modified sequence opt2 from MLLT6__Homo_sapiens__NP_005928
augaaggagauggucggcggcugcugcgucugcuccgacgagcgcggcugggccgagaacccccucgucuacugcgacggccacgccugcuccgucgccguccaccaggccugcuacggcaucguccagguccccaccggccccugguucugccgcaagugcgagucccaggagcgcgccgcccgcguccgcugcgagcucugcccccacaaggacggcgcccucaagcgcaccgacaacggcggcugggcccacgucgucugcgcccucuacauccccgagguccaguucgccaacguccucaccauggagcccaucguccuccaguacgucccccacgaccgcuucaacaagaccugcuacaucugcgaggagcagggccgcgaguccaaggccgccuccggcgccugcaugaccugcaaccgccacggcugccgccaggccuuccacgucaccugcgcccagauggccggccuccucugcgaggaggagguccucgaggucgacaacgucaaguacugcggcuacugcaaguaccacuucuccaagaugaagaccucccgccacuccuccggcggcggcggcggcggcgccggcggcggcggcggcuccaugggcggcggcggcuccggcuucaucuccggccgccgcucccgcuccgccucccccuccacccagcaggagaagcaccccacccaccacgagcgcggccagaagaagucccgcaaggacaaggagcgccucaagcagaagcacaagaagcgccccgaguccccccccuccauccucaccccccccgucguccccaccgccgacaaggucuccuccuccgccuccuccuccucccaccacgaggccuccacccaggagaccuccgaguccucccgcgaguccaagggcaagaaguccuccucccacucccucucccacaagggcaagaagcucuccuccggcaagggcgucuccuccuucaccuccgccuccuccuccuccuccuccuccuccuccuccuccggcggccccuuccagcccgccgucuccucccuccaguccucccccgacuucuccgccuuccccaagcucgagcagcccgaggaggacaaguacuccaagcccaccgcccccgcccccuccgccccccccucccccuccgcccccgagccccccaaggccgaccucuucgagcagaaggucgucuucuccggcuucggccccaucaugcgcuucuccaccaccaccuccuccuccggccgcgcccgcgcccccucccccggcgacuacaaguccccccacgucaccggcuccggcgccuccgccggcacccacaagcgcaugcccgcccucuccgccacccccguccccgccgacgagacccccgagaccggccucaaggagaagaagcacaaggccuccaagcgcucccgccacggccccggccgccccaagggcucccgcaacaaggagggcaccggcggccccgccgcccccucccuccccuccgcccagcucgccggcuucaccgccaccgccgccucccccuucuccggcggcucccucgucuccuccggccucggcggccucuccucccgcaccuucggccccuccggcucccuccccucccucucccucgaguccccccuccucggcgccggcaucuacaccuccaacaaggaccccaucucccacuccggcggcaugcuccgcgccgucugcuccaccccccucuccuccucccuccucggcccccccggcaccuccgcccucccccgccucucccgcucccccuucaccuccacccuccccuccuccuccgccuccaucuccaccacccaggucuucucccucgccggcuccaccuucucccuccccuccacccacaucuucggcacccccaugggcgccgucaacccccuccucucccaggccgaguccucccacaccgagcccgaccucgaggacugcuccuuccgcugccgcggcaccuccccccaggagucccucuccuccaugucccccaucuccucccuccccgcccucuucgaccagaccgccuccgcccccugcggcggcggccagcucgaccccgccgcccccggcaccaccaacauggagcagcuccucgagaagcagggcgacggcgaggccggcgucaacaucgucgagaugcucaaggcccuccacgcccuccagaaggagaaccagcgccuccaggagcagauccucucccucaccgccaagaaggagcgccuccagauccucaacguccagcucuccguccccuuccccgcccuccccgccgcccuccccgccgccaacggccccguccccggccccuacggccuccccccccaggccggcuccuccgacucccucuccaccuccaaguccccccccggcaaguccucccucggccucgacaacucccucuccaccuccuccgaggacccccacuccggcugccccucccgcuccuccuccucccucuccuuccacuccaccccccccccccucccccuccuccagcagucccccgccacccucccccucgcccuccccggcgcccccgccccccuccccccccagccccagaacggccucggccgcgcccccggcgccgccggccucggcgccaugcccauggccgagggccuccucggcggccucgccggcuccggcggccucccccucaacggccuccucggcggccucaacggcgccgccgcccccaaccccgccucccucucccaggccggcggcgcccccacccuccagcuccccggcugccucaacucccucaccgagcagcagcgccaccuccuccagcagcaggagcagcagcuccagcagcuccagcagcuccucgccuccccccagcucacccccgagcaccagaccgucgucuaccagaugauccagcagauccagcagaagcgcgagcuccagcgccuccagauggccggcggcucccagcuccccauggccucccuccucgccggcuccuccaccccccuccucuccgccggcacccccggccuccuccccaccgccuccgcccccccccuccuccccgccggcgcccucgucgcccccucccucggcaacaacaccucccucauggccgccgccgccgccgccgccgccgucgccgccgccggcggcccccccguccucaccgcccagaccaaccccuuccucucccucuccggcgccgagggcuccggcggcggccccaagggcggcaccgccgacaagggcgccuccgccaaccaggagaagggcuga

SEQ ID NO: 46024 - RNA, 345 nt, Artificial Sequence
  derived and/or modified sequence opt2 from MLN__Homo_sapiens__NP_001035198
auggucucccgcaaggccgucgccgcccuccucgucguccacgucgccgccaugcucgccucccagaccgaggccuucguccccaucuucaccuacggcgagcuccagcgcaugcaggagaaggagcgcaacaagggccagaagaagucccucuccgucuggcagcgcuccggcgaggagggccccgucgaccccgccgagcccauccgcgaggaggagaacgagaugaucaagcucaccgccccccucgagaucggcaugcgcaugaacucccgccagcucgagaaguaccccgccacccucgagggccuccucuccgagaugcucccccagcacgccaaguga

SEQ ID NO: 46025 - RNA, 1239 nt, Artificial Sequence
  derived and/or modified sequence opt2 from MLNR__Homo_sapiens__NP_001498
augggcucccccuggaacggcuccgacggccccgagggcgcccgcgagccccccuggcccgcccucccccccugcgacgagcgccgcugcucccccuucccccucggcgcccucguccccgucaccgccgucugccucugccucuucgucgucggcgucuccggcaacgucgucaccgucaugcucaucggccgcuaccgcgacaugcgcaccaccaccaaccucuaccucggcuccauggccgucuccgaccuccucauccuccucggccuccccuucgaccucuaccgccucuggcgcucccgccccugggucuucggcccccuccucugccgccucucccucuacgucggcgagggcugcaccuacgccacccuccuccacaugaccgcccucuccgucgagcgcuaccucgccaucugccgcccccuccgcgcccgcguccucgucacccgccgccgcguccgcgcccucaucgccguccucugggccgucgcccuccucuccgccggccccuuccucuuccucgucggcgucgagcaggaccccggcaucuccgucguccccggccucaacggcaccgcccgcaucgccuccuccccccucgccuccucccccccccucuggcucucccgcgcccccccccccuccccccccuccggccccgagaccgccgaggccgccgcccucuucucccgcgagugccgccccucccccgcccagcucggcgcccuccgcgucaugcucugggucaccaccgccuacuucuuccuccccuuccucugccucuccauccucuacggccucaucggccgcgagcucugguccucccgccgcccccuccgcggccccgccgccuccggccgcgagcgcggccaccgccagaccguccgcguccuccucgucgucguccucgccuucaucaucugcuggcuccccuuccacgucggccgcaucaucuacaucaacaccgaggacucccgcaugauguacuucucccaguacuucaacaucgucgcccuccagcucuucuaccucuccgccuccaucaaccccauccucuacaaccucaucuccaagaaguaccgcgccgccgccuucaagcuccuccucgcccgcaagucccgcccccgcggcuuccaccgcucccgcgacaccgccggcgaggucgccggcgacaccggcggcgacaccgucggcuacaccgagaccuccgccaacgucaagaccaugggcuga

SEQ ID NO: 46026 - RNA, 1719 nt, Artificial Sequence
  derived and/or modified sequence opt2 from MLPH__Homo_sapiens__NP_001035932
augggcaagaagcucgaccucuccaagcucaccgacgaggaggcccagcacguccucgaggucguccagcgcgacuucgaccuccgccgcaaggaggaggagcgccucgaggcccucaagggcaagaucaagaaggaguccuccaagcgcgagcuccucuccgacaccgcccaccucaacgagacccacugcgcccgcugccuccagcccuaccagcuccucgucaacuccaagcgccagugccucgagugcggccucuucaccugcaaguccugcggccgcguccaccccgaggagcagggcuggaucugcgaccccugccaccucgcccgcgucgucaagaucggcucccucgagugguacuacgagcacgucaaggcccgcuucaagcgcuucggcuccgccaaggucauccgcucccuccacggccgccuccagggcggcgccggccccgagcucaucuccgaggagcgcuccggcgacuccgaccagaccgacgaggacggcgagcccggcuccgaggcccaggcccaggcccagcccuucggcuccaagaagaagcgccuccucuccguccacgacuucgacuucgagggcgacuccgacgacuccacccagccccagggccacucccuccaccucuccuccguccccgaggcccgcgacuccccccagucccucaccgacgaguccugcuccgagaaggccgccccccacaaggccgagggccucgaggaggccgacaccggcgccuccggcugccacucccaccccgaggagcagcccaccuccaucucccccucccgccacggcgcccucgccgagcucugcccccccggcggcucccaccgcauggcccucggcaccgccgccgcccucggcuccaacgucauccgcaacgagcagcucccccuccaguaccucgccgacgucgacaccuccgacgaggaguccauccgcgcccacgucauggccucccaccacuccaagcgccgcggccgcgccuccuccgagucccagggccucggcgccggcguccgcaccgaggccgacgucgaggaggaggcccuccgccgcaagcucgaggagcucaccuccaacgucuccgaccaggagaccuccuccgaggaggaggaggccaaggacgagaaggccgagcccaaccgcgacaaguccgucggcccccucccccaggccgaccccgaggucggcaccgccgcccaccagaccaaccgccaggagaaguccccccaggaccccggcgaccccguccaguacaaccgcaccaccgacgaggagcucuccgagcucgaggaccgcgucgccgucaccgccuccgagguccagcaggccgaguccgaggucuccgacaucgagucccgcaucgccgcccuccgcgccgccggccucaccgucaagcccuccggcaagccccgccgcaaguccaaccuccccaucuuccucccccgcgucgccggcaagcucggcaagcgccccgaggaccccaacgccgaccccuccuccgaggccaaggccauggccguccccuaccuccuccgccgcaaguucuccaacucccucaagucccagggcaaggacgacgacuccuucgaccgcaaguccgucuaccgcggcucccucacccagcgcaaccccaacgcccgcaagggcauggccucccacaccuucgccaagcccgucgucgcccaccaguccuga

SEQ ID NO: 46027 - RNA, 981 nt, Artificial Sequence
  derived and/or modified sequence opt2 from MLST8__Homo_sapiens__NP_001186102
augaacaccucccccggcaccgucggcuccgaccccgucauccucgccaccgccggcuacgaccacaccguccgcuucuggcaggcccacuccggcaucugcacccgcaccguccagcaccaggacucccaggucaacgcccucgaggucacccccgaccgcuccaugaucgccgccgccggcuaccagcacauccgcauguacgaccucaacuccaacaaccccaaccccaucaucuccuacgacggcgucaacaagaacaucgccuccgucggcuuccacgaggacggccgcuggauguacaccggcggcgaggacugcaccgcccgcaucugggaccuccgcucccgcaaccuccagugccagcgcaucuuccaggucaacgcccccaucaacugcgucugccuccaccccaaccaggccgagcucaucgucggcgaccaguccggcgccauccacaucugggaccucaagaccgaccacaacgagcagcucauccccgagcccgaggucuccaucaccuccgcccacaucgaccccgacgccuccuacauggccgccgucaacuccaccggcaacugcuacgucuggaaccucaccggcggcaucggcgacgaggucacccagcucauccccaagaccaagauccccgcccacacccgcuacgcccuccagugccgcuucucccccgacuccacccuccucgccaccugcuccgccgaccagaccugcaagaucuggcgcaccuccaacuucucccucaugaccgagcucuccaucaaguccggcaaccccggcgaguccucccgcggcuggauguggggcugcgccuucuccggcgacucccaguacaucgucaccgccuccuccgacaaccucgcccgccucuggugcgucgagaccggcgagaucaagcgcgaguacggcggccaccagaaggccgucgucugccucgccuucaacgacuccguccucggcuga

SEQ ID NO: 46028 - RNA, 897 nt, Artificial Sequence
  derived and/or modified sequence opt2 from MLX__Homo_sapiens__NP_733752
augaccgagcccggcgccucccccgaggaccccugggucaaggccucccccgucggcgcccacgccggcgagggccgcgccggccgcgcccgcgcccgccgcggcgccggccgccgcggcgccucccuccucucccccaagucccccacccucuccgucccccgcggcugccgcgaggacuccucccaccccgccugcgccaaggucgaguacgccuacuccgacaacucccucgaccccggccucuucgucgaguccacccgcaagggcuccgucgucucccgcgccaacuccaucggcuccaccuccgccuccuccguccccaacaccgacgacgaggacuccgacuaccaccaggaggccuacaaggaguccuacaaggaccgccgccgccgcgcccacacccaggccgagcagaagcgccgcgacgccaucaagcgcggcuacgacgaccuccagaccaucguccccaccugccagcagcaggacuucuccaucggcucccagaagcucuccaaggccaucguccuccagaagaccaucgacuacauccaguuccuccacaaggagaagaagaagcaggaggaggaggucuccacccuccgcaaggacgucaccgcccucaagaucaugaaggucaacuacgagcagaucgucaaggcccaccaggacaacccccacgagggcgaggaccaggucuccgaccaggucaaguucaacgucuuccagggcaucauggacucccucuuccaguccuucaacgccuccaucuccgucgccuccuuccaggagcucuccgccugcgucuucuccuggaucgaggagcacugcaagccccagacccuccgcgagaucgucaucggcguccuccaccagcucaagaaccagcucuacuga

SEQ ID NO: 46029 - RNA, 2760 nt, Artificial Sequence
  derived and/or modified sequence opt2 from MLXIP__Homo_sapiens__NP_055753
auggccgccgacgucuucaugugcuccccccgccgcccccgcucccgcggccgccagguccuccucaagccccaggucuccgaggacgacgacgacuccgacaccgacgagcccucccccccccccgccuccggcgccgccacccccgcccgcgcccacgccuccgccgcccccccccccccccgcgccggccccggccgcgaggagcccccccgccgccagcagaucauccacuccggccacuucauggucuccuccccccaccgcgagcacccccccaagaagggcuacgacuucgacaccgucaacaagcagaccugccagaccuacuccuucggcaagaccuccuccugccaccucuccaucgacgccucccucaccaagcucuucgagugcaugacccucgccuacuccggcaagcucgucucccccaaguggaagaacuucaagggccucaagcuccaguggcgcgacaagauccgccucaacaacgccaucuggcgcgccugguacaugcaguaccucgagaagcgcaagaaccccgucugccacuucgucaccccccucgacggcuccgucgacgucgacgagcaccgccgccccgaggccaucaccaccgagggcaaguacuggaagucccgcaucgagaucgucauccgcgaguaccacaaguggcgcaccuacuucaagaagcgccuccagcagcacaaggacgaggaccucuccucccucguccaggacgacgacaugcucuacuggcacaagcacggcgacggcuggaagacccccguccccauggaggaggacccccuccucgacaccgacaugcucauguccgaguucuccgacacccucuucuccacccucuccucccaccagcccgucgccuggcccaacccccgcgagaucgcccaccucggcaacgccgacaugauccagcccggccucaucccccuccagcccaaccucgacuucauggacaccuucgagcccuuccaggaccucuucuccuccucccgcuccaucuucggcuccaugcuccccgccuccgccuccgcccccguccccgaccccaacaacccccccgcccaggaguccauccuccccaccaccgcccuccccaccgucucccuccccgacucccucaucgccccccccaccgcccccucccucgcccacauggacgagcagggcugcgagcacaccucccgcaccgaggaccccuucauccagcccaccgacuucggccccuccgagcccccccucuccgucccccagcccuuccuccccgucuucaccaugccccuccucucccccucccccgcccccccccccaucucccccguccucccccucguccccccccccgccaccgcccucaacccccccgccccccccaccuuccaccagccccagaaguucgccggcgucaacaaggcccccuccgucaucacccacaccgccuccgccacccucacccacgacgcccccgccaccaccuucucccagucccagggccucgucaucaccacccaccaccccgcccccuccgccgcccccugcggccucgcccucucccccgucacccgccccccccagccccgccucaccuucguccaccccaagcccgucucccucaccggcggccgccccaagcagccccacaagaucguccccgcccccaagcccgagcccgucucccucguccucaagaacgcccgcaucgcccccgccgccuucuccggccagccccaggccgucaucaugaccuccggcccccucaagcgcgagggcaugcucgccuccaccgucucccaguccaacgucgucaucgcccccgccgccaucgcccgcgcccccggcguccccgaguuccacuccuccauccucgucaccgaccucggccacggcaccuccuccccccccgcccccgucucccgccucuuccccuccaccgcccaggacccccucggcaagggcgagcaggucccccuccacggcggcuccccccaggucaccgucaccggccccucccgcgacugccccaacuccggccaggccucccccugcgccuccgagcagucccccuccccccaguccccccagaacaacugcuccggcaaguccgaccccaagaacgucgccgcccucaagaaccgccagaugaagcacaucuccgccgagcagaagcgccgcuucaacaucaagaugugcuucgacaugcucaacucccucaucuccaacaacuccaagcucaccucccacgccaucacccuccagaagaccgucgaguacaucaccaagcuccagcaggagcgcggccagaugcaggaggaggcccgccgccuccgcgaggagaucgaggagcucaacgccaccaucaucuccugccagcagcuccuccccgccaccggcguccccgucacccgccgccaguucgaccacaugaaggacauguucgacgaguacgucaagacccgcacccuccagaacuggaaguucuggaucuucuccaucaucaucaagccccucuucgaguccuucaagggcauggucuccaccuccucccucgaggagcuccaccgcaccgcccucuccuggcucgaccagcacugcucccuccccauccuccgccccaugguccucuccacccuccgccagcucuccaccuccaccuccauccucaccgaccccgcccagcuccccgagcaggccuccaaggccgucacccgcaucggcaagcgccucggcgaguccuga

SEQ ID NO: 46030 - RNA, 2559 nt, Artificial Sequence
  derived and/or modified sequence opt2 from MLXIPL__Homo_sapiens__NP_116569
auggccggcgcccucgccggccucgccgccggccuccaggucccccgcgucgcccccucccccgacuccgacuccgacaccgacuccgaggaccccucccuccgccgcuccgccggcggccuccuccgcucccaggucauccacuccggccacuucauggucuccuccccccacuccgacucccucccccgccgccgcgaccaggagggcuccgucggccccuccgacuucggcccccgcuccaucgaccccacccucacccgccucuucgagugccucucccucgccuacuccggcaagcucgucucccccaaguggaagaacuucaagggccucaagcuccucugccgcgacaagauccgccucaacaacgccaucuggcgcgccugguacauccaguacgucaagcgccgcaagucccccgucugcggcuucgucaccccccuccagggccccgaggccgacgcccaccgcaagcccgaggccgucguccucgagggcaacuacuggaagcgccgcaucgaggucgucaugcgcgaguaccacaaguggcgcaucuacuacaagaagcgccuccgcaagcccucccgcgaggacgaccuccucgcccccaagcaggccgagggccgcuggcccccccccgagcaguggugcaagcagcucuucuccuccgucguccccguccuccucggcgaccccgaggaggagcccggcggccgccagcuccucgaccucaacugcuuccucuccgacaucuccgacacccucuucaccaugacccaguccggccccuccccccuccagcucccccccgaggacgccuacgucggcaacgccgacaugauccagcccgaccucaccccccuccagcccucccucgacgacuucauggacaucuccgacuucuucaccaacucccgccucccccagccccccaugcccuccaacuuccccgagccccccuccuucucccccgucgucgacucccucuucuccuccggcacccucggccccgaggucccccccgccuccuccgccaugacccaccucuccggccacucccgccuccaggcccgcaacuccugccccggcccccucgacuccuccgccuuccucuccuccgacuuccuccuccccgaggaccccaagccccgccucccccccccccccgucccccccccccuccuccacuaccccccccccgccaagguccccggccucgagcccugcccccccccccccuucccccccauggccccccccaccgcccuccuccaggaggagccccucuucuccccccgcuuccccuuccccaccgucccccccgcccccggcgucuccccccuccccgcccccgccgccuucccccccaccccccaguccguccccucccccgcccccacccccuuccccaucgagcuccucccccucggcuacuccgagcccgccuucggccccugcuucuccaugccccgcggcaagccccccgcccccuccccccgcggccagaaggccuccccccccacccucgcccccgccaccgccuccccccccaccaccgccggcuccaacaaccccugccucacccagcuccucaccgccgccaagcccgagcaggcccucgagcccccccucgucuccuccacccuccuccgcucccccggcuccccccaggagaccguccccgaguuccccugcaccuuccucccccccacccccgcccccacccccccccgccccccccccggccccgccacccucgcccccucccgcccccuccucguccccaaggccgagcgccucuccccccccgcccccuccggcuccgagcgccgccucuccggcgaccucuccuccaugcccggccccggcacccucuccguccgcgucucccccccccagcccauccucucccgcggccgccccgacuccaacaagaccgagaaccgccgcaucacccacaucuccgccgagcagaagcgccgcuucaacaucaagcucggcuucgacacccuccacggccucgucuccacccucuccgcccagcccucccucaaggucuccaaggccaccacccuccagaagaccgccgaguacauccucaugcuccagcaggagcgcgccggccuccaggaggaggcccagcagcuccgcgacgagaucgaggagcucaacgccgccaucaaccucugccagcagcagcuccccgccaccggcguccccaucacccaccagcgcuucgaccagaugcgcgacauguucgacgacuacguccgcacccgcacccuccacaacuggaaguucugggucuucuccauccucauccgcccccucuucgaguccuucaacggcauggucuccaccgccuccguccacacccuccgccagaccucccucgccuggcucgaccaguacugcucccuccccgcccuccgccccaccguccucaacucccuccgccagcucggcaccuccaccuccauccucaccgaccccggccgcauccccgagcaggccacccgcgccgucaccgagggcacccucggcaagccccucuga

SEQ ID NO: 46031 - RNA, 1482 nt, Artificial Sequence
  derived and/or modified sequence opt2 from MLYCD__Homo_sapiens__NP_036345
augcgcggcuucggccccggccucaccgcccgccgccuccucccccuccgccuccccccccgcccccccggcccccgccucgccuccggccaggccgccggcgcccucgagcgcgccauggacgagcuccuccgccgcgccgucccccccacccccgccuacgagcuccgcgagaagacccccgcccccgccgagggccagugcgccgacuucgucuccuucuacggcggccucgccgagaccgcccagcgcgccgagcuccucggccgccucgcccgcggcuucggcgucgaccacggccaggucgccgagcaguccgccggcguccuccaccuccgccagcagcagcgcgaggccgccguccuccuccaggccgaggaccgccuccgcuacgcccucgucccccgcuaccgcggccucuuccaccacaucuccaagcucgacggcggcguccgcuuccucguccagcuccgcgccgaccuccucgaggcccaggcccucaagcucgucgagggccccgacguccgcgagaugaacggcguccucaagggcaugcucuccgagugguucuccuccggcuuccucaaccucgagcgcgucaccuggcacucccccugcgagguccuccagaagaucuccgaggccgaggccguccaccccgucaagaacuggauggacaugaagcgccgcgucggccccuaccgccgcugcuacuucuucucccacugcuccacccccggcgagccccucgucguccuccacgucgcccucaccggcgacaucuccuccaacauccaggccaucgucaaggagcacccccccuccgagaccgaggagaagaacaagaucaccgccgccaucuucuacuccaucucccucacccagcagggccuccagggcgucgagcucggcaccuuccucaucaagcgcgucgucaaggagcuccagcgcgaguucccccaccucggcgucuucuccucccucucccccauccccggcuucaccaaguggcuccucggccuccucaacucccagaccaaggagcacggccgcaacgagcucuucaccgacuccgagugcaaggagaucuccgagaucaccggcggccccaucaacgagacccucaagcuccuccucuccuccuccgaguggguccaguccgagaagcucguccgcgcccuccagaccccccucaugcgccucugcgccugguaccucuacggcgagaagcaccgcggcuacgcccucaaccccgucgccaacuuccaccuccagaacggcgccguccucuggcgcaucaacuggauggccgacgucucccuccgcggcaucaccggcuccugcggccucauggccaacuaccgcuacuuccucgaggagaccggccccaacuccaccuccuaccucggcuccaagaucaucaaggccuccgagcagguccucucccucgucgcccaguuccagaagaacuccaagcucuga

SEQ ID NO: 46032 - RNA, 1257 nt, Artificial Sequence
  derived and/or modified sequence opt2 from MMAA__Homo_sapiens__NP_758454
augcccaugcuccucccccacccccaccagcacuuccucaagggccuccuccgcgcccccuuccgcugcuaccacuucaucuuccacuccuccacccaccucggcuccggcauccccugcgcccagcccuucaacucccucggccuccacugcaccaaguggaugcuccucuccgacggccucaagcgcaagcucugcguccagaccacccucaaggaccacaccgagggccucuccgacaaggagcagcgcuucgucgacaagcucuacaccggccucauccagggccagcgcgccugccucgccgaggccaucacccucgucgaguccacccacucccgcaagaaggagcucgcccagguccuccuccagaagguccuccucuaccaccgcgagcaggagcaguccaacaagggcaagccccucgccuuccgcgucggccucuccggcccccccggcgccggcaaguccaccuucaucgaguacuucggcaagaugcucaccgagcgcggccacaagcucuccguccucgccgucgaccccuccuccugcaccuccggcggcucccuccucggcgacaagacccgcaugaccgagcucucccgcgacaugaacgccuacauccgccccucccccacccgcggcacccucggcggcgucacccgcaccaccaacgaggccauccuccucugcgagggcgccggcuacgacaucauccucaucgagaccgucggcgucggccaguccgaguucgccgucgccgacauggucgacauguucguccuccuccucccccccgccggcggcgacgagcuccagggcaucaagcgcggcaucaucgagauggccgaccucgucgccgucaccaaguccgacggcgaccucaucguccccgcccgccgcauccaggccgaguacgucuccgcccucaagcuccuccgcaagcgcucccaggucuggaagcccaaggucauccgcaucuccgcccgcuccggcgagggcaucuccgagaugugggacaagaugaaggacuuccaggaccucaugcucgccuccggcgagcucaccgccaagcgccgcaagcagcagaaggucuggauguggaaccucauccaggaguccguccucgagcacuuccgcacccaccccaccguccgcgagcagaucccccuccucgagcagaagguccucaucggcgcccucucccccggccucgccgccgacuuccuccucaaggccuucaagucccgcgacuga

SEQ ID NO: 46033 - RNA, 753 nt, Artificial Sequence
  derived and/or modified sequence opt2 from MMAB__Homo_sapiens__NP_443077
auggccgucugcggccucggcucccgccucggccucggcucccgccucggccuccgcggcugcuucggcgccgcccgccuccucuacccccgcuuccagucccgcggcccccagggcgucgaggacggcgaccgcccccagcccuccuccaagaccccccgcauccccaagaucuacaccaagaccggcgacaagggcuucuccuccaccuucaccggcgagcgccgccccaaggacgaccaggucuucgaggccgucggcaccaccgacgagcucuccuccgccaucggcuucgcccucgagcucgucaccgagaagggccacaccuucgccgaggagcuccagaagauccagugcacccuccaggacgucggcuccgcccucgccacccccugcuccuccgcccgcgaggcccaccucaaguacaccaccuucaaggccggccccauccucgagcucgagcaguggaucgacaaguacaccucccagcuccccccccucaccgccuucauccuccccuccggcggcaagaucuccuccgcccuccacuucugccgcgccgucugccgccgcgccgagcgccgcgucgucccccucguccagaugggcgagaccgacgccaacgucgccaaguuccucaaccgccucuccgacuaccucuucacccucgcccgcuacgccgccaugaaggagggcaaccaggagaagaucuacaugaagaacgaccccuccgccgaguccgagggccucuga

SEQ ID NO: 46034 - RNA, 891 nt, Artificial Sequence
  derived and/or modified sequence opt2 from MMADHC__Homo_sapiens__NP_056517
auggccaacguccucugcaaccgcgcccgccucgucuccuaccuccccggcuucugcucccucgucaagcgcgucgucaaccccaaggccuucuccaccgccggcuccuccggcuccgacgagucccacgucgccgccgccccccccgacaucugcucccgcaccgucuggcccgacgagaccaugggccccuucggcccccaggaccagcgcuuccagcuccccggcaacaucggcuucgacugccaccucaacggcaccgccucccagaagaagucccucguccacaagacccuccccgacguccucgccgagccccucuccuccgagcgccacgaguucgucauggcccaguacgucaacgaguuccagggcaacgacgcccccgucgagcaggagaucaacuccgccgagaccuacuucgaguccgcccgcgucgagugcgccauccagaccugccccgagcuccuccgcaaggacuucgagucccucuuccccgaggucgccaacggcaagcucaugauccucaccgucacccagaagaccaagaacgacaugaccgucugguccgaggaggucgagaucgagcgcgagguccuccucgagaaguucaucaacggcgccaaggagaucugcuacgcccuccgcgccgagggcuacugggccgacuucaucgaccccuccuccggccucgccuucuucggccccuacaccaacaacacccucuucgagaccgacgagcgcuaccgccaccucggcuucuccgucgacgaccucggcugcugcaaggucauccgccacucccucuggggcacccacgucgucgucggcuccaucuucaccaacgccacccccgacucccacaucaugaagaagcucuccggcaacuga

SEQ ID NO: 46035 - RNA, 813 nt, Artificial Sequence
  derived and/or modified sequence opt2 from MMD2__Homo_sapiens__NP_001094070
auguucgccccccgccuccucgacuuccagaagaccaaguacgcccgcuucaugaaccaccgcguccccgcccacaagcgcuaccagcccaccgaguacgagcacgccgccaacugcgccacccacgccuucuggaucauccccuccauccucggcuccuccaaccucuacuuccucuccgacgacgacugggagaccaucuccgccuggaucuacggccucggccucugcggccucuucgucgucuccaccgucuuccacaccaucuccuggaagaagucccaccuccgcauggucgagcacugccuccacauguucgaccgcauggucaucuacuucuucaucgccgccuccuacgcccccuggcucaaccuccgcgagcucggccccugggccucccacaugcgcuggcucgucuggaucauggccuccgucggcaccaucuacgucuucuucuuccacgagcgcaccggcuccugcguccaguuccuccgcggcgaggccugccccaaggccggcaccgccugccuccccgcccgcuacaagcucgucgagcuccucugcuacgucgucaugggcuucuuccccgcccucgucauccucuccaugcccaacaccgagggcaucugggagcucgucaccggcggcgucuucuacugccucggcauggucuucuucaaguccgacggccgcauccccuucgcccacgccaucuggcaccucuucgucgccuucggcgccggcacccacuacuacgccaucuggcgcuaccucuaccuccccuccacccuccagaccaaggucuccaaguga

SEQ ID NO: 46036 - RNA, 717 nt, Artificial Sequence
  derived and/or modified sequence opt2 from MMD__Homo_sapiens__NP_036461
augcgcuucaagaaccgcuuccagcgcuucaugaaccaccgcgcccccgccaacggccgcuacaagcccaccugcuacgagcacgccgccaacugcuacacccacgccuuccucaucguccccgccaucgucggcuccgcccuccuccaccgccucuccgacgacugcugggagaagaucaccgccuggaucuacggcaugggccucugcgcccucuucaucgucuccaccgucuuccacaucgucuccuggaagaagucccaccuccgcaccgucgagcacugcuuccacaugugcgaccgcauggucaucuacuucuucaucgccgccuccuacgcccccuggcucaaccuccgcgagcucggcccccucgccucccacaugcgcugguucaucuggcucauggccgccggcggcaccaucuacgucuuccucuaccacgagaaguacaaggucgucgagcucuucuucuaccucaccaugggcuucucccccgcccucgucgucaccuccaugaacaacaccgacggccuccaggagcucgccugcggcggccucaucuacugccucggcgucgucuucuucaaguccgacggcaucauccccuucgcccacgccaucuggcaccucuucgucgccaccgccgccgccguccacuacuacgccaucuggaaguaccucuaccgcucccccaccgacuucaugcgccaccucuga

SEQ ID NO: 46037 - RNA, 2253 nt, Artificial Sequence
  derived and/or modified sequence opt2 from MME__Homo_sapiens__XP_011511160
augggcaaguccgagucccagauggacaucaccgacaucaacacccccaagcccaagaagaagcagcgcuggaccccccucgagaucucccucuccguccucguccuccuccucaccaucaucgccgucaccaugaucgcccucuacgccaccuacgacgacggcaucugcaaguccuccgacugcaucaaguccgccgcccgccucauccagaacauggacgccaccaccgagcccugcaccgacuucuucaaguacgccugcggcggcuggcucaagcgcaacgucauccccgagaccuccucccgcuacggcaacuucgacauccuccgcgacgagcucgaggucguccucaaggacguccuccaggagcccaagaccgaggacaucgucgccguccagaaggccaaggcccucuaccgcuccugcaucaacgaguccgccaucgacucccgcggcggcgagccccuccucaagcuccuccccgacaucuacggcuggcccgucgccaccgagaacugggagcagaaguacggcgccuccuggaccgccgagaaggccaucgcccagcucaacuccaaguacggcaagaagguccucaucaaccucuucgucggcaccgacgacaagaacuccgucaaccacgucauccacaucgaccagccccgccucggccuccccucccgcgacuacuacgagugcaccggcaucuacaaggaggccugcaccgccuacgucgacuucaugaucuccgucgcccgccucauccgccaggaggagcgccuccccaucgacgagaaccagcucgcccucgagaugaacaaggucauggagcucgagaaggagaucgccaacgccaccgccaagcccgaggaccgcaacgaccccaugcuccucuacaacaagaugacccucgcccagauccagaacaacuucucccucgagaucaacggcaagcccuucuccuggcucaacuucaccaacgagaucauguccaccgucaacaucuccaucaccaacgaggaggacgucgucgucuacgcccccgaguaccucaccaagcucaagcccauccucaccaaguacuccgcccgcgaccuccagaaccucauguccuggcgcuucaucauggaccucgucuccucccucucccgcaccuacaaggagucccgcaacgccuuccgcaaggcccucuacggcaccaccuccgagaccgccaccuggcgccgcugcgccaacuacgucaacggcaacauggagaacgccgucggccgccucuacgucgaggccgccuucgccggcgaguccaagcacgucgucgaggaccucaucgcccagauccgcgaggucuucauccagacccucgacgaccucaccuggauggacgccgagaccaagaagcgcgccgaggagaaggcccucgccaucaaggagcgcaucggcuaccccgacgacaucgucuccaacgacaacaagcucaacaacgaguaccucgagcucaacuacaaggaggacgaguacuucgagaacaucauccagaaccucaaguucucccaguccaagcagcucaagaagcuccgcgagaaggucgacaaggacgaguggaucuccggcgccgccgucgucaacgccuucuacuccuccggccgcaaccagaucgucuuccccgccggcauccuccagccccccuucuucuccgcccagcaguccaacucccucaacuacggcggcaucggcauggucaucggccacgagaucacccacggcuucgacgacaacggccgcaacuucaacaaggacggcgaccucgucgacugguggacccagcaguccgccuccaacuucaaggagcagucccagugcauggucuaccaguacggcaacuucuccugggaccucgccggcggccagcaccucaacggcaucaacacccucggcgagaacaucgccgacaacggcggccucggccaggccuaccgcgccuaccagaacuacaucaagaagaacggcgaggagaagcuccuccccggccucgaccucaaccacaagcagcucuucuuccucaacuucgcccaggucuggugcggcaccuaccgccccgaguacgccgucaacuccaucaagaccgacguccacucccccggcaacuuccgcaucaucggcacccuccagaacuccgccgaguucuccgaggccuuccacugccgcaagaacuccuacaugaaccccgagaagaagugccgcgucugguga

SEQ ID NO: 46038 - RNA, 1206 nt, Artificial Sequence
  derived and/or modified sequence opt2 from MMEL1__Homo_sapiens__XP_011540425
augggcaaguccgagggccccgucggcauggucgaguccgccggccgcgccggccagaagcgccccggcuuccucgagggcggccuccuccuccuccuccuccucgucaccgccgcccucgucgcccucggcguccucuacgccgaccgccgcggcaagcagcucccccgccucgccucccgccucugcuuccuccaggaggagcgcaccuucgucaagcgcaagccccgcggcauccccgaggcccaggaggucuccgaggucugcaccacccccggcugcgucaucgccgccgcccgcauccuccagaacauggaccccaccaccgagcccugcgacgacuucuaccaguucgccugcggcggcuggcuccgccgccacgucauccccgagaccaacucccgcuacuccaucuucgacguccuccgcgacgagcucgaggucauccucaaggccguccucgagaacuccaccgccaaggaccgccccgccgucgagaaggcccgcacccucuaccgcuccugcaugaaccaguccgucaucgagaagcgcggcucccagccccuccucgacauccucgaggucgucggcggcuggcccgucgccauggaccgcuggaacgagaccgucggccucgagugggagcucgagcgccagcucgcccucaugaacucccaguucaaccgccgcguccucaucgaccucuucaucuggaacgacgaccagaacuccucccgccacaucaucuacguccgcgccgcccccgucggccgcgaccgccccgcccaccucggccacgcccucccccgcguccuccuccagcgccgccagcagcccgaggagaacucccucggcgccauggucgccgaggccacccagcucugccccgccuccuucggccccggcgccggcucccuccccgccguccacggcgucuccggccacgucgccgccggcggcugcaagcccgcccagggccagcuccccggcgccggcggccacggcgccggcgccggcgccggcgacaccgccggccagggccacggcacccccggcggcgagacccgccgccaccgccucgucccccccgacggcaccggcggcgccgccaagcccgucuggcccgagggcuccggcgccggcgagggccagaaguccggcgucaccuccaagaccugccagaaggcccgcaagggcgccggcuga

SEQ ID NO: 46039 - RNA, 1431 nt, Artificial Sequence
  derived and/or modified sequence opt2 from MMP10__Homo_sapiens__NP_002416
augaugcaccucgccuuccucguccuccucugccuccccgucugcuccgccuacccccucuccggcgccgccaaggaggaggacuccaacaaggaccucgcccagcaguaccucgagaaguacuacaaccucgagaaggacgucaagcaguuccgccgcaaggacuccaaccucaucgucaagaagauccagggcaugcagaaguuccucggccucgaggucaccggcaagcucgacaccgacacccucgaggucaugcgcaagccccgcugcggcguccccgacgucggccacuucuccuccuuccccggcaugcccaaguggcgcaagacccaccucaccuaccgcaucgucaacuacacccccgaccucccccgcgacgccgucgacuccgccaucgagaaggcccucaaggucugggaggaggucaccccccucaccuucucccgccucuacgagggcgaggccgacaucaugaucuccuucgccgucaaggagcacggcgacuucuacuccuucgacggccccggccacucccucgcccacgccuacccccccggccccggccucuacggcgacauccacuucgacgacgacgagaaguggaccgaggacgccuccggcaccaaccucuuccucgucgccgcccacgagcucggccacucccucggccucuuccacuccgccaacaccgaggcccucauguacccccucuacaacuccuucaccgagcucgcccaguuccgccucucccaggacgacgucaacggcauccagucccucuacggccccccccccgccuccaccgaggagccccucguccccaccaaguccguccccuccggcuccgagaugcccgccaagugcgaccccgcccucuccuucgacgccaucuccacccuccgcggcgaguaccucuucuucaaggaccgcuacuucuggcgccgcucccacuggaaccccgagcccgaguuccaccucaucuccgccuucuggcccucccuccccuccuaccucgacgccgccuacgaggucaacucccgcgacaccgucuucaucuucaagggcaacgaguucugggccauccgcggcaacgagguccaggccggcuacccccgcggcauccacacccucggcuucccccccaccauccgcaagaucgacgccgccgucuccgacaaggagaagaagaagaccuacuucuucgccgccgacaaguacuggcgcuucgacgagaacucccaguccauggagcagggcuucccccgccucaucgccgacgacuuccccggcgucgagcccaaggucgacgccguccuccaggccuucggcuucuucuacuucuucuccggcuccucccaguucgaguucgaccccaacgcccgcauggucacccacauccucaaguccaacuccuggcuccacugcuga

SEQ ID NO: 46040 - RNA, 1467 nt, Artificial Sequence
  derived and/or modified sequence opt2 from MMP11__Homo_sapiens__NP_005931
auggcccccgccgccuggcuccgcuccgccgccgcccgcgcccuccucccccccaugcuccuccuccuccuccagccccccccccuccucgcccgcgcccucccccccgacgcccaccaccuccacgccgagcgccgcggcccccagcccuggcacgccgcccuccccuccucccccgcccccgcccccgccacccaggaggccccccgccccgccuccucccuccgccccccccgcugcggcguccccgaccccuccgacggccucuccgcccgcaaccgccagaagcgcuucguccucuccggcggccgcugggagaagaccgaccucaccuaccgcauccuccgcuuccccuggcagcucguccaggagcagguccgccagaccauggccgaggcccucaaggucugguccgacgucaccccccucaccuucaccgagguccacgagggccgcgccgacaucaugaucgacuucgcccgcuacuggcacggcgacgaccuccccuucgacggccccggcggcauccucgcccacgccuucuuccccaagacccaccgcgagggcgacguccacuucgacuacgacgagaccuggaccaucggcgacgaccagggcaccgaccuccuccaggucgccgcccacgaguucggccacguccucggccuccagcacaccaccgccgccaaggcccucauguccgccuucuacaccuuccgcuacccccucucccucucccccgacgacugccgcggcguccagcaccucuacggccagcccuggcccaccgucaccucccgcacccccgcccucggcccccaggccggcaucgacaccaacgagaucgccccccucgagcccgacgccccccccgacgccugcgaggccuccuucgacgccgucuccaccauccgcggcgagcucuucuucuucaaggccggcuucgucuggcgccuccgcggcggccagcuccagcccggcuaccccgcccucgccucccgccacuggcagggccuccccucccccgucgacgccgccuucgaggacgcccagggccacaucugguucuuccagggcgcccaguacugggucuacgacggcgagaagcccguccucggccccgccccccucaccgagcucggccucguccgcuuccccguccacgccgcccucgucuggggccccgagaagaacaagaucuacuucuuccgcggccgcgacuacuggcgcuuccaccccuccacccgccgcgucgacucccccgucccccgccgcgccaccgacuggcgcggcguccccuccgagaucgacgccgccuuccaggacgccgacggcuacgccuacuuccuccgcggccgccucuacuggaaguucgaccccgucaaggucaaggcccucgagggcuucccccgccucgucggccccgacuucuucggcugcgccgagcccgccaacaccuuccucuga

SEQ ID NO: 46041 - RNA, 1413 nt, Artificial Sequence
  derived and/or modified sequence opt2 from MMP12__Homo_sapiens__NP_002417
augaaguuccuccucauccuccuccuccaggccaccgccuccggcgcccucccccucaacuccuccaccucccucgagaagaacaacguccucuucggcgagcgcuaccucgagaaguucuacggccucgagaucaacaagcuccccgucaccaagaugaaguacuccggcaaccucaugaaggagaagauccaggagaugcagcacuuccucggccucaaggucaccggccagcucgacaccuccacccucgagaugaugcacgccccccgcugcggcguccccgacguccaccacuuccgcgagaugcccggcggccccgucuggcgcaagcacuacaucaccuaccgcaucaacaacuacacccccgacaugaaccgcgaggacgucgacuacgccauccgcaaggccuuccaggucugguccaacgucaccccccucaaguucuccaagaucaacaccggcauggccgacauccucgucgucuucgcccgcggcgcccacggcgacuuccacgccuucgacggcaagggcggcauccucgcccacgccuucggccccggcuccggcaucggcggcgacgcccacuucgacgaggacgaguucuggaccacccacuccggcggcaccaaccucuuccucaccgccguccacgagaucggccacucccucggccucggccacuccuccgaccccaaggccgucauguuccccaccuacaaguacgucgacaucaacaccuuccgccucuccgccgacgacauccgcggcauccagucccucuacggcgaccccaaggagaaccagcgccuccccaaccccgacaacuccgagcccgcccucugcgaccccaaccucuccuucgacgccgucaccaccgucggcaacaagaucuucuucuucaaggaccgcuucuucuggcucaaggucuccgagcgccccaagaccuccgucaaccucaucuccucccucuggcccacccuccccuccggcaucgaggccgccuacgagaucgaggcccgcaaccaggucuuccucuucaaggacgacaaguacuggcucaucuccaaccuccgccccgagcccaacuaccccaaguccauccacuccuucggcuuccccaacuucgucaagaagaucgacgccgccgucuucaacccccgcuucuaccgcaccuacuucuucgucgacaaccaguacuggcgcuacgacgagcgccgccagaugauggaccccggcuaccccaagcucaucaccaagaacuuccagggcaucggccccaagaucgacgccgucuucuacuccaagaacaaguacuacuacuucuuccagggcuccaaccaguucgaguacgacuuccuccuccagcgcaucaccaagacccucaaguccaacuccugguucggcugcuga

SEQ ID NO: 46042 - RNA, 1416 nt, Artificial Sequence
  derived and/or modified sequence opt2 from MMP13__Homo_sapiens__NP_002418
augcaccccggcguccucgccgccuuccucuuccucuccuggacccacugccgcgcccucccccuccccuccggcggcgacgaggacgaccucuccgaggaggaccuccaguucgccgagcgcuaccuccgcuccuacuaccaccccaccaaccucgccggcauccucaaggagaacgccgccuccuccaugaccgagcgccuccgcgagaugcaguccuucuucggccucgaggucaccggcaagcucgacgacaacacccucgacgucaugaagaagccccgcugcggcguccccgacgucggcgaguacaacgucuucccccgcacccucaagugguccaagaugaaccucaccuaccgcaucgucaacuacacccccgacaugacccacuccgaggucgagaaggccuucaagaaggccuucaaggucugguccgacgucaccccccucaacuucacccgccuccacgacggcaucgccgacaucaugaucuccuucggcaucaaggagcacggcgacuucuaccccuucgacggccccuccggccuccucgcccacgccuucccccccggccccaacuacggcggcgacgcccacuucgacgacgacgagaccuggaccuccuccuccaagggcuacaaccucuuccucgucgccgcccacgaguucggccacucccucggccucgaccacuccaaggaccccggcgcccucauguuccccaucuacaccuacaccggcaagucccacuucaugcuccccgacgacgacguccagggcauccagucccucuacggccccggcgacgaggaccccaaccccaagcaccccaagacccccgacaagugcgaccccucccucucccucgacgccaucaccucccuccgcggcgagaccaugaucuucaaggaccgcuucuucuggcgccuccacccccagcaggucgacgccgagcucuuccucaccaaguccuucuggcccgagcuccccaaccgcaucgacgccgccuacgagcaccccucccacgaccucaucuucaucuuccgcggccgcaaguucugggcccucaacggcuacgacauccucgagggcuaccccaagaagaucuccgagcucggccuccccaaggaggucaagaagaucuccgccgccguccacuucgaggacaccggcaagacccuccucuucuccggcaaccaggucuggcgcuacgacgacaccaaccacaucauggacaaggacuacccccgccucaucgaggaggacuuccccggcaucggcgacaaggucgacgccgucuacgagaagaacggcuacaucuacuucuucaacggccccauccaguucgaguacuccaucugguccaaccgcaucguccgcgucaugcccgccaacuccauccucuggugcuga

SEQ ID NO: 46043 - RNA, 1749 nt, Artificial Sequence
  derived and/or modified sequence opt2 from MMP14__Homo_sapiens__NP_004986
augucccccgccccccgccccccccgcugccuccuccucccccuccucacccucggcaccgcccucgccucccucggcuccgcccaguccuccuccuucucccccgaggccuggcuccagcaguacggcuaccucccccccggcgaccuccgcacccacacccagcgcuccccccagucccucuccgccgccaucgccgccaugcagaaguucuacggccuccaggucaccggcaaggccgacgccgacaccaugaaggccaugcgccgcccccgcugcggcguccccgacaaguucggcgccgagaucaaggccaacguccgccgcaagcgcuacgccauccagggccucaaguggcagcacaacgagaucaccuucugcauccagaacuacacccccaaggucggcgaguacgccaccuacgaggccauccgcaaggccuuccgcgucugggaguccgccaccccccuccgcuuccgcgagguccccuacgccuacauccgcgagggccacgagaagcaggccgacaucaugaucuucuucgccgagggcuuccacggcgacuccacccccuucgacggcgagggcggcuuccucgcccacgccuacuuccccggccccaacaucggcggcgacacccacuucgacuccgccgagcccuggaccguccgcaacgaggaccucaacggcaacgacaucuuccucgucgccguccacgagcucggccacgcccucggccucgagcacuccuccgaccccuccgccaucauggcccccuucuaccaguggauggacaccgagaacuucguccuccccgacgacgaccgccgcggcauccagcagcucuacggcggcgaguccggcuuccccaccaagaugcccccccagccccgcaccaccucccgccccuccguccccgacaagcccaagaaccccaccuacggccccaacaucugcgacggcaacuucgacaccgucgccaugcuccgcggcgagauguucgucuucaaggagcgcugguucuggcgcguccgcaacaaccaggucauggacggcuaccccaugcccaucggccaguucuggcgcggccuccccgccuccaucaacaccgccuacgagcgcaaggacggcaaguucgucuucuucaagggcgacaagcacugggucuucgacgaggccucccucgagcccggcuaccccaagcacaucaaggagcucggccgcggccuccccaccgacaagaucgacgccgcccucuucuggaugcccaacggcaagaccuacuucuuccgcggcaacaaguacuaccgcuucaacgaggagcuccgcgccgucgacuccgaguaccccaagaacaucaaggucugggagggcauccccgaguccccccgcggcuccuucaugggcuccgacgaggucuucaccuacuucuacaagggcaacaaguacuggaaguucaacaaccagaagcucaaggucgagcccggcuaccccaaguccgcccuccgcgacuggaugggcugccccuccggcggccgccccgacgagggcaccgaggaggagaccgaggucaucaucaucgaggucgacgaggagggcggcggcgccgucuccgccgccgccgucguccuccccguccuccuccuccuccucguccucgccgucggccucgccgucuucuucuuccgccgccacggcaccccccgccgccuccucuacugccagcgcucccuccucgacaaggucuga

SEQ ID NO: 46044 - RNA, 2010 nt, Artificial Sequence
  derived and/or modified sequence opt2 from MMP15__Homo_sapiens__NP_002419
augggcuccgaccccuccgcccccggccgccccggcuggaccggcucccuccucggcgaccgcgaggaggccgcccgcccccgccuccucccccuccuccucguccuccucggcugccucggccucggcgucgccgccgaggacgccgagguccacgccgagaacuggcuccgccucuacggcuaccucccccagcccucccgccacauguccaccaugcgcuccgcccagauccucgccuccgcccucgccgagaugcagcgcuucuacggcauccccgucaccggcguccucgacgaggagaccaaggaguggaugaagcgcccccgcugcggcguccccgaccaguucggcguccgcgucaaggccaaccuccgccgccgccgcaagcgcuacgcccucaccggccgcaaguggaacaaccaccaccucaccuucuccauccagaacuacaccgagaagcucggcugguaccacuccauggaggccguccgccgcgccuuccgcgucugggagcaggccaccccccucgucuuccaggagguccccuacgaggacauccgccuccgccgccagaaggaggccgacaucaugguccucuucgccuccggcuuccacggcgacuccucccccuucgacggcaccggcggcuuccucgcccacgccuacuuccccggccccggccucggcggcgacacccacuucgacgccgacgagcccuggaccuucuccuccaccgaccuccacggcaacaaccucuuccucgucgccguccacgagcucggccacgcccucggccucgagcacuccuccaaccccaacgccaucauggcccccuucuaccaguggaaggacgucgacaacuucaagcuccccgaggacgaccuccgcggcauccagcagcucuacggcacccccgacggccagccccagcccacccagccccuccccaccgucaccccccgccgccccggccgccccgaccaccgccccccccgccccccccagccccccccccccggcggcaagcccgagcgcccccccaagcccggcccccccguccagccccgcgccaccgagcgccccgaccaguacggccccaacaucugcgacggcgacuucgacaccgucgccaugcuccgcggcgagauguucgucuucaagggccgcugguucuggcgcguccgccacaaccgcguccucgacaacuaccccaugcccaucggccacuucuggcgcggccuccccggcgacaucuccgccgccuacgagcgccaggacggccgcuucgucuucuucaagggcgaccgcuacuggcucuuccgcgaggccaaccucgagcccggcuacccccagccccucaccuccuacggccucggcauccccuacgaccgcaucgacaccgccaucuggugggagcccaccggccacaccuucuucuuccaggaggaccgcuacuggcgcuucaacgaggagacccagcgcggcgaccccggcuaccccaagcccaucuccgucuggcagggcauccccgccucccccaagggcgccuuccucuccaacgacgccgccuacaccuacuucuacaagggcaccaaguacuggaaguucgacaacgagcgccuccgcauggagcccggcuaccccaaguccauccuccgcgacuucaugggcugccaggagcacgucgagcccggcccccgcuggcccgacgucgcccgcccccccuucaacccccacggcggcgccgagcccggcgccgacuccgccgagggcgacgucggcgacggcgacggcgacuucggcgccggcgucaacaaggacggcggcucccgcgucgucguccagauggaggaggucgcccgcaccgucaacgucgucaugguccucgucccccuccuccuccuccucugcguccucggccucaccuacgcccucguccagaugcagcgcaagggcgccccccgcguccuccucuacugcaagcgcucccuccaggagugggucuga

SEQ ID NO: 46045 - RNA, 1824 nt, Artificial Sequence
  derived and/or modified sequence opt2 from MMP16__Homo_sapiens__NP_005932
augauccuccucaccuucuccaccggccgccgccucgacuucguccaccacuccggcgucuucuuccuccagacccuccucuggauccucugcgccaccgucugcggcaccgagcaguacuucaacgucgaggucuggcuccagaaguacggcuaccucccccccaccgacccccgcauguccguccuccgcuccgccgagaccaugcaguccgcccucgccgccaugcagcaguucuacggcaucaacaugaccggcaaggucgaccgcaacaccaucgacuggaugaagaagccccgcugcggcguccccgaccagacccgcggcuccuccaaguuccacauccgccgcaagcgcuacgcccucaccggccagaaguggcagcacaagcacaucaccuacuccaucaagaacgucacccccaaggucggcgaccccgagacccgcaaggccauccgccgcgccuucgacgucuggcagaacgucaccccccucaccuucgaggagguccccuacuccgagcucgagaacggcaagcgcgacgucgacaucaccaucaucuucgccuccggcuuccacggcgacuccucccccuucgacggcgagggcggcuuccucgcccacgccuacuuccccggccccggcaucggcggcgacacccacuucgacuccgacgagcccuggacccucggcaaccccaaccacgacggcaacgaccucuuccucgucgccguccacgagcucggccacgcccucggccucgagcacuccaacgaccccaccgccaucauggcccccuucuaccaguacauggagaccgacaacuucaagcuccccaacgacgaccuccagggcauccagaagaucuacggcccccccgacaagauccccccccccacccgcccccuccccaccguccccccccaccgcuccaucccccccgccgacccccgcaagaacgaccgccccaagcccccccgcccccccaccggccgccccuccuaccccggcgccaagcccaacaucugcgacggcaacuucaacacccucgccauccuccgccgcgagauguucgucuucaaggaccagugguucuggcgcguccgcaacaaccgcgucauggacggcuaccccaugcagaucaccuacuucuggcgcggccucccccccuccaucgacgccgucuacgagaacuccgacggcaacuucgucuucuucaagggcaacaaguacugggucuucaaggacaccacccuccagcccggcuacccccacgaccucaucacccucggcuccggcauccccccccacggcaucgacuccgccaucuggugggaggacgucggcaagaccuacuucuucaagggcgaccgcuacuggcgcuacuccgaggagaugaagaccauggaccccggcuaccccaagcccaucaccgucuggaagggcauccccgaguccccccagggcgccuucguccacaaggagaacggcuucaccuacuucuacaagggcaaggaguacuggaaguucaacaaccagauccucaaggucgagcccggcuacccccgcuccauccucaaggacuucaugggcugcgacggccccaccgaccgcgucaaggagggccacuccccccccgacgacgucgacaucgucaucaagcucgacaacaccgccuccaccgucaaggccaucgccaucgucauccccugcauccucgcccucugccuccucguccucgucuacaccgucuuccaguucaagcgcaagggcaccccccgccacauccucuacugcaagcgcuccaugcaggagugggucuga

SEQ ID NO: 46046 - RNA, 1812 nt, Artificial Sequence
  derived and/or modified sequence opt2 from MMP17__Homo_sapiens__NP_057239
augcgccgccgcgccgcccgcggccccggcccccccccccccggccccggccucucccgccucccccucccccuccuccuccuccucgcccucggcacccgcggcggcugcgccgcccccgcccccgccccccgcgccgaggaccucucccucggcgucgaguggcucucccgcuucggcuaccucccccccgccgaccccaccaccggccagcuccagacccaggaggagcucuccaaggccaucaccgccaugcagcaguucggcggccucgaggccaccggcauccucgacgaggccacccucgcccucaugaagaccccccgcugcucccuccccgaccuccccguccucacccaggcccgccgccgccgccaggcccccgcccccaccaaguggaacaagcgcaaccucuccuggcgcguccgcaccuucccccgcgacuccccccucggccacgacaccguccgcgcccucauguacuacgcccucaaggucugguccgacaucgccccccucaacuuccacgaggucgccggcuccgccgccgacauccagaucgacuucuccaaggccgaccacaacgacggcuaccccuucgacggccccggcggcaccgucgcccacgccuucuuccccggccaccaccacaccgccggcgacacccacuucgacgacgacgaggccuggaccuuccgcuccuccgacgcccacggcauggaccucuucgccgucgccguccacgaguucggccacgccaucggccucucccacgucgccgccgcccacuccaucaugcgccccuacuaccagggccccgucggcgacccccuccgcuacggccuccccuacgaggacaagguccgcgucuggcagcucuacggcguccgcgaguccgucucccccaccgcccagcccgaggagcccccccuccuccccgagccccccgacaaccgcuccuccgcccccccccgcaaggacgucccccaccgcugcuccacccacuucgacgccgucgcccagauccgcggcgaggccuucuucuucaagggcaaguacuucuggcgccucacccgcgaccgccaccucgucucccuccagcccgcccagaugcaccgcuucuggcgcggccucccccuccaccucgacuccgucgacgccgucuacgagcgcaccuccgaccacaagaucgucuucuucaagggcgaccgcuacugggucuucaaggacaacaacgucgaggagggcuacccccgccccgucuccgacuucucccucccccccggcggcaucgacgccgccuucuccugggcccacaacgaccgcaccuacuucuucaaggaccagcucuacuggcgcuacgacgaccacacccgccacauggaccccggcuaccccgcccaguccccccucuggcgcggcguccccuccacccucgacgacgccaugcgcugguccgacggcgccuccuacuucuuccgcggccaggaguacuggaagguccucgacggcgagcucgaggucgcccccggcuacccccaguccaccgcccgcgacuggcucgucugcggcgacucccaggccgacggcuccgucgccgccggcgucgacgccgccgagggcccccgcgccccccccggccagcacgaccagucccgcuccgaggacggcuacgaggucugcuccugcaccuccggcgccuccuccccccccggcgcccccggcccccucgucgccgccaccaugcuccuccuccuccccccccucucccccggcgcccucuggaccgccgcccaggcccucacccucuga

SEQ ID NO: 46047 - RNA, 918 nt, Artificial Sequence
  derived and/or modified sequence opt2 from MMP19__Homo_sapiens__NP_001259030
augaacugccagcagcucuggcucggcuuccuccuccccaugaccgucuccggccgcguccucggccucgccgaggucgcccccgucgacuaccucucccaguacggcuaccuccagaagccccucgagggcuccaacaacuucaagcccgaggacaucaccgaggcccuccgcgccuuccaggaggccuccgagcuccccgucuccggccagcucgacgacgccacccgcgcccgcaugcgccagccccgcugcggccucgaggaccccuucaaccagaagacccucaaguaccuccuccucggccgcuggcgcaagaagcaccucaccuuccgcauccucaaccuccccuccacccuccccccccacaccgcccgcgccgcccuccgccaggccuuccaggacugguccaacgucgccccccucaccuuccaggagguccaggccggcgccgccgacauccgccucuccuuccacggccgccaguccuccuacugcuccaacaccuucgacggccccggcaagaagucccccgucauccgcgacgaggaggaggaggagaccgagcuccccaccgucccccccguccccaccgagcccucccccaugcccgaccccugcuccuccgagcucgacgccaugaugcucggcgaggcccccccccuccaggccgucggccgccgcuggggccagcccgccgaccccgaggccuggaccaacggcuccgacaugggccuccagcacgagcaguggcgcgcccccugggaggaccucugcuuccagggcggccucugcgucgacugcauccgcuuccgcaccggcccccucguccccuccgucugcccccucggcggcgccccccgcaagcccggcugcugcugccuccucgccuccaacaccauggacucccuccucuga

SEQ ID NO: 46048 - RNA, 1410 nt, Artificial Sequence
  derived and/or modified sequence opt2 from MMP1__Homo_sapiens__NP_002412
augcacuccuuccccccccuccuccuccuccucuucuggggcgucgucucccacuccuuccccgccacccucgagacccaggagcaggacgucgaccucguccagaaguaccucgagaaguacuacaaccucaagaacgacggccgccaggucgagaagcgccgcaacuccggccccgucgucgagaagcucaagcagaugcaggaguucuucggccucaaggucaccggcaagcccgacgccgagacccucaaggucaugaagcagccccgcugcggcguccccgacgucgcccaguucguccucaccgagggcaacccccgcugggagcagacccaccucaccuaccgcaucgagaacuacacccccgaccucccccgcgccgacgucgaccacgccaucgagaaggccuuccagcucugguccaacgucaccccccucaccuucaccaaggucuccgagggccaggccgacaucaugaucuccuucguccgcggcgaccaccgcgacaacucccccuucgacggccccggcggcaaccucgcccacgccuuccagcccggccccggcaucggcggcgacgcccacuucgacgaggacgagcgcuggaccaacaacuuccgcgaguacaaccuccaccgcgucgccgcccacgagcucggccacucccucggccucucccacuccaccgacaucggcgcccucauguaccccuccuacaccuucuccggcgacguccagcucgcccaggacgacaucgacggcauccaggccaucuacggccgcucccagaaccccguccagcccaucggcccccagacccccaaggccugcgacuccaagcucaccuucgacgccaucaccaccauccgcggcgaggucauguucuucaaggaccgcuucuacaugcgcaccaaccccuucuaccccgaggucgagcucaacuucaucuccgucuucuggccccagcuccccaacggccucgaggccgccuacgaguucgccgaccgcgacgagguccgcuucuucaagggcaacaaguacugggccguccagggccagaacguccuccacggcuaccccaaggacaucuacuccuccuucggcuucccccgcaccgucaagcacaucgacgccgcccucuccgaggagaacaccggcaagaccuacuucuucgucgccaacaaguacuggcgcuacgacgaguacaagcgcuccauggaccccggcuaccccaagaugaucgcccacgacuuccccggcaucggccacaaggucgacgccgucuucaugaaggacggcuucuucuacuucuuccacggcacccgccaguacaaguucgaccccaagaccaagcgcauccucacccuccagaaggccaacuccugguucaacugccgcaagaacuga

SEQ ID NO: 46049 - RNA, 1452 nt, Artificial Sequence
  derived and/or modified sequence opt2 from MMP20__Homo_sapiens__NP_004762
augaagguccuccccgccuccggccucgccgucuuccucaucauggcccucaaguucuccaccgccgcccccucccucgucgccgccuccccccgcaccuggcgcaacaacuaccgccucgcccaggccuaccucgacaaguacuacaccaacaaggagggccaccagaucggcgagauggucgcccgcggcuccaacuccaugauccgcaagaucaaggagcuccaggccuucuucggccuccaggucaccggcaagcucgaccagaccaccaugaacgucaucaagaagccccgcugcggcguccccgacgucgccaacuaccgccucuuccccggcgagcccaaguggaagaagaacacccucaccuaccgcaucuccaaguacacccccuccauguccuccgucgaggucgacaaggccgucgagauggcccuccaggccugguccuccgccgucccccucuccuucguccgcaucaacuccggcgaggccgacaucaugaucuccuucgagaacggcgaccacggcgacuccuaccccuucgacggcccccgcggcacccucgcccacgccuucgcccccggcgagggccucggcggcgacacccacuucgacaacgccgagaaguggaccaugggcaccaacggcuucaaccucuucaccgucgccgcccacgaguucggccacgcccucggccucgcccacuccaccgaccccuccgcccucauguaccccaccuacaaguacaagaaccccuacggcuuccaccuccccaaggacgacgucaagggcauccaggcccucuacggcccccgcaaggucuuccucggcaagcccacccucccccacgccccccaccacaagcccuccauccccgaccucugcgacuccuccuccuccuucgacgccgucaccaugcucggcaaggagcuccuccucuucaaggaccgcaucuucuggcgccgccagguccaccuccgcaccggcauccgccccuccaccaucaccuccuccuucccccagcucauguccaacgucgacgccgccuacgaggucgccgagcgcggcaccgccuacuucuucaagggcccccacuacuggaucacccgcggcuuccagaugcagggccccccccgcaccaucuacgacuucggcuucccccgccacguccagcagaucgacgccgccgucuaccuccgcgagccccagaagacccucuucuucgucggcgacgaguacuacuccuacgacgagcgcaagcgcaagauggagaaggacuaccccaagaacaccgaggaggaguucuccggcgucaacggccagaucgacgccgccgucgagcucaacggcuacaucuacuucuucuccggccccaagaccuacaaguacgacaccgagaaggaggacgucgucuccgucgucaaguccuccuccuggaucggcugcuga

SEQ ID NO: 46050 - RNA, 1710 nt, Artificial Sequence
  derived and/or modified sequence opt2 from MMP21__Homo_sapiens__XP_011537559
augcucgccgccuccaucuuccgccccacccuccuccucugcuggcucgccgcccccuggcccacccagcccgagucccucuuccacucccgcgaccgcuccgaccucgagcccuccccccuccgccaggccaagcccaucgccgaccuccacgccgcccagcgcuuccucucccgcuacggcugguccggcgucugggccgccuggggccccucccccgagggcccccccgagacccccaagggcgccgcccucgccgaggccguccgccgcuuccagcgcgccaacgcccuccccgccuccggcgagcucgacgccgccacccucgccgccaugaaccgcccccgcugcggcguccccgacaugcgcccccccccccccuccgccccccccuccccccccggcccccccccccgcgcccgcucccgccgcuccccccgcgccccccucucccucucccgccgcggcuggcagccccgcggcuaccccgacggcggcgccgcccaggccuucuccaagcgcacccucuccuggcgccuccucggcgaggcccucuccucccagcucuccgucgccgaccagcgccgcaucgucgcccucgccuuccgcaugugguccgaggucaccccccucgacuuccgcgaggaccucgccgcccccggcgccgccgucgacaucaagcucggcuucggccgcggccgccaccucggcugcccccgcgccuucgacggcuccggccaggaguucgcccacgccuggcgccucggcgacauccacuucgacgacgacgagcacuucaccccccccaccuccgacaccggcaucucccuccucaaggucgccguccacgagaucggccacguccucggccucccccacaccuaccgcaccggcuccaucaugcagcccaacuacaucccccaggagcccgccuucgagcucgacugguccgaccgcaaggccauccagaagcucuacggcuccugcgagggcuccuucgacaccgccuucgacuggauccgcaaggagcgcaaccaguacggcgaggucaugguccgcuucuccaccuacuucuuccgcaacuccugguacuggcucuacgagaaccgcaacaaccgcacccgcuacggcgaccccauccagauccucaccggcuggcccggcauccccacccacaacaucgacgccuucguccacaucuggaccuggaagcgcgacgagcgcuacuucuuccagggcaaccaguacuggcgcuacgacuccgacaaggaccaggcccucaccgaggacgagcagggcaaguccuaccccaagcucaucuccgagggcuuccccggcauccccuccccccucgacaccgccuucuacgaccgccgccagaagcucaucuacuucuucaaggagucccucgucuucgccuucgacgucaaccgcaaccgcguccucaacuccuaccccaagcgcaucaccgaggucuuccccgccgucaucccccagaaccaccccuuccgcaacaucgacuccgccuacuacuccuacgccuacaacuccaucuucuucuucaagggcaacgccuacuggaaggucgucaacgacaaggacaagcagcagaacuccuggcuccccgccaacggccucuuccccaagaaguucaucuccgagaagugguucgacgucugcgacguccacaucuccacccucaacauguga

SEQ ID NO: 46051 - RNA, 1938 nt, Artificial Sequence
  derived and/or modified sequence opt2 from MMP24__Homo_sapiens__NP_006681
augccccgcucccgcggcggccgcgccgcccccggcccccccccccccccccccccccccggccaggccccccgcuggucccgcuggcgcguccccggccgccuccuccuccuccuccuccccgcccucugcugccuccccggcgccgcccgcgccgccgccgccgccgccggcgccggcaaccgcgccgccgucgccgucgccgucgcccgcgccgacgaggccgaggcccccuucgccggccagaacuggcucaaguccuacggcuaccuccuccccuacgacucccgcgccuccgcccuccacuccgccaaggcccuccaguccgccgucuccaccaugcagcaguucuacggcauccccgucaccggcguccucgaccagaccaccaucgaguggaugaagaagccccgcugcggcguccccgaccacccccaccucucccgccgccgccgcaacaagcgcuacgcccucaccggccagaaguggcgccagaagcacaucaccuacuccauccacaacuacacccccaaggucggcgagcucgacacccgcaaggccauccgccaggccuucgacgucuggcagaaggucaccccccucaccuucgaggagguccccuaccacgagaucaaguccgaccgcaaggaggccgacaucaugaucuucuucgccuccggcuuccacggcgacuccucccccuucgacggcgagggcggcuuccucgcccacgccuacuuccccggccccggcaucggcggcgacacccacuucgacuccgacgagcccuggacccucggcaacgccaaccacgacggcaacgaccucuuccucgucgccguccacgagcucggccacgcccucggccucgagcacuccuccgaccccuccgccaucauggcccccuucuaccaguacauggagacccacaacuucaagcucccccaggacgaccuccagggcauccagaagaucuacggcccccccgccgagccccucgagcccacccgcccccuccccacccuccccguccgccgcauccacucccccuccgagcgcaagcacgagcgccagccccgccccccccgccccccccucggcgaccgccccuccacccccggcaccaagcccaacaucugcgacggcaacuucaacaccgucgcccucuuccgcggcgagauguucgucuucaaggaccgcugguucuggcgccuccgcaacaaccgcguccaggagggcuaccccaugcagaucgagcaguucuggaagggccuccccgcccgcaucgacgccgccuacgagcgcgccgacggccgcuucgucuucuucaagggcgacaaguacugggucuucaaggaggucaccgucgagcccggcuacccccacucccucggcgagcucggcuccugccucccccgcgagggcaucgacaccgcccuccgcugggagcccgucggcaagaccuacuucuucaagggcgagcgcuacuggcgcuacuccgaggagcgccgcgccaccgaccccggcuaccccaagcccaucaccgucuggaagggcaucccccaggccccccagggcgccuucaucuccaaggagggcuacuacaccuacuucuacaagggccgcgacuacuggaaguucgacaaccagaagcucuccgucgagcccggcuacccccgcaacauccuccgcgacuggaugggcugcaaccagaaggaggucgagcgccgcaaggagcgccgccucccccaggacgacgucgacaucauggucaccaucaacgacguccccggcuccgucaacgccgucgccgucgucauccccugcauccucucccucugcauccucguccucgucuacaccaucuuccaguucaagaacaagaccggcccccagcccgucaccuacuacaagcgccccguccaggagugggucuga

SEQ ID NO: 46052 - RNA, 1689 nt, Artificial Sequence
  derived and/or modified sequence opt2 from MMP25__Homo_sapiens__NP_071913
augcgccuccgccuccgccuccucgcccuccuccuccuccuccucgccccccccgcccgcgcccccaagcccuccgcccaggacgucucccucggcgucgacuggcucacccgcuacggcuaccucccccccccccaccccgcccaggcccagcuccagucccccgagaagcuccgcgacgccaucaaggucaugcagcgcuucgccggccuccccgagaccggccgcauggaccccggcaccgucgccaccaugcgcaagccccgcugcucccuccccgacguccucggcgucgccggccucguccgccgccgccgccgcuacgcccucuccggcuccgucuggaagaagcgcacccucaccuggcgcguccgcuccuucccccaguccucccagcucucccaggagaccguccgcguccucauguccuacgcccucauggccuggggcauggaguccggccucaccuuccacgaggucgacuccccccagggccaggagcccgacauccucaucgacuucgcccgcgccuuccaccaggacuccuaccccuucgacggccucggcggcacccucgcccacgccuucuuccccggcgagcaccccaucuccggcgacacccacuucgacgacgaggagaccuggaccuucggcuccaaggacggcgagggcaccgaccucuucgccgucgccguccacgaguucggccacgcccucggccucggccacuccuccgcccccaacuccaucaugcgccccuucuaccagggccccgucggcgaccccgacaaguaccgccucucccaggacgaccgcgacggccuccagcagcucuacggcaaggccccccagacccccuacgacaagcccacccgcaagccccucgccccccccccccagccccccgccucccccacccacucccccuccuuccccauccccgaccgcugcgagggcaacuucgacgccaucgccaacauccgcggcgagaccuucuucuucaagggccccugguucuggcgccuccagcccuccggccagcucgucuccccccgccccgcccgccuccaccgcuucugggagggccuccccgcccagguccgcgucguccaggccgccuacgcccgccaccgcgacggccgcauccuccucuucuccggcccccaguucugggucuuccaggaccgccagcucgagggcggcgcccgcccccucaccgagcucggccucccccccggcgaggaggucgacgccgucuucuccuggccccagaacggcaagaccuaccucguccgcggccgccaguacuggcgcuacgacgaggccgccgcccgccccgaccccggcuacccccgcgaccucucccucugggagggcgccccccccucccccgacgacgucaccgucuccaacgccggcgacaccuacuucuucaagggcgcccacuacuggcgcuuccccaagaacuccaucaagaccgagcccgacgccccccagcccaugggccccaacuggcucgacugccccgcccccuccuccggcccccgcgccccccgcccccccaaggccacccccgucuccgagaccugcgacugccagugcgagcucaaccaggccgccggccgcuggcccgcccccaucccccuccuccuccucccccuccucgucggcggcgucgccucccgcuga

SEQ ID NO: 46053 - RNA, 786 nt, Artificial Sequence
  derived and/or modified sequence opt2 from MMP26__Homo_sapiens__NP_068573
augcagcucgucauccuccgcgucaccaucuuccuccccuggugcuucgccguccccgucccccccgccgccgaccacaagggcugggacuucgucgagggcuacuuccaccaguucuuccucaccaagaaggaguccccccuccucacccaggagacccagacccagcuccuccagcaguuccaccgcaacggcaccgaccuccucgacaugcagaugcacgcccuccuccaccagccccacugcggcguccccgacggcuccgacaccuccaucucccccggccgcugcaaguggaacaagcacacccucaccuaccgcaucaucaacuacccccacgacaugaagcccuccgccgucaaggacuccaucuacaacgccgucuccaucugguccaacgucaccccccucaucuuccagcagguccagaacggcgacgccgacaucaaggucuccuucuggcagugggcccacgaggacggcuggcccuucgacggccccggcggcauccucggccacgccuuccuccccaacuccggcaaccccggcgucguccacuucgacaagaacgagcacugguccgccuccgacaccggcuacaaccucuuccucgucgccacccacgagaucggccacucccucggccuccagcacuccggcaaccaguccuccaucauguaccccaccuacugguaccacgacccccgcaccuuccagcucuccgccgacgacauccagcgcauccagcaccucuacggcgagaagugcuccuccgacauccccuga

SEQ ID NO: 46054 - RNA, 393 nt, Artificial Sequence
  derived and/or modified sequence opt2 from MMP28__Homo_sapiens__NP_001027449
auggucgcccgcgucggccuccuccuccgcgcccuccagcuccuccucuggggccaccucgacgcccagcccgccgagcgcggcggccaggagcuccgcaaggaggccgaggccuuccucgagaaguacggcuaccucaacgagcagguccccaaggcccccaccuccacccgcuucuccgacgccauccgcgccuuccagugggucucccagcuccccgucuccggcguccucgaccgcgccacccuccgccagaugacccgcccccgcugcggcgucaccgacaccaacuccuacgccgccugggccgagcgcaucuccgaccucuucgcccgccaccgcaccaagaugcgccgcaagaagcgcuucgccaagcagggcgagcacugcuga

SEQ ID NO: 46055 - RNA, 1833 nt, Artificial Sequence
  derived and/or modified sequence opt2 from MMP2__Homo_sapiens__NP_001121363
augcaguaccucaacaccuucuacggcugccccaaggaguccugcaaccucuucguccucaaggacacccucaagaagaugcagaaguucuucggccucccccagaccggcgaccucgaccagaacaccaucgagaccaugcgcaagccccgcugcggcaaccccgacgucgccaacuacaacuucuucccccgcaagcccaagugggacaagaaccagaucaccuaccgcaucaucggcuacacccccgaccucgaccccgagaccgucgacgacgccuucgcccgcgccuuccaggucugguccgacgucaccccccuccgcuucucccgcauccacgacggcgaggccgacaucaugaucaacuucggccgcugggagcacggcgacggcuaccccuucgacggcaaggacggccuccucgcccacgccuucgcccccggcaccggcgucggcggcgacucccacuucgacgacgacgagcucuggacccucggcgagggccaggucguccgcgucaaguacggcaacgccgacggcgaguacugcaaguuccccuuccucuucaacggcaaggaguacaacuccugcaccgacaccggccgcuccgacggcuuccucuggugcuccaccaccuacaacuucgagaaggacggcaaguacggcuucugcccccacgaggcccucuucaccaugggcggcaacgccgagggccagcccugcaaguuccccuuccgcuuccagggcaccuccuacgacuccugcaccaccgagggccgcaccgacggcuaccgcuggugcggcaccaccgaggacuacgaccgcgacaagaaguacggcuucugccccgagaccgccauguccaccgucggcggcaacuccgagggcgcccccugcgucuuccccuucaccuuccucggcaacaaguacgaguccugcaccuccgccggccgcuccgacggcaagauguggugcgccaccaccgccaacuacgacgacgaccgcaaguggggcuucugccccgaccagggcuacucccucuuccucgucgccgcccacgaguucggccacgccaugggccucgagcacucccaggaccccggcgcccucauggcccccaucuacaccuacaccaagaacuuccgccucucccaggacgacaucaagggcauccaggagcucuacggcgccucccccgacaucgaccucggcaccggccccacccccacccucggccccgucacccccgagaucugcaagcaggacaucgucuucgacggcaucgcccagauccgcggcgagaucuucuucuucaaggaccgcuucaucuggcgcaccgucaccccccgcgacaagcccaugggcccccuccucgucgccaccuucuggcccgagcuccccgagaagaucgacgccgucuacgaggccccccaggaggagaaggccgucuucuucgccggcaacgaguacuggaucuacuccgccuccacccucgagcgcggcuaccccaagccccucaccucccucggccucccccccgacguccagcgcgucgacgccgccuucaacugguccaagaacaagaagaccuacaucuucgccggcgacaaguucuggcgcuacaacgaggucaagaagaagauggaccccggcuuccccaagcucaucgccgacgccuggaacgccauccccgacaaccucgacgccgucgucgaccuccagggcggcggccacuccuacuucuucaagggcgccuacuaccucaagcucgagaaccagucccucaaguccgucaaguucggcuccaucaaguccgacuggcucggcugcuga

SEQ ID NO: 46056 - RNA, 1434 nt, Artificial Sequence
  derived and/or modified sequence opt2 from MMP3__Homo_sapiens__NP_002413
augaagucccuccccauccuccuccuccucugcgucgccgucugcuccgccuacccccucgacggcgccgcccgcggcgaggacaccuccaugaaccucguccagaaguaccucgagaacuacuacgaccucaagaaggacgucaagcaguucguccgccgcaaggacuccggccccgucgucaagaagauccgcgagaugcagaaguuccucggccucgaggucaccggcaagcucgacuccgacacccucgaggucaugcgcaagccccgcugcggcguccccgacgucggccacuuccgcaccuuccccggcauccccaaguggcgcaagacccaccucaccuaccgcaucgucaacuacacccccgaccuccccaaggacgccgucgacuccgccgucgagaaggcccucaaggucugggaggaggucaccccccucaccuucucccgccucuacgagggcgaggccgacaucaugaucuccuucgccguccgcgagcacggcgacuucuaccccuucgacggccccggcaacguccucgcccacgccuacgcccccggccccggcaucaacggcgacgcccacuucgacgacgacgagcaguggaccaaggacaccaccggcaccaaccucuuccucgucgccgcccacgagaucggccacucccucggccucuuccacuccgccaacaccgaggcccucauguacccccucuaccacucccucaccgaccucacccgcuuccgccucucccaggacgacaucaacggcauccagucccucuacggccccccccccgacucccccgagaccccccucguccccaccgagcccgucccccccgagcccggcacccccgccaacugcgaccccgcccucuccuucgacgccgucuccacccuccgcggcgagauccucaucuucaaggaccgccacuucuggcgcaagucccuccgcaagcucgagcccgagcuccaccucaucuccuccuucuggcccucccuccccuccggcgucgacgccgccuacgaggucaccuccaaggaccucgucuucaucuucaagggcaaccaguucugggccauccgcggcaacgagguccgcgccggcuacccccgcggcauccacacccucggcuucccccccaccguccgcaagaucgacgccgccaucuccgacaaggagaagaacaagaccuacuucuucgucgaggacaaguacuggcgcuucgacgagaagcgcaacuccauggagcccggcuuccccaagcagaucgccgaggacuuccccggcaucgacuccaagaucgacgccgucuucgaggaguucggcuucuucuacuucuucaccggcuccucccagcucgaguucgaccccaacgccaagaaggucacccacacccucaaguccaacuccuggcucaacugcuga

SEQ ID NO: 46057 - RNA, 804 nt, Artificial Sequence
  derived and/or modified sequence opt2 from MMP7__Homo_sapiens__NP_002414
augcgccucaccguccucugcgccgucugccuccuccccggcucccucgcccucccccucccccaggaggccggcggcauguccgagcuccagugggagcaggcccaggacuaccucaagcgcuucuaccucuacgacuccgagaccaagaacgccaacucccucgaggccaagcucaaggagaugcagaaguucuucggccuccccaucaccggcaugcucaacucccgcgucaucgagaucaugcagaagccccgcugcggcguccccgacgucgccgaguacucccucuuccccaacucccccaaguggaccuccaaggucgucaccuaccgcaucgucuccuacacccgcgaccucccccacaucaccgucgaccgccucgucuccaaggcccucaacauguggggcaaggagaucccccuccacuuccgcaaggucgucuggggcaccgccgacaucaugaucggcuucgcccgcggcgcccacggcgacuccuaccccuucgacggccccggcaacacccucgcccacgccuucgcccccggcaccggccucggcggcgacgcccacuucgacgaggacgagcgcuggaccgacggcuccucccucggcaucaacuuccucuacgccgccacccacgagcucggccacucccucggcaugggccacuccuccgaccccaacgccgucauguaccccaccuacggcaacggcgacccccagaacuucaagcucucccaggacgacaucaagggcauccagaagcucuacggcaagcgcuccaacucccgcaagaaguga

SEQ ID NO: 46058 - RNA, 1404 nt, Artificial Sequence
  derived and/or modified sequence opt2 from MMP8__Homo_sapiens__NP_002415
auguucucccucaagacccuccccuuccuccuccuccuccacguccagaucuccaaggccuuccccgucuccuccaaggagaagaacaccaagaccguccaggacuaccucgagaaguucuaccagcuccccuccaaccaguaccaguccacccgcaagaacggcaccaacgucaucgucgagaagcucaaggagaugcagcgcuucuucggccucaacgucaccggcaagcccaacgaggagacccucgacaugaugaagaagccccgcugcggcguccccgacuccggcggcuucaugcucacccccggcaaccccaagugggagcgcaccaaccucaccuaccgcauccgcaacuacaccccccagcucuccgaggccgaggucgagcgcgccaucaaggacgccuucgagcucugguccgucgccuccccccucaucuucacccgcaucucccagggcgaggccgacaucaacaucgccuucuaccagcgcgaccacggcgacaacucccccuucgacggccccaacggcauccucgcccacgccuuccagcccggccagggcaucggcggcgacgcccacuucgacgccgaggagaccuggaccaacaccuccgccaacuacaaccucuuccucgucgccgcccacgaguucggccacucccucggccucgcccacuccuccgaccccggcgcccucauguaccccaacuacgccuuccgcgagaccuccaacuacucccucccccaggacgacaucgacggcauccaggccaucuacggccucuccuccaaccccauccagcccaccggccccuccacccccaagcccugcgaccccucccucaccuucgacgccaucaccacccuccgcggcgagauccucuucuucaaggaccgcuacuucuggcgccgccacccccagcuccagcgcgucgagaugaacuucaucucccucuucuggcccucccuccccaccggcauccaggccgccuacgaggacuucgaccgcgaccucaucuuccucuucaagggcaaccaguacugggcccucuccggcuacgacauccuccagggcuaccccaaggacaucuccaacuacggcuuccccuccuccguccaggccaucgacgccgccgucuucuaccgcuccaagaccuacuucuucgucaacgaccaguucuggcgcuacgacaaccagcgccaguucauggagcccggcuaccccaaguccaucuccggcgccuuccccggcaucgaguccaaggucgacgccgucuuccagcaggagcacuucuuccacgucuucuccggcccccgcuacuacgccuucgaccucaucgcccagcgcgucacccgcgucgcccgcggcaacaaguggcucaacugccgcuacggcuga

SEQ ID NO: 46059 - RNA, 2124 nt, Artificial Sequence
  derived and/or modified sequence opt2 from MMP9__Homo_sapiens__NP_004985
augucccucuggcagccccucguccucguccuccucguccucggcugcugcuucgccgccccccgccagcgccaguccacccucguccucuuccccggcgaccuccgcaccaaccucaccgaccgccagcucgccgaggaguaccucuaccgcuacggcuacacccgcgucgccgagaugcgcggcgaguccaagucccucggccccgcccuccuccuccuccagaagcagcucucccuccccgagaccggcgagcucgacuccgccacccucaaggccaugcgcaccccccgcugcggcguccccgaccucggccgcuuccagaccuucgagggcgaccucaaguggcaccaccacaacaucaccuacuggauccagaacuacuccgaggaccucccccgcgccgucaucgacgacgccuucgcccgcgccuucgcccucugguccgccgucaccccccucaccuucacccgcgucuacucccgcgacgccgacaucgucauccaguucggcgucgccgagcacggcgacggcuaccccuucgacggcaaggacggccuccucgcccacgccuucccccccggccccggcauccagggcgacgcccacuucgacgacgacgagcucuggucccucggcaagggcgucgucguccccacccgcuucggcaacgccgacggcgccgccugccacuuccccuucaucuucgagggccgcuccuacuccgccugcaccaccgacggccgcuccgacggccuccccuggugcuccaccaccgccaacuacgacaccgacgaccgcuucggcuucugccccuccgagcgccucuacacccaggacggcaacgccgacggcaagcccugccaguuccccuucaucuuccagggccaguccuacuccgccugcaccaccgacggccgcuccgacggcuaccgcuggugcgccaccaccgccaacuacgaccgcgacaagcucuucggcuucugccccacccgcgccgacuccaccgucaugggcggcaacuccgccggcgagcucugcgucuuccccuucaccuuccucggcaaggaguacuccaccugcaccuccgagggccgcggcgacggccgccucuggugcgccaccaccuccaacuucgacuccgacaagaaguggggcuucugccccgaccagggcuacucccucuuccucgucgccgcccacgaguucggccacgcccucggccucgaccacuccuccguccccgaggcccucauguaccccauguaccgcuucaccgagggccccccccuccacaaggacgacgucaacggcauccgccaccucuacggcccccgccccgagcccgagccccgcccccccaccaccaccaccccccagcccaccgccccccccaccgucugccccaccggcccccccaccguccaccccuccgagcgccccaccgccggccccaccggcccccccuccgccggccccaccggcccccccaccgccggccccuccaccgccaccaccgucccccucucccccgucgacgacgccugcaacgucaacaucuucgacgccaucgccgagaucggcaaccagcucuaccucuucaaggacggcaaguacuggcgcuucuccgagggccgcggcucccgcccccagggccccuuccucaucgccgacaaguggcccgcccucccccgcaagcucgacuccgucuucgaggagcgccucuccaagaagcucuucuucuucuccggccgccaggucugggucuacaccggcgccuccguccucggcccccgccgccucgacaagcucggccucggcgccgacgucgcccaggucaccggcgcccuccgcuccggccgcggcaagaugcuccucuucuccggccgccgccucuggcgcuucgacgucaaggcccagauggucgacccccgcuccgccuccgaggucgaccgcauguuccccggcgucccccucgacacccacgacgucuuccaguaccgcgagaaggccuacuucugccaggaccgcuucuacuggcgcgucuccucccgcuccgagcucaaccaggucgaccaggucggcuacgucaccuacgacauccuccagugccccgaggacuga

SEQ ID NO: 46060 - RNA, 3687 nt, Artificial Sequence
  derived and/or modified sequence opt2 from MMRN1__Homo_sapiens__NP_031377
augaagggcgcccgccucuucguccuccucuccucccucugguccggcggcaucggccucaacaacuccaagcacuccuggaccauccccgaggacggcaacucccagaagaccaugcccuccgccuccgucccccccaacaagauccagucccuccagauccuccccaccacccgcgucauguccgccgagaucgccaccacccccgaggcccgcaccuccgaggacucccuccucaaguccacccucccccccuccgagaccuccgcccccgccgagggcguccgcaaccagacccucaccuccaccgagaaggccgagggcgucgucaagcuccagaaccucacccuccccaccaacgccuccaucaaguucaaccccggcgccgaguccgucguccucuccaacuccacccucaaguuccuccaguccuucgcccgcaaguccaacgagcaggccaccucccucaacaccgucggcggcaccggcggcaucggcggcgucggcggcaccggcggcgucggcaaccgcgccccccgcgagaccuaccucucccgcggcgacuccuccuccucccagcgcaccgacuaccagaaguccaacuucgagaccacccgcggcaagaacuggugcgccuacguccacacccgccucucccccaccgucauccucgacaaccaggucaccuacguccccggcggcaagggccccugcggcuggaccggcggcuccugcccccagcgcucccagaagaucuccaaccccgucuaccgcaugcagcacaagaucgucaccucccucgacuggcgcugcugccccggcuacuccggccccaagugccagcuccgcgcccaggagcagcagucccucauccacaccaaccaggccgagucccacaccgccgucggccgcggcgucgccgagcagcagcagcagcagggcugcggcgaccccgaggucaugcagaagaugaccgaccaggucaacuaccaggccaugaagcucacccuccuccagaagaagaucgacaacaucucccucaccgucaacgacguccgcaacaccuacuccucccucgagggcaaggucuccgaggacaagucccgcgaguuccagucccuccucaagggccucaaguccaaguccaucaacguccucauccgcgacaucguccgcgagcaguucaagaucuuccagaacgacaugcaggagaccgucgcccagcucuucaagaccgucuccucccucuccgaggaccucgaguccacccgccagaucauccagaaggucaacgaguccgucgucuccaucgccgcccagcagaaguucguccucguccaggagaaccgccccacccucaccgacaucgucgagcuccgcaaccacaucgucaacguccgccaggagaugacccucaccugcgagaagcccaucaaggagcucgaggucaagcagacccaccucgagggcgcccucgagcaggagcacucccgcuccauccucuacuacgagucccucaacaagacccucuccaagcucaaggagguccacgagcagcuccucuccaccgagcaggucuccgaccagaagaacgcccccgccgccgaguccgucuccaacaacgucaccgaguacauguccacccuccacgagaacaucaagaagcagucccucaugaugcuccagauguucgaggaccuccacauccaggaguccaagaucaacaaccucaccgucucccucgagauggagaaggagucccuccgcggcgagugcgaggacaugcucuccaagugccgcaacgacuucaaguuccagcucaaggacaccgaggagaaccuccacguccucaaccagacccucgccgagguccucuuccccauggacaacaagauggacaagauguccgagcagcucaacgaccucaccuacgacauggagauccuccagccccuccucgagcagggcgccucccuccgccagaccaugaccuacgagcagcccaaggaggccaucgucauccgcaagaagaucgagaaccucaccuccgccgucaacucccucaacuucaucaucaaggagcucaccaagcgccacaaccuccuccgcaacgagguccagggccgcgacgacgcccucgagcgccgcaucaacgaguacgcccucgagauggaggacggccucaacaagaccaugaccaucaucaacaacgccaucgacuucauccaggacaacuacgcccucaaggagacccucuccaccaucaaggacaacuccgagauccaccacaagugcaccuccgacauggagaccauccucaccuucaucccccaguuccaccgccucaacgacuccauccagacccucgucaacgacaaccagcgcuacaacuucguccuccaggucgccaagacccucgccggcaucccccgcgacgagaagcucaaccaguccaacuuccagaagauguaccagauguucaacgagaccaccucccagguccgcaaguaccagcagaacaugucccaccucgaggagaagcuccuccucaccaccaagaucuccaagaacuucgagacccgccuccaggacaucgaguccaaggucacccagacccucauccccuacuacaucuccgucaagaagggcuccgucgucaccaacgagcgcgaccaggcccuccagcuccagguccucaacucccgcuucaaggcccucgaggccaaguccauccaccucuccaucaacuucuucucccucaacaagacccuccacgagguccucaccaugugccacaacgccuccaccuccgucuccgagcucaacgccaccauccccaaguggaucaagcacucccuccccgacauccagcuccuccagaagggccucaccgaguucgucgagcccaucauccagaucaagacccaggccgcccucuccaaccucaccugcugcaucgaccgcucccuccccggcucccucgccaacgucgucaagucccagaagcaggucaagucccuccccaagaagaucaacgcccucaagaagcccaccgucaaccucaccaccguccucaucggccgcacccagcgcaacaccgacaacaucaucuaccccgaggaguacuccuccugcucccgccaccccugccagaacggcggcaccugcaucaacggccgcaccuccuucaccugcgccugccgccaccccuucaccggcgacaacugcaccaucaagcucgucgaggagaacgcccucgcccccgacuucuccaagggcuccuaccgcuacgcccccauggucgccuucuucgccucccacaccuacggcaugaccauccccggccccauccucuucaacaaccucgacgucaacuacggcgccuccuacaccccccgcaccggcaaguuccgcauccccuaccucggcgucuacgucuucaaguacaccaucgaguccuucuccgcccacaucuccggcuuccucgucgucgacggcaucgacaagcucgccuucgaguccgagaacaucaacuccgagauccacugcgaccgcguccucaccggcgacgcccuccucgagcucaacuacggccaggaggucuggcuccgccucgccaagggcaccauccccgccaaguucccccccgucaccaccuucuccggcuaccuccucuaccgcaccuga

SEQ ID NO: 46061 - RNA, 2850 nt, Artificial Sequence
  derived and/or modified sequence opt2 from MMRN2__Homo_sapiens__NP_079032
augauccucucccuccucuucucccucggcggcccccucggcuggggccuccucggcgccugggcccaggccuccuccaccucccucuccgaccuccaguccucccgcacccccggcgucuggaaggccgaggccgaggacaccggcaaggaccccgucggccgcaacuggugccccuaccccauguccaagcucgucacccuccucgcccucugcaagaccgagaaguuccucauccacucccagcagcccugcccccagggcgcccccgacugccagaaggucaaggucauguaccgcauggcccacaagcccgucuaccaggucaagcagaagguccucaccucccucgccuggcgcugcugccccggcuacaccggccccaacugcgagcaccacgacuccauggccauccccgagcccgccgaccccggcgacucccaccaggagccccaggacggccccgucuccuucaagcccggccaccucgccgccgucaucaacgaggucgagguccagcaggagcagcaggagcaccuccucggcgaccuccagaacgacguccaccgcgucgccgacucccuccccggccucuggaaggcccuccccggcaaccucaccgccgccgucauggaggccaaccagaccggccacgaguuccccgaccgcucccucgagcagguccuccucccccacgucgacaccuuccuccagguccacuucucccccaucuggcgcuccuucaaccagucccuccacucccucacccaggccauccgcaaccucucccucgacgucgaggccaaccgccaggccaucucccgcguccaggacuccgccgucgcccgcgccgacuuccaggagcucggcgccaaguucgaggccaagguccaggagaacacccagcgcgucggccagcuccgccaggacgucgaggaccgccuccacgcccagcacuucacccuccaccgcuccaucuccgagcuccaggccgacgucgacaccaagcucaagcgccuccacaaggcccaggaggcccccggcaccaacggcucccucguccucgccacccccggcgccggcgcccgccccgagcccgacucccuccaggcccgccucggccagcuccagcgcaaccucuccgagcuccacaugaccaccgcccgccgcgaggaggagcuccaguacacccucgaggacaugcgcgccacccucacccgccacgucgacgagaucaaggagcucuacuccgaguccgacgagaccuucgaccagaucuccaaggucgagcgccaggucgaggagcuccaggucaaccacaccgcccuccgcgagcuccgcgucauccucauggagaagucccucaucauggaggagaacaaggaggaggucgagcgccagcuccucgagcucaaccucacccuccagcaccuccagggcggccacgccgaccucaucaaguacgucaaggacugcaacugccagaagcucuaccucgaccucgacgucauccgcgagggccagcgcgacgccacccgcgcccucgaggagacccaggucucccucgacgagcgccgccagcucgacggcuccucccuccaggcccuccagaacgccgucgacgccgucucccucgccgucgacgcccacaaggccgagggcgagcgcgcccgcgccgccaccucccgccuccgcucccagguccaggcccucgacgacgaggucggcgcccucaaggccgccgccgccgaggcccgccacgagguccgccagcuccacuccgccuucgccgcccuccucgaggacgcccuccgccacgaggccguccucgccgcccucuucggcgaggagguccucgaggagauguccgagcagacccccggcccccucccccucuccuacgagcagauccgcgucgcccuccaggacgccgccuccggccuccaggagcaggcccucggcugggacgagcucgccgcccgcgucaccgcccucgagcaggccuccgagcccccccgccccgccgagcaccucgagcccucccacgacgccggccgcgaggaggccgccaccaccgcccucgccggccucgcccgcgagcuccagucccucuccaacgacgucaagaacgucggccgcugcugcgaggccgaggccggcgccggcgccgccucccucaacgccucccuccacggccuccacaacgcccucuucgccacccagcgcucccucgagcagcaccagcgccucuuccacucccucuucggcaacuuccagggccucauggaggccaacgucucccucgaccucggcaagcuccagaccaugcucucccgcaagggcaagaagcagcagaaggaccucgaggccccccgcaagcgcgacaagaaggaggccgagccccucgucgacauccgcgucaccggccccguccccggcgcccucggcgccgcccucugggaggccggcucccccgucgccuucuacgccuccuucuccgagggcaccgccgcccuccagaccgucaaguucaacaccaccuacaucaacaucggcuccuccuacuuccccgagcacggcuacuuccgcgcccccgagcgcggcgucuaccucuucgccgucuccgucgaguucggccccggccccggcaccggccagcucgucuucggcggccaccaccgcacccccgucugcaccaccggccagggcuccggcuccaccgccaccgucuucgccauggccgagcuccagaagggcgagcgcgucugguucgagcucacccagggcuccaucaccaagcgcucccucuccggcaccgccuucggcggcuuccucauguucaagaccuga

SEQ ID NO: 46062 - RNA, 2964 nt, Artificial Sequence
  derived and/or modified sequence opt2 from MMS19__Homo_sapiens__NP_001276332
auggccgccgccgccgccgucgaggccgccgcccccaugggcgcccucuggggccucguccacgacuucgucgucggccagcaggagggccccgccgaccaggucgccgccgacgucaaguccggcaacuacaccguccuccaggucgucgaggcccucggcuccucccucgagaaccccgagccccgcacccgcgcccgcgccauccagcuccucucccagguccuccuccacugccacacccuccuccucgagaaggaggucguccaccucauccucuucuacgagaaccgccucaaggaccaccaccucgucauccccuccguccuccagggccucaaggcccucucccucugcgucgcccucccccccggccucgccgucuccguccucaaggccaucuuccaggagguccacguccagucccucccccaggucgaccgccacaccgucuacaacaucaucaccaacuucaugcgcacccgcgaggagggccccuucgucgaggagcucuucgaggucaccuccugcuacuuccccaucgacuucacccccccccccaacgacccccacggcauccagcgcgaggaccucauccucucccuccgcgccguccucgccuccaccccccgcuucgccgaguuccuccucccccuccucaucgagaaggucgacuccgagguccucuccgccaagcucgacucccuccagacccucaacgccugcugcgccgucuacggccagaaggagcucaaggacuuccuccccucccucugggccuccauccgccgcgaggucuuccagaccgccuccgagcgcgucgaggccgagggccucgccgcccuccacucccucaccgccugccucucccgcuccguccuccgcgccgacgccgaggaccuccucgacuccuuccucuccaacauccuccaggacugccgccaccaccucugcgagcccgacaugaagcucgucuggcccuccgccaagcuccuccaggccgccgccggcgccuccgcccgcgccugcgacuccgucaccuccaacguccucccccuccuccucgagcaguuccacaagcacucccaguccucccagcgccgcaccauccucgagaugcuccucggcuuccucaagcuccagcagaagugguccuacgaggacaaggaccagcgcccccucaacggcuucaaggaccagcucugcucccucgucuucauggcccucaccgaccccuccacccagcuccagcucgucggcauccgcacccucaccguccucggcgcccagcccgaccuccucuccuacgaggaccucgagcucgccgucggccaccucuaccgccucuccuuccucaaggaggacucccaguccugccgcgucgccgcccucgaggccuccggcacccucgccgcccucuaccccgucgccuucuccucccaccucguccccaagcucgccgaggagcuccgcgucggcgaguccaaccucaccaacggcgacgagcccacccagugcucccgccaccucugcugccuccaggcccucuccgccgucuccacccaccccuccaucgucaaggagacccucccccuccuccuccagcaccucuggcaggucaaccgcggcaacauggucgcccaguccuccgacgucaucgccgucugccagucccuccgccagauggccgagaagugccagcaggaccccgaguccugcugguacuuccaccagaccgccauccccugccuccucgcccucgccguccaggccuccaugcccgagaaggagcccuccguccuccgcaagguccuccucgaggacgagguccucgccgccauggucuccgucaucggcaccgccaccacccaccucucccccgagcucgccgcccaguccgucacccacaucgucccccucuuccucgacggcaacgucuccuuccuccccgagaacuccuuccccucccgcuuccagcccuuccaggacggcuccuccggccagcgccgccucaucgcccuccucauggccuucgucugcucccucccccgcaacgucgagaucccccagcucaaccagcucaugcgcgagcuccucgagcucuccugcugccacuccugccccuucuccuccaccgccgccgccaagugcuucgccggccuccucaacaagcaccccgccggccagcagcucgacgaguuccuccagcucgccgucgacaaggucgaggccggccucggcuccggccccugccgcucccaggccuucacccuccuccucugggucaccaaggcccucguccuccgcuaccacccccucuccuccugccucaccgcccgccucaugggccuccucuccgaccccgagcucggccccgccgccgccgacggcuucucccuccucauguccgacugcaccgacguccucacccgcgccggccacgccgagguccgcaucauguuccgccagcgcuucuucaccgacaacguccccgcccucguccagggcuuccacgccgccccccaggacgucaagcccaacuaccucaagggccucucccacguccucaaccgccuccccaagcccguccuccuccccgagcuccccacccuccucucccuccuccucgaggcccucuccugccccgacugcgucguccagcucuccacccucuccugccuccagccccuccuccucgaggccccccaggucaugucccuccacgucgacacccucgucaccaaguuccucaaccucuccuccucccccuccauggccguccgcaucgccgcccuccagugcaugcacgcccucacccgccuccccacccccguccuccuccccuacaagccccaggucauccgcgcccucgccaagccccucgacgacaagaagcgccucguccgcaaggaggccgucuccgcccgcggcgagugguuccuccucggcucccccggcuccuga

SEQ ID NO: 46063 - RNA, 3732 nt, Artificial Sequence
  derived and/or modified sequence opt2 from MMS22L__Homo_sapiens__NP_940870
auggagaacugcuccgccgccuccaccuuccucaccgacucccucgagcucgagcucggcaccgaguggugcaagccccccuacuucuccugcgccgucgacaaccgcggcggcggcaagcacuucuccggcgaguccuaccucugcuccggcgcccucaagcgccucauccucaaccucgacccccuccccaccaacuucgaggaggacacccucgagaucuucggcauccagugggucaccgagaccgcccucgucaacuccucccgcgagcucuuccaccucuuccgccagcagcucuacaaccucgagacccuccuccaguccuccugcgacuucggcaaggucuccacccuccacugcaaggccgacaacauccgccagcagugcguccucuuccuccacuacgucaaggucuucaucuuccgcuaccucaagguccagaacgccgagucccacguccccguccaccccuacgaggcccucgaggcccagcuccccuccguccucaucgacgagcuccacggccuccuccucuacaucggccaccucuccgagcuccccuccgucaacaucggcgccuucgucaaccagaaccagaucaagcucuucccccccuccuggcaccuccuccaccuccaccucgacauccacuggcucguccucgagauccucuacaugcucggcgagaagcucaagcaggucgucuacggccaccaguucaugaaccucgccuccgacaaccucaccaacaucucccucuucgaggagcacugcgagacccuccucugcgaccucaucucccucucccucaaccgcuacgacaagguccgcuccuccgagucccucauguccgaccagugccccugccucugcaucaaggagcucuggguccuccucauccaccuccucgaccaccgcuccaagugguucgucuccgaguccuucuggaacuggcucaacaagcuccucaagacccuccucgagaaguccuccgaccgccgccgcuccuccaugcccgucauccagucccgcgacccccucggcuucuccugguggaucaucacccacgucgccuccuucuacaaguucgaccgccacggcguccccgacgagaugcgcaaggucgaguccaacuggaacuucgucgaggagcuccucaagaaguccaucuccguccagggcgucauccucgaggagcagcuccgcauguaccuccacugcugccucacccucugcgacuucugggagcccaacaucgccaucgucaccauccucugggaguacuacuccaagaaccucaacuccuccuucuccaucuccuggcuccccuucaagggccucgccaacaccaugaaguccccccucuccaugcucgagauggucaagaccugcugcugcgacaagcaggaccaggagcucuacaaguccuccuccuccuacaccaucuuccucugcauccucgccaaggucgucaagaaggccaugaaguccaacggcccccaccccuggaagcaggucaagggccgcaucuacuccaaguuccaccagaagcgcauggaggagcucaccgaggucggccuccagaacuucuucucccucuuccuccuccucgccgccgucgccgaggucgaggacgucgccucccacguccucgaccuccucaacuuccucaagcccgccuucgucaccucccagcgcgcccucaucuggaagggccacauggccuuccuccucauguacgcccagaagaaccucgacaucggcguccucgccgagaaguucuccugcgccuuccgcgagaaggccaaggaguuccucgucuccaagaacgaggagaugguccagcgccagaccaucuggacccuccucuccaucuacaucgacggcguccaggaggucuucgagaccuccuacugccucuaccccucccacgagaagcuccucaacgacggcuucuccaugcuccuccgcgccugccgcgaguccgagcuccgcaccguccucuccuuccuccaggccguccucgcccgcauccgcuccaugcaccagcagcucugccaggagcuccagcgcgacaacgucgaccucuucguccaguccucccucuccgccaaggagcgccaccucgccgccgucgccuccgcccucuggcgccacuucuucuccuuccucaagucccagcgcaugucccaggucguccccuucucccagcucgccgacgccgccgccgacuucacccuccucgccauggacaugcccuccaccgcccccuccgacuuccagccccagcccgucaucuccaucauccagcucuucggcugggacgacaucaucugcccccaggucgucgcccgcuaccucucccacguccuccagaacuccacccucugcgaggcccucucccacuccggcuacgucuccuuccaggcccucaccguccgcuccuggauccgcugcguccuccagauguacaucaagaaccucuccggccccgacgaccuccucaucgacaagaaccucgaggaggccgucgagaaggaguacaugaagcagcucgucaagcucacccgccuccucuucaaccucuccgaggucaaguccaucuucuccaaggcccaggucgaguaccucuccaucuccgaggaccccaagaaggcccucguccgcuucuucgaggccgucggcgucaccuacggcaacguccagacccucuccgacaaguccgccauggucaccaagucccucgaguaccucggcgagguccucaaguacaucaagcccuaccucggcaagaaggucuucuccgccggccuccagcucaccuacggcaugaugggcauccucgucaaguccugggcccagaucuucgccaccuccaaggcccagaagcuccucuuccgcaucaucgacugccuccuccucccccacgccguccuccagcaggagaaggagcuccccgcccccaugcucuccgccauccagaagucccucccccucuaccuccagggcaugugcaucgucugcugccagucccagaaccccaacgccuaccucaaccagcuccucggcaacgucaucgagcaguacaucggccgcuuccuccccgccucccccuacgucuccgaccucggccagcaccccguccuccucgcccuccgcaacaccgccaccaucccccccaucuccucccucaagaagugcaucguccaggucauccgcaaguccuaccucgaguacaagggcuccuccccccccccccgccucgccuccauccucgccuucauccuccagcucuucaaggagaccaacaccgacaucuacgaggucgagcuccuccuccccggcauccucaagugccucguccucgucuccgagccccaggucaagcgccucgccaccgagaaccuccaguacauggucaaggccugccaggucggcuccgaggaggagcccuccucccagcucaccuccgucuuccgccaguucauccaggacuacggcaugcgcuacuacuaccaggucuacuccauccucgagaccgucgccacccucgaccagcaggucgucauccaccucaucuccacccucacccagucccucaaggacuccgagcagaaguggggccucggccgcaacaucgcccagcgcgaggccuacuccaagcuccucucccaccucggccagaugggccaggacgagaugcagcgccucgagaacgacaacaccuga

SEQ ID NO: 46064 - RNA, 3963 nt, Artificial Sequence
  derived and/or modified sequence opt2 from MN1__Homo_sapiens__NP_002421
auguucggccucgaccaguucgagccccaggucaacucccgcaacgccggccagggcgagcgcaacuucaacgagaccggccucuccaugaacacccacuucaaggcccccgccuuccacaccggcggcccccccggccccgucgaccccgccauguccgcccucggcgagccccccauccucggcaugaacauggagcccuacggcuuccacgcccgcggccacuccgagcuccacgccggcggccuccaggcccagcccguccacggcuucuucggcggccagcagccccaccacggccaccccggcucccaccacccccaccagcaccacccccacuucggcggcaacuucggcggccccgaccccggcgccuccugccuccacggcggccgccuccucggcuacggcggcgccgccggcggccucggcucccagccccccuucgccgagggcuacgagcacauggccgagucccagggccccgaguccuucggcccccagcgccccggcaaccuccccgacuuccacuccuccggcgccuccucccacgccguccccgcccccugccucccccucgaccagucccccaaccgcgccgccuccuuccacggccuccccuccuccuccggcuccgacucccacucccucgagccccgccgcgucaccaaccagggcgccgucgacucccucgaguacaacuaccccggcgaggcccccuccggccacuucgacauguucucccccuccgacuccgagggccagcucccccacuacgccgccggccgccagguccccggcggcgccuuccccggcgccuccgccaugccccgcgccgccggcauggucggccucuccaagaugcacgcccagcccccccagcagcagccccagcagcagcagcagccccagcagcagcagcagcagcacggcgucuucuucgagcgcuucuccggcgcccgcaagaugcccgucggccucgagcccuccgucggcucccgccacccccucaugcagcccccccagcaggcccccccccccccccagcagcagcccccccagcagcccccccagcagcagcccccccccccccccggccuccucguccgccagaacuccugcccccccgcccucccccgcccccagcagggcgaggccggcacccccuccggcggccuccaggacggcggccccaugcuccccucccagcacgcccaguucgaguaccccauccaccgccucgagaaccgcuccaugcaccccuacuccgagcccgucuucuccaugcagcacccccccccccagcaggcccccaaccagcgccuccagcacuucgacgccccccccuacaugaacgucgccaagcgcccccgcuucgacuuccccggcuccgccggcgucgaccgcugcgccuccuggaacggcuccaugcacaacggcgcccucgacaaccaccucucccccuccgccuaccccggccuccccggcgaguucaccccccccguccccgacuccuuccccuccggccccccccuccagcaccccgcccccgaccaccagucccuccagcagcagcagcagcagcagcagcagcagcagcagcagcagcagcagcagcagcagcagcagcagcagcagcagcagcagcagcgccagaacgccgcccucaugaucaagcagauggccucccgcaaccagcagcagcgccuccgccagcccaaccucgcccagcucggccaccccggcgacgucggccagggcggccucguccacggcggccccgucggcggccucgcccagcccaacuucgagcgcgagggcggcuccaccggcgccggccgccucggcaccuucgagcagcaggccccccaccucgcccaggaguccgccugguucuccggcccccaccccccccccggcgaccuccucccccgccgcaugggcggcuccggccuccccgccgacugcggcccccacgaccccucccucgcccccccccccccccccggcggcuccggcguccucuuccgcggcccccuccaggagcccaugcgcaugcccggcgagggccacguccccgcccuccccucccccggccuccaguucggcggcucccucggcggccucggccagcuccagucccccggcgccggcgucggccuccccuccgccgccuccgagcgccgcccccccccccccgacuucgccaccuccgcccucggcggccagcccggcuuccccuucggcgccgccggccgccaguccaccccccacuccggccccggcgucaacuccccccccuccgccggcggcggcggcggcuccuccggcggcggcggcggcggcggcgccuaccccccccagcccgacuuccagcccucccagcgcaccuccgccuccaagcucggcgcccucucccucggcuccuucaacaagcccuccuccaaggacaaccucuucggccaguccugccucgccgcccucuccaccgccugccagaacaugaucgccucccucggcgcccccaaccucaacgucaccuucaacaagaagaacccccccgagggcaagcgcaagcucucccagaacgagaccgacggcgccgccgucgccggcaaccccggcuccgacuacuuccccggcggcaccgcccccggcgcccccggccccggcggccccuccggcaccuccuccuccggcuccaaggccuccggcccccccaacccccccgcccagggcgacggcaccucccucucccccaacuacacccucgaguccaccuccggcaacgacggcaagcccgucuccggcggcggcggccgcggccgcggccgccgcaagcgcgacuccggccacgucucccccggcaccuucuucgacaaguacuccgccgcccccgacuccggcggcgcccccggcgucucccccggccagcagcaggccuccggcgccgccgucggcggcuccuccgccggcgagacccgcggcgcccccaccccccacgagaaggcccucaccucccccuccuggggcaagggcgccgagcuccuccucggcgaccagcccgaccucaucggcucccucgacggcggcgccaaguccgacuccuccucccccaacgucggcgaguucgccuccgacgaggucuccaccuccuacgccaacgaggacgaggucuccuccuccuccgacaacccccaggcccucgucaaggccucccgcuccccccucgucaccggcucccccaagcuccccccccgcggcgucggcgccggcgagcacggccccaaggcccccccccccgcccucggccucggcaucauguccaacuccaccuccacccccgacuccuacggcggcggcggcggccccggccaccccggcacccccggccucgagcagguccgcacccccaccuccuccuccggcgcccccccccccgacgagauccacccccucgagauccuccaggcccagauccagcuccagcgccagcaguucuccaucuccgaggaccagccccucggccucaagggcggcaagaagggcgagugcgccgucggcgccuccggcgcccagaacggcgacuccgagcucggcuccugcugcuccgaggccgucaaguccgccauguccaccaucgaccucgacucccucauggccgagcacuccgccgccugguacaugcccgccgacaaggcccucgucgacuccgccgacgacgacaagacccucgcccccugggagaaggccaagccccagaaccccaacuccaaggaggcccacgaccuccccgccaacaaggccuccgccucccagcccggcucccaccuccagugccucuccguccacugcaccgacgacgucggcgacgccaaggcccgcgccuccguccccaccuggcgcucccuccacuccgacaucuccaaccgcuucggcaccuucgucgccgcccucaccuga

SEQ ID NO: 46065 - RNA, 804 nt, Artificial Sequence
  derived and/or modified sequence opt2 from MNAT1__Homo_sapiens__NP_001171434
auggacgaccagggcugcccccgcugcaagaccaccaaguaccgcaaccccucccucaagcucauggucaacgucugcggccacacccucugcgaguccugcgucgaccuccucuucguccgcggcgccggcaacugccccgagugcggcaccccccuccgcaaguccaacuuccgcguccagcucuucgaggaccccaccgucgacaaggaggucgagauccgcaagaagguccucaagaucuacaacaagcgcgaggaggacuuccccucccuccgcgaguacaacgacuuccucgaggaggucgaggagaucgucuucaaccucaccaacaacgucgaccucgacaacaccaagaagaagauggagaucuaccagaaggagaacaaggacgucauccagaagaacaagcucaagcucacccgcgagcaggaggagcucgaggaggcccucgaggucgagcgccaggagaacgagcagcgccgccucuucauccagaaggaggagcagcuccagcagauccucaagcgcaagaacaagcaggccuuccucgacgagcucggccagcacaucucccucgcccccauccacaagcucgaggaggcccucuacgaguaccagccccuccagaucgagaccuacggcccccacguccccgagcucgagaugcucggccgccucggcuaccucaaccacguccgcgccgccuccccccaggaccucgccggcggcuacaccuccucccucgccugccaccgcgcccuccaggacgccuucuccggccucuucuggcagcccuccuga

SEQ ID NO: 46066 - RNA, 1224 nt, Artificial Sequence
  derived and/or modified sequence opt2 from MNDA__Homo_sapiens__NP_002423
auggucaacgaguacaagaagauccuccuccucaagggcuucgagcucauggacgacuaccacuucaccuccaucaagucccuccucgccuacgaccucggccucaccaccaagaugcaggaggaguacaaccgcaucaagaucaccgaccucauggagaagaaguuccagggcgucgccugccucgacaagcucaucgagcucgccaaggacaugcccucccucaagaaccucgucaacaaccuccgcaaggagaaguccaaggucgccaagaagaucaagacccaggagaaggcccccgucaagaagaucaaccaggaggaggucggccucgccgcccccgcccccaccgcccgcaacaagcucaccuccgaggcccgcggccgcauccccgucgcccagaagcgcaagacccccaacaaggagaagaccgaggccaagcgcaacaaggucucccaggagcaguccaagccccccggccccuccggcgccuccaccuccgccgccgucgaccaccccccccucccccagaccuccuccuccacccccuccaacaccuccuucacccccaaccaggagacccaggcccagcgccaggucgacgcccgccgcaacgucccccagaacgaccccgucaccgucgucguccucaaggccaccgcccccuucaaguacgagucccccgagaacggcaaguccaccauguuccacgccaccgucgccuccaagacccaguacuuccacgucaaggucuucgacaucaaccucaaggagaaguucguccgcaagaaggucaucaccaucuccgacuacuccgagugcaagggcgucauggagaucaaggaggccuccuccgucuccgacuucaaccagaacuucgagguccccaaccgcaucaucgagaucgccaacaagacccccaagaucucccagcucuacaagcaggccuccggcaccauggucuacggccucuucaugcuccagaagaaguccguccacaagaagaacaccaucuacgagauccaggacaacaccggcuccauggacgucgucggcuccggcaaguggcacaacaucaagugcgagaagggcgacaagcuccgccucuucugccuccagcuccgcaccgucgaccgcaagcucaagcucgucugcggcucccacuccuucaucaaggucaucaaggccaagaagaacaaggagggccccaugaacgucaacuga

SEQ ID NO: 46067 - RNA, 1488 nt, Artificial Sequence
  derived and/or modified sequence opt2 from MNS1__Homo_sapiens__NP_060835
augggcuccaagcgccgcaaccucuccugcuccgagcgccaccagaagcucgucgacgagaacuacugcaagaagcuccacguccaggcccucaagaacgucaacucccagauccgcaaccagaugguccagaacgagaacgacaaccgcguccagcgcaagcaguuccuccgccuccuccagaacgagcaguucgagcucgacauggaggaggccauccagaaggccgaggagaacaagcgccucaaggagcuccagcucaagcaggaggagaagcucgccauggagcucgccaagcucaagcacgagucccucaaggacgagaagaugcgccagcagguccgcgagaacuccaucgagcuccgcgagcucgagaagaagcucaaggccgccuacaugaacaaggagcgcgccgcccagaucgccgagaaggacgccaucaaguacgagcagaugaagcgcgacgccgagaucgccaagaccaugauggaggagcacaagcgcaucaucaaggaggagaacgccgccgaggacaagcgcaacaaggccaaggcccaguacuaccucgaccucgagaagcagcucgaggagcaggagaagaagaagcaggaggccuacgagcagcuccucaaggagaagcucaugaucgacgagaucguccgcaagaucuacgaggaggaccagcucgagaagcagcagaagcucgagaagaugaacgccaugcgccgcuacaucgaggaguuccagaaggagcaggcccucuggcgcaagaagaagcgcgaggagauggaggaggagaaccgcaagaucaucgaguucgccaacaugcagcagcagcgcgaggaggaccgcauggccaagguccaggagaacgaggagaagcgccuccagcuccagaacgcccucacccagaagcucgaggagaugcuccgccagcgcgaggaccucgagcagguccgccaggagcucuaccaggaggagcaggccgagaucuacaaguccaagcucaaggaggaggccgagaagaagcuccgcaagcagaaggagaugaagcaggacuucgaggagcagauggcccucaaggagcucguccuccaggccgccaaggaggaggaggagaacuuccgcaagaccaugcucgccaaguucgccgaggacgaccgcaucgagcucaugaacgcccagaagcagcgcaugaagcagcucgagcaccgccgcgccgucgagaagcucaucgaggagcgccgccagcaguuccucgccgacaagcagcgcgagcucgaggaguggcagcuccagcagcgccgccagggcuucaucaacgccaucaucgaggaggagcgccucaagcuccucaaggagcacgccaccaaccuccucggcuaccuccccaagggcgucuucaagaaggaggacgacaucgaccuccucggcgaggaguuccgcaaggucuaccagcagcgcuccgagaucugcgaggagaaguga

SEQ ID NO: 46068 - RNA, 1749 nt, Artificial Sequence
  derived and/or modified sequence opt2 from MNT__Homo_sapiens__NP_064706
auguccaucgagacccuccucgaggccgcccgcuuccucgaguggcaggcccagcagcagcagcgcgcccgcgaggagcaggagcgccuccgccucgagcaggagcgcgagcaggagcagaagaaggccaacucccucgcccgccucgcccacacccuccccgucgaggagccccgcauggaggcccccccccucccccucuccccccccgcccccccccccgcccccccccccccccucgccacccccgccccccucaccgucauccccauccccgucgucaccaacuccccccagccccucccccccccccccccccuccccgccgccgcccagccccucccccucgccccccgccagcccgcccucgucggcgcccccggccucuccaucaaggagcccgccccccuccccucccgcccccagguccccacccccgccccccuccuccccgacuccaaggccaccaucccccccaacggcucccccaagccccuccagccccuccccacccccguccucaccaucgccccccaccccggcguccagccccagcucgccccccagcagccccccccccccacccucggcacccucaagcucgcccccgccgaggaggucaaguccuccgagcagaagaagcgccccggcggcaucggcacccgcgagguccacaacaagcucgagaagaaccgccgcgcccaccucaaggagugcuucgagacccucaagcgcaacauccccaacgucgacgacaagaagaccuccaaccucuccguccuccgcaccgcccuccgcuacauccagucccucaagcgcaaggagaaggaguacgagcacgagauggagcgccucgcccgcgagaagaucgccacccagcagcgccucgccgagcucaagcacgagcucucccaguggauggacguccucgagaucgaccgcguccuccgccagaccggccagcccgaggacgaccaggccuccaccuccaccgccuccgagggcgaggacaacaucgacgaggacauggaggaggaccgcgccggccucggcccccccaagcucucccaccgcccccagcccgagcuccucaaguccacccuccccccccccuccaccacccccgccccccuccccccccacccccacccccacccccacuccgucgcccucccccccgcccaccuccccguccagcagcagcagccccagcagaagaccccccuccccgcccccccccccccccccgccgcccccgcccagacccucguccccgcccccgcccaccucgucgccaccgccggcggcggcuccaccgucaucgcccacaccgccaccacccacgccuccgucauccagaccgucaaccacguccuccagggccccggcggcaagcacaucgcccacaucgcccccuccgcccccucccccgccguccagcucgcccccgccaccccccccaucggccacaucaccguccaccccgccacccucaaccacgucgcccaccucggcucccagcucccccucuacccccagcccgucgccgucucccacaucgcccacacccucucccaccagcaggucaacggcaccgccggccucggcccccccgccaccgucauggccaagcccgccgucggcgcccaggucguccaccacccccagcucgucggccagaccguccucaaccccgucaccauggucaccaugcccuccuuccccgucuccacccucaagcucgccuga

SEQ ID NO: 46069 - RNA, 570 nt, Artificial Sequence
  derived and/or modified sequence opt2 from MNX1__Homo_sapiens__NP_001158727
augggcggccucuccaccgucggcgccugccccggcauccucggcgcccagcaggcccaggcccaguccaaccuccucggcaagugccgccgcccccgcaccgccuucaccucccagcagcuccucgagcucgagcaccaguucaagcucaacaaguaccucucccgccccaagcgcuucgaggucgccaccucccucaugcucaccgagacccaggucaagaucugguuccagaaccgccgcaugaaguggaagcgcuccaagaaggccaaggagcaggccgcccaggaggccgagaagcagaagggcggcggcggcggcgccggcaagggcggcgccgaggagcccggcgccgaggagcuccucggcccccccgcccccggcgacaagggcuccggccgccgccuccgcgaccuccgcgacuccgaccccgaggaggacgaggacgaggacgacgaggaccacuuccccuacuccaacggcgccuccguccacgccgccuccuccgacugcuccuccgaggacgacuccccccccccccgccccucccaccagcccgccccccaguga

SEQ ID NO: 46070 - RNA, 1056 nt, Artificial Sequence
  derived and/or modified sequence opt2 from MOAP1__Homo_sapiens__NP_071434
augacccuccgccuccucgaggacuggugccgcggcauggacaugaacccccgcaaggcccuccucaucgccggcaucucccaguccugcuccgucgccgagaucgaggaggcccuccaggccggccucgccccccucggcgaguaccgccuccucggccgcauguuccgccgcgacgagaaccgcaaggucgcccucgucggccucaccgccgagaccucccacgcccucguccccaaggagauccccggcaagggcggcaucuggcgcgucaucuucaagccccccgaccccgacaacaccuuccucucccgccucaacgaguuccucgccggcgagggcaugaccgucggcgagcucucccgcgcccucggccacgagaacggcucccucgaccccgagcagggcaugauccccgagaugugggcccccaugcucgcccaggcccucgaggcccuccagcccgcccuccagugccucaaguacaagaagcuccgcgucuucuccggccgcgagucccccgagcccggcgaggaggaguucggccgcuggauguuccacaccacccagaugaucaaggccuggcagguccccgacgucgagaagcgccgccgccuccucgagucccuccgcggccccgcccucgacgucauccgcguccucaagaucaacaacccccucaucaccgucgacgagugccuccaggcccucgaggaggucuucggcgucaccgacaacccccgcgagcuccaggucaaguaccucaccaccuaccagaaggacgaggagaagcucuccgccuacguccuccgccucgagccccuccuccagaagcucguccagcgcggcgccaucgagcgcgacgccgucaaccaggcccgccucgaccaggucaucgccggcgccguccacaagaccauccgccgcgagcucaaccuccccgaggacggccccgcccccggcuuccuccagcuccucguccucaucaaggacuacgaggccgccgaggaggaggaggcccuccuccaggccauccucgagggcaacuucaccuga

SEQ ID NO: 46071 - RNA, 651 nt, Artificial Sequence
  derived and/or modified sequence opt2 from MOB1A__Homo_sapiens__NP_060691
auguccuuccucuucuccucccgcuccuccaagaccuucaagcccaagaagaacauccccgagggcucccaccaguacgagcuccucaagcacgccgaggccacccucggcuccggcaaccuccgccaggccgucaugcuccccgagggcgaggaccucaacgaguggaucgccgucaacaccgucgacuucuucaaccagaucaacaugcucuacggcaccaucaccgaguucugcaccgaggccuccugccccgucauguccgccggcccccgcuacgaguaccacugggccgacggcaccaacaucaagaagcccaucaagugcuccgcccccaaguacaucgacuaccucaugaccuggguccaggaccagcucgacgacgagacccucuuccccuccaagaucggcguccccuuccccaagaacuucauguccgucgccaagaccauccucaagcgccucuuccgcgucuacgcccacaucuaccaccagcacuucgacuccgucaugcagcuccaggaggaggcccaccucaacaccuccuucaagcacuucaucuucuucguccaggaguucaaccucaucgaccgccgcgagcucgccccccuccaggagcucaucgagaagcucggcuccaaggaccgcuga

SEQ ID NO: 46072 - RNA, 651 nt, Artificial Sequence
  derived and/or modified sequence opt2 from MOB1B__Homo_sapiens__NP_775739
auguccuuccucuucggcucccgcuccuccaagaccuucaagcccaagaagaacauccccgagggcucccaccaguacgagcuccucaagcacgccgaggccacccucggcuccggcaaccuccgcauggccgucaugcuccccgagggcgaggaccucaacgagugggucgccgucaacaccgucgacuucuucaaccagaucaacaugcucuacggcaccaucaccgacuucugcaccgaggaguccugccccgucauguccgccggccccaaguacgaguaccacugggccgacggcaccaacaucaagaagcccaucaagugcuccgcccccaaguacaucgacuaccucaugaccuggguccaggaccagcucgacgacgagacccucuuccccuccaagaucggcguccccuuccccaagaacuucauguccgucgccaagaccauccucaagcgccucuuccgcgucuacgcccacaucuaccaccagcacuucgaccccgucauccagcuccaggaggaggcccaccucaacaccuccuucaagcacuucaucuucuucguccaggaguucaaccucaucgaccgccgcgagcucgccccccuccaggagcucaucgagaagcucaccuccaaggaccgcuga

SEQ ID NO: 46073 - RNA, 807 nt, Artificial Sequence
  derived and/or modified sequence opt2 from MOB2__Homo_sapiens__NP_001165694
augcucggcgaccacugcucccuccccgaggaccaggcccgccccggccagucccuccaguccggccucugcugcaagaugguccuccaggccgucuccaagguccuccgcaaguccaaggccaagcccaacggcaagaagcccgccgccgaggagcgcaaggccuaccucgagcccgagcacaccaaggcccgcaucaccgacuuccaguucaaggagcucgucguccucccccgcgagaucgaccucaacgaguggcucgccuccaacaccaccaccuucuuccaccacaucaaccuccaguacuccaccaucuccgaguucugcaccggcgagaccugccagaccauggccgucugcaacacccaguacuacugguacgacgagcgcggcaagaaggucaagugcaccgccccccaguacgucgacuucgucauguccuccguccagaagcucgucaccgacgaggacgucuuccccaccaaguacggccgcgaguuccccuccuccuucgagucccucguccgcaagaucugccgccaccucuuccacguccucgcccacaucuacugggcccacuucaaggagacccucgcccucgagcuccacggccaccucaacacccucuacguccacuucauccucuucgcccgcgaguucaaccuccucgaccccaaggagaccgccaucauggacgaccucaccgagguccucugcuccggcgccggcggcguccacuccggcggcuccggcgacggcgccggcuccggcggccccggcgcccagaaccacgucaaggagcgcuga

SEQ ID NO: 46074 - RNA, 651 nt, Artificial Sequence
  derived and/or modified sequence opt2 from MOB3B__Homo_sapiens__NP_079037
auguccaucgcccucaagcaggucuucaacaaggacaagaccuuccgccccaagcgcaaguucgagcccggcacccagcgcuucgagcuccacaagcgcgcccaggccucccucaacuccggcgucgaccucaaggccgccguccagcuccccuccggcgaggaccagaacgacugggucgccguccacgucgucgacuucuucaaccgcaucaaccucaucuacggcaccaucugcgaguucugcaccgagcgcaccugccccgucauguccggcggccccaaguacgaguaccgcuggcaggacgaccucaaguacaagaagcccaccgcccuccccgccccccaguacaugaaccuccucauggacuggaucgagguccagaucaacaacgaggagaucuuccccaccugcgucggcguccccuuccccaagaacuuccuccagaucugcaagaagauccucugccgccucuuccgcgucuucguccacgucuacauccaccacuucgaccgcgucaucgucaugggcgccgaggcccacgucaacaccugcuacaagcacuucuacuacuucgucaccgagaugaaccucaucgaccgcaaggagcucgagccccucaaggagaugaccucccgcaugugccacuga

SEQ ID NO: 46075 - RNA, 615 nt, Artificial Sequence
  derived and/or modified sequence opt2 from MOB4__Homo_sapiens__NP_001094289
auggucauggccgagggcaccgccguccuccgccgcaaccgccccggcaccaaggcccaguacauccagcagaacauccgcgccgacugcuccaacaucgacaagauccucgagccccccgagggccaggacgagggcgucuggaaguacgagcaccuccgccaguucugccucgagcucaacggccucgccgucaagcuccaguccgagugccaccccgacaccugcacccagaugaccgccaccgagcaguggaucuuccucugcgccgcccacaagacccccaaggagugccccgccaucgacuacacccgccacacccucgacggcgccgccugccuccucaacuccaacaaguacuuccccucccgcgucuccaucaaggaguccuccgucgccaagcucggcuccgucugccgccgcaucuaccgcaucuucucccacgccuacuuccaccaccgccagaucuucgacgaguacgagaacgagaccuuccucugccaccgcuucaccaaguucgucaugaaguacaaccucauguccaaggacaaccucaucguccccauccucgaggaggagguccagaacuccgucuccggcgaguccgaggccuga

SEQ ID NO: 46076 - RNA, 621 nt, Artificial Sequence
  derived and/or modified sequence opt2 from MOBP__Homo_sapiens__NP_001265251
augucccagaagcccgccaaggagggcccccgccucuccaagaaccagaaguacuccgagcacuucuccauccacugcugcccccccuucaccuuccucaacuccaagaaggagaucgucgaccgcaaguacuccaucugcaaguccggcugcuucuaccagaagaaggaggaggacuggaucugcugcgccugccagaagaccuccuccugccagcgccgccucuccucccgcggcgagcccuggcuccccccccccgccuccuucggcccccuccgcaccucccgccgcgccaaguccccccagcgccccaagcagcagcccgccgccccccccgccgucguccgcgcccccgccaagccccgcucccccccccgcuccgagcgccagccccgcucccccccccgcuccgagcgccagccccgcucccccccccgcuccgagcgccagccccgcucccccccccgcuccgagcgccagccccgcccccgccccgagguccgccccccccccgccaagcagcgccccccccagaaguccaagcagcagccccgcuccuccccccuccgcggccccggcgccucccgcggcggcucccccgucaaggccucccgcuucuga

SEQ ID NO: 46077 - RNA, 2667 nt, Artificial Sequence
  derived and/or modified sequence opt2 from MOCOS__Homo_sapiens__NP_060417
auggccggcgccgccgccgaguccggccgcgagcucuggaccuucgccggcucccgcgaccccuccgccccccgccucgccuacggcuacggccccggcucccuccgcgagcuccgcgcccgcgaguucucccgccucgccggcaccgucuaccucgaccacgccggcgccacccucuucucccagucccagcucgaguccuucaccuccgaccucauggagaacaccuacggcaacccccacucccagaacaucuccuccaagcucacccacgacaccgucgagcagguccgcuaccgcauccucgcccacuuccacaccaccgccgaggacuacaccgucaucuucaccgccggcuccaccgccgcccucaagcucgucgccgaggccuuccccugggucucccagggccccgaguccuccggcucccgcuucugcuaccucaccgacucccacaccuccgucgucggcaugcgcaacgucaccauggccaucaacgucaucuccacccccguccgccccgaggaccucugguccgccgaggagcgcuccgccuccgccuccaaccccgacugccagcucccccaccucuucugcuaccccgcccaguccaacuucuccggcguccgcuacccccucuccuggaucgaggaggucaaguccggccgccuccaccccgucuccacccccggcaagugguucguccuccucgacgccgccuccuacgucuccaccuccccccucgaccucuccgcccaccaggccgacuucguccccaucuccuucuacaagaucuucggcuuccccaccggccucggcgcccuccucguccacaaccgcgccgccccccuccuccgcaagaccuacuucggcggcggcaccgccuccgccuaccucgccggcgaggacuucuacaucccccgccaguccgucgcccagcgcuucgaggacggcaccaucuccuuccucgacgucaucgcccucaagcacggcuucgacacccucgagcgccucaccggcggcauggagaacaucaagcagcacaccuucacccucgcccaguacaccuacgucgcccucuccucccuccaguaccccaacggcgcccccgucguccgcaucuacuccgacuccgaguucuccucccccgagguccagggccccaucaucaacuucaacguccucgacgacaagggcaacaucaucggcuacucccaggucgacaagauggccucccucuacaacauccaccuccgcaccggcugcuucugcaacaccggcgccugccagcgccaccucggcaucuccaacgagaugguccgcaagcacuuccaggccggccacgucugcggcgacaacauggaccucaucgacggccagcccaccggcuccguccgcaucuccuucggcuacauguccacccucgacgacguccaggccuuccuccgcuucaucaucgacacccgccuccacuccuccggcgacuggcccgucccccaggcccacgccgacaccggcgagaccggcgcccccuccgccgacucccaggccgacgucauccccgccgucaugggccgccgcucccucuccccccaggaggacgcccucaccggcucccgcgucuggaacaacuccuccaccgucaacgccguccccgucgccccccccgucugcgacgucgcccgcacccagcccacccccuccgagaaggccgccggcguccucgagggcgcccucggcccccacgucgucaccaaccucuaccucuaccccaucaaguccugcgccgccuucgaggucacccgcuggcccgucggcaaccagggccuccucuacgaccgcuccuggauggucgucaaccacaacggcgucugccucucccagaagcaggagccccgccucugccucauccagcccuucaucgaccuccgccagcgcaucauggucaucaaggccaagggcauggagcccaucgaggucccccucgaggagaacuccgagcgcacccagauccgccagucccgcgucugcgccgaccgcgucuccaccuacgacugcggcgagaagaucuccuccuggcucuccaccuucuucggccgccccugccaccucaucaagcaguccuccaacucccagcgcaacgccaagaagaagcacggcaaggaccagcuccccggcaccauggccacccucucccucgucaacgaggcccaguaccuccucaucaacaccuccuccauccucgagcuccaccgccagcucaacaccuccgacgagaacggcaaggaggagcucuucucccucaaggaccucucccuccgcuuccgcgccaacaucaucaucaacggcaagcgcgccuucgaggaggagaagugggacgagaucuccaucggcucccuccgcuuccagguccucggccccugccaccgcugccagaugaucugcaucgaccagcagaccggccagcgcaaccagcacgucuuccagaagcucuccgagucccgcgagaccaaggucaacuucggcauguaccucaugcacgccucccucgaccucuccucccccugcuuccucuccgucggcucccagguccuccccguccucaaggagaacgucgagggccacgaccuccccgccuccgagaagcaccaggacgucaccuccuga

SEQ ID NO: 46078 - RNA, 1158 nt, Artificial Sequence
  derived and/or modified sequence opt2 from MOCS1__Homo_sapiens__NP_001068566
auggccgcccgcccccucucccgcaugcuccgccgccuccuccgcuccuccgcccgcuccugcuccuccggcgcccccgucacccagcccugccccggcgaguccgcccgcgccgccuccgaggaggucucccgccgccgccaguuccuccgcgagcacgccgcccccuucuccgccuuccucaccgacuccuucggccgccagcacuccuaccuccgcaucucccucaccgagaagugcaaccuccgcugccaguacugcaugcccgaggagggcgucccccucacccccaaggccaaccuccucaccaccgaggagauccucacccucgcccgccucuucgucaaggagggcaucgacaagauccgccucaccggcggcgagccccucauccgccccgacgucgucgacaucgucgcccagcuccagcgccucgagggccuccgcaccaucggcgucaccaccaacggcaucaaccucgcccgccuccucccccagcuccagaaggccggccucuccgccaucaacaucucccucgacacccucguccccgccaaguucgaguucaucguccgccgcaagggcuuccacaaggucauggagggcauccacaaggccaucgagcucggcuacaaccccgucaaggucaacugcgucgucaugcgcggccucaacgaggacgagcuccucgacuucgccgcccucaccgagggccucccccucgacguccgcuucaucgaguacaugcccuucgacggcaacaaguggaacuucaagaagauggucuccuacaaggagaugcucgacaccguccgccagcaguggcccgagcucgagaagguccccgaggaggaguccuccaccgccaaggccuucaagauccccggcuuccagggccagaucuccuucaucaccuccauguccgagcacuucugcggcaccugcaaccgccuccgcaucaccgccgacggcaaccucaaggucugccucuucggcaacuccgaggucucccuccgcgaccaccuccgcgccggcgccuccgagcaggagcuccuccgcaucaucggcgccgccgucggccgcaagaagcgccagcacgccggcauguucuccaucucccagaugaagaaccgccccaugauccucaucggcggcuga

SEQ ID NO: 46079 - RNA, 567 nt, Artificial Sequence
  derived and/or modified sequence opt2 from MOCS2__Homo_sapiens__NP_004522
auguccucccucgagaucuccuccuccugcuucucccucgagaccaagcucccccucucccccccccucgucgaggacuccgccuucgagcccucccgcaaggacauggacgaggucgaggagaaguccaaggacgucaucaacuucaccgccgagaagcucuccgucgacgaggucucccagcucgucaucuccccccucugcggcgccaucucccucuucgucggcaccacccgcaacaacuucgagggcaagaaggucaucucccucgaguacgaggccuaccuccccauggccgagaacgagguccgcaagaucugcuccgacauccgccagaaguggcccgucaagcacaucgccgucuuccaccgccucggccucguccccgucuccgaggccuccaucaucaucgccgucuccuccgcccaccgcgccgccucccucgaggccgucuccuacgccaucgacacccucaaggccaagguccccaucuggaagaaggagaucuacgaggaguccuccaccuggaagggcaacaaggagugcuucugggccuccaacuccuga

SEQ ID NO: 46080 - RNA, 1008 nt, Artificial Sequence
  derived and/or modified sequence opt2 from MOGAT1__Homo_sapiens__NP_477513
augaaggucgaguucgccccccucaacauccagcucgcccgccgccuccagaccgucgccguccuccaguggguccucaaguaccuccuccucggccccauguccaucggcaucaccgucaugcucaucauccacaacuaccucuuccucuacauccccuaccucauguggcucuacuucgacuggcacacccccgagcgcggcggccgccgcuccuccuggaucaagaacuggacccucuggaagcacuucaaggacuacuuccccauccaccucaucaagacccaggaccucgaccccucccacaacuacaucuucggcuuccacccccacggcaucauggccgucggcgccuucggcaacuucuccgucaacuacuccgacuucaaggaccucuuccccggcuucaccuccuaccuccacguccucccccucugguucuggugccccgucuuccgcgaguacgucauguccgucggccucgucuccgucuccaagaaguccgucuccuacauggucuccaaggagggcggcggcaacaucuccgucaucguccucggcggcgccaaggagucccucgacgcccaccccggcaaguucacccucuucauccgccagcgcaagggcuucgucaagaucgcccucacccacggcgccucccucguccccgucgucuccuucggcgagaacgagcucuucaagcagaccgacaaccccgagggcuccuggauccgcaccguccagaacaagcuccagaagaucaugggcuucgcccucccccucuuccacgcccgcggcgucuuccaguacaacuucggccucaugaccuaccgcaaggccauccacaccgucgucggccgccccauccccguccgccagacccucaaccccacccaggagcagaucgaggagcuccaccagaccuacauggaggagcuccgcaagcucuucgaggagcacaagggcaaguacggcauccccgagcacgagacccucguccucaaguga

SEQ ID NO: 46081 - RNA, 1005 nt, Artificial Sequence
  derived and/or modified sequence opt2 from MOGAT2__Homo_sapiens__NP_079374
auggucgaguucgccccccucuucaugcccugggagcgccgccuccagacccucgccguccuccaguucgucuucuccuuccucgcccucgccgagaucugcaccgucggcuucaucgcccuccucuucacccgcuucuggcuccucaccguccucuacgccgccuggugguaccucgaccgcgacaagccccgccagggcggccgccacauccaggccauccgcugcuggaccaucuggaaguacaugaaggacuacuuccccaucucccucgucaagaccgccgagcucgaccccucccgcaacuacaucgccggcuuccacccccacggcguccucgccgucggcgccuucgccaaccucugcaccgaguccaccggcuucuccuccaucuuccccggcauccgcccccaccucaugaugcucacccucugguuccgcgcccccuucuuccgcgacuacaucauguccgccggccucgucaccuccgagaaggaguccgccgcccacauccucaaccgcaagggcggcggcaaccuccucggcaucaucgucggcggcgcccaggaggcccucgacgcccgccccggcuccuucacccuccuccuccgcaaccgcaagggcuucguccgccucgcccucacccacggcgccccccucguccccaucuucuccuucggcgagaacgaccucuucgaccagauccccaacuccuccggcuccuggcuccgcuacauccagaaccgccuccagaagaucaugggcaucucccucccccucuuccacggccgcggcgucuuccaguacuccuucggccucauccccuaccgccgccccaucaccaccgucgucggcaagcccaucgagguccagaagacccuccaccccuccgaggaggaggucaaccagcuccaccagcgcuacaucaaggagcucugcaaccucuucgaggcccacaagcucaaguucaacauccccgccgaccagcaccucgaguucugcuga

SEQ ID NO: 46082 - RNA, 846 nt, Artificial Sequence
  derived and/or modified sequence opt2 from MOGAT3__Homo_sapiens__NP_001274076
augggcgucgccaccacccuccagccccccaccaccuccaagacccuccagaagcagcaccucgaggccgucggcgccuaccaguacguccucaccuuccucuucaugggccccuucuucucccuccucgucuucguccuccucuucaccucccucuggcccuucuccgucuucuaccucgucuggcucuacgucgacugggacacccccaaccagggcggccgccgcuccgaguggauccgcaaccgcgccaucuggcgccagcuccgcgacuacuaccccgucaagcucgucaagaccgccgagcucccccccgaccgcaacuacguccucggcgcccacccccacggcaucaugugcaccggcuuccucugcaacuucuccaccgaguccaacggcuucucccagcucuuccccggccuccgccccuggcucgccguccucgccggccucuucuaccuccccgucuaccgcgacuacaucauguccuucggccucugccccgucucccgccagucccucgacuucauccucucccagccccagcucggccaggccgucgucaucauggucggcggcgcccacgaggcccucuacuccguccccggcgagcacugccucacccuccagaagcgcaagggcuucguccgccucgcccuccgccacggcggccccccccacccccgcccccccgccccccccccccaccgcggcggcucccagucccucucccgcccccuccacgacggccccggcgccgcccuccgcggcgcccagggcaagcucuggggcccccgcuuccaccucccccaccuccaccucggccucgccgccgccuuccgcuga

SEQ ID NO: 46083 - RNA, 675 nt, Artificial Sequence
  derived and/or modified sequence opt2 from MOG__Homo_sapiens__NP_001008229
auggccucccucucccgccccucccuccccuccugccucugcuccuuccuccuccuccuccuccuccaggucuccuccuccuacgccggccaguuccgcgucaucggcccccgccaccccauccgcgcccucgucggcgacgaggucgagcuccccugccgcaucucccccggcaagaacgccaccggcauggaggucggcugguaccgcccccccuucucccgcgucguccaccucuaccgcaacggcaaggaccaggacggcgaccaggcccccgaguaccgcggccgcaccgagcuccucaaggacgccaucggcgagggcaaggucacccuccgcauccgcaacguccgcuucuccgacgagggcggcuucaccugcuucuuccgcgaccacuccuaccaggaggaggccgccauggagcucaaggucgaggaccccuucuacugggucucccccggcguccucguccuccucgccguccuccccguccuccuccuccagaucaccgucggccucaucuuccucugccuccaguaccgccuccgcggcaagcuccgcgccgagaucgagaaccuccaccgcaccuucgaguccuucggcguccucggcccccaggucaaggagcccaagaagaccggccaguuccucgaggagcuccgcaaccccuucuga

SEQ ID NO: 46084 - RNA, 2196 nt, Artificial Sequence
  derived and/or modified sequence opt2 from MOGS__Homo_sapiens__NP_001139630
augaagacccgcucccccaagccccuccucaccggccucaugugggcccagcagggcaccacccccggcacccccaagcuccgccacaccugcgagcagggcgacggcgucggccccuacggcugggaguuccacgacggccucuccuucggccgccagcacauccaggacggcgcccuccgccucaccaccgaguucgucaagcgccccggcggccagcacggcggcgacugguccuggcgcgucaccgucgagccccaggacuccggcaccuccgcccucccccucgucucccucuucuucuacgucgucaccgacggcaaggagguccuccuccccgaggucggcgccaagggccagcucaaguucaucuccggccacaccuccgagcucggcgacuuccgcuucacccuccucccccccaccucccccggcgacaccgcccccaaguacggcuccuacaacgucuucuggaccuccaaccccggccucccccuccucaccgagauggucaagucccgccucaacuccugguuccagcaccgcccccccggcgccccccccgagcgcuaccucggccuccccggcucccucaagugggaggaccgcggccccuccggccagggccagggccaguuccucauccagcaggucacccucaagauccccaucuccaucgaguucgucuucgaguccggcuccgcccaggccggcggcaaccaggcccucccccgccucgccggcucccuccucacccaggcccucgagucccacgccgagggcuuccgcgagcgcuucgagaagaccuuccagcucaaggagaagggccucuccuccggcgagcagguccucggccaggccgcccucuccggccuccucggcggcaucggcuacuucuacggccagggccucguccuccccgacaucggcgucgagggcuccgagcagaaggucgaccccgcccucuucccccccgucccccucuucaccgccguccccucccgcuccuucuucccccgcggcuuccucugggacgagggcuuccaccagcucgucguccagcgcugggaccccucccucacccgcgaggcccucggccacuggcucggccuccucaacgccgacggcuggaucggccgcgagcagauccucggcgacgaggcccgcgcccgcgucccccccgaguuccucguccagcgcgccguccacgccaacccccccacccuccuccuccccgucgcccacaugcucgaggucggcgaccccgacgaccucgccuuccuccgcaaggcccucccccgccuccacgccugguucuccuggcuccaccagucccaggccggcccccucccccucuccuaccgcuggcgcggccgcgaccccgcccuccccacccuccucaaccccaagacccuccccuccggccucgacgacuacccccgcgccucccaccccuccgucaccgagcgccaccucgaccuccgcugcugggucgcccucggcgcccgcguccucacccgccucgccgagcaccucggcgaggccgaggucgccgccgagcucggcccccucgccgccucccucgaggccgccgagucccucgacgagcuccacugggcccccgagcucggcgucuucgccgacuucggcaaccacaccaaggccguccagcucaagccccgccccccccagggccucguccgcgucgucggccgcccccagccccagcuccaguacgucgacgcccucggcuacgucucccucuucccccuccuccuccgccuccucgaccccaccuccucccgccucggcccccuccucgacauccucgccgacucccgccaccucuggucccccuucggccuccgcucccucgccgccuccuccuccuucuacggccagcgcaacuccgagcacgacccccccuacuggcgcggcgccgucuggcucaacgucaacuaccucgcccucggcgcccuccaccacuacggccaccucgagggcccccaccaggcccgcgccgccaagcuccacggcgagcuccgcgccaacgucgucggcaacgucuggcgccaguaccaggccaccggcuuccucugggagcaguacuccgaccgcgacggccgcggcaugggcugccgccccuuccacggcuggaccucccucguccuccucgccauggccgaggacuacuga

SEQ ID NO: 46085 - RNA, 1260 nt, Artificial Sequence
  derived and/or modified sequence opt2 from MOK__Homo_sapiens__NP_055041
augaagaacuacaaggccaucggcaagaucggcgagggcaccuucuccgaggucaugaagaugcagucccuccgcgacggcaacuacuacgccugcaagcagaugaagcagcgcuucgaguccaucgagcaggucaacaaccuccgcgagauccaggcccuccgccgccucaacccccaccccaacauccucaugcuccacgaggucgucuucgaccgcaaguccggcucccucgcccucaucugcgagcucauggacaugaacaucuacgagcucauccgcggccgccgcuacccccucuccgagaagaagaucaugcacuacauguaccagcucugcaagucccucgaccacauccaccgcaacggcaucuuccaccgcgacgucaagcccgagaacauccucaucaagcaggacguccucaagcucggcgacuucggcuccugccgcuccgucuacuccaagcagcccuacaccgaguacaucuccacccgcugguaccgcgcccccgagugccuccucaccgacggcuucuacaccuacaagauggaccucugguccgccggcugcgucuucuacgagaucgccucccuccagccccucuuccccggcgucaacgagcucgaccagaucuccaagauccacgacgucaucggcacccccgcccagaagauccucaccaaguucaagcagucccgcgccaugaacuucgacuuccccuucaagaagggcuccggcaucccccuccucaccaccaaccucuccccccagugccucucccuccuccacgccauggucgccuacgaccccgacgagcgcaucgccgcccaccaggcccuccagcaccccuacuuccaggagcagcgcaagaccgagaagcgcgcccucggcucccaccgcaaggccggcuuccccgagcaccccgucgcccccgagccccucuccaacuccugccagaucuccaaggagggccgcaagcagaagcagucccucaagcaggaggaggaccgccccaagcgccgcggccccgccuacgucauggagcuccccaagcucaagcucuccggcgucguccgccucuccuccuacuccucccccacccuccaguccguccucggcuccggcaccaacggccgcguccccguccuccgcccccucaagugcauccccgccuccaagaagaccgacccccagaaggaccucaagcccgccccccagcagugccgccuccccaccaucguccgcaagggcggccgcuga

SEQ ID NO: 46086 - RNA, 1473 nt, Artificial Sequence
  derived and/or modified sequence opt2 from MON1A__Homo_sapiens__NP_001135973
augcaccccggcggcggccccucccgcgccgagcgccucgagcucggccucggccgcgagcgccccgccaaggccaucuuccuccaccgccgccccggcgagggcggcggccgcgagcgcugccuccgcugcggccacgucugcguccgccgcggccccggcccccgcgaggccguccccuccggccgcccccgccccgacacccucaccccccccuggguccgccagcgcgccgucaccggcaccuucugcgccuccuggaccccccuccgcaaccgccgcgcccagcgcauggccaccgacaugcagcgcaagcgcuccuccgagugccucgacggcacccucacccccuccgacggccaguccauggagcgcgccgagucccccacccccggcauggcccagggcauggagcccgacggcuacaaggucgucuucguccgccgcuccccccucguccucgucgccgucgcccgcacccgccaguccgcccaggagcucgcccaggagcuccucuacaucuacuaccagauccucucccuccucaccggcgcccagcucucccacaucuuccagcagaagcagaacuacgaccuccgccgccuccucuccggcuccgagcgcaucaccgacaaccuccuccagcucauggcccgcgaccccuccuuccucaugggcgccgcccgcugccucccccucgccgccgccguccgcgacaccgucuccgccucccuccagcaggcccgcgcccgcucccucgucuucuccauccuccucgcccgcaaccagcucgucgcccucguccgccgcaaggaccaguuccuccaccccaucgaccuccaccuccucuucaaccucaucuccuccuccuccuccuuccgcgagggcgaggccuggacccccgucugccuccccaaguucaacgccgccggcuucuuccacgcccacaucuccuaccucgagcccgacaccgaccucugccuccuccucgucuccaccgaccgcgaggacuucuucgccgucuccgacugccgccgccgcuuccaggagcgccuccgcaagcgcggcgcccaccucgcccuccgcgaggcccuccgcacccccuacuacuccgucgcccaggucggcauccccgaccuccgccacuuccucuacaaguccaaguccuccggccucuucaccucccccgagaucgaggcccccuacaccuccgaggaggagcaggagcgccuccucggccucuaccaguaccuccacucccgcgcccacaacgccucccgcccccucaagaccaucuacuacaccggccccaacgagaaccuccucgccugggucaccggcgccuucgagcucuacaugugcuacuccccccucggcaccaaggccuccgccgucuccgccauccacaagcucaugcgcuggauccgcaaggaggaggaccgccucuucauccucaccccccucaccuacuga

SEQ ID NO: 46087 - RNA, 1317 nt, Artificial Sequence
  derived and/or modified sequence opt2 from MON1B__Homo_sapiens__NP_001273568
auggaggucggcggcgacaccgccgcccccgcccccggcggcgccgaggaccucgaggacacccaguuccccuccgaggaggcccgcgagggcggcggcguccacgccgucccccccgaccccgaggacgagggccucgaggagaccgaggaccacaagcucgucuuccuccagcagggcccccuccuccucgucgccaugucccgcaccucccaguccgccgcccagcuccgcggcgagcuccucgccguccacgcccagaucgucuccacccucacccgcgccuccgucgcccgcaucuucgcccacaagcagaacuacgaccuccgccgccuccucgccggcuccgagcgcacccucgaccgccuccucgacuccauggagcaggaccccggcgcccuccuccucggcgccguccgcugcgucccccucgcccgcccccuccgcgacgcccucggcgcccuccuccgccgcugcaccgcccccggccucgcccucuccguccucgccgucggcggccgccucaucaccgccgcccaggagcgcaacguccucgccgagugccgccucgaccccgccgaccuccagcuccuccucgacugggucggcgcccccgccuucgccgccggcgaggccugggcccccgucugccucccccgcuucaaccccgacggcuucuucuacgccuacgucgcccgccucgacgccaugcccgucugccuccuccuccucggcacccagcgcgaggccuuccacgccauggccgccugccgccgccucgucgaggacggcaugcacgcccucggcgccaugcgcgcccucggcgaggccgccuccuucuccaacgccuccuccgccuccgcccccgccuacuccguccaggccgucggcgcccccggccuccgccacuuccucuacaagccccucgacauccccgaccaccaccgccagcucccccaguucaccucccccgagcucgaggcccccuacucccgcgaggaggagcgccagcgccucuccgaccucuaccaccgccuccacgcccgccuccacuccaccucccgcccccuccgccucaucuaccacgucgccgagaaggagacccuccucgccugggucaccuccaaguucgagcucuacaccugccucuccccccucgucaccaaggccggcgccauccucgucgucaccaagcuccuccgcugggucaagaaggaggaggaccgccucuucauccgcuacccccccaaguacuccaccccccccgccaccuccaccgaccaggccgcccacaacggccucuucaccggccucuga

SEQ ID NO: 46088 - RNA, 5028 nt, Artificial Sequence
  derived and/or modified sequence opt2 from MON2__Homo_sapiens__NP_001265398
auguccggcaccuccucccccgaggccgucaagaagcuccucgagaacaugcaguccgaccuccgcgcccucucccucgagugcaagaagaaguucccccccgucaaggaggccgccgaguccggcaucaucaaggucaagaccaucgccgcccgcaacaccgagauccucgccgcccucaaggagaacuccuccgaggucguccagcccuuccucaugggcugcggcaccaaggagcccaagaucacccagcucugccucgccgccauccagcgccucaugucccacgaggucgucuccgagaccgccgccggcaacaucaucaacaugcucuggcagcucauggagaacucccucgaggagcucaagcuccuccagaccguccucguccuccucaccaccaacaccgucguccacgacgaggcccucuccaaggccaucguccucugcuuccgccuccacuucaccaaggacaacaucaccaacaacaccgccgccgccaccguccgccaggucgucaccgucgucuucgagcgcauggucgccgaggacgagcgccaccgcgacaucaucgagcagcccguccucguccagggcaacuccaaccgccgcuccgucuccacccucaagcccugcgccaaggacgccuacaugcucuuccaggaccucugccagcucgucaacgccgacgcccccuacuggcucgucggcaugaccgagaugacccgcaccuucggccucgagcuccucgaguccguccucaacgacuucccccaggucuuccuccagcaccaggaguucuccuuccuccucaaggagcgcgucugcccccucgucaucaagcucuucucccccaacaucaaguuccgccagggcuccuccaccuccuccucccccgcccccgucgagaagcccuacuuccccaucugcaugcgccuccuccgcgucgucuccguccucaucaagcaguucuacucccuccucgucaccgagugcgagaucuuccucucccuccucgucaaguuccucgacgccgacaagccccaguggcuccgcgccgucgccgucgaguccauccaccgcuucugcguccagccccagcuccuccgcuccuucugccaguccuacgacaugaagcagcacuccaccaaggucuuccgcgacaucgucaacgcccucggcuccuucauccagucccucuuccucgucccccccaccggcaaccccgccaccuccaaccaggccggcaacaacaaccucggcggcuccgucuccgcccccgccaacuccggcauggucggcaucggcggcggcgucacccuccuccccgccuucgaguaccgcggcaccuggauccccauccucaccaucaccguccagggcuccgccaaggccaccuaccucgagaugcucgacaaggucgagccccccaccauccccgagggcuacgccauguccgucgccuuccacugccuccucgaccucguccgcggcaucaccuccaugaucgagggcgagcucggcgagcucgagaccgagugccagaccaccaccgaggagggcuccucccccacccaguccaccgagcagcaggaccuccaguccaccuccgaccagauggacaaggagaucgucucccgcgccgucugggaggagauggucaacgccugcuggugcggccuccucgccgcccucucccuccuccucgacgccuccaccgacgaggccgccaccgagaacauccucaaggccgagcucaccauggccgcccucugcggccgccucggccucgucaccucccgcgacgccuucaucaccgccaucugcaagggcucccuccccccccacuacgcccucaccguccucaacaccaccaccgccgccacccucuccaacaaguccuacuccguccagggccaguccgucaugaugaucucccccuccuccgagucccaccagcaggucgucgccgucggccagccccucgccguccagccccagggcaccgucaugcucaccuccaagaacauccagugcaugcgcacccuccucaaccucgcccacugccacggcgccguccucggcaccuccuggcagcucguccucgccacccuccagcaccucgucuggauccucggccucaagcccuccuccggcggcgcccucaagcccggccgcgccgucgagggccccuccaccguccucaccaccgccgucaugaccgaccuccccgucaucuccaacauccucucccgccucuucgaguccucccaguaccucgacgacgucucccuccaccaccucaucaacgcccucugcucccucucccucgaggccauggacauggccuacggcaacaacaaggagcccucccucuucgccgucgccaagcuccucgagaccggccucgucaacaugcaccgcaucgagauccucuggcgcccccucaccggccaccuccucgaggucugccagcaccccaacucccgcaugcgcgaguggggcgccgaggcccucaccucccucaucaaggccggccucaccuucaaccacgaccccccccucucccagaaccagcgccuccagcuccuccuccucaacccccucaaggagauguccaacaucaaccaccccgacauccgccucaagcagcucgagugcguccuccagauccuccagucccagggcgacucccucggccccggcuggccccucguccucggcgucaugggcgccauccgcaacgaccagggcgagucccucauccgcaccgccuuccagugccuccagcucgucgucaccgacuuccuccccaccaugcccugcaccugccuccagaucgucgucgacgucgccggcuccuucggccuccacaaccaggagcucaacaucucccucaccuccaucggccuccucuggaacaucuccgacuacuucuuccagcgcggcgagaccaucgagaaggagcucaacaaggaggaggccgcccagcagaagcaggccgaggagaagggcgucguccucaaccgccccuuccaccccgccccccccuucgacugccucuggcucugccucuacgccaagcucggcgagcucugcgucgacccccgccccgccguccgcaaguccgccggccagacccucuucuccaccaucggcgcccacggcacccuccuccagcacuccaccuggcacaccgucaucuggaagguccucuuccaccuccucgaccgcguccgcgaguccuccaccaccgccgacaaggagaagaucgaguccggcggcggcaacauccucauccaccacucccgcgacaccgccgagaagcagugggccgagaccuggguccucacccucgccggcgucgcccgcaucuucaacacccgccgcuaccuccuccagccccucggcgacuucucccgcgccugggacguccuccucgaccacauccaguccgccgcccucuccaagaacaacgaggucucccucgccgcccucaaguccuuccaggagauccuccagaucgucucccccguccgcgacuccgacaagcccgagaccccccccgucgucaacguccccguccccguccucaucggccccaucuccggcaugucccgccccuucguccgcaccgacuccaucggcgagaagcucggccgcuacuccuccuccgagccccccaucgucaccgacgagcucgaggaccucaaccucuggugggccgccuggaacaccugguaccgcaucggcuccgaguccaccaagccccccaucaccuucgacaagcucaccuucauccccucccagcccuuccucaccgcccucauccagaucuuccccgcccucuaccagcacaucaagaccggcuucaacauggacgaccuccagaagcucggcgucauccuccacuccgccaucuccguccccaucuccuccgacgccucccccuucauccuccccuccuacaccgaggccguccucaccucccuccaggaggccguccucaccgcccucgacguccuccagaaggccaucugcgucggccccgagaacaugcagaucauguaccccgccaucuucgaccagcuccucgccuucgucgaguucuccugcaagcccccccaguacggccagcucgagaccaagcacaucgccaacgccaaguacaaccagauccagcucuucgcccccgccgagugggucgcccucaacuacguccccuucgccgagcgcucccucgaggucgucgucgaccucuaccagaagaccgccugccacaaggccgucgucaacgagaagguccuccagaacaucaucaagacccuccgcgucccccucucccucaaguacuccugccccuccgaguccaccuggaagcucgccgucuccucccuccuccgcguccucuccaucggccuccccgucgcccgccagcacgccuccuccggcaaguucgacuccauguggcccgagcucgccaacaccuucgaggacuuccucuucaccaaguccaucccccccgacaaccucuccauccaggaguuccagcgcaacgagaacaucgacgucgaggucguccagcucaucuccaacgagauccuccccuacgccaacuucauccccaaggaguucgucggccagaucaugaccaugcucaacaagggcuccauccacucccaguccuccuccuucaccgaggccgagaucgacauccgccuccgcgaggaguucuccaagaugugcuucgagacccuccuccaguucuccuucuccaacaaggucaccaccccccaggagggcuacaucucccgcauggcccucuccguccuccucaagcgcucccaggacguccuccaccgcuacaucgaggacgagcgccucuccggcaagugcccccucccccgccagcaggucaccgagaucaucuucguccucaaggccgucuccacccucaucgacucccucaagaagacccagcccgagaacgccugcaucucccucuucggcaucccccccuacuucuga

SEQ ID NO: 46089 - RNA, 2820 nt, Artificial Sequence
  derived and/or modified sequence opt2 from MORC3__Homo_sapiens__NP_056173
auggccgcccagcccccccgcggcauccgccucuccgcccucugccccaaguuccuccacaccaacuccaccucccacaccuggcccuucuccgccgucgccgagcucaucgacaacgccuacgaccccgacgucaacgccaagcagaucuggaucgacaagaccgucaucaacgaccacaucugccucaccuucaccgacaacggcaacggcaugaccuccgacaagcuccacaagaugcucuccuucggcuucuccgacaaggucaccaugaacggccacguccccgucggccucuacggcaacggcuucaaguccggcuccaugcgccucggcaaggacgccaucgucuucaccaagaacggcgaguccauguccgucggccuccucucccagaccuaccucgaggucaucaaggccgagcacgucgucguccccaucgucgccuucaacaagcaccgccagaugaucaaccucgccgaguccaaggccucccucgccgccauccucgagcacucccucuucuccaccgagcagaagcuccucgccgagcucgacgccaucaucggcaagaagggcacccgcaucaucaucuggaaccuccgcuccuacaagaacgccaccgaguucgacuucgagaaggacaaguacgacauccgcauccccgaggaccucgacgagaucaccggcaagaagggcuacaagaagcaggagcgcauggaccagaucgcccccgaguccgacuacucccuccgcgccuacugcuccauccucuaccucaagccccgcaugcagaucauccuccgcggccagaaggucaagacccagcucgucuccaagucccucgccuacaucgagcgcgacgucuaccgccccaaguuccucuccaagaccguccgcaucaccuucggcuucaacugccgcaacaaggaccacuacggcaucaugauguaccaccgcaaccgccucaucaaggccuacgagaaggucggcugccagcuccgcgccaacaacaugggcgucggcgucgucggcaucaucgagugcaacuuccucaagcccacccacaacaagcaggacuucgacuacaccaacgaguaccgccucaccaucaccgcccucggcgagaagcucaacgacuacuggaacgagaugaaggucaagaagaacaccgaguacccccucaaccuccccgucgaggacauccagaagcgccccgaccagaccuggguccagugcgacgccugccucaaguggcgcaagcuccccgacggcauggaccagcuccccgagaagugguacugcuccaacaaccccgacccccaguuccgcaacugcgagguccccgaggagcccgaggacgaggaccucguccaccccaccuacgagaagaccuacaagaagaccaacaaggagaaguuccgcauccgccagcccgagaugaucccccgcaucaacgccgagcuccucuuccgccccaccgcccucuccacccccuccuucuccucccccaaggaguccgucccccgccgccaccucuccgagggcaccaacuccuacgccacccgccuccucaacaaccaccagguccccccccaguccgagcccgaguccaacucccucaagcgccgccucuccacccgcuccuccauccucaacgccaagaaccgccgccucuccucccaguucgagaacuccgucuacaagggcgacgacgacgacgaggacgucaucauccucgaggagaacuccacccccaagcccgccgucgaccacgacaucgacaugaaguccgagcagucccacgucgagcagggcggcguccaggucgaguucgucggcgacuccgagcccugcggccagaccggcuccaccuccaccuccuccucccgcugcgaccagggcaacaccgccgccacccagaccgagguccccucccucgucgucaagaaggaggagaccgucgaggacgagaucgacguccgcaacgacgccgucauccuccccuccugcgucgaggccgaggccaagauccacgagacccaggagaccaccgacaaguccgccgacgacgccggcugccagcuccaggagcuccgcaaccagcuccuccucgucaccgaggagaaggagaacuacaagcgccagugccacauguucaccgaccagaucaagguccuccagcagcgcauccucgagaugaacgacaaguacgucaagaaggagaccugccaccaguccaccgagaccgacgccgucuuccuccucgaguccaucaacggcaaguccgagucccccgaccacauggucucccaguaccagcaggcccucgaggagaucgagcgccucaagaagcagugcuccgcccuccagcacgucaaggccgagugcucccagugcuccaacaacgaguccaaguccgagauggacgagauggccguccagcucgacgacgucuuccgccagcucgacaagugcuccaucgagcgcgaccaguacaaguccgaggucgagcuccucgagauggagaagucccagauccgcucccagugcgaggagcucaagaccgaggucgagcagcucaaguccaccaaccagcagaccgccaccgacgucuccaccuccuccaacaucgaggaguccgucaaccacauggacggcgagucccucaagcuccgcucccuccgcgucaacgucggccagcuccucgccaugaucguccccgaccucgaccuccagcaggucaacuacgacgucgacgucgucgacgagauccucggccaggucgucgagcagauguccgagaucuccuccaccuga

SEQ ID NO: 46090 - RNA, 708 nt, Artificial Sequence
  derived and/or modified sequence opt2 from MORF4L1__Homo_sapiens__NP_001252534
augcgcggcgccgcccccggcaagaagaccuccggccuccagcagaagaacgucgaggucaagaccaagaagaacaagcagaagacccccggcaacggcgacggcggcuccaccuccgagaccccccagcccccccgcaagaagcgcgcccgcgucgaccccaccgucgagaacgaggagaccuucaugaaccgcgucgaggucaaggucaagauccccgaggagcucaagcccuggcucgucgacgacugggaccucaucacccgccagaagcagcucuucuaccuccccgccaagaagaacgucgacuccauccucgaggacuacgccaacuacaagaagucccgcggcaacaccgacaacaaggaguacgccgucaacgaggucgucgccggcaucaaggaguacuucaacgucaugcucggcacccagcuccucuacaaguucgagcgcccccaguacgccgagauccucgccgaccaccccgacgcccccaugucccaggucuacggcgccccccaccuccuccgccucuucguccgcaucggcgccaugcucgccuacaccccccucgacgagaagucccucgcccuccuccucaacuaccuccacgacuuccucaaguaccucgccaagaacuccgccacccucuucuccgccuccgacuacgaggucgccccccccgaguaccaccgcaaggccgucuga

SEQ ID NO: 46091 - RNA, 1053 nt, Artificial Sequence
  derived and/or modified sequence opt2 from MORN1__Homo_sapiens__NP_001287989
auggccgccgccggcgagggcacccccuccucccgcggcccccgccgcgaccccccccgccgccccccccgcaacggcuacggcgucuacgucuaccccaacuccuucuuccgcuacgagggcgaguggaaggccggccgcaagcacggccacggcaagcuccucuucaaggacggcuccuacuacgagggcgccuucgucgacggcgagaucaccggcgagggccgccgccacugggccugguccggcgacaccuucuccggccaguucguccucggcgagccccagggcuacggcgucauggaguacaaggccggcggcugcuacgagggcgaggucucccacggcaugcgcgagggccacggcuuccucgucgaccgcgacggccaggucuaccagggcuccuuccacgacaacaagcgccacggccccggccagaugcucuuccagaacggcgacaaguacgacggcgacuggguccgcgaccgccgccagggccacggcguccuccgcugcgccgacggcuccaccuacaagggccaguggcacuccgacgucuucuccggccucggcuccauggcccacugcuccggcgucaccuacuacggccucuggaucaacggccaccccgccgagcaggccacccgcaucgucauccucggccccgaggucauggaggucgcccagggcucccccuucuccgucaacguccagcuccuccaggaccacggcgagaucgccaaguccgaguccggccgcguccuccagaucuccgccggcguccgcuacguccagcucuccgccuacuccgaggucaacuucuucaaggucgaccgcgacaaccaggagacccucauccagacccccuucggcuucgagugcauccccuaccccgucuccucccccgccgccggcguccccggcccccgcgccgccaagggcggcgccgaggccgacgucccccucccccgcggcgaccucgagcuccaccucggcgcccuccacggccaggaggacacccccggcggccuccucggcuccucccucuucuga

SEQ ID NO: 46092 - RNA, 240 nt, Artificial Sequence
  derived and/or modified sequence opt2 from MORN2__Homo_sapiens__NP_001138922
augaacggcuucggccgccucgagcacuucuccggcgccgucuacgagggccaguucaaggacaacauguuccacggccucggcaccuacaccuuccccaacggcgccaaguacaccggcaacuucaacgagaaccgcgucgagggcgagggcgaguacaccgacauccagggccucgagugguccggcaacuuccacuucaccgccgcccccgaccucaagcucaagcuccacauguga

SEQ ID NO: 46093 - RNA, 486 nt, Artificial Sequence
  derived and/or modified sequence opt2 from MORN5__Homo_sapiens__NP_940871
auggaguacaccggcuccaaguacaucggcgaguacgucgacggccgcauggagggcaaggccaaguacauccuccccaccgagaccaucuacgucggcgagaugaaggacggcauguuccacggcgagggcacccucuacuuccccuccggcucccaguacgacgccaucugggagaacggccucgccaucaagggcaccuacaccuucuccgacggccuccacuacgacgagaagaacuggcacuacugcgacggcuacgaccgccgcuucuacaccgagauccucaacggccucaagcccgccggcauggcccagcucaccaacauggaccccccccgcaagauccccaagggcuacuacgacugcggcgacggcuucuacaaccccgucacccgcgucgucaaggacuaccgcaaccgcuuccuccgcaacgccgacgacgacgagcacgaguggaucacccgcaccugccgcaagggcuga

SEQ ID NO: 46094 - RNA, 1041 nt, Artificial Sequence
  derived and/or modified sequence opt2 from MOS__Homo_sapiens__NP_005363
augcccuccccccucgcccuccgccccuaccuccgcuccgaguucucccccuccgucgacgcccgccccugcuccucccccuccgagcuccccgccaagcuccuccucggcgccacccucccccgcgccccccgccucccccgccgccucgccuggugcuccaucgacugggagcaggucugccuccuccagcgccucggcgccggcggcuucggcuccgucuacaaggccaccuaccgcggcguccccgucgccaucaagcaggucaacaagugcaccaagaaccgccucgccucccgccgcuccuucugggccgagcucaacgucgcccgccuccgccacgacaacaucguccgcgucgucgccgccuccacccgcacccccgccggcuccaacucccucggcaccaucaucauggaguucggcggcaacgucacccuccaccaggucaucuacggcgccgccggccaccccgagggcgacgccggcgagccccacugccgcaccggcggccagcucucccucggcaagugccucaaguacucccucgacgucgucaacggccuccucuuccuccacucccaguccaucguccaccucgaccucaagcccgccaacauccucaucuccgagcaggacgucugcaagaucuccgacuucggcugcuccgagaagcucgaggaccuccucugcuuccagacccccuccuacccccucggcggcaccuacacccaccgcgcccccgagcuccucaagggcgagggcgucacccccaaggccgacaucuacuccuucgccaucacccucuggcagaugaccaccaagcaggcccccuacuccggcgagcgccagcacauccucuacgccgucgucgccuacgaccuccgccccucccucuccgccgccgucuucgaggacucccuccccggccagcgccucggcgacgucauccagcgcugcuggcgccccuccgccgcccagcgccccuccgcccgccuccuccucgucgaccucaccucccucaaggccgagcucggcuga

SEQ ID NO: 46095 - RNA, 3498 nt, Artificial Sequence
  derived and/or modified sequence opt2 from MOV10L1__Homo_sapiens__NP_001157576
augcucucccucgccgccaagcucgucgccuucuucuggcgcaccgccgacaccccccgcgaggaggccggccagcucgagcccgagcucgccgagggcgacaccaagcucaagaccguccgcggcgucgucacccgcuacugcuccgacuacggcaugaucgacgacaugaucuacuucuccuccgacgccgucaccucccgcguccuccucaacgucggccaggaggucaucgccgucgucgaggagaacaaggucuccaacggccucaaggccauccgcgucgaggccgucuccgacaagugggaggacgacucccgcaaccacggcucccccuccgacugcggcccccgcguccucaucggcugcgucaccucccucgucgagggcgccggcugcaucucccagaccaccuacuucucccucgaguccgucugcgagggcuucgagcccugcaagggcgacugggucgaggccgaguaccgcauccgccccggcaccugguccuccgaggccaccuccgucaagccccuccgcuacaagcgcgucgacaaggucugcaucuccucccucugcggccgcaacggcguccucgaggaguccaucuucuucacccucgacucccucaagcuccccgacggcuacaccccccgccgcggcgacgucgucaacgccgucgucgucgaguccucccaguccugcuacgucuggcgcgcccucugcaugacccucgucaagcgccgcgacgccgcccccguccacgaggccacccacuucuacggcaccauccuccucaagaacaagggcgacaucgaggucacccaggucacccacuucggcacccucaaggagggccgcuccaagaccauggucaucuggaucgagaacaagggcgacaucccccagaaccucgucuccugcaagcucgccggcugggacaaguccaagcaguuccgcuuccagaugcucgacaaggaccagaugugccccgucgucuccuucgucuccguccccgagaaggagaacuccuccgacgagaacaucaacucccucaacucccacaccaagaacaagaccucccagauguccgaguccucccucgucaacaaccgcggcaucucccccggcgacugcaccugcaagggcgagaacggcgagaaggacaacauccucucccgcaagcagaugaccgagcccgagcccggcggccucgucccccccggcggcaagaccuucaucgucgucaucugcgacggcaagaaccccggccgcugcaaggagcuccuccuccucugcuucuccgacuuccucaucggccgcuaccucgaggucaacgucaucuccggcgaggagucccucaucgccgcccgcgagcccuucuccuggaagaagcucaaguccucccaggcccucaccuccgccaagaccaccgucgucgucaccgcccagaagcgcaacucccgccgccagcuccccuccuuccucccccaguaccccauccccgaccgccuccgcaagugcgucgagcagaagaucgacauccucaccuuccagccccuccucgccgagcuccucaacauguccaacuacaaggagaaguucuccacccuccucuggcucgaggagaucuacgccgagauggagcucaaggaguacaacauguccggcaucauccuccgccgcaacggcgaccuccucguccucgagguccccggccucgccgagggccgccccucccucuacgccggcgacaagcucauccucaagacccaggaguacaacggccacgccaucgaguacaucuccuacgucaccgagauccacgaggaggacgucacccucaagaucaaccccgaguucgagcaggccuacaacuucgagcccauggacgucgaguucaccuacaaccgcaccaccucccgccgcugccacuucgcccucgagcacgucauccaccucggcgucaagguccucuuccccgaggagaucauccuccaguccccccaggucaccggcaacuggaaccacgcccaggacaccaaguccuccggccaguccaccuccaagaagaaccgcaagaccaugaccgaccaggccgagcacggcaccgaggagcgccgcgucggcgacaaggaccuccccguccucgcccccuucaccgccgagauguccgacugggucgacgagauccagacccccaaggcccgcaagauggaguucuucaaccccguccucaacgagaaccagaagcucgccgucaagcgcauccucuccggcgacugccgcccccuccccuacauccucuucggcccccccggcaccggcaagaccgucaccaucaucgaggccguccuccagguccacuucgcccuccccgacucccgcauccucgucugcgcccccuccaacuccgccgccgaccucgucugccuccgccuccacgaguccaagguccuccagcccgccaccaugguccgcgucaacgccaccugccgcuucgaggagaucgucaucgacgccgucaagcccuacugccgcgacggcgaggacaucuggaaggccucccgcuuccgcaucaucaucaccaccugcuccuccuccggccucuucuaccagaucggcguccgcgucggccacuucacccacgucuucgucgacgaggccggccaggccuccgagcccgagugccucaucccccucggccucauguccgacaucuccggccagaucguccucgccggcgaccccaugcagcucggccccgucaucaagucccgccucgccauggccuacggccucaacgucuccuuccucgagcgccucaugucccgccccgccuaccagcgcgacgagaacgccuucggcgccugcggcgcccacaacccccuccucgucaccaagcucgucaagaacuaccgcucccacgaggcccuccucaugcuccccucccgccucuucuaccaccgcgagcucgaggucugcgccgaccccaccgucgucaccucccuccucggcugggagaagcuccccaagaagggcuucccccucaucuuccacggcguccgcggcuccgaggcccgcgagggcaagucccccuccugguucaaccccgccgaggccguccagguccuccgcuacugcugccuccucgcccacuccaucuccucccaggucuccgccuccgacaucggcgucaucacccccuaccgcaagcaggucgagaagauccgcauccuccuccgcaacgucgaccucauggacaucaaggucggcuccgucgaggaguuccagggccaggaguaccucgucaucaucaucuccaccgaccccugcuucggcgcccuccucgaguacuccaucaccaacggcgucuacaugggcugcgaccucccccccgcccuccagucccuccagaacugcggcgagggcgucgccgaccccuccuaccccgucguccccgaguccaccggccccgagaagcaccaggagcccuccuga

SEQ ID NO: 46096 - RNA, 201 nt, Artificial Sequence
  derived and/or modified sequence opt2 from MPC1__Homo_sapiens__NP_001257808
augaagaagucccccgagaucaucuccggccgcaugaccuucgcccucugcugcuacucccucaccuucaugcgcuucgccuacaagguccagccccgcaacuggcuccucuucgccugccacgccaccaacgaggucgcccagcucauccagggcggccgccucaucaagcacgagaugaccaagaccgccuccgccuga

SEQ ID NO: 46097 - RNA, 384 nt, Artificial Sequence
  derived and/or modified sequence opt2 from MPC2__Homo_sapiens__NP_001137146
auguccgccgccggcgcccgcggccuccgcgccaccuaccaccgccuccucgacaaggucgagcucaugcuccccgagaagcuccgcccccucuacaaccaccccgccggcccccgcaccgucuucuucugggcccccaucaugaaguggggccucgucugcgccggccucgccgacauggcccgccccgccgagaagcucuccaccgcccaguccgccguccucauggccaccggcuucaucuggucccgcuacucccucgucaucauccccaagaacuggucccucuucgccgucaacuucuucgucggcgccgccggcgccucccagcucuuccgcaucuggcgcuacaaccaggagcucaaggccaaggcccacaaguga

SEQ ID NO: 46098 - RNA, 744 nt, Artificial Sequence
  derived and/or modified sequence opt2 from MPDU1__Homo_sapiens__NP_004861
auggccgccgaggccgacggcccccucaagcgccuccucguccccauccuccuccccgagaagugcuacgaccagcucuucguccagugggaccuccuccacguccccugccucaagauccuccucuccaagggccucggccucggcaucgucgccggcucccuccucgucaagcucccccaggucuucaagauccucggcgccaaguccgccgagggccucucccuccaguccgucaugcucgagcucgucgcccucaccggcaccauggucuacuccaucaccaacaacuuccccuucuccuccuggggcgaggcccucuuccucaugcuccagaccaucaccaucugcuuccucgucaugcacuaccgcggccagaccgucaagggcgucgccuuccucgccugcuacggccucguccuccucguccuccucuccccccucaccccccucaccgucgucacccuccuccaggccuccaacguccccgccgucgucgucggccgccuccuccaggccgccaccaacuaccacaacggccacaccggccagcucuccgccaucaccgucuuccuccucuucggcggcucccucgcccgcaucuucaccuccauccaggagaccggcgacccccucauggccggcaccuucgucgucuccucccucugcaacggccucaucgccgcccagcuccucuucuacuggaacgccaagcccccccacaagcagaagaaggcccaguga

SEQ ID NO: 46099 - RNA, 6114 nt, Artificial Sequence
  derived and/or modified sequence opt2 from MPDZ__Homo_sapiens__NP_001248335
augcucgaggccaucgacaagaaccgcgcccuccacgccgccgagcgccuccagaccaagcuccgcgagcgcggcgacgucgccaacgaggacaagcucucccuccucaaguccguccuccaguccccccucuucucccagauccucucccuccagaccuccguccagcagcucaaggaccaggucaacaucgccaccuccgccaccuccaacaucgaguacgcccacgucccccaccucucccccgccgucauccccacccuccagaacgaguccuuccuccucucccccaacaacggcaaccucgaggcccucaccggccccggcaucccccacaucaacggcaagcccgccugcgacgaguucgaccagcucaucaagaacauggcccagggccgccacgucgaggucuucgagcuccucaagccccccuccggcggccucggcuucuccgucgucggccuccgcuccgagaaccgcggcgagcucggcaucuucguccaggagauccaggagggcuccgucgcccaccgcgacggccgccucaaggagaccgaccagauccucgccaucaacggccaggcccucgaccagaccaucacccaccagcaggccaucuccauccuccagaaggccaaggacaccguccagcucgucaucgcccgcggcucccucccccagcucgucucccccaucgucucccgcucccccuccgccgccuccaccaucuccgcccacuccaaccccguccacuggcagcacauggagaccaucgagcucgucaacgacggcuccggccucggcuucggcaucaucggcggcaaggccaccggcgucaucgucaagaccauccuccccggcggcgucgccgaccagcacggccgccucugcuccggcgaccacauccucaagaucggcgacaccgaccucgccggcauguccuccgagcaggucgcccagguccuccgccagugcggcaaccgcgucaagcucaugaucgcccgcggcgccaucgaggagcgcaccgcccccaccgcccucggcaucacccucuccuccucccccaccuccacccccgagcuccgcgucgacgccuccacccagaagggcgaggaguccgagaccuucgacgucgagcucaccaagaacguccagggccucggcaucaccaucgccggcuacaucggcgacaagaagcucgagcccuccggcaucuucgucaaguccaucaccaaguccuccgccgucgagcacgacggccgcauccagaucggcgaccagaucaucgccgucgacggcaccaaccuccagggcuucaccaaccagcaggccgucgagguccuccgccacaccggccagaccguccuccucacccucaugcgccgcggcaugaagcaggaggccgagcucaugucccgcgaggacgucaccaaggacgccgaccucucccccgucaacgccuccaucaucaaggagaacuacgagaaggacgaggacuuccucuccuccacccgcaacaccaacauccuccccaccgaggaggagggcuacccccuccucuccgccgagaucgaggagaucgaggacgcccagaagcaggaggccgcccuccucaccaaguggcagcgcaucaugggcaucaacuacgagaucgucgucgcccacgucuccaaguucuccgagaacuccggccucggcaucucccucgaggccaccgucggccaccacuucauccgcuccguccuccccgagggccccgucggccacuccggcaagcucuucuccggcgacgagcuccucgaggucaacggcaucacccuccucggcgagaaccaccaggacgucgucaacauccucaaggagcuccccaucgaggucaccauggucugcugccgccgcaccgucccccccaccacccaguccgagcucgacucccucgaccucugcgacaucgagcucaccgagaagccccacgucgaccucggcgaguucaucggcuccuccgagaccgaggaccccguccucgccaugaccgacgccggccaguccaccgaggagguccaggccccccucgccaugugggaggccggcauccagcacaucgagcucgagaagggcuccaagggccucggcuucuccauccucgacuaccaggaccccaucgaccccgccuccaccgucaucaucauccgcucccucguccccggcggcaucgccgagaaggacggccgccuccuccccggcgaccgccucauguucgucaacgacgucaaccucgagaacuccucccucgaggaggccgucgaggcccucaagggcgcccccuccggcaccguccgcaucggcgucgccaagccccucccccucucccccgaggagggcuacgucuccgccaaggaggacuccuuccucuaccccccccacuccugcgaggaggccggccucgccgacaagccccucuuccgcgccgaccucgcccucgucggcaccaacgacgccgaccucgucgacgaguccaccuucgagucccccuacucccccgagaacgacuccaucuacuccacccaggccuccauccucucccuccacggcuccuccugcggcgacggccucaacuacggcuccucccuccccuccuccccccccaaggacgucaucgagaacuccugcgaccccguccucgaccuccacaugucccucgaggagcucuacacccagaaccuccuccagcgccaggacgagaacacccccuccgucgacaucuccaugggccccgccuccggcuucaccaucaacgacuacacccccgccaacgccaucgagcagcaguacgagugcgagaacaccaucgucuggaccgagucccaccuccccuccgaggucaucuccuccgccgagcuccccuccguccuccccgacuccgccggcaagggcuccgaguaccuccucgagcaguccucccucgccugcaacgccgagugcgucaugcuccagaacgucuccaaggaguccuucgagcgcaccaucaacaucgccaagggcaacuccucccucggcaugaccgucuccgccaacaaggacggccucggcaugaucguccgcuccaucauccacggcggcgccaucucccgcgacggccgcaucgccaucggcgacugcauccucuccaucaacgaggaguccaccaucuccgucaccaacgcccaggcccgcgccaugcuccgccgccacucccucaucggccccgacaucaagaucaccuacguccccgccgagcaccucgaggaguucaagaucucccucggccagcaguccggccgcgucauggcccucgacaucuucuccuccuacaccggccgcgacauccccgagcuccccgagcgcgaggagggcgagggcgaggaguccgagcuccagaacaccgccuacuccaacuggaaccagccccgccgcgucgagcucuggcgcgagcccuccaagucccucggcaucuccaucgucggcggccgcggcaugggcucccgccucuccaacggcgaggucaugcgcggcaucuucaucaagcacguccucgaggacucccccgccggcaagaacggcacccucaagcccggcgaccgcaucgucgaggucgacggcauggaccuccgcgacgccucccacgagcaggccgucgaggccauccgcaaggccggcaaccccgucgucuucaugguccaguccaucaucaaccgcccccgcgcccccucccaguccgaguccgagcccgagaaggccccccucugcuccguccccccccccccccccuccgccuucgccgagaugggcuccgaccacacccaguccuccgccuccaagaucucccaggacgucgacaaggaggacgaguucggcuacuccuggaagaacauccgcgagcgcuacggcacccucaccggcgagcuccacaugaucgagcucgagaagggccacuccggccucggccucucccucgccggcaacaaggaccgcucccgcauguccgucuucaucgucggcaucgaccccaacggcgccgccggcaaggacggccgccuccagaucgccgacgagcuccucgagaucaacggccagauccucuacggccgcucccaccagaacgccuccuccaucaucaagugcgcccccuccaaggucaagaucaucuucauccgcaacaaggacgccgucaaccagauggccgucugccccggcaacgccgucgagccccuccccuccaacuccgagaaccuccagaacaaggagaccgagcccaccgucaccaccuccgacgccgccgucgaccucuccuccuucaagaacguccagcaccucgagcuccccaaggaccagggcggccucggcaucgccaucuccgaggaggacacccucuccggcgucaucaucaagucccucaccgagcacggcgucgccgccaccgacggccgccucaaggucggcgaccagauccucgccgucgacgacgagaucgucgucggcuaccccaucgagaaguucaucucccuccucaagaccgccaagaugaccgucaagcucaccauccacgccgagaaccccgacucccaggccguccccuccgccgccggcgccgccuccggcgagaagaagaacuccucccagucccucauggucccccaguccggcucccccgagcccgaguccauccgcaacaccucccgcuccuccacccccgccaucuucgccuccgaccccgccaccugccccaucauccccggcugcgagaccaccaucgagaucuccaagggccgcaccggccucggccucuccaucgucggcggcuccgacacccuccucggcgccaucaucauccacgaggucuacgaggagggcgccgccugcaaggacggccgccucugggccggcgaccagauccucgaggucaacggcaucgaccuccgcaaggccacccacgacgaggccaucaacguccuccgccagaccccccagcgcguccgccucacccucuaccgcgacgaggcccccuacaaggaggaggaggucugcgacacccucaccaucgagcuccagaagaagcccggcaagggccucggccucuccaucgucggcaagcgcaacgacaccggcgucuucgucuccgacaucgucaagggcggcaucgccgacgccgacggccgccucaugcagggcgaccagauccucauggucaacggcgaggacguccgcaacgccacccaggaggccgucgccgcccuccucaagugcucccucggcaccgucacccucgaggucggccgcaucaaggccggccccuuccacuccgagcgccgccccucccaguccucccaggucuccgagggcucccucuccuccuucaccuucccccucuccggcuccuccaccuccgagucccucgaguccuccuccaagaagaacgcccucgccuccgagauccagggccuccgcaccgucgagaugaagaagggccccaccgacucccucggcaucuccaucgccggcggcgucggcuccccccucggcgacguccccaucuucaucgccaugaugcaccccaccggcgucgccgcccagacccagaagcuccgcgucggcgaccgcaucgucaccaucugcggcaccuccaccgagggcaugacccacacccaggccgucaaccuccucaagaacgccuccggcuccaucgagaugcaggucgucgccggcggcgacgucuccgucgucaccggccaccagcaggagcccgccuccuccucccucuccuucaccggccucaccuccuccuccaucuuccaggacgaccucggccccccccagugcaaguccaucacccucgagcgcggccccgacggccucggcuucuccaucgucggcggcuacggcuccccccacggcgaccuccccaucuacgucaagaccgucuucgccaagggcgccgccuccgaggacggccgccucaagcgcggcgaccagaucaucgccgucaacggccagucccucgagggcgucacccacgaggaggccgucgccauccucaagcgcaccaagggcaccgucacccucaugguccucuccuga

SEQ ID NO: 46100 - RNA, 2151 nt, Artificial Sequence
  derived and/or modified sequence opt2 from MPEG1__Homo_sapiens__NP_001034485
augaacaacuuccgcgccaccauccucuucugggccgccgccgccugggccaaguccggcaagcccuccggcgagauggacgaggucggcguccagaagugcaagaacgcccucaagcuccccguccucgagguccuccccggcggcggcugggacaaccuccgcaacgucgacaugggccgcgucauggagcucaccuacuccaacugccgcaccaccgaggacggccaguacaucauccccgacgagaucuucaccaucccccagaagcaguccaaccucgagaugaacuccgagauccucgaguccugggccaacuaccaguccuccaccuccuacuccaucaacaccgagcucucccucuucuccaaggucaacggcaaguucuccaccgaguuccagcgcaugaagacccuccaggucaaggaccaggccaucaccacccgcguccagguccgcaaccucgucuacaccgucaagaucaaccccacccucgagcucuccuccggcuuccgcaaggagcuccucgacaucuccgaccgccucgagaacaaccagacccgcauggccaccuaccucgccgagcuccucguccucaacuacggcacccacgucaccaccuccgucgacgccggcgccgcccucauccaggaggaccaccuccgcgccuccuuccuccaggacucccaguccucccgcuccgccgucaccgccuccgccggccucgccuuccagaacaccgucaacuucaaguucgaggagaacuacaccucccagaacguccucaccaaguccuaccucuccaaccgcaccaacucccgcguccaguccaucggcggcguccccuucuaccccggcaucacccuccaggccuggcagcagggcaucaccaaccaccucgucgccaucgaccgcuccggccucccccuccacuucuucaucaaccccaacaugcuccccgaccuccccggcccccucgucaagaaggucuccaagaccgucgagaccgccgucaagcgcuacuacaccuucaacaccuaccccggcugcaccgaccucaacucccccaacuucaacuuccaggccaacaccgacgacggcuccugcgagggcaagaugaccaacuucuccuucggcggcgucuaccaggagugcacccagcucuccggcaaccgcgacguccuccucugccagaagcucgagcagaagaacccccucaccggcgacuucuccugccccuccggcuacucccccguccaccuccucucccagauccacgaggagggcuacaaccaccucgagugccaccgcaagugcacccuccucgucuucugcaagaccgucugcgaggacgucuuccaggucgccaaggccgaguuccgcgccuucuggugcgucgccuccucccagguccccgagaacuccggccuccucuucggcggccucuucuccuccaaguccaucaaccccaugaccaacgcccaguccugccccgccggcuacuucccccuccgccucuucgagaaccucaaggucugcgucucccaggacuacgagcucggcucccgcuucgccguccccuucggcggcuucuucuccugcaccgucggcaacccccucgucgaccccgccaucucccgcgaccucggcgcccccucccucaagaagugccccggcggcuucucccagcaccccgcccucaucuccgacggcugccaggucuccuacugcgucaaguccggccucuucaccggcggcucccucccccccgcccgccucccccccuucacccgccccccccucaugucccaggccgccaccaacaccgucaucgucaccaacuccgagaacgcccgcuccuggaucaaggacucccagacccaccaguggcgccucggcgagcccaucgagcuccgccgcgccaugaacgucauccacggcgacggcggcggccucuccggcggcgccgccgccggcgucaccgucggcgucaccaccauccucgccgucgucaucacccucgccaucuacggcacccgcaaguucaagaagaaggccuaccaggccaucgaggagcgccagucccucguccccggcaccgccgccaccggcgacaccaccuaccaggagcagggccagucccccgccuga

SEQ ID NO: 46101 - RNA, 882 nt, Artificial Sequence
  derived and/or modified sequence opt2 from MPG__Homo_sapiens__NP_001015052
augcccgcccgcuccggcgcccaguucugccgccgcaugggccagaagaagcagcgccccgcccgcgccggccagccccacuccuccuccgacgccgcccaggcccccgccgagcagccccacuccuccuccgacgccgcccaggcccccugcccccgcgagcgcugccucggcccccccaccacccccggccccuaccgcuccaucuacuucuccucccccaagggccaccucacccgccucggccucgaguucuucgaccagcccgccgucccccucgcccgcgccuuccucggccagguccucguccgccgccuccccaacggcaccgagcuccgcggccgcaucgucgagaccgaggccuaccucggccccgaggacgaggccgcccacucccgcggcggccgccagaccccccgcaaccgcggcauguucaugaagcccggcacccucuacgucuacaucaucuacggcauguacuucugcaugaacaucuccucccagggcgacggcgccugcguccuccuccgcgcccucgagccccucgagggccucgagaccaugcgccagcuccgcuccacccuccgcaagggcaccgccucccgcguccucaaggaccgcgagcucugcuccggccccuccaagcucugccaggcccucgccaucaacaaguccuucgaccagcgcgaccucgcccaggacgaggccgucuggcucgagcgcggcccccucgagcccuccgagcccgccgucgucgccgccgcccgcgucggcgucggccacgccggcgagugggcccgcaagccccuccgcuucuacguccgcggcucccccugggucuccgucgucgaccgcgucgccgagcaggacacccaggccuga

SEQ ID NO: 46102 - RNA, 2046 nt, Artificial Sequence
  derived and/or modified sequence opt2 from MPHOSPH10__Homo_sapiens__NP_005782
auggccccccaggucuggcgccgccgcacccucgagcgcugccucaccgaggucggcaaggccaccggccgccccgagugcuuccucaccauccaggagggccucgccuccaaguucaccucccucaccaagguccucuacgacuucaacaagauccucgagaacggccgcauccacggcuccccccuccagaagcucgucaucgagaacuucgacgacgagcagaucuggcagcagcucgagcuccagaacgagcccauccuccaguacuuccagaacgccgucuccgagaccaucaacgacgaggacaucucccuccuccccgaguccgaggagcaggagcgcgaggaggacggcuccgagaucgaggccgacgacaaggaggaccucgaggaccucgaggaggaggaggucuccgacaugggcaacgacgaccccgagaugggcgagcgcgccgagaacuccuccaaguccgaccuccgcaagucccccgucuucuccgacgaggacuccgaccucgacuucgacaucuccaagcucgagcagcaguccaagguccagaacaagggccagggcaagccccgcgagaaguccaucgucgacgacaaguucuucaagcucuccgagauggaggccuaccucgagaacaucgagaaggaggaggagcgcaaggacgacaacgacgaggaggaggaggacaucgacuucuucgaggacaucgacuccgacgaggacgagggcggccucuucggcuccaagaagcucaaguccggcaaguccucccgcaaccucaaguacaaggacuucuucgaccccgucgaguccgacgaggacaucaccaacguccacgacgacgagcucgacuccaacaaggaggacgacgagaucgccgaggaggaggccgaggagcucuccaucuccgagaccgacgaggacgacgaccuccaggagaacgaggacaacaagcagcacaaggagucccucaagcgcgucaccuucgcccuccccgacgacgccgagaccgaggacaccggcguccucaacgucaagaagaacuccgacgaggucaaguccuccuucgagaagcgccaggagaagaugaacgagaagaucgccucccucgagaaggagcuccucgagaagaagcccuggcagcuccagggcgaggucaccgcccagaagcgccccgagaacucccuccucgaggagacccuccacuucgaccacgccguccgcauggcccccgucaucaccgaggagaccacccuccagcucgaggacaucaucaagcagcgcauccgcgaccaggccugggacgacgucguccgcaaggagaagcccaaggaggacgccuacgaguacaagaagcgccucacccucgaccacgagaaguccaagcucucccucgccgagaucuacgagcaggaguacaucaagcucaaccagcagaagaccgccgaggaggagaaccccgagcacgucgagauccagaagaugauggacucccucuuccucaagcucgacgcccucuccaacuuccacuucauccccaagccccccguccccgagaucaaggucgucuccaaccuccccgccaucaccauggaggaggucgcccccgucuccgucuccgacgccgcccuccucgcccccgaggagaucaaggagaagaacaaggccggcgacaucaagaccgccgccgagaagaccgccaccgacaagaagcgcgagcgccgcaagaagaaguaccagaagcgcaugaagaucaaggagaaggagaagcgccgcaagcuccucgagaaguccuccgucgaccaggccggcaaguacuccaagaccgucgccuccgagaagcucaagcagcucaccaagaccggcaaggccuccuucaucaaggacgagggcaaggacaaggcccucaaguccucccaggccuucuucuccaagcuccaggaccaggucaagaugcagaucaacgacgccaagaagaccgagaagaagaagaagaagcgccaggacaucuccguccacaagcucaagcucuga

SEQ ID NO: 46103 - RNA, 483 nt, Artificial Sequence
  derived and/or modified sequence opt2 from MPHOSPH6__Homo_sapiens__NP_005783
auggccgccgagcgcaagacccgccucuccaagaaccuccuccgcaugaaguucaugcagcgcggccucgacuccgagaccaagaagcagcucgaggaggaggagaagaagaucaucuccgaggagcacugguaccucgaccuccccgagcucaaggagaaggaguccuucaucaucgaggagcaguccuuccuccucugcgaggaccuccucuacggccgcauguccuuccgcggcuucaaccccgaggucgagaagcucaugcuccagaugaacgccaagcacaaggccgaggaggucgaggacgagaccgucgagcucgacgucuccgacgaggagauggcccgccgcuacgagacccucgucggcaccaucggcaagaaguucgcccgcaagcgcgaccacgccaacuacgaggaggacgagaacggcgacaucacccccaucaaggccaagaagauguuccucaagccccaggacuga

SEQ ID NO: 46104 - RNA, 2583 nt, Artificial Sequence
  derived and/or modified sequence opt2 from MPHOSPH8__Homo_sapiens__NP_059990
auggagcaggucgccgagggcgcccgcgucaccgccguccccgucuccgccgccgacuccaccgaggagcucgccgaggucgaggagggcgucggcgucgucggcgaggacaacgacgccgccgcccgcggcgccgaggccuucggcgacuccgaggaggacggcgaggacgucuucgaggucgagaagauccucgacaugaagaccgagggcggcaagguccucuacaagguccgcuggaagggcuacaccuccgacgacgacaccugggagcccgagauccaccucgaggacugcaaggagguccuccucgaguuccgcaagaagaucgccgagaacaaggccaaggccguccgcaaggacauccagcgccucucccucaacaacgacaucuucgaggccaacuccgacuccgaccagcaguccgagaccaaggaggacaccucccccaagaagaagaagaagaagcuccgccagcgcgaggagaagucccccgacgaccucaagaagaagaaggccaaggccggcaagcucaaggacaaguccaagcccgaccucgaguccucccucgagucccucgucuucgaccuccgcaccaagaagcgcaucuccgaggccaaggaggagcucaaggaguccaagaagcccaagaaggacgaggucaaggagaccaaggagcucaagaaggucaagaagggcgagauccgcgaccucaagaccaagacccgcgaggaccccaaggagaaccgcaagaccaagaaggagaaguucgucgagucccaggucgaguccgaguccuccguccucaacgacucccccuuccccgaggacgacuccgagggccuccacuccgacucccgcgaggagaagcagaacaccaaguccgcccgcgagcgcgccggccaggacaugggccucgagcacggcuucgagaagccccucgacuccgccauguccgccgaggaggacaccgacguccgcggccgccgcaagaagaagaccccccgcaaggccgaggacacccgcgagaaccgcaagcucgagaacaagaacgccuuccucgagaagaagaccguccccaagaagcagcgcaaccaggaccgcuccaaguccgccgccgagcucgagaagcucaugcccgucuccgcccagacccccaagggccgccgccucuccggcgaggagcgcggccucugguccaccgacuccgccgaggaggacaaggagaccaagcgcaacgaguccaaggagaaguaccagaagcgccacgacuccgacaaggaggagaagggccgcaaggagcccaagggccucaagacccucaaggagauccgcaacgccuucgaccucuucaagcucacccccgaggagaagaacgacgucuccgagaacaaccgcaagcgcgaggagaucccccucgacuucaagaccaucgacgaccacaagaccaaggagaacaagcagucccucaaggagcgccgcaacacccgcgacgagaccgacaccugggccuacaucgccgccgagggcgaccaggagguccucgacuccgucugccaggccgacgagaacuccgacggccgccagcagauccucucccucggcauggaccuccagcucgaguggaugaagcucgaggacuuccagaagcaccucgacggcaaggacgagaacuucgccgccaccgacgccauccccuccaacguccuccgcgacgccgucaagaacggcgacuacaucaccgucaaggucgcccucaacuccaacgaggaguacaaccucgaccaggaggacuccuccggcaugacccucgucaugcucgccgccgccggcggccaggacgaccuccuccgccuccucaucaccaagggcgccaaggucaacggccgccagaagaacggcaccaccgcccucauccacgccgccgagaagaacuuccucaccaccgucgccauccuccucgaggccggcgccuucgucaacguccagcaguccaacggcgagaccgcccucaugaaggccugcaagcgcggcaacuccgacaucguccgccucgucaucgagugcggcgccgacugcaacauccucuccaagcaccagaacuccgcccuccacuucgccaagcaguccaacaacguccucgucuacgaccuccucaagaaccaccucgagacccucucccgcgucgccgaggagaccaucaaggacuacuucgaggcccgccucgcccuccucgagcccgucuuccccaucgccugccaccgccucugcgagggccccgacuucuccaccgacuucaacuacaagcccccccagaacauccccgagggcuccggcauccuccucuucaucuuccacgccaacuuccucggcaaggaggucaucgcccgccucugcggccccugcuccguccaggccgucguccucaacgacaaguuccagcuccccgucuuccucgacucccacuucgucuacuccuucucccccgucgccggccccaacaagcucuucauccgccucaccgaggcccccuccgccaaggucaagcuccucaucggcgccuaccgcguccagcuccaguga

SEQ ID NO: 46105 - RNA, 3552 nt, Artificial Sequence
  derived and/or modified sequence opt2 from MPHOSPH9__Homo_sapiens__NP_073619
auggaggaguucgaccucgucaagacccuccacaagaccuccuccuccgucggcuccgacgagaacucccuccacucccucggccucaaccucaacaccgaccgcuccuccccccaccucuccaccaacggcgucuccuccuucuccggcaagacccgccccuccgucauccagggcaccgucgagguccucaccucccucaugcaggagcuccagaacuccggcaagaccgacuccgagcucuggaagaacugcgagacccgcuggcuccagcucuucaaccucgucgagaagcagugccaggagcagaucgucgcccagcaggagcaguuccacaaccagauccagcacauccaggaggagaucaagaaccucgucaagcuccagaccuccuccgccucccucgccuccugcgagggcaacuccuccaacaagcaggucuccuccgagucccagaugggcuucuucucccucuccuccgagcgcaacgaguccgucauccacuaccccgaguccaccgagcccgagauccagcaggagauguccaccucccagcccgacugcaacgucgacuccugcuccgucuccuccggcuacggcaccuucugcaucuccgagcucaaccucuacaaguccaaggaccccaaggaguucauggagcacaucgacguccccaagggccaguacgucgcccccgccguccccgccgagucccucgucgacggcgucaagaacgagaacuucuacauccagacccccgaggagugccacgucucccucaaggaggacgucuccaucucccccggcgaguucgagcacaacuuccucggcgagaacaaggucuccgaggucuacuccggcaagaccaacuccaacgccaucaccuccugggcccagaagcucaagcagaaccagcccaagcgcgcccacgucgaggacggcggcucccgcuccaagcagggcaacgagcaguccaagaagacccccaucgagaaguccgacuucgccgccgccacccacccccgcgccuucuaccucuccaagcccgacgagacccccaacgccuggauguccgacuccggcaccggccucaccuacuggaagcucgaggagaaggacaugcaccacucccuccccgagacccucgagaagaccuucaucucccucuccuccaccgacgucucccccaaccaguccaacaccuccaacgagaugaagcuccccucccucaaggacaucuacuacaagaagcagcgcgagaacaagcagcuccccgagcgcaaccucaccuccgccuccaaccccaaccacccccccgagguccucacccucgaccccacccuccacaugaagcccaagcagcagaucuccggcauccagccccacggccuccccaacgcccucgacgaccgcaucuccuucucccccgacuccguccucgagcccuccauguccucccccuccgacaucgacuccuucucccaggccuccaacgucaccucccagcuccccggcuuccccaaguaccccucccacaccaaggccucccccgucgacuccuggaagaaccagaccuuccagaacgagucccgcaccuccuccaccuuccccuccgucuacaccaucaccuccaacgacaucuccgucaacaccgucgacgaggagaacaccgucauggucgccuccgccuccgucucccagucccagcuccccggcaccgccaacuccguccccgagugcaucucccucaccucccucgaggaccccgucauccucuccaagauccgccagaaccucaaggagaagcacgcccgccacaucgccgaccuccgcgccuacuacgaguccgagaucaacucccucaagcagaagcucgaggccaaggagaucuccggcgucgaggacuggaagaucaccaaccagauccucgucgaccgcugcggccagcucgacuccgcccuccacgaggccaccucccgcguccgcacccucgagaacaagaacaaccuccucgagaucgaggucaacgaccuccgcgagcgcuucuccgccgccuccuccgccuccaagauccuccaggagcgcaucgaggagaugcgcaccuccuccaaggagaaggacaacaccaucauccgccucaagucccgccuccaggaccucgaggaggccuucgagaacgccuacaagcucuccgacgacaaggaggcccagcucaagcaggagaacaagauguuccaggaccuccucggcgaguacgagucccucggcaaggagcaccgccgcgucaaggacgcccucaacaccaccgagaacaagcuccucgacgccuacacccagaucuccgaccucaagcgcaugaucuccaagcucgaggcccaggucaagcaggucgagcacgagaacaugcucucccuccgccacaacucccgcauccacguccgccccucccgcgccaacacccucgccaccuccgacgucucccgccgcaaguggcucauccccggcgccgaguacuccaucuucaccggccagccccucgacacccaggacuccaacgucgacaaccagcucgaggagaccugcucccucggccaccgcuccccccucgagaaggacuccucccccggcuccuccuccaccucccuccucaucaagaagcagcgcgagaccuccgacacccccaucaugcgcgcccucaaggagcucgacgagggcaagaucuucaagaacuggggcacccagaccgagaaggaggacaccuccaacaucaacccccgccagaccgagaccuccgucaacgccucccgcucccccgagaagugcgcccagcagcgccagaagcgccucaacuccgccucccagcgcuccuccucccucccccccuccaaccgcaaguccuccacccccaccaagcgcgagaucaugcucacccccgucaccgucgccuacucccccaagcgcucccccaaggagaaccucucccccggcuucucccaccuccucuccaagaacgaguccucccccauccgcuucgacauccuccucgacgaccucgacaccguccccgucuccacccuccagcgcaccaacccccgcaagcagcuccaguuccucccccucgacgacuccgaggagaagaccuacuccgagaaggccaccgacaaccacgucaaccacuccuccugccccgagcccguccccaacggcgucaagaaggucuccguccgcaccgccugggagaagaacaaguccgucuccuacgagcagugcaagcccgucuccgucaccccccagggcaacgacuucgaguacaccgccaagauccgcacccucgccgagaccgagcgcuucuucgacgagcucaccaaggagaaggaccagaucgaggccgcccucucccgcaugcccucccccggcggccgcaucacccuccagacccgccucaaccaggaggcccucgaggaccgccucgagcgcaucaaccgcgagcucggcuccguccgcaugacccucaagaaguuccacguccuccgcaccuccgccaaccucuga

SEQ ID NO: 46106 - RNA, 864 nt, Artificial Sequence
  derived and/or modified sequence opt2 from MPI__Homo_sapiens__NP_001276084
auggccgccccccgcgucuucccccucuccugcgccguccagcaguacgccuggggcaagaugggcuccaacuccgaggucgcccgccuccucgccuccuccgacccccucgcccagaucgccgaggacaagcccuacgccgagcucuggaugggcacccacccccgcggcgacgccaagauccucgacaaccgcaucucccagaagacccucucccaguggaucgccgagaaccaggacucccucggcuccaaggucaaggacaccuucaacggcaaccuccccuuccucuucaagguccucuccgucgagaccccccucuccauccaggcccaccccaacaaggagcucgccgagaagcuccaccuccaggccccccagcacuaccccgacgccaaccacaagcccgagauggccaucgcccucacccccuuccagggccucugcggcuuccgccccgucgaggagaucgucaccuuccucaagaagguccccgaguuccaguuccucaucggcgacgaggccgccacccaccucaagcagaccaugucccacgacucccaggccgucgccuccucccuccaguccugcuucucccaccucaugaaguccgagaagaaggucgucgucgagcagcucaaccuccucgucaagcgcaucucccagcaggccgccgccggcaacaacauggaggacaucuucggcgagcuccuccuccagcuccaccagcaguaccccggcgacaucggcugcuucgccaucuacuuccucaaccuccucacccucaagcccggcgaggccauguuccucgaggccaacgucccccacgccuaccucaagggcggccccuggcucugccacuga

SEQ ID NO: 46107 - RNA, 540 nt, Artificial Sequence
  derived and/or modified sequence opt2 from MPLKIP__Homo_sapiens__NP_619646
augcagcgccagaacuuccgcccccccaccccccccuaccccggccccggcggcggcggcuggggcuccggcuccuccuuccgcggcacccccggcggcggcggcccccgcccccccuccccccgcgacggcuacggcuccccccaccacaccccccccuacggcccccgcucccgccccuacggcuccucccacuccccccgccacggcggcuccuuccccggcggccgcuucggcucccccucccccggcggcuaccccggcuccuacucccgcucccccgccggcucccagcagcaguucggcuacucccccggccagcagcagacccacccccagggcuccccccgcaccuccacccccuucggcuccggccgcguccgcgagaagcgcauguccaacgagcucgagaacuacuucaagcccuccaugcucgaggaccccugggccggccucgagcccgucuccgucgucgacaucucccagcaguacuccaacacccagaccuucaccggcaagaagggccgcuacuucugcuga

SEQ ID NO: 46108 - RNA, 2238 nt, Artificial Sequence
  derived and/or modified sequence opt2 from MPO__Homo_sapiens__NP_000241
augggcguccccuucuucuccucccuccgcugcauggucgaccucggccccugcugggccggcggccucaccgccgagaugaagcuccuccucgcccucgccggccuccucgccauccucgccaccccccagcccuccgagggcgccgcccccgccguccucggcgaggucgacaccucccucguccucuccuccauggaggaggccaagcagcucgucgacaaggccuacaaggagcgccgcgaguccaucaagcagcgccuccgcuccggcuccgccucccccauggagcuccucuccuacuucaagcagcccgucgccgccacccgcaccgccguccgcgccgccgacuaccuccacgucgcccucgaccuccucgagcgcaagcuccgcucccucuggcgccgccccuucaacgucaccgacguccucacccccgcccagcucaacguccucuccaaguccuccggcugcgccuaccaggacgucggcgucaccugccccgagcaggacaaguaccgcaccaucaccggcaugugcaacaaccgccgcucccccacccucggcgccuccaaccgcgccuucguccgcuggcuccccgccgaguacgaggacggcuucucccuccccuacggcuggacccccggcgucaagcgcaacggcuuccccgucgcccucgcccgcgccgucuccaacgagaucguccgcuuccccaccgaccagcucacccccgaccaggagcgcucccucauguucaugcaguggggccagcuccucgaccacgaccucgacuucacccccgagcccgccgcccgcgccuccuucgucaccggcgucaacugcgagaccuccugcguccagcagccccccugcuucccccucaagaucccccccaacgacccccgcaucaagaaccaggccgacugcauccccuucuuccgcuccugccccgccugccccggcuccaacaucaccauccgcaaccagaucaacgcccucaccuccuucgucgacgccuccauggucuacggcuccgaggagccccucgcccgcaaccuccgcaacauguccaaccagcucggccuccucgccgucaaccagcgcuuccaggacaacggccgcgcccuccuccccuucgacaaccuccacgacgaccccugccuccucaccaaccgcuccgcccgcauccccugcuuccucgccggcgacacccgcuccuccgagaugcccgagcucaccuccaugcacacccuccuccuccgcgagcacaaccgccucgccaccgagcucaagucccucaacccccgcugggacggcgagcgccucuaccaggaggcccgcaagaucgucggcgccaugguccagaucaucaccuaccgcgacuaccucccccucguccucggccccaccgccaugcgcaaguaccuccccaccuaccgcuccuacaacgacuccgucgacccccgcaucgccaacgucuucaccaacgccuuccgcuacggccacacccucauccagcccuucauguuccgccucgacaaccgcuaccagcccauggagcccaacccccgcgucccccucucccgcgucuucuucgccuccuggcgcgucguccucgagggcggcaucgaccccauccuccgcggccucauggccacccccgccaagcucaaccgccagaaccagaucgccgucgacgagauccgcgagcgccucuucgagcaggucaugcgcaucggccucgaccuccccgcccucaacaugcagcgcucccgcgaccacggccuccccggcuacaacgccuggcgccgcuucugcggccucccccagcccgagaccgucggccagcucggcaccguccuccgcaaccucaagcucgcccgcaagcucauggagcaguacggcacccccaacaacaucgacaucuggaugggcggcgucuccgagccccucaagcgcaagggccgcgucggcccccuccucgccugcaucaucggcacccaguuccgcaagcuccgcgacggcgaccgcuucuggugggagaacgagggcgucuucuccaugcagcagcgccaggcccucgcccagaucucccucccccgcaucaucugcgacaacaccggcaucaccaccgucuccaagaacaacaucuucauguccaacuccuacccccgcgacuucgucaacugcuccacccuccccgcccucaaccucgccuccuggcgcgaggccuccuga

SEQ ID NO: 46109 - RNA, 1341 nt, Artificial Sequence
  derived and/or modified sequence opt2 from MPP1__Homo_sapiens__NP_001159933
augacccucaaggccuccgagggcgaguccggcggcuccaugcacaccgcccucuccgaccucuaccucgagcaccuccuccagaagcgcucccgccccgaggccgucucccacccccucaacaccgucaccgaggacauguacaccaacggcucccccgcccccggcucccccgcccaggucaagggccaggagguccgcaagguccgccucauccaguucgagaaggucaccgaggagcccaugggcaucacccucaagcucaacgagaagcaguccugcaccgucgcccgcauccuccacggcggcaugauccaccgccagggcucccuccacgucggcgacgagauccucgagaucaacggcaccaacgucaccaaccacuccgucgaccagcuccagaaggccaugaaggagaccaagggcaugaucucccucaaggucauccccaaccagcagucccgccuccccgcccuccaggaggccggccucaaguucgccaccggcgacaucauccagaucaucaacaaggacgacuccaacugguggcagggccgcgucgagggcuccuccaaggaguccgccggccucauccccucccccgagcuccaggaguggcgcgucgccuccauggcccaguccgcccccuccgaggcccccuccugcucccccuucggcaagaagaagaaguacaaggacaaguaccucgccaagcacuccuccaucuucgaccagcucgacgucgucuccuacgaggaggucguccgccuccccgccuucaagcgcaagacccucguccucaucggcgccuccggcgucggccgcucccacaucaagaacgcccuccucucccagaaccccgagaaguucgucuaccccguccccuacaccacccgccccccccgcaaguccgaggaggacggcaaggaguaccacuucaucuccaccgaggagaugacccgcaacaucuccgccaacgaguuccucgaguucggcuccuaccagggcaacauguucggcaccaaguucgagaccguccaccagauccacaagcagaacaagaucgccauccucgacaucgagccccagacccucaagaucguccgcaccgccgagcucucccccuucaucgucuucaucgcccccaccgaccagggcacccagaccgaggcccuccagcagcuccagaaggacuccgaggccauccgcucccaguacgcccacuacuucgaccucucccucgucaacaacggcgucgacgagacccucaagaagcuccaggaggccuucgaccaggccugcuccuccccccaguggguccccgucuccugggucuacuga

SEQ ID NO: 46110 - RNA, 1794 nt, Artificial Sequence
  derived and/or modified sequence opt2 from MPP2__Homo_sapiens__NP_001265299
auguccugggccccccccccccaggucggccagaaccuccgcucccagaccguccuccgcauccucaacggcauggaggaccucaugugggucgccauggaggagcgccgcuuccgcgcccucgccuccuucaccaugcccgucgccgccaccaacuccgagaccgccaugcagcagguccucgacaaccucggcucccuccccuccgccaccggcgccgccgagcucgaccucaucuuccuccgcggcaucauggagucccccaucguccgcucccucgccaaggcccacgagcgccucgaggagaccaagcucgaggccguccgcgacaacaaccucgagcucguccaggagauccuccgcgaccucgcccagcucgccgagcaguccuccaccgccgccgagcucgcccacauccuccaggagccccacuuccagucccuccucgagacccacgacuccgucgccuccaagaccuacgagacccccccccccucccccggccucgaccccaccuucuccaaccagcccgucccccccgacgccguccgcauggucggcauccgcaagaccgccggcgagcaccucggcgucaccuuccgcgucgagggcggcgagcucgucaucgcccgcauccuccacggcggcauggucgcccagcagggccuccuccacgucggcgacaucaucaaggaggucaacggccagcccgucggcuccgacccccgcgcccuccaggagcuccuccgcaacgccuccggcuccgucauccucaagauccuccccuccuaccaggagccccaccucccccgccaggucuucgucaagugccacuucgacuacgaccccgcccgcgacucccucauccccugcaaggaggccggccuccgcuucaacgccggcgaccuccuccagaucgucaaccaggacgacgccaacugguggcaggccugccacgucgagggcggcuccgccggccucauccccucccagcuccucgaggagaagcgcaaggccuucgucaagcgcgaccucgagcucacccccaacuccggcacccucugcggcucccucuccggcaagaagaagaagcgcaugauguaccucaccaccaagaacgccgaguucgaccgccacgagcuccucaucuacgaggaggucgcccgcaugccccccuuccgccgcaagacccucguccucaucggcgcccagggcgucggccgccgcucccucaagaacaagcucaucaugugggaccccgaccgcuacggcaccaccguccccuacaccucccgccgccccaaggacuccgagcgcgagggccagggcuacuccuucgucucccgcggcgagauggaggccgacguccgcgccggccgcuaccucgagcacggcgaguacgagggcaaccucuacggcacccgcaucgacuccauccgcggcgucgucgccgccggcaaggucugcguccucgacgucaacccccaggccgucaagguccuccgcaccgccgaguucguccccuacgucgucuucaucgaggcccccgacuucgagacccuccgcgccaugaaccgcgccgcccucgaguccggcaucuccaccaagcagcucaccgaggccgaccuccgccgcaccgucgaggaguccucccgcauccagcgcggcuacggccacuacuucgaccucugccucgucaacuccaaccucgagcgcaccuuccgcgagcuccagaccgccauggagaagcuccgcaccgagccccaguggguccccgucuccugggucuacuga

SEQ ID NO: 46111 - RNA, 1758 nt, Artificial Sequence
  derived and/or modified sequence opt2 from MPP3__Homo_sapiens__NP_001923
augcccguccucuccgaggacuccggccuccacgagacccucgcccuccucaccucccagcuccgccccgacuccaaccacaaggaggagaugggcuuccuccgcgacgucuucuccgagaagucccucuccuaccucaugaagauccacgagaagcuccgcuacuacgagcgccagucccccacccccguccuccacuccgccgucgcccucgccgaggacgucauggaggagcuccaggccgccuccguccacuccgacgagcgcgagcuccuccagcuccucuccaccccccaccuccgcgccguccucaugguccacgacaccgucgcccagaagaacuucgaccccguccuccccccccuccccgacaacaucgacgaggacuucgacgaggaguccgucaagaucguccgccucgucaagaacaaggagccccucggcgccaccauccgccgcgacgagcacuccggcgccgucgucgucgcccgcaucaugcgcggcggcgccgccgaccgcuccggccucguccacgucggcgacgagcuccgcgaggucaacggcaucgccguccuccacaagcgccccgacgagaucucccagauccucgcccagucccagggcuccaucacccucaagaucauccccgccacccaggaggaggaccgccucaaggaguccaaggucuucaugcgcgcccucuuccacuacaacccccgcgaggaccgcgccauccccugccaggaggccggccuccccuuccagcgccgccagguccucgaggucgucucccaggacgaccccaccugguggcaggccaagcgcgucggcgacaccaaccuccgcgccggccucauccccuccaagggcuuccaggagcgccgccucuccuaccgccgcgccgccggcacccuccccuccccccagucccuccgcaagccccccuacgaccagcccugcgacaaggagaccugcgacugcgagggcuaccucaagggccacuacgucgccggccuccgccgcuccuuccgccucggcugccgcgagcgccucggcggcucccaggagggcaagauguccuccggcgccgagucccccgagcuccucaccuacgaggaggucgcccgcuaccagcaccagcccggcgagcgcccccgccucgucguccucaucggcucccucggcgcccgccuccacgagcucaagcagaaggucgucgccgagaacccccagcacuucggcgucgccgucccccacaccacccgcccccgcaagucccacgagaaggagggcgucgaguaccacuucgucuccaagcaggccuucgaggccgaccuccaccacaacaaguuccucgagcacggcgaguacaaggagaaccucuacggcaccucccucgaggccauccaggccgucauggccaagaacaaggucugccucgucgacgucgagcccgaggcccucaagcagcuccgcaccuccgaguucaagcccuacaucaucuucgucaagcccgccauccaggagaagcgcaagaccccccccaugucccccgccugcgaggacaccgccgcccccuucgacgagcagcagcaggagauggccgccuccgccgccuucaucgaccgccacuacggccaccucgucgacgccguccucgucaaggaggaccuccagggcgccuacucccagcucaaggucguccucgagaagcucuccaaggacacccacuggguccccgucuccuggguccgcuga

SEQ ID NO: 46112 - RNA, 1926 nt, Artificial Sequence
  derived and/or modified sequence opt2 from MPP5__Homo_sapiens__NP_001243479
auggccgucgacugccccggcgaccucggcacccgcaugaugcccauccgccgcuccgcccagcucgagcgcauccgccagcagcaggaggacaugcgccgccgccgcgaggaggagggcaagaagcaggagcucgaccucaacuccuccaugcgccucaagaagcucgcccagaucccccccaagaccggcaucgacaaccccauguucgacaccgaggagggcaucguccucgaguccccccacuacgccgucaagauccucgagaucgaggaccucuucuccucccucaagcacauccagcacacccucgucgacucccagucccaggaggacaucucccuccuccuccagcucguccagaacaaggacuuccagaacgccuucaagauccacaacgccaucaccguccacaugaacaaggccuccccccccuucccccucaucuccaacgcccaggaccucgcccaggagguccagaccguccucaagcccguccaccacaaggagggccaggagcucaccgcccuccucaacaccccccacauccaggcccuccuccucgcccacgacaaggucgccgagcaggagaugcagcucgagcccaucaccgacgagcgcgucuacgaguccaucggccaguacggcggcgagaccgucaagaucguccgcaucgagaaggcccgcgacaucccccucggcgccaccguccgcaacgagauggacuccgucaucaucucccgcaucgucaagggcggcgccgccgagaaguccggccuccuccacgagggcgacgagguccucgagaucaacggcaucgagauccgcggcaaggacgucaacgaggucuucgaccuccucuccgacaugcacggcacccucaccuucguccucauccccucccagcagaucaagcccccccccgccaaggagaccgucauccacgucaaggcccacuucgacuacgaccccuccgacgaccccuacguccccugccgcgagcucggccucuccuuccagaagggcgacauccuccacgucaucucccaggaggaccccaacugguggcaggccuaccgcgagggcgacgaggacaaccagccccucgccggccucguccccggcaaguccuuccagcagcagcgcgaggccaugaagcagaccaucgaggaggacaaggagcccgagaaguccggcaagcucuggugcgccaagaagaacaagaagaagcgcaagaagguccucuacaacgccaacaagaacgacgacuacgacaacgaggagauccucaccuacgaggagaugucccucuaccaccagcccgccaaccgcaagcgccccaucauccucaucggcccccagaacugcggccagaacgagcuccgccagcgccucaugaacaaggagaaggaccgcuucgccuccgccgucccccacaccacccgcucccgccgcgaccaggaggucgccggccgcgacuaccacuucgucucccgccaggccuucgaggccgacaucgccgccggcaaguucaucgagcacggcgaguucgagaagaaccucuacggcaccuccaucgacuccguccgccaggucaucaacuccggcaagaucugccuccucucccuccgcacccagucccucaagacccuccgcaacuccgaccucaagcccuacaucaucuucaucgccccccccucccaggagcgccuccgcgcccuccucgccaaggagggcaagaaccccaagcccgaggagcuccgcgagaucaucgagaagacccgcgagauggagcagaacaacggccacuacuucgacaccgccaucgucaacuccgaccucgacaaggccuaccaggagcuccuccgccucaucaacaagcucgacaccgagccccaguggguccccuccaccuggcuccgcuga

SEQ ID NO: 46113 - RNA, 1500 nt, Artificial Sequence
  derived and/or modified sequence opt2 from MPP7__Homo_sapiens__XP_005252425
augcccgcccucuccaccggcuccggcuccgacaccggccucuacgagcuccucgccgcccuccccgcccagcuccagccccacgucgacucccaggaggaccucaccuuccucugggacauguucggcgagaagucccuccacucccucgucaagauccacgagaagcuccacuacuacgagaagcagucccccguccccauccuccacggcgccgccgcccucgccgacgaccucgccgaggagcuccagaacaagccccucaacuccgagauccgcgagcuccucaagcuccucuccaagcccaacgucaaggcccuccucuccguccacgacaccgucgcccagaagaacuacgaccccguccucccccccaugcccgaggacaucgacgacgaggaggacuccgucaagaucauccgccucgucaagaaccgcgagccccucggcgccaccaucaagaaggacgagcagaccggcgccaucaucgucgcccgcaucaugcgcggcggcgccgccgaccgcuccggccucauccacgucggcgacgagcuccgcgaggucaacggcauccccgucgaggacaagcgccccgaggagaucauccagauccucgcccagucccagggcgccaucaccuucaagaucauccccggcuccaaggaggagacccccuccaaggagggcaagauguucaucaaggcccucuucgacuacaaccccaacgaggacaaggccauccccugcaaggaggccggccucuccuucaagaagggcgacauccuccagaucaugucccaggacgacgccaccugguggcaggccaagcacgaggccgacgccaacccccgcgccggccucauccccuccaagcacuuccaggagcgccgccucgcccuccgccgccccgagauccucguccagccccucaaggucuccaaccgcaaguccuccggcuuccgcaaguccuuccgccucucccgcaaggacaagaagaccaacaaguccauguacgagugcaagaaguccgaccaguacgacaccgccgacguccccaccuacgaggaggucacccccuaccgccgccagaccaacgagaaguaccgccucgucguccucgucggccccgucggcgucggccucaacgagcucaagcgcaagcuccucaucuccgacacccagcacuacggcgucaccgucccccacaccacccgcgcccgccgcucccaggaguccgacggcgucgaguacaucuucaucuccaagcaccucuucgagaccgacguccagaacaacaaguucaucgaguacggcgaguacaagaacaacuacuacggcaccuccaucgacuccguccgcuccguccucgccaagaacaaggucugccuccucgacguccagccccacggccccugguuccuccucccccucauggccguccccuggggcgccaagccccccaacgcccgcaugaccugcggcuccccccucgaccucuga

SEQ ID NO: 46114 - RNA, 1002 nt, Artificial Sequence
  derived and/or modified sequence opt2 from MPPE1__Homo_sapiens__NP_001229833
auggccaugaucgagcucggcuucggccgccagaacuuccacccccucaagcgcaaguccucccuccuccucaagcucaucgccgucgucuucgccguccuccucuucugcgaguuccucaucuacuaccucgccaucuuccagugcaacuggcccgaggucaagaccaccgccuccgacggcgagcagaccacccgcgagcccguccucaaggccauguuccucgccgacacccaccuccucggcgaguuccucggccacuggcucgacaagcuccgccgcgaguggcagauggagcgcgccuuccagaccgcccucuggcuccuccagcccgaggucgucuucauccucggcgacaucuucgacgagggcaagugguccacccccgaggccugggccgacgacgucgagcgcuuccagaagauguuccgccaccccucccacguccagcucaaggucgucgccggcaaccacgacaucggcuuccacuacgagaugaacaccuacaaggucgagcgcuucgagaaggucuucuccuccgagcgccucuucuccuggaagggcaucaacuucgucauggucaacuccgucgcccucaacggcgacggcugcggcaucugcuccgagaccgaggccgagcucaucgaggucucccaccgccucaacugcucccgcgagcuccucugguggcuccagccccgccucguccucuccggccacacccacuccgccugcgagguccaccacggcggccgcguccccgagcucuccguccccuccuucuccuggcgcaaccgcaacaaccccuccuucaucaugggcuccaucacccccaccgacuacacccucuccaagugcuaccucccccgcgaggacgucguccucaucaucuacugcggcgucgucggcuuccucgucguccucacccucacccacuucggccuccucgccucccccuuccucuccggccucaaccuccucggcaagcgcaagacccgcuga

SEQ ID NO: 46115 - RNA, 834 nt, Artificial Sequence
  derived and/or modified sequence opt2 from MPPED2__Homo_sapiens__NP_001138871
auggcccacggcauccccucccagggcaaggucaccaucaccgucgacgaguacuccuccaaccccacccaggccuucacccacuacaacaucaaccagucccgcuuccagcccccccacguccacauggucgaccccauccccuacgacacccccaagcccgccggccacacccgcuucgucugcaucuccgacacccacucccgcaccgacggcauccagaugcccuacggcgacauccuccuccacaccggcgacuucaccgagcucggccuccccuccgaggucaagaaguucaacgacuggcucggcaaccuccccuacgaguacaagaucgucaucgccggcaaccacgagcucaccuucgacaaggaguucauggccgaccucgucaagcaggacuacuaccgcuuccccuccgucuccaagcucaagcccgaggacuucgacaacguccagucccuccucaccaacuccaucuaccuccaggacuccgaggucaccgucaagggcuuccgcaucuacggcgcccccuggacccccugguucaacggcuggggcuucaaccucccccgcggccagucccuccucgacaaguggaaccucauccccgagggcaucgacauccucaugacccacggccccccccucggcuuccgcgacuggguccccaaggagcuccagcgcgucggcugcgucgagcuccucaacaccguccagcgccgcguccgccccaagcuccacgucuucggcggcauccacgaggucaaccccgucuccaucuccaaggcccuccgcaccaagaucugcucccuccccuccaagaccuccuga

SEQ ID NO: 46116 - RNA, 3117 nt, Artificial Sequence
  derived and/or modified sequence opt2 from MPRIP__Homo_sapiens__NP_055949
auguccgccgccaaggagaaccccugccgcaaguuccaggccaacaucuucaacaaguccaagugccagaacugcuucaagccccgcgagucccaccuccucaacgacgaggaccucacccaggccaagcccaucuacggcggcuggcuccuccucgcccccgacggcaccgacuucgacaaccccguccaccgcucccgcaaguggcagcgccgcuucuucauccucuacgagcacggccuccuccgcuacgcccucgacgagaugcccaccacccucccccagggcaccaucaacaugaaccagugcaccgacgucgucgacggcgagggccgcaccggccagaaguucucccucugcauccucacccccgagaaggagcacuucauccgcgccgagaccaaggagaucgucuccggcuggcucgagaugcucauggucuacccccgcaccaacaagcagaaccagaagaagaagcgcaaggucgagccccccaccccccaggagcccggccccgccaaggucgccgucaccuccuccuccuccuccuccuccuccuccuccuccauccccuccgccgagaagguccccaccaccaaguccacccucuggcaggaggagaugcgcaccaaggaccagcccgacggcuccucccucucccccgcccagucccccucccagucccagccccccgccgccuccucccuccgcgagcccggccucgaguccaaggaggaggaguccgccauguccuccgaccgcauggacugcggccgcaagguccgcgucgaguccggcuacuucucccucgagaagaccaagcaggaccucaaggccgaggagcagcagcucccccccccccucuccccccccucccccuccacccccaaccaccgccgcucccaggucaucgagaaguucgaggcccucgacaucgagaaggccgagcacauggagaccaacgccgucggccccucccccuccuccgacacccgccagggccgcuccgagaagcgcgccuucccccgcaagcgcgacuucaccaacgaggccccccccgccccccuccccgacgccuccgccuccccccucuccccccaccgccgcgccaagucccucgaccgccgcuccaccgagcccuccgucacccccgaccuccucaacuucaagaagggcuggcucaccaagcaguacgaggacggccaguggaagaagcacugguucguccucgccgaccagucccuccgcuacuaccgcgacuccgucgccgaggaggccgccgaccucgacggcgagaucgaccucuccgccugcuacgacgucaccgaguaccccguccagcgcaacuacggcuuccagauccacaccaaggagggcgaguucacccucuccgccaugaccuccggcauccgccgcaacuggauccagaccaucaugaagcacguccaccccaccaccgcccccgacgucaccuccucccuccccgaggagaagaacaaguccuccugcuccuucgagaccugcccccgccccaccgagaagcaggaggccgagcucggcgagcccgaccccgagcagaagcgcucccgcgcccgcgagcgccgccgcgagggccgcuccaagaccuucgacugggccgaguuccgccccauccagcaggcccucgcccaggagcgcgucggcggcgucggccccgccgacacccacgagccccuccgccccgaggccgagcccggcgagcucgagcgcgagcgcgcccgccgccgcgaggagcgccgcaagcgcuucggcaugcucgacgccaccgacggccccggcaccgaggacgccgcccuccgcauggaggucgaccgcucccccggccuccccauguccgaccucaagacccacaacguccacgucgagaucgagcagcgcuggcaccaggucgagaccaccccccuccgcgaggagaagcagguccccaucgcccccguccaccucuccuccgaggacggcggcgaccgccucuccacccacgagcucaccucccuccucgagaaggagcucgagcagucccagaaggaggccuccgaccuccucgagcagaaccgccuccuccaggaccagcuccgcgucgcccucggccgcgagcaguccgcccgcgagggcuacguccuccaggccaccugcgagcgcggcuucgccgccauggaggagacccaccagaagaagaucgaggaccuccagcgccagcaccagcgcgagcucgagaagcuccgcgaggagaaggaccgccuccucgccgaggagaccgccgccaccaucuccgccaucgaggccaugaagaacgcccaccgcgaggagauggagcgcgagcucgagaagucccagcgcucccagaucuccuccgucaacuccgacgucgaggcccuccgccgccaguaccucgaggagcuccaguccguccagcgcgagcucgagguccucuccgagcaguacucccagaagugccucgagaacgcccaccucgcccaggcccucgaggccgagcgccaggcccuccgccagugccagcgcgagaaccaggagcucaacgcccacaaccaggagcucaacaaccgccucgccgccgagaucacccgccuccgcacccuccucaccggcgacggcggcggcgaggccaccggcuccccccucgcccagggcaaggacgccuacgagcucgagguccuccuccgcgucaaggaguccgagauccaguaccucaagcaggagaucuccucccucaaggacgagcuccagaccgcccuccgcgacaagaaguacgccuccgacaaguacaaggacaucuacaccgagcucuccaucgccaaggccaaggccgacugcgacaucucccgccucaaggagcagcucaaggccgccaccgaggcccucggcgagaagucccccgacuccgccaccgucuccggcuacgacaucaugaaguccaaguccaaccccgacuuccucaagaaggaccgcuccugcgucacccgccagcuccgcaacauccgcuccaagucccucaaggagggccucaccguccaggagcgccucaagcucuucgagucccgcgaccucaagaaggacuga

SEQ ID NO: 46117 - RNA, 894 nt, Artificial Sequence
  derived and/or modified sequence opt2 from MPST__Homo_sapiens__NP_001123989
auggccuccccccagcucugccgcgcccucgucuccgcccagugggucgccgaggcccuccgcgccccccgcgccggccagccccuccagcuccucgacgccuccugguaccuccccaagcucggccgcgacgcccgccgcgaguucgaggagcgccacauccccggcgccgccuucuucgacaucgaccagugcuccgaccgcaccucccccuacgaccacaugcuccccggcgccgagcacuucgccgaguacgccggccgccucggcgucggcgccgccacccacgucgucaucuacgacgccuccgaccagggccucuacuccgccccccgcgucugguggauguuccgcgccuucggccaccacgccgucucccuccucgacggcggccuccgccacuggcuccgccagaaccucccccucuccuccggcaagucccagcccgcccccgccgaguuccgcgcccagcucgaccccgccuucaucaagaccuacgaggacaucaaggagaaccucgagucccgccgcuuccaggucgucgacucccgcgccaccggccgcuuccgcggcaccgagcccgagccccgcgacggcaucgagcccggccacauccccggcaccgucaacauccccuucaccgacuuccucucccaggagggccucgagaagucccccgaggagauccgccaccucuuccaggagaagaaggucgaccucuccaagccccucgucgccaccugcggcuccggcgucaccgccugccacgucgcccucggcgccuaccucugcggcaagcccgacguccccaucuacgacggcuccugggucgagugguacaugcgcgcccgccccgaggacgucaucuccgagggccgcggcaagacccacuga

SEQ ID NO: 46118 - RNA, 531 nt, Artificial Sequence
  derived and/or modified sequence opt2 from MPV17__Homo_sapiens__XP_005264383
auggcccucuggcgcgccuaccagcgcgcccucgccgcccaccccuggaagguccagguccucaccgccggcucccucaugggccucggcgacaucaucucccagcagcucgucgagcgccgcggccuccaggagcaccagcgcggccgcacccucaccauggucucccucggcugcggcuucgucggccccgucgucggcggcugguacaagguccucgaccgcuucauccccggcaccaccaaggucgacgcccucaagaagaugcuccucgaccagggcggcuucgcccccugcuuccucggcugcuuccucccccucgucggcgcccucaacggccucuccgcccaggacaacugggccaagcuccagcgcgacuaccccgacgcccucaucaccaacuacuaccucuggcccgccguccagcucgccaacuucuaccucgucccccuccacuaccgccucgccgucguccagugcgucgccgucaucuggaacuccuaccucuccuggaaggcccaccgccucuga

SEQ ID NO: 46119 - RNA, 621 nt, Artificial Sequence
  derived and/or modified sequence opt2 from MPV17L2__Homo_sapiens__NP_116072
auggcccgcggcggcuggcgccgccuccgccgccuccucuccgccggccagcuccucuuccagggccgcgcccuccucgucaccaacacccucggcugcggcgcccucauggccgccggcgacggcguccgccaguccugggagauccgcgcccgccccggccaggucuucgacccccgccgcuccgccuccauguucgccgucggcugcuccaugggccccuuccuccacuacugguaccucucccucgaccgccucuuccccgccuccggccuccgcggcuuccccaacguccucaagaagguccucgucgaccagcucgucgccuccccccuccucggcgucugguacuuccucggccucggcugccucgagggccagaccgucggcgaguccugccaggagcuccgcgagaaguucugggaguucuacaaggccgacuggugcgucuggcccgccgcccaguucgucaacuuccucuucguccccccccaguuccgcgucaccuacaucaacggccucacccucggcugggacaccuaccucuccuaccucaaguaccgcucccccgucccccucaccccccccggcugcgucgcccucgacacccgcgccgacuga

SEQ ID NO: 46120 - RNA, 747 nt, Artificial Sequence
  derived and/or modified sequence opt2 from MPZ__Homo_sapiens__NP_000521
auggcccccggcgcccccuccuccucccccucccccauccucgccguccuccucuucuccucccucguccucucccccgcccaggccaucgucgucuacaccgaccgcgagguccacggcgccgucggcucccgcgucacccuccacugcuccuucugguccuccgagugggucuccgacgacaucuccuucaccuggcgcuaccagcccgagggcggccgcgacgccaucuccaucuuccacuacgccaagggccagcccuacaucgacgaggucggcaccuucaaggagcgcauccagugggucggcgacccccgcuggaaggacggcuccaucgucauccacaaccucgacuacuccgacaacggcaccuucaccugcgacgucaagaacccccccgacaucgucggcaagaccucccaggucacccucuacgucuucgagaagguccccacccgcuacggcgucguccucggcgccgucaucggcggcguccucggcgucguccuccuccuccuccuccucuucuacgucguccgcuacugcuggcuccgccgccaggccgcccuccagcgccgccucuccgccauggagaagggcaagcuccacaagcccggcaaggacgccuccaagcgcggccgccagacccccguccucuacgccaugcucgaccacucccgcuccaccaaggccgucuccgagaagaaggccaagggccucggcgagucccgcaaggacaagaaguga

SEQ ID NO: 46121 - RNA, 360 nt, Artificial Sequence
  derived and/or modified sequence opt2 from MPZL1__Homo_sapiens__NP_001139663
auggccgccuccgccggcgccggcgccgucaucgccgcccccgacucccgccgcuggcucugguccguccucgccgccgcccucggccuccucaccgccggcgucuccgcccucgaggucuacacccccaaggagaucuucgucgccaacggcacccagggcaagcucaccugcaaguucaaguccaccuccaccaccggcggccucaccuccgucuccugguccuuccagcccgagggcgccgacaccaccgucuccggccccgucaucuacgcccagcucgaccacuccggcggccaccacuccgacaagaucaacaaguccgaguccgucgucuacgccgacauccgcaagaacuga

SEQ ID NO: 46122 - RNA, 648 nt, Artificial Sequence
  derived and/or modified sequence opt2 from MPZL2__Homo_sapiens__NP_658911
auguacggcaaguccuccacccgcgccguccuccuccuccucggcauccagcucaccgcccucuggcccaucgccgccgucgagaucuacaccucccgcguccucgaggccgucaacggcaccgacgcccgccucaagugcaccuucuccuccuucgcccccgucggcgacgcccucaccgucaccuggaacuuccgcccccucgacggcggccccgagcaguucgucuucuacuaccacaucgaccccuuccagcccauguccggccgcuucaaggaccgcgucuccugggacggcaaccccgagcgcuacgacgccuccauccuccucuggaagcuccaguucgacgacaacggcaccuacaccugccaggucaagaacccccccgacgucgacggcgucaucggcgagauccgccucuccgucguccacaccguccgcuucuccgagauccacuuccucgcccucgccaucggcuccgccugcgcccucaugaucaucaucgucaucgucgucguccucuuccagcacuaccgcaagaagcgcugggccgagcgcgcccacaaggucgucgagaucaaguccaaggaggaggagcgccucaaccaggagaagaaggucuccgucuaccucgaggacaccgacuga

SEQ ID NO: 46123 - RNA, 672 nt, Artificial Sequence
  derived and/or modified sequence opt2 from MPZL3__Homo_sapiens__NP_001273081
augcagcagcgcggcgccgccggcucccgcggcugcgcccucuucccccuccucggcguccucuucuuccaggacgcccacguccgcggcuacgucggcgagaagaucaagcucaagugcaccuucaaguccaccuccgacgucaccgacaagcucaccaucgacuggaccuaccgcccccccuccuccucccacaccgucuccaucuuccacuaccaguccuuccaguaccccaccaccgccggcaccuuccgcgaccgcaucuccugggucggcaacgucuacaagggcgacgccuccaucuccaucuccaaccccaccaucaaggacaacggcaccuucuccugcgccgucaagaacccccccgacguccaccacaacauccccaugaccgagcucaccgucaccgagcgcggcuucggcaccaugcucuccuccgucgcccuccucuccauccucgucuucguccccuccgccgucgucgucgcccuccuccucguccgcaugggccgcaaggccgccggccucaagaagcgcucccgcuccggcuacaagaaguccuccaucgaggucuccgacgacaccgaccaggaggaggaggaggccugcauggcccgccucugcguccgcugcgccgagugccucgacuccgacuacgaggagaccuacuga

SEQ ID NO: 46124 - RNA, 891 nt, Artificial Sequence
  derived and/or modified sequence opt2 from MR1__Homo_sapiens__NP_001181928
augggcgagcucauggccuuccuccucccccucaucaucguccucauggucaagcacuccgacucccgcacccacucccuccgcuacuuccgccucggcgucuccgaccccauccacggcguccccgaguucaucuccgucggcuacgucgacucccaccccaucaccaccuacgacuccgucacccgccagaaggagccccgcgcccccuggauggccgagaaccucgcccccgaccacugggagcgcuacacccagcuccuccgcggcuggcagcagauguucaaggucgagcucaagcgccuccagcgccacuacaaccacuccgacaacgucgcccacaccaucaagcaggccugggaggccaaccagcacgagcuccucuaccagaagaacuggcucgaggaggagugcaucgccuggcucaagcgcuuccucgaguacggcaaggacacccuccagcgcaccgagcccccccucguccgcgucaaccgcaaggagaccuuccccggcgucaccgcccucuucugcaaggcccacggcuucuacccccccgagaucuacaugaccuggaugaagaacggcgaggagaucguccaggagaucgacuacggcgacauccuccccuccggcgacggcaccuaccaggccugggccuccaucgagcucgacccccaguccuccaaccucuacuccugccacgucgagcacugcggcguccacaugguccuccaggucccccaggaguccgagaccaucccccucgucaugaaggccgucuccggcuccaucguccucgucaucguccucgccggcgucggcguccucgucuggcgccgccgcccccgcgagcagaacggcgccaucuaccuccccacccccgaccgcuga

SEQ ID NO: 46125 - RNA, 618 nt, Artificial Sequence
  derived and/or modified sequence opt2 from MRAP2__Homo_sapiens__XP_011533703
auguccgcccagcgccucaucuccaaccgcaccucccagcaguccgccuccaacuccgacuacaccugggaguacgaguacuacgagaucggccccgucuccuucgagggccucaaggcccacaaguacuccaucgucaucggcuucugggucggccucgccgucuucgucaucuucauguucuucguccucacccuccucaccaagaccggcgccccccaccaggacaacgccgaguccuccgagaagcgcuuccgcaugaacuccuucgucuccgacuucggccgcccccucgagcccgacaaggucuucucccgccagggcaacgaggagucccgcucccucuuccacugcuacaucaacgaggucgagcgccucgaccgcgccaaggccugccaccagaccaccgcccucgacuccgacguccagcuccaggaggccauccgcuccuccggccagcccgaggaggagcucaaccgccucaugaaguucgacauccccaacuucgucaacaccgaccagaacuacuucggcgaggacgaccuccucaucuccgagccccccaucguccucgagaccaagccccucucccagaccucccacaaggaccucgacuga

SEQ ID NO: 46126 - RNA, 519 nt, Artificial Sequence
  derived and/or modified sequence opt2 from MRAP__Homo_sapiens__NP_848932
auggccaacggcaccaacgccuccgcccccuacuacuccuacgaguacuaccucgacuaccucgaccucauccccgucgacgagaagaagcucaaggcccacaagcacuccaucgucaucgccuucugggucucccucgccgccuucgucguccuccucuuccucauccuccucuacauguccugguccgccuccccccagaugcgcaacucccccaagcaccaccagaccugccccuggucccacggccucaaccuccaccucugcauccagaagugccuccccugccaccgcgagccccucgccaccucccaggcccaggccuccuccgucgagcccggcucccgcaccggccccgaccagccccuccgccaggaguccuccuccacccucccccucggcggcuuccagacccaccccacccuccucugggagcucacccucaacggcggcccccucguccgcuccaagcccuccgagcccccccccggcgaccgcaccucccagcuccaguccuga

SEQ ID NO: 46127 - RNA, 627 nt, Artificial Sequence
  derived and/or modified sequence opt2 from MRAS__Homo_sapiens__NP_001239019
auggccaccuccgccguccccuccgacaaccuccccaccuacaagcucgucgucgucggcgacggcggcgucggcaaguccgcccucaccauccaguucuuccagaagaucuucguccccgacuacgaccccaccaucgaggacuccuaccucaagcacaccgagaucgacaaccagugggccauccucgacguccucgacaccgccggccaggaggaguucuccgccaugcgcgagcaguacaugcgcaccggcgacggcuuccucaucgucuacuccgucaccgacaaggccuccuucgagcacgucgaccgcuuccaccagcucauccuccgcgucaaggaccgcgaguccuuccccaugauccucgucgccaacaaggucgaccucaugcaccuccgcaagaucacccgcgagcagggcaaggagauggccaccaagcacaacauccccuacaucgagaccuccgccaaggaccccccccucaacgucgacaaggccuuccacgaccucguccgcgucauccgccagcagauccccgagaagucccagaagaagaagaagaagaccaaguggcgcggcgaccgcgccaccggcacccacaagcuccagugcgucauccucuga

SEQ ID NO: 46128 - RNA, 4371 nt, Artificial Sequence
  derived and/or modified sequence opt2 from MRC1__Homo_sapiens__NP_002429
augcgccucccccuccuccucgucuucgccuccgucauccccggcgccguccuccuccucgacacccgccaguuccucaucuacaacgaggaccacaagcgcugcgucgacgccgucucccccuccgccguccagaccgccgccugcaaccaggacgccgagucccagaaguuccgcugggucuccgagucccagaucauguccgucgccuucaagcucugccucggcguccccuccaagaccgacugggucgccaucacccucuacgccugcgacuccaaguccgaguuccagaagugggagugcaagaacgacacccuccucggcaucaagggcgaggaccucuucuucaacuacggcaaccgccaggagaagaacaucaugcucuacaagggcuccggccucuggucccgcuggaagaucuacggcaccaccgacaaccucugcucccgcggcuacgaggccauguacacccuccucggcaacgccaacggcgccaccugcgccuuccccuucaaguucgagaacaagugguacgccgacugcaccuccgccggccgcuccgacggcuggcucuggugcggcaccaccaccgacuacgacaccgacaagcucuucggcuacugcccccucaaguucgagggcuccgagucccucuggaacaaggacccccucaccuccgucuccuaccagaucaacuccaaguccgcccucaccuggcaccaggcccgcaaguccugccagcagcagaacgccgagcuccucuccaucaccgagauccacgagcagaccuaccucaccggccucaccuccucccucaccuccggccucuggaucggccucaacucccucuccuucaacuccggcuggcagugguccgaccgcucccccuuccgcuaccucaacuggcuccccggcucccccuccgccgagcccggcaaguccugcgucucccucaaccccggcaagaacgccaagugggagaaccucgagugcguccagaagcucggcuacaucugcaagaagggcaacaccacccucaacuccuucgucauccccuccgaguccgacguccccacccacugccccucccagugguggcccuacgccggccacugcuacaagauccaccgcgacgagaagaagauccagcgcgacgcccucaccaccugccgcaaggagggcggcgaccucaccuccauccacaccaucgaggagcucgacuucaucaucucccagcucggcuacgagcccaacgacgagcucuggaucggccucaacgacaucaagauccagauguacuucgagugguccgacggcacccccgucaccuucaccaaguggcuccgcggcgagcccucccacgagaacaaccgccaggaggacugcgucgucaugaagggcaaggacggcuacugggccgaccgcggcugcgaguggccccucggcuacaucugcaagaugaagucccgcucccagggccccgagaucgucgaggucgagaagggcugccgcaagggcuggaagaagcaccacuucuacugcuacaugaucggccacacccucuccaccuucgccgaggccaaccagaccugcaacaacgagaacgccuaccucaccaccaucgaggaccgcuacgagcaggccuuccucaccuccuucgucggccuccgccccgagaaguacuucuggaccggccucuccgacauccagaccaagggcaccuuccaguggaccaucgaggaggagguccgcuucacccacuggaacuccgacaugcccggccgcaagcccggcugcgucgccaugcgcaccggcaucgccggcggccucugggacguccucaagugcgacgagaaggccaaguucgucugcaagcacugggccgagggcgucacccacccccccaagcccaccaccacccccgagcccaagugccccgaggacuggggcgccuccucccgcaccucccucugcuucaagcucuacgccaagggcaagcacgagaagaagaccugguucgagucccgcgacuucugccgcgcccucggcggcgaccucgccuccaucaacaacaaggaggagcagcagaccaucuggcgccucaucaccgccuccggcuccuaccacaagcucuucuggcucggccucaccuacggcucccccuccgagggcuucaccugguccgacggcucccccgucuccuacgagaacugggccuacggcgagcccaacaacuaccagaacgucgaguacugcggcgagcucaagggcgaccccaccauguccuggaacgacaucaacugcgagcaccucaacaacuggaucugccagauccagaagggccagacccccaagcccgagcccacccccgccccccaggacaacccccccgucaccgaggacggcugggucaucuacaaggacuaccaguacuacuucuccaaggagaaggagaccauggacaacgcccgcgccuucugcaagcgcaacuucggcgaccucgucuccauccaguccgaguccgagaagaaguuccucuggaaguacgucaaccgcaacgacgcccaguccgccuacuucaucggccuccucaucucccucgacaagaaguucgccuggauggacggcuccaaggucgacuacgucuccugggccaccggcgagcccaacuucgccaacgaggacgagaacugcgucaccauguacuccaacuccggcuucuggaacgacaucaacugcggcuaccccaacgccuucaucugccagcgccacaacuccuccaucaacgccaccaccgucaugcccaccaugcccuccguccccuccggcugcaaggagggcuggaacuucuacuccaacaagugcuucaagaucuucggcuucauggaggaggagcgcaagaacuggcaggaggcccgcaaggccugcaucggcuucggcggcaaccucgucuccauccagaacgagaaggagcaggccuuccucaccuaccacaugaaggacuccaccuucuccgccuggaccggccucaacgacgucaacuccgagcacaccuuccucuggaccgacggccgcggcguccacuacaccaacuggggcaagggcuaccccggcggccgccgcuccucccucuccuacgaggacgccgacugcgucgucaucaucggcggcgccuccaacgaggccggcaaguggauggacgacaccugcgacuccaagcgcggcuacaucugccagacccgcuccgaccccucccucaccaacccccccgccaccauccagaccgacggcuucgucaaguacggcaaguccuccuacucccucaugcgccagaaguuccaguggcacgaggccgagaccuacugcaagcuccacaacucccucaucgccuccauccucgaccccuacuccaacgccuucgccuggcuccagauggagaccuccaacgagcgcgucuggaucgcccucaacuccaaccucaccgacaaccaguacaccuggaccgacaaguggcgcguccgcuacaccaacugggccgccgacgagcccaagcucaaguccgccugcgucuaccucgaccucgacggcuacuggaagaccgcccacugcaacgaguccuucuacuuccucugcaagcgcuccgacgagauccccgccaccgagcccccccagcuccccggccgcugccccgaguccgaccacaccgccuggauccccuuccacggccacugcuacuacaucgaguccuccuacacccgcaacuggggccaggccucccucgagugccuccgcaugggcuccucccucgucuccaucgaguccgccgccgaguccuccuuccucuccuaccgcgucgagccccucaaguccaagaccaacuucuggaucggccucuuccgcaacgucgagggcaccuggcucuggaucaacaacucccccgucuccuucgucaacuggaacaccggcgaccccuccggcgagcgcaacgacugcgucgcccuccacgccuccuccggcuucugguccaacauccacugcuccuccuacaagggcuacaucugcaagcgccccaagaucaucgacgccaagcccacccacgagcuccucaccaccaaggccgacacccgcaagauggaccccuccaagcccuccuccaacgucgccggcgucgucaucaucgucauccuccucauccucaccggcgccggccucgccgccuacuucuucuacaagaagcgccgcguccaccucccccaggagggcgccuucgagaacacccucuacuucaacucccaguccucccccggcaccuccgacaugaaggaccucgucggcaacaucgagcagaacgagcacuccgucaucuga

SEQ ID NO: 46129 - RNA, 4440 nt, Artificial Sequence
  derived and/or modified sequence opt2 from MRC2__Homo_sapiens__NP_006030
augggccccggccgccccgcccccgcccccuggccccgccaccuccuccgcugcguccuccuccucggcugccuccaccucggccgccccggcgcccccggcgacgccgcccuccccgagcccaacgucuuccucaucuucucccacggccuccagggcugccucgaggcccagggcggccagguccgcgucacccccgccugcaacaccucccuccccgcccagcgcuggaagugggucucccgcaaccgccucuucaaccucggcaccaugcagugccucggcaccggcuggcccggcaccaacaccaccgccucccucggcauguacgagugcgaccgcgaggcccucaaccuccgcuggcacugccgcacccucggcgaccagcucucccuccuccucggcgcccgcaccuccaacaucuccaagcccggcacccucgagcgcggcgaccagacccgcuccggccaguggcgcaucuacggcuccgaggaggaccucugcgcccuccccuaccacgaggucuacaccauccagggcaacucccacggcaagcccugcaccauccccuucaaguacgacaaccagugguuccacggcugcaccuccaccggccgcgaggacggccaccucuggugcgccaccacccaggacuacggcaaggacgagcgcuggggcuucugccccaucaaguccaacgacugcgagaccuucugggacaaggaccagcucaccgacuccugcuaccaguucaacuuccaguccacccucuccuggcgcgaggccugggccuccugcgagcagcagggcgccgaccuccucuccaucaccgagauccacgagcagaccuacaucaacggccuccucaccggcuacuccuccacccucuggaucggccucaacgaccucgacaccuccggcggcuggcagugguccgacaacuccccccucaaguaccucaacugggaguccgaccagcccgacaaccccuccgaggagaacugcggcgucauccgcaccgaguccuccggcggcuggcagaaccgcgacugcuccaucgcccuccccuacgucugcaagaagaagcccaacgccaccgccgagcccaccccccccgaccgcugggccaacgucaaggucgagugcgagcccuccuggcagcccuuccagggccacugcuaccgccuccaggccgagaagcgcuccuggcaggaguccaagaaggccugccuccgcggcggcggcgaccucgucuccauccacuccauggccgagcucgaguucaucaccaagcagaucaagcaggaggucgaggagcucuggaucggccucaacgaccucaagcuccagaugaacuucgagugguccgacggcucccucgucuccuucacccacuggcaccccuucgagcccaacaacuuccgcgacucccucgaggacugcgucaccaucuggggccccgagggccgcuggaacgacucccccugcaaccagucccuccccuccaucugcaagaaggccggccagcucucccagggcgccgccgaggaggaccacggcugccgcaagggcuggaccuggcacucccccuccugcuacuggcucggcgaggaccaggucaccuacuccgaggcccgccgccucugcaccgaccacggcucccagcucgucaccaucaccaaccgcuucgagcaggccuucgucuccucccucaucuacaacugggagggcgaguacuucuggaccgcccuccaggaccucaacuccaccggcuccuucuucuggcucuccggcgacgaggucauguacacccacuggaaccgcgaccagcccggcuacucccgcggcggcugcgucgcccucgccaccggcuccgccaugggccucugggaggucaagaacugcaccuccuuccgcgcccgcuacaucugccgccagucccucggcacccccgucacccccgagcuccccggccccgaccccacccccucccucaccggcuccugcccccagggcugggccuccgacaccaagcuccgcuacugcuacaaggucuucuccuccgagcgccuccaggacaagaaguccuggguccaggcccagggcgccugccaggagcucggcgcccagcuccucucccucgccuccuacgaggaggagcacuucgucgccaacaugcucaacaagaucuucggcgaguccgagcccgagauccacgagcagcacugguucuggaucggccucaaccgccgcgacccccgcggcggccaguccuggcgcugguccgacggcgucggcuucuccuaccacaacuucgaccgcucccgccacgacgacgacgacauccgcggcugcgccguccucgaccucgccucccuccagugggucgccaugcagugcgacacccagcucgacuggaucugcaagaucccccgcggcaccgacguccgcgagcccgacgacuccccccagggccgccgcgaguggcuccgcuuccaggaggccgaguacaaguucuucgagcaccacuccaccugggcccaggcccagcgcaucugcaccugguuccaggccgagcucaccuccguccacucccaggccgagcucgacuuccucucccacaaccuccagaaguucucccgcgcccaggagcagcacugguggaucggccuccacaccuccgaguccgacggccgcuuccgcuggaccgacggcuccaucaucaacuucaucuccugggcccccggcaagccccgccccgucggcaaggacaagaagugcgucuacaugaccgccucccgcgaggacuggggcgaccagcgcugccucaccgcccuccccuacaucugcaagcgcuccaacgucaccaaggagacccagccccccgaccuccccaccaccgcccucggcggcugccccuccgacuggauccaguuccucaacaagugcuuccagguccagggccaggagccccagucccgcgucaagugguccgaggcccaguucuccugcgagcagcaggaggcccagcucgucaccaucaccaacccccucgagcaggccuucaucaccgccucccuccccaacgucaccuucgaccucuggaucggccuccacgccucccagcgcgacuuccagugggucgagcaggagccccucauguacgccaacugggcccccggcgagcccuccggccccucccccgcccccuccggcaacaagcccaccuccugcgccgucguccuccacucccccuccgcccacuucaccggccgcugggacgaccgcuccugcaccgaggagacccacggcuucaucugccagaagggcaccgaccccucccucucccccucccccgccgcccucccccccgcccccggcaccgagcucuccuaccucaacggcaccuuccgccuccuccagaagccccuccgcuggcacgacgcccuccuccucugcgagucccgcaacgccucccucgccuacguccccgaccccuacacccaggccuuccucacccaggccgcccgcggccuccgcaccccccucuggaucggccucgccggcgaggagggcucccgccgcuacuccugggucuccgaggagccccucaacuacgucggcuggcaggacggcgagccccagcagcccggcggcugcaccuacgucgacgucgacggcgccuggcgcaccaccuccugcgacaccaagcuccagggcgccgucugcggcgucuccuccggccccccccccccccgccgcaucuccuaccacggcuccugcccccagggccucgccgacuccgccuggauccccuuccgcgagcacugcuacuccuuccacauggagcuccuccucggccacaaggaggcccgccagcgcugccagcgcgccggcggcgccguccucuccauccucgacgagauggagaacgucuucgucugggagcaccuccaguccuacgagggccagucccgcggcgccuggcucggcaugaacuucaaccccaagggcggcacccucgucuggcaggacaacaccgccgucaacuacuccaacuggggcccccccggccucggccccuccaugcucucccacaacuccugcuacuggauccaguccaacuccggccucuggcgccccggcgccugcaccaacaucaccaugggcgucgucugcaagcucccccgcgccgagcaguccuccuucucccccuccgcccuccccgagaaccccgccgcccucgucgucguccucauggccguccuccuccuccucgcccuccucaccgccgcccucauccucuaccgccgccgccaguccaucgagcgcggcgccuucgagggcgcccgcuacucccgcuccuccuccucccccaccgaggccaccgagaagaacauccucgucuccgacauggagaugaacgagcagcaggaguga

SEQ ID NO: 46130 - RNA, 2043 nt, Artificial Sequence
  derived and/or modified sequence opt2 from MRE11A__Homo_sapiens__NP_005581
auguccaccgccgacgcccucgacgacgagaacaccuucaagauccucgucgccaccgacauccaccucggcuucauggagaaggacgccguccgcggcaacgacaccuucgucacccucgacgagauccuccgccucgcccaggagaacgaggucgacuucauccuccucggcggcgaccucuuccacgagaacaagcccucccgcaagacccuccacaccugccucgagcuccuccgcaaguacugcaugggcgaccgccccguccaguucgagauccucuccgaccaguccgucaacuucggcuucuccaaguuccccugggucaacuaccaggacggcaaccucaacaucuccauccccgucuucuccauccacggcaaccacgacgaccccaccggcgccgacgcccucugcgcccucgacauccucuccugcgccggcuucgucaaccacuucggccgcuccauguccgucgagaagaucgacaucucccccguccuccuccagaagggcuccaccaagaucgcccucuacggccucggcuccauccccgacgagcgccucuaccgcauguucgucaacaagaaggucaccaugcuccgccccaaggaggacgagaacuccugguucaaccucuucgucauccaccagaaccgcuccaagcacggcuccaccaacuucauccccgagcaguuccucgacgacuucaucgaccucgucaucuggggccacgagcacgagugcaagaucgcccccaccaagaacgagcagcagcucuucuacaucucccagcccggcuccuccgucgucaccucccucucccccggcgaggccgucaagaagcacgucggccuccuccgcaucaagggccgcaagaugaacaugcacaagaucccccuccacaccguccgccaguucuucauggaggacaucguccucgccaaccaccccgacaucuucaaccccgacaaccccaaggucacccaggccauccaguccuucugccucgagaagaucgaggagaugcucgagaacgccgagcgcgagcgccucggcaacucccaccagcccgagaagccccucguccgccuccgcgucgacuacuccggcggcuucgagcccuucuccguccuccgcuucucccagaaguucgucgaccgcgucgccaaccccaaggacaucauccacuucuuccgccaccgcgagcagaaggagaagaccggcgaggagaucaacuucggcaagcucaucaccaagcccuccgagggcaccacccuccgcgucgaggaccucgucaagcaguacuuccagaccgccgagaagaacguccagcucucccuccucaccgagcgcggcaugggcgaggccguccaggaguucgucgacaaggaggagaaggacgccaucgaggagcucgucaaguaccagcucgagaagacccagcgcuuccucaaggagcgccacaucgacgcccucgaggacaagaucgacgaggagguccgccgcuuccgcgagacccgccagaagaacaccaacgaggaggacgacgagguccgcgaggccaugacccgcgcccgcgcccuccgcucccaguccgaggaguccgccuccgccuucuccgccgacgaccucauguccaucgaccucgccgagcagauggccaacgacuccgacgacuccaucuccgccgccaccaacaagggccgcggccgcggccgcggccgccgcggcggccgcggccagaacuccgccucccgcggcggcucccagcgcggccgcgccuucaaguccacccgccagcagcccucccgcaacgucaccaccaagaacuacuccgaggucaucgaggucgacgaguccgacgucgaggaggacaucuuccccaccaccuccaagaccgaccagcgcugguccuccaccuccuccuccaagaucaugucccagucccaggucuccaagggcgucgacuucgaguccuccgaggacgacgacgacgaccccuucaugaacaccuccucccuccgccgcaaccgccgcuga

SEQ ID NO: 46131 - RNA, 645 nt, Artificial Sequence
  derived and/or modified sequence opt2 from MREG__Homo_sapiens__NP_060470
augggccuccgcgacuggcuccgcaccgucugcugcugcugcggcugcgagugccucgaggagcgcgcccuccccgagaaggagccccucgucuccgacaacaaccccuacuccuccuucggcgccacccucguccgcgacgacgagaagaaccucugguccaugccccacgacgucucccacaccgaggccgacgacgaccgcacccucuacaaccucaucgucauccgcaaccagcaggccaaggacuccgaggaguggcagaagcucaacuacgacauccacacccuccgccagguccgccgcgagguccgcaaccgcuggaagugcauccucgaggaccucggcuuccagaaggaggccgacucccuccucuccgucaccaagcucuccaccaucuccgacuccaagaacacccgcaaggcccgcgagaugcuccucaagcucgccgaggagaccaacaucuuccccaccuccugggagcucuccgagcgcuaccucuucgucgucgaccgccucaucgcccucgacgccgccgaggaguucuucaagcucgcccgccgcaccuaccccaagaagcccggcguccccugccucgccgacggccagaaggagcuccacuaccuccccuuccccucccccuga

SEQ ID NO: 46132 - RNA, 384 nt, Artificial Sequence
  derived and/or modified sequence opt2 from MRFAP1__Homo_sapiens__NP_150638
augcgcccccucgacaucgucgagcucgccgagcccgaggaggucgagguccucgagcccgaggaggacuucgagcaguuccuccuccccgucaucaacgagaugcgcgaggacaucgccucccucacccgcgagcacggccgcgccuaccuccgcaaccgcuccaagcucugggagauggacaacaugcucauccagaucaagacccaggucgaggccuccgaggaguccgcccucaaccaccuccagaaccccggcgacgccgccgagggccgcgccgccaagcgcugcgagaaggccgaggagaaggccaaggagaucgccaagauggccgagaugcucgucgagcucguccgccgcaucgagaaguccgaguccuccuga

SEQ ID NO: 46133 - RNA, 615 nt, Artificial Sequence
  derived and/or modified sequence opt2 from MRGBP__Homo_sapiens__NP_060740
augggcgaggccgaggucggcggcggcggcgccgccggcgacaagggccccggcgaggccgccaccucccccgccgaggagaccgucgucuggucccccgaggucgaggucugccucuuccacgccaugcucggccacaagcccgucggcgucaaccgccacuuccacaugaucugcauccgcgacaaguucucccagaacaucggccgccagguccccuccaaggucaucugggaccaccucuccaccauguacgacaugcaggcccuccacgaguccgagauccuccccuuccccaaccccgagcgcaacuucguccuccccgaggagaucauccaggagguccgcgagggcaaggucaugaucgaggaggagaugaaggaggagaugaaggaggacgucgacccccacaacggcgccgacgacgucuucuccuccuccggcucccucggcaaggccuccgagaaguccuccaaggacaaggagaagaacuccuccgaccucggcugcaaggagggcgccgacaagcgcaagcgcucccgcgucaccgacaagguccucaccgccaacuccaaccccuccucccccuccgccgccaagcgccgccgcaccuga

SEQ ID NO: 46134 - RNA, 1032 nt, Artificial Sequence
  derived and/or modified sequence opt2 from MRGPRF__Homo_sapiens__NP_659452
auggccggcaacugcuccugggaggcccaccccggcaaccgcaacaagaugugccccggccucuccgaggcccccgagcucuacucccgcggcuuccucaccaucgagcagaucgccaugcuccccccccccgccgucaugaacuacaucuuccuccuccucugccucugcggccucgucggcaacggccucguccucugguucuucggcuucuccaucaagcgcaaccccuucuccaucuacuuccuccaccucgccuccgccgacgucggcuaccucuucuccaaggccgucuucuccauccucaacaccggcggcuuccucggcaccuucgccgacuacauccgcuccgucugccgcguccucggccucugcauguuccucaccggcgucucccuccuccccgccgucuccgccgagcgcugcgccuccgucaucuuccccgccugguacuggcgccgccgccccaagcgccucuccgccgucgucugcgcccuccucuggguccucucccuccucgucaccugccuccacaacuacuucugcgucuuccucggccgcggcgcccccggcgccgccugccgccacauggacaucuuccucggcauccuccucuuccuccucugcugcccccucaugguccuccccugccucgcccucauccuccacgucgagugccgcgcccgccgccgccagcgcuccgccaagcucaaccacgucauccucgccauggucuccgucuuccucgucuccuccaucuaccucggcaucgacugguuccucuucugggucuuccagauccccgcccccuuccccgaguacgucaccgaccucugcaucugcaucaacuccuccgccaagcccaucgucuacuuccucgccggccgcgacaagucccagcgccucugggagccccuccgcgucgucuuccagcgcgcccuccgcgacggcgccgagcucggcgaggccggcggcuccacccccaacaccgucaccauggagaugcagugcccccccggcaacgccuccuga

SEQ ID NO: 46135 - RNA, 969 nt, Artificial Sequence
  derived and/or modified sequence opt2 from MRGPRX1__Homo_sapiens__NP_671732
auggaccccaccaucuccacccucgacaccgagcucacccccaucaacggcaccgaggagacccucugcuacaagcagacccucucccucaccguccucaccugcaucgucucccucgucggccucaccggcaacgccgucguccucuggcuccucggcugccgcaugcgccgcaacgccuucuccaucuacauccucaaccucgccgccgccgacuuccucuuccucuccggccgccucaucuacucccuccucuccuucaucuccaucccccacaccaucuccaagauccucuaccccgucaugauguucuccuacuucgccggccucuccuuccucuccgccgucuccaccgagcgcugccucuccguccucuggcccaucugguaccgcugccaccgccccacccaccucuccgccgucgucugcguccuccucugggcccucucccuccuccgcuccauccucgaguggaugcucugcggcuuccucuucuccggcgccgacuccgccuggugccagaccuccgacuucaucaccgucgccuggcucaucuuccucugcgucguccucugcggcuccucccucguccuccucauccgcauccucugcggcucccgcaagaucccccucacccgccucuacgucaccauccuccucaccguccucgucuuccuccucugcggccuccccuucggcauccaguucuuccucuuccucuggauccacgucgaccgcgagguccucuucugccacguccaccucgucuccaucuuccucuccgcccucaacuccuccgccaaccccaucaucuacuucuucgucggcuccuuccgccagcgccagaaccgccagaaccucaagcucguccuccagcgcgcccuccaggacgccuccgaggucgacgagggcggcggccagcuccccgaggagauccucgagcucuccggcucccgccucgagcaguga

SEQ ID NO: 46136 - RNA, 969 nt, Artificial Sequence
  derived and/or modified sequence opt2 from MRGPRX3__Homo_sapiens__NP_473372
auggacuccaccauccccguccucggcaccgagcucacccccaucaacggccgcgaggagacccccugcuacaagcagacccucuccuucaccggccucaccugcaucgucucccucgucgcccucaccggcaacgccgucguccucuggcuccucggcugccgcaugcgccgcaacgccgucuccaucuacauccucaaccucgucgccgccgacuuccucuuccucuccggccacaucaucugcuccccccuccgccucaucaacauccgccaccccaucuccaagauccucucccccgucaugaccuuccccuacuucaucggccucuccaugcucuccgccaucuccaccgagcgcugccucuccauccucuggcccaucugguaccacugccgccgcccccgcuaccucuccuccgucaugugcguccuccucugggcccucucccuccuccgcuccauccucgaguggauguucugcgacuuccucuucuccggcgccaacuccgucuggugcgagaccuccgacuucaucaccaucgccuggcucgucuuccucugcgucguccucugcggcuccucccucguccuccucguccgcauccucugcggcucccgcaagaugccccucacccgccucuacgucaccauccuccucaccguccucgucuuccuccucugcggccuccccuucggcauccagugggcccucuucucccgcauccaccucgacuggaagguccucuucugccacguccaccucgucuccaucuuccucuccgcccucaacuccuccgccaaccccaucaucuacuucuucgucggcuccuuccgccagcgccagaaccgccagaaccucaagcucguccuccagcgcgcccuccaggacacccccgaggucgacgagggcggcggcuggcucccccaggagacccucgagcucuccggcucccgccucgagcaguga

SEQ ID NO: 46137 - RNA, 969 nt, Artificial Sequence
  derived and/or modified sequence opt2 from MRGPRX4__Homo_sapiens__NP_473373
auggaccccaccguccccgucuucggcaccaagcucacccccaucaacggccgcgaggagacccccugcuacaaccagacccucuccuucaccguccucaccugcaucaucucccucgucggccucaccggcaacgccgucguccucuggcuccucggcuaccgcaugcgccgcaacgccgucuccaucuacauccucaaccucgccgccgccgacuuccucuuccucuccuuccagaucauccgccucccccuccgccucaucaacaucucccaccucauccgcaagauccucgucuccgucaugaccuuccccuacuucaccggccucuccaugcucuccgccaucuccaccgagcgcugccucuccguccucuggcccaucugguaccgcugccgccgccccacccaccucuccgccgucgucugcguccuccucuggggccucucccuccucuucuccaugcucgaguggcgcuucugcgacuuccucuucuccggcgccgacuccuccuggugcgagaccuccgacuucauccccgucgccuggcucaucuuccucugcgucguccucugcgucuccucccucguccuccucguccgcauccucugcggcucccgcaagaugccccucacccgccucuacgucaccauccuccucaccguccucgucuuccuccucugcggccuccccuucggcauccucggcgcccucaucuaccgcaugcaccucaaccucgagguccucuacugccacgucuaccucgucugcaugucccucuccucccucaacuccuccgccaaccccaucaucuacuucuucgucggcuccuuccgccagcgccagaaccgccagaaccucaagcucguccuccagcgcgcccuccaggacaagcccgaggucgacaagggcgagggccagcuccccgaggagucccucgagcucuccggcucccgccucggccccuga

SEQ ID NO: 46138 - RNA, 1110 nt, Artificial Sequence
  derived and/or modified sequence opt2 from MRI1__Homo_sapiens__NP_001026897
augacccucgaggccauccgcuacucccgcggcucccuccagauccucgaccagcuccuccuccccaagcagucccgcuacgaggccgucggcuccguccaccaggccugggaggccauccgcgccaugaagguccgcggcgcccccgccaucgcccucgucggcugccucucccucgccgucgagcuccaggccggcgccggcggccccggccucgccgcccucgucgccuucguccgcgacaagcucuccuuccucgucaccgcccgccccaccgccgucaacauggcccgcgccgcccgcgaccucgccgacgucgccgcccgcgaggccgagcgcgagggcgccaccgaggaggccguccgcgagcgcgucaucugcugcaccgaggacaugcucgagaaggaccuccgcgacaaccgcuccaucggcgaccucggcgcccgccaccuccucgagcgcgucgcccccuccggcggcaaggucaccguccucacccacugcaacaccggcgcccucgccaccgccggcuacggcaccgcccucggcgucauccgcucccuccacucccucggccgccucgagcacgccuucugcaccgagacccgccccuacaaccagggcgcccgccucaccgccuucgagcucgucuacgagcagauccccgccacccucaucaccgacuccauggucgccgccgccauggcccaccgcggcgucuccgccgucgucgucggcgccgaccgcgucgucgccaacggcgacaccgccaacaaggucggcaccuaccagcucgccaucgucgccaagcaccacggcauccccuucuacgucgccgcccccuccuccuccugcgaccuccgccucgagaccggcaaggagaucaucaucgaggagcgccccggccaggagcucaccgacgucaacggcguccgcaucgccgcccccggcaucggcgucuggaaccccgccuucgacgucaccccccacgaccucaucaccggcggcaucaucaccgagcucggcgucuucgcccccgaggagcuccgcaccgcccucaccaccaccaucuccucccgcgacggcacccucgacggcccccagauguga

SEQ ID NO: 46139 - RNA, 1062 nt, Artificial Sequence
  derived and/or modified sequence opt2 from MRM1__Homo_sapiens__NP_079140
auggcccuccucuccaccguccgcggcgccaccuggggccgccucgucacccgccacuucucccacgccgcccgccacggcgagcgccccggcggcgaggagcucucccgccuccuccucgacgaccucguccccaccucccgccucgagcuccucuucggcaugacccccugccuccucgcccuccaggccgcccgccgcuccgucgcccgccuccuccuccaggccggcaaggccggccuccagggcaagcgcgccgagcuccuccgcauggccgaggcccgcgacauccccguccuccgcccccgccgccagaagcucgacaccaugugccgcuaccagguccaccagggcgucugcauggaggucuccccccuccgcccccgccccuggcgcgaggccggcgaggccucccccggcgacgacccccagcagcucuggcucguccucgacggcauccaggacccccgcaacuucggcgccguccuccgcuccgcccacuuccucggcgucgacaaggucaucaccucccgccgcaacuccugcccccucacccccgucgucuccaaguccuccgccggcgccauggaggucauggacgucuucuccaccgacgaccucaccggcuuccuccagaccaaggcccagcagggcuggcucgucgccggcaccgucggcugccccuccaccgaggacccccaguccuccgagauccccaucauguccugccucgaguuccucugggagcgccccacccuccucguccucggcaacgagggcuccggccucucccaggagguccaggccuccugccagcuccuccucaccauccucccccgccgccagcucccccccggccucgagucccucaacgucuccgucgccgccggcauccuccuccacuccaucugcucccagcgcaagggcuuccccaccgagggcgagcgccgccagcuccuccaggacccccaggagcccuccgcccgcuccgagggccucuccauggcccagcaccccggccucuccuccggccccgagaaggagcgccagaacgagggcuga

SEQ ID NO: 46140 - RNA, 4758 nt, Artificial Sequence
  derived and/or modified sequence opt2 from MROH2B__Homo_sapiens__NP_775760
augacccucuccaccgaggaguccaucgagauguucggcgacaucaaccucacccucggcaugcucaacaaggaggacaucgucaacaaggaggacaucuacucccaccucaccuccgucauccagaacaccgacauccucgacgacgccaucguccagcgccucaucuacuacgccuccaaggacaugcgcgacaacaacaugcuccgcgagauccgcaugcucgccggcgagguccucgucucccucgccgcccacgacuucaacuccgucauguacgagguccaguccaacuuccgcauccucgagcuccccgacgaguucgucguccucgcccucgccgagcucgccaccuccuacgucucccaguccauccccuucaugaugaugacccuccucaccaugcagaccaugcuccgccucgccgaggacgagcgcaugaagggcaccuucugcaucgcccucgagaaguucuccaaggccaucuacaaguacgucaaccacuggcgcgacuuccccuacccccgccucgacgccaaccgccucuccgacaagaucuucaugcucuucugguacaucauggagaagugggccccccucgccucccccaugcagacccucuccaucgucaaggcccacggccccaccgucucccuccuccuccaccgcgaggacuuccgcggcuacgcccucggccagguccccuggcuccucaaccaguacaaggacaaggagaucgacuuccacgucacccagucccucaagcagauccucaccgccgccguccucuacgacaucggccucccccgcucccuccgccgcuccaucuucaucaaccuccuccagcagaucugccgcgcccccgagccccccgucaaggagaacgagaugaaggccuccuccugcuuccucauccucgcccacuccaaccccggcgagcucauggaguucuucgacgagcagguccgcuccaacaacgaggccauccgcgucggcauccucacccuccuccgccucgccgucaacgccgacgagccccgccuccgcgaccacaucaucuccaucgagcgcaccgucaagaucgucaugggcgaccucuccaccaagguccgcaacuccguccuccuccucauccagaccaugugcgagaaguccuacaucgaggcccgcgagggcuggccccucaucgacuacgucuucucccaguucgccacccucaaccgcaaccucgagaagcccgucaagaccaacuuccacgagaacgagaaggaggaggaguccguccgcgagaccucccucgagguccucaagacccucgacccccucgucaucggcaugccccagguccucuggccccgcauccucaccuucgucguccccgccgaguacaccgaggcccucgagccccucuucuccaucauccgcauccucaucauggccgaggagaagaagcagcacuccgccaaggaguccaccgcccucgucgucuccaccggcgccgucaagcuccccuccccccagcagcuccucgcccgccuccucgucaucuccaugcccgccucccucggcgagcuccgcggcgccggcgccaucggccuccucaagauccuccccgagaucauccaccccaagcucgucgaccucuggaagacccgccuccccgagcuccuccagccccucgagggcaagaacaucuccaccguccucugggagaccaugcuccuccagcuccucaaggagucccucuggaagaucuccgacgucgccuggaccauccagcucacccaggacuucaagcagcagaugggcuccuacuccaacaacuccaccgagaagaaguuccucuggaaggcccucggcaccacccucgccugcugccaggacuccgacuucgucaacucccagaucaaggaguuccucaccgcccccaaccagcucggcgaccagcgccagggcaucaccuccauccucggcuacugcgccgagaaccaccucgacaucguccucaagguccucaagaccuuccagaaccaggagaaguucuucaugaaccgcugcaagucccucuucuccggcaagaagucccucaccaagaccgacgucauggucaucuacggcgccgucgcccuccacgcccccaagaagcagcuccucucccgccucaaccaggacaucaucucccagguccucucccuccacggccagugcucccagguccucggcauguccgucaugaacaaggacauggaccuccagauguccuucacccgcuccaucaccgagaucggcaucgccguccaggacgccgaggaccagggcuuccaguucuccuacaaggagaugcucaucggcuacaugcucgacuucauccgcgacgagccccucgacucccucgccucccccauccgcuggaaggcccucaucgccauccgcuaccucuccaagcucaagccccagcucucccuccaggaccaccucaacauccucgaggagaacauccgccgccuccucccccuccccccccucgagaaccucaaguccgagggccagaccgacaaggacaaggagcacauccaguuccucuacgagcgcuccauggacgcccucggcaagcuccucaagaccaugaugugggacaacgucaacgccgaggacugccaggagauguucaaccuccuccagauguggcucgucucccagaaggagugggagcgcgagcgcgccuuccagaucaccgccaagguccucaccaacgacaucgaggcccccgagaacuucaagaucggcucccuccucggccuccucgccccccacuccugcgacacccuccccaccauccgccaggccgccgccuccuccaccaucggccucuucuacaucaagggcauccaccucgaggucgagcgccuccagggccuccaggagggccucgaguccgacgacguccagguccagaucaagaucuccuccaagaucgccaagaucgucuccaaguucauccccaacgaggagauccucauguuccucgaggagaugcucgacggccucgagucccucaaccccaccugcaccaaggccugcggcaucuggaugaucaccguccucaagcagcagggcgccgcccucgaggaccagcuccucgagauccucggcaccaucuaccaccacaugcccguccuccgccagaaggaggaguccuuccaguucauccucgaggccaucucccagaucgccuccuuccacauggacaccgucgucgucaaccuccuccagaagccccuccccuucgaccgcgacaccaagacccucuggaaggcccucgccgagaagcccgccuccuccggcaagcuccuccaggcccucaucgacaagcucgagaccgagcucgaggacgacaucgcccgcgucgaggccaucuccgucgccugcgccauguacgaggucaucuccaugggcaccuccgucaccggccucuaccccgagcucuucacccuccuccucaagcucgucuccugcacccucggccagaagaugcucaccugccccuggucccaccgccgccacgucaugcagcagggcgagcagcagcagauccccgaccccugccgccucuccaccgccacccucaagugccuccaggcccaggccaugcgcgagggccucgccaaggaguccgacgagggcgacaaccucuggacccuccucuccucccccuccacccaccacaucggcgucugcucccucgcccgcuccauggccgucuggcagcacggcgucauccucgacaucauggagcagcuccucuccucccucaccuccuccuccgagaacuaccgcaucaccggcgccgccuucuucuccgagcucaugaaggagcccauccucuggaagcacggcaaccuccgcaacguccucauccucauggaccaguccgccugggacuccaacgccacccuccgccagauggccauccgcggccucggcaacaccgccuccggcgccccccacaaggucaagaagcacaagcagcucaugcucgaguccaucauccgcggccucuaccaccucgcccgcaccgaggucgucugcgagucccucaaggcccucaagaagauccucgagcuccucaccgaccgcgacgucuccuucuacuucaaggagaucguccuccagacccgcaccuucuucgaggacgagcaggacgacguccgccucaccgccaucuuccucuucgaggaccucgccccccucaccggccgccgcuggaagaucuucuucgccgaggagaucaagaagucccucaucuccuuccuccuccaccucugggaccccaaccccaagaucggcgucgccugccgcgacguccucauggucugcauccccuuccucggccuccaggagcucuacggcguccucgaccgccuccucgaccaggaccucccccgcgcccgcgacuucuaccgccaguucugcgucaagcucgccaagaagaaccaggagauccucuggauccuccacacccacuccuucaccuucuucaccuccaccugggaggucauccgcuccgccgccgucaagcucaccgacgccgucguccucaaccucaccucccaguacgucgagcuccucgaccgcgagcagcucaccacccgccuccaggcccuccgccaggaccccugcaucuccguccagcgcgccgccgaggccgcccuccagacccuccuccgccgcugcaaggagaccuccaucccccucuga

SEQ ID NO: 46141 - RNA, 633 nt, Artificial Sequence
  derived and/or modified sequence opt2 from MRO__Homo_sapiens__NP_001120647
auggccuggggcuccaagggcauccagggcugggagaaccucgccgaguccucccaccucgccaccacccgcgaguccuccccccccgaguccggcaccggcuccggcuccucccgcggcucccgccuccaggagccccaggucuccuggaagcuccgcuuccagaagcgcgagccccucaagaacgucuucuucauccucgccgagcgcgcccgcgaccccuccgccaagaagcgccacauggccaugcgcaaccucggcaccauggccuacgaggcccccgacaagguccgcaaguacaagaagaucguccucgaccuccucgucuacggccucuacgaccccgucaaccucgaggucauccacgaguccaugaagacccucaccgucguccucggcaagauccagggcaagggccucggcuccuucuucaucgacaucacccuccagacccgcacccuccucgacgacgccugcaagaccaccuuccaggccugcucccccuaccucaagcucaaggaggaguacuccuuccaguccgaggaggaccagcgcaacaccaagcucuaccagcagcucucccacuaccaccccgagauccuccaguucuucuacgccaacaagauccucuga

SEQ ID NO: 46142 - RNA, 786 nt, Artificial Sequence
  derived and/or modified sequence opt2 from MRPL10__Homo_sapiens__NP_660298
auggccgccgccgucgccggcaugcuccgcggcggccuccucccccaggccggccgccuccccacccuccagaccguccgcuacggcuccaaggccgucacccgccaccgccgcgucaugcacuuccagcgccagaagcucauggccgucaccgaguacaucccccccaagcccgccauccaccccuccugccuccccuccccccccucccccccccaggaggagaucggccucauccgccuccuccgccgcgagaucgccgccgucuuccaggacaaccgcaugaucgccgucugccagaacgucgcccucuccgccgaggacaagcuccucaugcgccaccagcuccgcaagcacaagauccucaugaaggucuuccccaaccagguccucaagcccuuccucgaggacuccaaguaccagaaccuccucccccucuucgucggccacaacaugcuccucgucuccgaggagcccaaggucaaggagaugguccgcauccuccgcaccguccccuuccucccccuccucggcggcugcaucgacgacaccauccucucccgccagggcuucaucaacuacuccaagcuccccucccucccccucguccagggcgagcucgucggcggccucaccugccucaccgcccagacccacucccuccuccagcaccagccccuccagcucaccacccuccucgaccaguacauccgcgagcagcgcgagaaggacuccgucauguccgccaacggcaagcccgaccccgacaccguccccgacuccuga

SEQ ID NO: 46143 - RNA, 579 nt, Artificial Sequence
  derived and/or modified sequence opt2 from MRPL11__Homo_sapiens__NP_057134
auguccaagcucggccgcgccgcccgcggccuccgcaagcccgaggucggcggcgucauccgcgccaucguccgcgccggccucgccaugcccggccccccccucggccccguccucggccagcgcggcgucuccaucaaccaguucugcaaggaguucaacgagcgcaccaaggacaucaaggagggcaucccccuccccaccaagauccucgucaagcccgaccgcaccuucgagaucaagaucggccagcccaccgucuccuacuuccucaaggccgccgccggcaucgagaagggcgcccgccagaccggcaaggaggucgccggccucgucacccucaagcacgucuacgagaucgcccgcaucaaggcccaggacgaggccuucgcccuccaggacgucccccucuccuccgucguccgcuccaucaucggcuccgcccgcucccucggcauccgcgucgucaaggaccucuccuccgaggagcucgccgccuuccagaaggagcgcgccaucuuccucgccgcccagaaggaggccgaccucgccgcccaggaggaggccgccaagaaguga

SEQ ID NO: 46144 - RNA, 537 nt, Artificial Sequence
  derived and/or modified sequence opt2 from MRPL13__Homo_sapiens__NP_054797
auguccuccuucucccgcgccccccagcagugggccaccuucgcccgcaucugguaccuccucgacggcaagaugcagccccccggcaagcucgccgccauggccuccauccgccuccagggccuccacaagcccgucuaccacgcccucuccgacugcggcgaccacgucgucaucaugaacacccgccacaucgccuucuccggcaacaagugggagcagaaggucuacuccucccacaccggcuaccccggcggcuuccgccaggucaccgccgcccagcuccaccuccgcgaccccgucgccaucgucaagcucgccaucuacggcaugcuccccaagaaccuccaccgccgcaccaugauggagcgccuccaccucuuccccgacgaguacauccccgaggacauccucaagaaccucgucgaggagcucccccagccccgcaagauccccaagcgccucgacgaguacacccaggaggagaucgacgccuucccccgccucuggaccccccccgaggacuaccgccucuga

SEQ ID NO: 46145 - RNA, 891 nt, Artificial Sequence
  derived and/or modified sequence opt2 from MRPL15__Homo_sapiens__NP_054894
auggccggcccccuccagggcggcggcgcccgcgcccucgaccuccuccgcggccucccccgcgucucccucgccaaccucaagcccaaccccggcuccaagaagcccgagcgccgcccccgcggccgccgccgcggccgcaagugcggccgcggccacaagggcgagcgccagcgcggcacccgcccccgccucggcuucgagggcggccagacccccuucuacauccgcauccccaaguacggcuucaacgagggccacuccuuccgccgccaguacaagccccucucccucaaccgccuccaguaccucaucgaccucggccgcgucgaccccucccagcccaucgaccucacccagcucgucaacggccgcggcgucaccauccagccccucaagcgcgacuacggcguccagcucgucgaggagggcgccgacaccuucaccgccaaggucaacaucgagguccagcucgccuccgagcucgccaucgccgccaucgagaagaacggcggcgucgucaccaccgccuucuacgacccccgcucccucgacaucgucugcaagcccguccccuucuuccuccgcggccagcccauccccaagcgcaugcucccccccgaggagcucguccccuacuacaccgacgccaagaaccgcggcuaccucgccgaccccgccaaguuccccgaggcccgccucgagcucgcccgcaaguacggcuacauccuccccgacaucaccaaggacgagcucuucaagaugcucugcacccgcaaggacccccgccagaucuucuucggccucgcccccggcugggucgucaacauggccgacaagaagauccucaagcccaccgacgagaaccuccucaaguacuacaccuccuga

SEQ ID NO: 46146 - RNA, 528 nt, Artificial Sequence
  derived and/or modified sequence opt2 from MRPL17__Homo_sapiens__NP_071344
augcgccucuccgucgccgccgccaucucccacggccgcgucuuccgccgcaugggccucggccccgagucccgcauccaccuccuccgcaaccuccucaccggccucguccgccacgagcgcaucgaggcccccugggcccgcgucgacgagaugcgcggcuacgccgagaagcucaucgacuacggcaagcucggcgacaccaacgagcgcgccaugcgcauggccgacuucuggcucaccgagaaggaccucauccccaagcucuuccagguccucgccccccgcuacaaggaccagaccggcggcuacacccgcaugcuccagauccccaaccgcucccucgaccgcgccaagauggccgucaucgaguacaagggcaacugccuccccccccucccccucccccgccgcgacucccaccucacccuccucaaccagcuccuccagggccuccgccaggaccuccgccagucccaggaggccuccaaccacuccucccacaccgcccagacccccggcaucuga

SEQ ID NO: 46147 - RNA, 879 nt, Artificial Sequence
  derived and/or modified sequence opt2 from MRPL19__Homo_sapiens__NP_055578
auggccgccugcaucgccgccggccacugggccgccaugggccucggccgcuccuuccaggccgcccgcacccuccuccccccccccgccuccaucgccugccgcguccacgccggccccguccgccagcaguccaccggccccuccgagcccggcgccuuccagcccccccccaagcccgucaucgucgacaagcaccgccccgucgagcccgagcgccgcuuccucucccccgaguucaucccccgccgcggccgcaccgacccccucaaguuccagaucgagcgcaaggacaugcucgagcgccgcaagguccuccacauccccgaguucuacgucggcuccauccuccgcgucaccaccgccgaccccuacgccuccggcaagaucucccaguuccucggcaucugcauccagcgcuccggccgcggccucggcgccaccuucauccuccgcaacgucaucgagggccagggcgucgagaucugcuucgagcucuacaacccccgcguccaggagauccaggucgucaagcucgagaagcgccucgacgacucccuccucuaccuccgcgacgcccuccccgaguacuccaccuucgacgucaacaugaagcccgucguccaggagcccaaccagaagguccccgucaacgagcucaaggucaagaugaagcccaagcccugguccaagcgcugggagcgccccaacuucaacaucaagggcauccgcuucgaccucugccucaccgagcagcagaugaaggaggcccagaaguggaaccagcccuggcucgaguucgacaugaugcgcgaguacgacaccuccaagaucgaggccgccaucuggaaggagaucgaggccuccaagcgcuccuga

SEQ ID NO: 46148 - RNA, 978 nt, Artificial Sequence
  derived and/or modified sequence opt2 from MRPL1__Homo_sapiens__NP_064621
auggccgccgccguccgcugcaugggccgcgcccucauccaccaccagcgccacucccucuccaagauggucuaccagaccucccucugcuccugcuccgucaacauccgcguccccaaccgccacuucgccgccgccaccaaguccgccaagaagaccaagaagggcgccaaggagaagacccccgacgagaagaaggacgagaucgagaagaucaaggccuaccccuacauggagggcgagcccgaggacgacgucuaccucaagcgccucuacccccgccagaucuacgaggucgagaaggccguccaccuccucaagaaguuccagauccucgacuucaccucccccaagcaguccgucuaccucgaccucacccucgacauggcccucggcaagaagaagaacgucgagcccuucaccuccguccucucccuccccuaccccuucgccuccgagaucaacaaggucgccgucuucaccgagaacgccuccgaggucaagaucgccgaggagaacggcgccgccuucgccggcggcaccucccucauccagaagaucugggacgacgagaucgucgccgacuucuacgucgccguccccgagaucaugcccgagcucaaccgccuccgcaagaagcucaacaagaaguaccccaagcucucccgcaacuccaucggccgcgacauccccaagaugcucgagcucuucaagaacggccacgagaucaaggucgacgaggagcgcgagaacuuccuccagaccaagaucgccacccucgacauguccuccgaccagaucgccgccaaccuccaggccgucaucaacgaggucugccgccaccgcccccucaaccucggccccuucgucguccgcgccuuccuccgcuccuccaccuccgagggccuccuccucaagaucgacccccuccuccccaaggaggucaagaacgaggaguccgagaaggaggacgccuga

SEQ ID NO: 46149 - RNA, 462 nt, Artificial Sequence
  derived and/or modified sequence opt2 from MRPL23__Homo_sapiens__NP_066957
auggcccgcaacgucgucuacccccucuaccgccucggcggcccccagcuccgcgucuuccgcaccaacuucuucauccagcucguccgccccggcgucgcccagcccgaggacaccguccaguuccgcauccccauggagaugacccgcgucgaccuccgcaacuaccucgagggcaucuacaacguccccgucgccgccguccgcacccgcguccagcacggcuccaacaagcgccgcgaccaccgcaacguccgcaucaagaagcccgacuacaaggucgccuacguccagcucgcccacggccagaccuucaccuuccccgaccucuuccccgagaaggacgagucccccgagggcuccgccgccgacgaccucuacuccaugcucgaggaggagcgccagcagcgccaguccuccgacccccgccgcggcggcguccccuccugguucggccucuga

SEQ ID NO: 46150 - RNA, 771 nt, Artificial Sequence
  derived and/or modified sequence opt2 from MRPL28__Homo_sapiens__XP_011520653
augccccuccacaaguaccccgucuggcucuggaagcgccuccagcuccgcgagggcaucugcucccgccuccccggccacuaccuccgcucccucgaggaggagcgcacccccacccccguccacuaccgcccccacggcgccaaguucaagaucaaccccaagaacggccagcgcgagcgcgucgaggacguccccauccccaucuacuucccccccgagucccagcgcggccucuggggcggcgagggcuggauccucggccagaucuacgccaacaacgacaagcucuccaagcgccucaagaaggucuggaagccccagcucuucgagcgcgaguucuacuccgagauccucgacaagaaguucaccgucaccgucaccaugcgcacccucgaccucaucgacgaggccuacggccucgacuucuacauccucaagacccccaaggaggaccucugcuccaaguucggcauggaccucaagcgcggcaugcuccuccgccucgcccgccaggacccccagcuccaccccgaggaccccgagcgccgcgccgccaucuacgacaaguacaaggaguucgccauccccgaggaggaggccgagugggucggccucacccucgaggaggccaucgagaagcagcgccuccucgaggagaaggaccccgucccccucuucaagaucuacgucgccgagcucauccagcagcuccagcagcaggcccucuccgagcccgccgucguccagaagcgcgccuccggccaguga

SEQ ID NO: 46151 - RNA, 198 nt, Artificial Sequence
  derived and/or modified sequence opt2 from MRPL33__Homo_sapiens__NP_004882
auguuccucuccgccgucuucuucgccaaguccaaguccaagaacauccucguccgcauggucuccgaggccggcaccggcuucugcuucaacaccaagcgcaaccgccuccgcgagaagcucacccuccuccacuacgaccccgucgucaagcagcgcguccucuucgucgagaagaagaagauccgcucccucuga

SEQ ID NO: 46152 - RNA, 312 nt, Artificial Sequence
  derived and/or modified sequence opt2 from MRPL36__Homo_sapiens__NP_115868
auggccaaccucuucauccgcaagauggucaacccccuccucuaccucucccgccacaccgucaagccccgcgcccucuccaccuuccucuucggcuccauccgcggcgccgcccccgucgccgucgagcccggcgccgccguccgcucccuccucucccccggccuccucccccaccuccuccccgcccucggcuucaagaacaagaccguccucaagaagcgcugcaaggacugcuaccucgucaagcgccgcggccgcugguacgucuacugcaagacccacccccgccacaagcagcgccagauguga

SEQ ID NO: 46153 - RNA, 1047 nt, Artificial Sequence
  derived and/or modified sequence opt2 from MRPL3__Homo_sapiens__NP_009139
augcccggcuggcgccuccucacccaggucggcgcccagguccucggccgccucggcgacggccucggcgccgcccucggccccggcaaccgcacccacaucuggcucuucguccgcggccuccacggcaaguccggcaccuggugggacgagcaccucuccgaggagaacguccccuucaucaagcagcucgucuccgacgaggacaaggcccagcucgccuccaagcucugcccccucaaggacgagcccuggcccauccaccccugggagcccggcuccuuccgcgucggccucaucgcccucaagcucggcaugaugccccucuggaccaaggacggccagaagcacgucgucacccuccuccagguccaggacugccacguccucaaguacaccuccaaggagaacugcaacggcaagauggccacccucuccgucggcggcaagaccgucucccgcuuccgcaaggccaccuccauccucgaguucuaccgcgagcucggccucccccccaagcagaccgucaagaucuucaacaucaccgacaacgccgccaucaagcccggcaccccccucuacgccgcccacuuccgccccggccaguacgucgacgucaccgccaagaccaucggcaagggcuuccagggcgucaugaagcgcuggggcuucaagggccagcccgccacccacggccagaccaagacccaccgccgccccggcgccgucgccaccggcgacaucggccgcgucuggcccggcaccaagaugcccggcaagaugggcaacaucuaccgcaccgaguacggccucaaggucuggcgcaucaacaccaagcacaacaucaucuacgucaacggcuccguccccggccacaagaacugccucgucaaggucaaggacuccaagcuccccgccuacaaggaccucggcaagaaccuccccuuccccaccuacuuccccgacggcgacgaggaggagcuccccgaggaccucuacgacgagaacgucugccagcccggcgcccccuccaucaccuucgccuga

SEQ ID NO: 46154 - RNA, 621 nt, Artificial Sequence
  derived and/or modified sequence opt2 from MRPL40__Homo_sapiens__NP_003767
augaccgccuccguccuccgcuccaucucccucgcccuccgccccaccuccggccuccucggcaccuggcagacccagcuccgcgagacccaccagcgcgccucccuccucuccuucugggagcucauccccaugcgcuccgagccccuccgcaagaagaagaaggucgaccccaagaaggaccaggaggccaaggagcgccucaagcgcaagauccgcaagcucgagaaggccacccaggagcucauccccaucgaggacuucaucaccccccucaaguuccucgacaaggcccgcgagcgcccccaggucgagcucaccuucgaggagaccgagcgccgcgcccuccuccucaagaaguggucccucuacaagcagcaggagcgcaagauggagcgcgacaccauccgcgccaugcucgaggcccagcaggaggcccucgaggagcuccagcucgagucccccaagcuccacgccgaggccaucaagcgcgaccccaaccucuuccccuucgagaaggagggcccccacuacaccccccccauccccaacuaccagccccccgagggccgcuacaacgacaucaccaaggucuacacccaggucgaguucaagcgcuga

SEQ ID NO: 46155 - RNA, 414 nt, Artificial Sequence
  derived and/or modified sequence opt2 from MRPL41__Homo_sapiens__NP_115866
augggcguccucgccgccgccgcccgcugccucguccgcggcgccgaccgcauguccaaguggaccuccaagcgcggcccccgcuccuuccgcggccgcaagggccgcggcgccaagggcaucggcuuccucaccuccggcuggcgcuucguccagaucaaggagaugguccccgaguucgucguccccgaccucaccggcuucaagcucaagcccuacgucuccuaccucgcccccgaguccgaggagaccccccucaccgccgcccagcucuucuccgaggccgucgcccccgccaucgagaaggacuucaaggacggcaccuucgaccccgacaaccucgagaaguacggcuucgagcccacccaggagggcaagcucuuccagcucuacccccgcaacuuccuccgcuga

SEQ ID NO: 46156 - RNA, 999 nt, Artificial Sequence
  derived and/or modified sequence opt2 from MRPL44__Homo_sapiens__NP_075066
auggccuccggccucguccgccuccuccagcagggccaccgcugccuccucgcccccgucgcccccaagcucgucccccccguccgcggcgucaagaagggcuuccgcgccgccuuccgcuuccagaaggagcucgagcgccagcgccuccuccgcugcccccccccccccguccgccgcuccgagaagcccaacugggacuaccacgccgagauccaggccuucggccaccgccuccaggagaacuucucccucgaccuccucaagaccgccuucgucaacuccugcuacaucaaguccgaggaggccaagcgccagcagcucggcaucgagaaggaggccguccuccucaaccucaaguccaaccaggagcucuccgagcagggcaccuccuucucccagaccugccucacccaguuccucgaggacgaguaccccgacaugcccaccgagggcaucaagaaccucgucgacuuccucaccggcgaggaggucgucugccacgucgcccgcaaccucgccgucgagcagcucacccucuccgaggaguuccccgucccccccgccguccuccagcagaccuucuucgccgucaucggcgcccuccuccaguccuccggccccgagcgcaccgcccucuucauccgcgacuuccucaucacccagaugaccggcaaggagcucuucgagauguggaagaucaucaaccccaugggccuccucgucgaggagcucaagaagcgcaacgucuccgcccccgagucccgccucacccgccaguccggcggcaccaccgcccucccccucuacuucgucggccucuacugcgacaagaagcucaucgccgagggccccggcgagaccguccucgucgccgaggaggaggccgcccgcgucgcccuccgcaagcucuacggcuucaccgagaaccgccgccccuggaacuacuccaagcccaaggagacccuccgcgccgagaaguccaucaccgccuccuga

SEQ ID NO: 46157 - RNA, 501 nt, Artificial Sequence
  derived and/or modified sequence opt2 from MRPL49__Homo_sapiens__NP_004918
auggccgccaccauguuccgcgccacccuccgcggcuggcgcaccggcguccagcgcggcugcggccuccgccuccucucccagacccagggcccccccgacuacccccgcuucgucgaguccgucgacgaguaccaguucgucgagcgccuccuccccgccacccgcauccccgacccccccaagcacgagcacuaccccacccccuccggcuggcagcccccccgcgaccccccccccaaccuccccuacuucguccgccgcucccgcaugcacaacauccccgucuacaaggacaucacccacggcaaccgccagaugaccgucauccgcaaggucgagggcgacaucugggcccuccagaaggacgucgaggacuuccucuccccccuccucggcaagacccccgucacccaggucaacgaggucaccggcacccuccgcaucaagggcuacuucgaccaggagcucaaggccuggcuccucgagaagggcuucuga

SEQ ID NO: 46158 - RNA, 372 nt, Artificial Sequence
  derived and/or modified sequence opt2 from MRPL52__Homo_sapiens__NP_848026
auggccgcccucggcaccguccucuucaccggcguccgccgccuccacugcuccgucgccgccugggccggcggccaguggcgccuccagcagggccucgccgccaaccccuccggcuacggcccccucaccgagcuccccgacugguccuacgccgacggccgccccgccccccccaugaagggccagcuccgccgcaaggccgagcgcgagaccuucgcccgccgcgucguccuccucucccaggagauggacgccggccuccaggccuggcagcuccgccagcagaagcuccaggaggagcagcgcaagcaggagaacgcccucaagcccaagggcgccucccucaaguccccccuccccucccaguga

SEQ ID NO: 46159 - RNA, 702 nt, Artificial Sequence
  derived and/or modified sequence opt2 from MRPL9__Homo_sapiens__NP_001287662
auggccgcccccgucgucaccgcccccggccgcgcccuccuccgcgccggcgccggccgccuccuccgcggcggcguccaggagcuccuccgcccccgccacgagggcaacgcccccgaccucgccugcaacuucucccucucccagaaccgcggcaccgucaucgucgagcgcugguggaaggucccccucgccggcgagggccgcaagccccgccuccaccgccgccaccgcgucuacaagcucgucgaggacaccaagcaccgccccaaggagaaccucgagcucauccucacccaguccgucgagaacgucggcguccgcggcgaccucgucuccgucaagaagucccucggccgcaaccgccuccucccccagggccucgccgucuacgccucccccgagaacaagaagcucuucgaggaggagaagcuccuccgccaggagggcaagcucgagaagauccagaccaaggccggcgaggcccucggcgucgucgucgccccccacacccucaagcuccccgaggagcccaucacccgcuggggcgaguacuggugcgaggucaccgucaacggccucgacaccguccgcguccccauguccgucgucaacuucgagaagcccaagaccaagcgcuacaaguacuggcucgcccagcaggccgccaaggccauggcccccaccuccccccagaucuga

SEQ ID NO: 46160 - RNA, 585 nt, Artificial Sequence
  derived and/or modified sequence opt2 from MRPS11__Homo_sapiens__NP_073750
augcaggccguccgcaacgccggcucccgcuuccuccgcuccuggaccuggccccagaccgccggccgcgucgucgcccgcacccccgccggcaccaucugcaccggcgcccgccagcuccaggacgccgccgccaagcagaaggucgagcagaacgccgcccccucccacaccaaguucuccaucuacccccccauccccggcgaggaguccucccuccgcugggccggcaagaaguucgaggagauccccaucgcccacaucaaggccucccacaacaacacccagauccaggucgucuccgccuccaacgagccccucgccuucgccuccugcggcaccgagggcuuccgcaacgccaagaagggcaccggcaucgccgcccagaccgccggcaucgccgccgccgcccgcgccaagcagaagggcgucauccacauccgcgucgucgucaagggccucggccccggccgccucuccgccaugcacggccucaucaugggcggccucgaggucaucuccaucaccgacaacacccccaucccccacaacggcugccgcccccgcaaggcccgcaagcucuga

SEQ ID NO: 46161 - RNA, 417 nt, Artificial Sequence
  derived and/or modified sequence opt2 from MRPS12__Homo_sapiens__NP_203527
auguccugguccggccuccuccacggccucaacaccucccucaccugcggccccgcccucgucccccgccucugggccaccugcuccauggccacccucaaccagaugcaccgccucggcccccccaagcgccccccccgcaagcucggccccaccgagggccgcccccagcucaagggcgucguccucugcaccuucacccgcaagcccaagaagcccaacuccgccaaccgcaagugcugccgcguccgccucuccaccggccgcgaggccgucugcuucauccccggcgagggccacacccuccaggagcaccagaucguccucgucgagggcggccgcacccaggaccuccccggcgucaagcucaccgucguccgcggcaaguacgacugcggccacguccagaagaaguga

SEQ ID NO: 46162 - RNA, 414 nt, Artificial Sequence
  derived and/or modified sequence opt2 from MRPS16__Homo_sapiens__NP_057149
augguccaccucaccacccuccucugcaaggccuaccgcggcggccaccucaccauccgccucgcccucggcggcugcaccaaccgccccuucuaccgcaucgucgccgcccacaacaagugcccccgcgacggccgcuucgucgagcagcucggcuccuacgacccccuccccaacucccacggcgagaagcucgucgcccucaaccucgaccgcauccgccacuggaucggcugcggcgcccaccucuccaagcccauggagaagcuccucggccucgccggcuucuucccccuccaccccaugaugaucaccaacgccgagcgccuccgccgcaagcgcgcccgcgagguccuccucgccucccagaagaccgacgccgaggccaccgacaccgaggccaccgagaccuga

SEQ ID NO: 46163 - RNA, 777 nt, Artificial Sequence
  derived and/or modified sequence opt2 from MRPS18B__Homo_sapiens__NP_054765
auggccgccuccguccucaacaccguccuccgccgccuccccaugcucucccucuuccgcggcucccaccgcguccaggucccccuccagacccucugcaccaaggcccccuccgaggaggacucccucuccuccguccccaucucccccuacaaggacgagcccuggaaguaccucgaguccgaggaguaccaggagcgcuacggcucccgccccgucugggccgacuaccgccgcaaccacaagggcggcguccccccccagcgcacccgcaagaccugcauccgccgcaacaaggucgucggcaaccccugccccaucugccgcgaccacaagcuccacgucgacuuccgcaacgucaagcuccucgagcaguucgucugcgcccacaccggcaucaucuucuacgcccccuacaccggcgucugcgucaagcagcacaagcgccucacccaggccauccagaaggcccgcgaccacggccuccucaucuaccacaucccccaggucgagccccgcgaccucgacuucuccaccucccacggcgccgucuccgccaccccccccgcccccacccucgucuccggcgaccccugguaccccugguacaacuggaagcagccccccgagcgcgagcucucccgccuccgccgccucuaccagggccaccuccaggaggaguccggccccccccccgaguccaugcccaagaugcccccccgcacccccgccgaggccuccuccaccggccagaccggcccccaguccgcccucuga

SEQ ID NO: 46164 - RNA, 1083 nt, Artificial Sequence
  derived and/or modified sequence opt2 from MRPS22__Homo_sapiens__NP_064576
auggccccccucggcaccaccguccuccucuggucccuccuccgcuccucccccggcgucgagcgcgucugcuuccgcgcccgcauccagcccuggcacggcggccuccuccagccccuccccugcuccuucgagaugggccucccccgccgccgcuucuccuccgaggccgccgaguccggcucccccgagaccaagaagcccaccuucauggacgaggagguccaguccauccucaccaagaugaccggccucaaccuccagaagaccuucaagcccgccauccaggagcucaagccccccaccuacaagcucaugacccaggcccagcucgaggaggccacccgccaggccgucgaggccgccaagguccgccucaagaugccccccguccucgaggagcgcguccccaucaacgacguccucgccgaggacaagauccucgagggcaccgagaccaccaaguacgucuucaccgacaucuccuacuccaucccccaccgcgagcgcuucaucgucguccgcgagcccuccggcacccuccgcaaggccuccugggaggagcgcgaccgcaugauccaggucuacuuccccaaggagggccgcaagauccucacccccaucaucuucaaggaggagaaccuccgcaccauguacucccaggaccgccacgucgacguccucaaccucugcuucgcccaguucgagcccgacuccaccgaguacaucaagguccaccacaagaccuacgaggacaucgacaagcgcggcaaguacgaccuccuccgcuccacccgcuacuucggcggcauggucugguacuucgucaacaacaagaagaucgacggccuccucaucgaccagauccagcgcgaccucaucgacgacgccaccaaccucguccagcucuaccacguccuccaccccgacggccaguccgcccagggcgccaaggaccaggccgccgagggcaucaaccucaucaaggucuucgccaagaccgaggcccagaagggcgccuacaucgagcucacccuccagaccuaccaggaggcccucucccgccacuccgccgccuccuga

SEQ ID NO: 46165 - RNA, 573 nt, Artificial Sequence
  derived and/or modified sequence opt2 from MRPS23__Homo_sapiens__NP_057154
auggccggcucccgccucgagaccgucggcuccaucuucucccgcacccgcgaccucguccgcgccggcguccucaaggagaagccccucugguucgacgucuacgacgccuuccccccccuccgcgagcccgucuuccagcgcccccgcguccgcuacggcaaggccaaggcccccauccaggacaucugguaccacgaggaccgcauccgcgccaaguucuacuccgucuacggcuccggccagcgcgccuucgaccucuucaaccccaacuucaaguccaccugccagcgcuucgucgagaaguacaccgagcuccagaagcucggcgagaccgacgaggagaagcucuucgucgagaccggcaaggcccuccucgccgagggcgucauccuccgccgcgucggcgaggcccgcacccagcacggcggcucccacgucucccgcaaguccgagcaccucuccguccgcccccagaccgcccucgaggagaacgagacccagaaggaggucccccaggaccagcaccucgaggcccccgccgaccaguccaagggccuccucccccccuga

SEQ ID NO: 46166 - RNA, 564 nt, Artificial Sequence
  derived and/or modified sequence opt2 from MRPS28__Homo_sapiens__NP_054737
auggccgcccucugccgcacccgcgccgucgccgccgagucccacuuccuccgcgucuuccucuucuuccgccccuuccgcggcgucggcaccgaguccggcuccgaguccggcuccuccaacgccaaggagcccaagacccgcgccggcggcuucgccuccgcccucgagcgccacuccgagcuccuccagaaggucgagccccuccagaagggcucccccaagaacgucgaguccuucgccuccaugcuccgccacuccccccucacccagaugggccccgccaaggacaagcucgucaucggccgcaucuuccacaucgucgagaacgaccucuacaucgacuucggcggcaaguuccacugcgucugccgccgccccgaggucgacggcgagaaguaccagaagggcacccgcguccgccuccgccuccucgaccucgagcucaccucccgcuuccucggcgccaccaccgacaccaccguccucgaggccaacgccguccuccucggcauccaggaguccaaggacucccgcuccaaggaggagcaccacgagaaguga

SEQ ID NO: 46167 - RNA, 1320 nt, Artificial Sequence
  derived and/or modified sequence opt2 from MRPS30__Homo_sapiens__NP_057724
auggccgccgcccgcugcuggcgcccccuccuccgcggcccccgccucucccuccacaccgccgccaacgccgccgccaccgccaccgagaccaccugccaggacgucgccgccacccccgucgcccgcuacccccccaucgucgccuccaugaccgccgacuccaaggccgcccgccuccgccgcaucgagcgcuggcaggccaccguccacgccgccgaguccgucgacgagaagcuccgcauccucaccaagaugcaguucaugaaguacauggucuacccccagaccuucgcccucaacgccgaccgcugguaccaguacuucaccaagaccgucuuccucuccggccucccccccccccccgccgagcccgagcccgagcccgagcccgagcccgagcccgcccucgaccucgccgcccuccgcgccgucgccugcgacugccuccuccaggagcacuucuaccuccgccgccgccgccgcguccaccgcuacgaggaguccgaggucaucucccuccccuuccucgaccagcucgucuccacccucgucggccuccucuccccccacaaccccgcccucgccgccgccgcccucgacuaccgcugccccguccacuucuacuggguccgcggcgaggagaucaucccccgcggccaccgccgcggccgcaucgacgaccuccgcuaccagaucgacgacaagcccaacaaccagauccgcaucuccaagcagcucgccgaguucgucccccucgacuacuccguccccaucgagauccccaccaucaagugcaagcccgacaagcucccccucuucaagcgccaguacgagaaccacaucuucgucggcuccaagaccgccgaccccugcugcuacggccacacccaguuccaccuccuccccgacaagcuccgccgcgagcgccuccuccgccagaacugcgccgaccagaucgaggucgucuuccgcgccaacgccaucgccucccucuucgccuggaccggcgcccaggccauguaccagggcuucugguccgaggccgacgucacccgccccuucgucucccaggccgucaucaccgacggcaaguacuucuccuucuucugcuaccagcucaacacccucgcccucaccacccaggccgaccagaacaacccccgcaagaacaucugcuggggcacccaguccaagccccucuacgagaccaucgaggacaacgacgucaagggcuucaacgacgacguccuccuccagaucguccacuuccuccucaaccgccccaaggaggagaagucccagcuccucgagaacuga

SEQ ID NO: 46168 - RNA, 1188 nt, Artificial Sequence
  derived and/or modified sequence opt2 from MRPS31__Homo_sapiens__NP_005821
auguucccccgcgucuccaccuuccucccccuccgcccccucucccgccacccccucuccuccggcucccccgagaccuccgccgccgccaucaugcuccucaccguccgccacggcaccguccgcuaccgcuccuccgcccuccucgcccgcaccaagaacaacauccagcgcuacuucggcaccaacuccgucaucugcuccaagaaggacaagcaguccguccgcaccgaggagaccuccaaggagaccuccgagucccaggacuccgagaaggagaacaccaagaaggaccuccucggcaucaucaagggcaugaaggucgagcucuccaccgucaacguccgcaccaccaagccccccaagcgccgcccccucaagucccucgaggccacccucggccgccuccgccgcgccaccgaguacgcccccaagaagcgcaucgagccccucucccccgagcucgucgccgccgccuccgccgucgccgacucccuccccuucgacaagcagaccaccaaguccgagcuccucucccagcuccagcagcacgaggaggagucccgcgcccagcgcgacgccaagcgccccaagaucuccuucuccaacaucaucuccgacaugaaggucgcccgcuccgccaccgcccgcguccgcucccgccccgagcuccgcauccaguucgacgagggcuacgacaacuaccccggccaggagaagaccgacgaccucaagaagcgcaagaacaucuucaccggcaagcgccucaacaucuucgacaugauggccgucaccaaggaggcccccgagaccgacaccucccccucccucugggacgucgaguucgccaagcagcucgccaccgucaacgagcagccccuccagaacggcuucgaggagcucauccaguggaccaaggagggcaagcucugggaguuccccaucaacaacgaggccggcuucgacgacgacggcuccgaguuccacgagcacaucuuccucgagaagcaccucgaguccuuccccaagcagggccccauccgccacuucauggagcucgucaccugcggccucuccaagaaccccuaccucuccgucaagcagaaggucgagcacaucgagugguuccgcaacuacuucaacgagaagaaggacauccucaaggaguccaacauccaguucaacuga

SEQ ID NO: 46169 - RNA, 321 nt, Artificial Sequence
  derived and/or modified sequence opt2 from MRPS33__Homo_sapiens__NP_444263
auguccucccucuccgaguacgccuuccgcaugucccgccucuccgcccgccucuucggcgaggucacccgccccaccaacuccaaguccaugaaggucgucaagcucuucuccgagcucccccucgccaagaagaaggagaccuacgacugguaccccaaccaccacaccuacgccgagcucaugcagacccuccgcuuccucggccucuaccgcgacgagcaccaggacuucauggacgagcagaagcgccucaagaagcuccgcggcaaggagaagcccaagaagggcgagggcaagcgcgccgccaagcgcaaguga

SEQ ID NO: 46170 - RNA, 378 nt, Artificial Sequence
  derived and/or modified sequence opt2 from MRPS6__Homo_sapiens__NP_115865
augccccgcuacgagcucgcccucauccucaaggccaugcagcgccccgagaccgccgccacccucaagcgcaccaucgaggcccucauggaccgcggcgccaucguccgcgaccucgagaaccucggcgagcgcgcccuccccuaccgcaucuccgcccacucccagcagcacaaccgcggcggcuacuuccucgucgacuucuacgcccccaccgccgccgucgaguccauggucgagcaccucucccgcgacaucgacgucauccgcggcaacaucgucaagcacccccucacccaggagcucaaggagugcgagggcaucguccccgucccccucgccgagaagcucuacuccaccaagaagcgcaagaaguga

SEQ ID NO: 46171 - RNA, 729 nt, Artificial Sequence
  derived and/or modified sequence opt2 from MRPS7__Homo_sapiens__NP_057055
auggccgcccccgccgucaaggucgcccgcggcugguccggccucgcccucggcguccgccgcgccguccuccagcuccccggccucacccagguccgcuggucccgcuacucccccgaguucaaggacccccucaucgacaaggaguacuaccgcaagcccgucgaggagcucaccgaggaggagaaguacguccgcgagcucaagaagacccagcucaucaaggccgcccccgccggcaagaccuccuccgucuucgaggaccccgucaucuccaaguucaccaacaugaugaugaucggcggcaacaagguccucgcccgcucccucaugauccagacccucgaggccgucaagcgcaagcaguucgagaaguaccacgccgccuccgccgaggagcaggccaccaucgagcgcaaccccuacaccaucuuccaccaggcccucaagaacugcgagcccaugaucggccucguccccauccucaagggcggccgcuucuaccagguccccgucccccuccccgaccgccgccgccgcuuccucgccaugaaguggaugaucaccgagugccgcgacaagaagcaccagcgcacccucaugcccgagaagcucucccacaagcuccucgaggccuuccacaaccagggccccgucaucaagcgcaagcacgaccuccacaagauggccgaggccaaccgcgcccucgcccacuaccgcuggugguga

SEQ ID NO: 46172 - RNA, 1191 nt, Artificial Sequence
  derived and/or modified sequence opt2 from MRPS9__Homo_sapiens__NP_872578
auggccgcccccugcgucuccuacggcggcgccgucuccuaccgccuccuccucuggggccgcggcucccucgcccgcaagcagggccucuggaagaccgccgcccccgagcuccagaccaacguccgcucccagauccuccgccuccgccacaccgccuucgucauccccaagaagaacguccccaccuccaagcgcgagaccuacaccgaggacuucaucaagaagcagaucgaggaguucaacaucggcaagcgccaccucgccaacaugaugggcgaggaccccgagaccuucacccaggaggacaucgaccgcgccaucgccuaccucuuccccuccggccucuucgagaagcgcgcccgccccgucaugaagcaccccgagcagaucuucccccgccagcgcgccauccaguggggcgaggacggccgccccuuccacuaccucuucuacaccggcaagcaguccuacuacucccucaugcacgacgucuacggcaugcuccucaaccucgagaagcaccagucccaccuccaggccaagucccuccuccccgagaagaccgucacccgcgacgucaucggcucccgcuggcucaucaaggaggagcucgaggagaugcucgucgagaagcucuccgaccucgacuacaugcaguucauccgccuccucgagaagcuccucaccucccagugcggcgccgccgaggaggaguucguccagcgcuuccgccgcuccgucacccucgaguccaagaagcagcucaucgagcccguccaguacgacgagcagggcauggccuucuccaaguccgagggcaagcgcaagaccgccaaggccgaggccaucgucuacaagcacggcuccggccgcaucaaggucaacggcaucgacuaccagcucuacuuccccaucacccaggaccgcgagcagcucauguuccccuuccacuucgucgaccgccucggcaagcacgacgucaccugcaccgucuccggcggcggccgcuccgcccaggccggcgccauccgccucgccauggccaaggcccucugcuccuucgucaccgaggacgaggucgaguggaugcgccaggccggccuccucaccaccgacccccgcguccgcgagcgcaagaagcccggccaggagggcgcccgccgcaaguucaccuggaagaagcgcuga

SEQ ID NO: 46173 - RNA, 633 nt, Artificial Sequence
  derived and/or modified sequence opt2 from MRRF__Homo_sapiens__NP_001166983
auggcccucggccucaagugcuuccgcaugguccaccccaccuuccgcaacuaccucgccgccuccauccgccccgucuccgaggucacccucaagaccguccacgagcgccagcacggccaccgccaguacauggccuacuccgccguccccguccgccacuucgccaccaagaaggccaagggcucccucgacaagaucgccgucgucaccgccgacggcaagcucgcccucaaccagaucucccagaucuccaugaaguccccccagcucauccucgucaacauggccuccuuccccgagugcaccgccgccgccaucaaggccauccgcgaguccggcaugaaccucaaccccgaggucgagggcacccucauccgcguccccaucccccaggucacccgcgagcaccgcgagaugcucgucaagcucgccaagcagaacaccaacaaggccaaggacucccuccgcaagguccgcaccaacuccaugaacaagcucaagaaguccaaggacaccgucuccgaggacaccauccgccucaucgagaagcagaucucccagauggccgacgacaccgucgccgagcucgaccgccaccucgccgucaagaccaaggagcuccucggcuga

SEQ ID NO: 46174 - RNA, 1341 nt, Artificial Sequence
  derived and/or modified sequence opt2 from MRS2__Homo_sapiens__NP_001273193
auggagugccuccgcucccuccccugccuccucccccgcgccaugcgccucccccgccgcacccucugcgcccucgcccucgacgucaccuccgucggcccccccgucgccgccugcggccgccgcgccaaccucaucggccgcucccgcgccgcccagcucugcggccccgaccgccuccgcgucgccggcgagguccaccgcuuccgcaccuccgacgucucccaggccacccucgccuccgucgcccccgucuucaccgucaccaaguucgacaagcagggcaacgucaccuccuucgagcgcaagaagaccgagcucuaccaggagcucggccuccaggcccgcgaccuccgcuuccagcacgucauguccaucaccguccgcaacaaccgcaucaucaugcgcauggagaaguacucccuccuccucgaguccgucgccuccauccuccagaacuccgucuccuucauggagcgccagaccgagcaguggcucuuccgcgagcuccccucccagcucuccggcgagggccagcucgucaccuacccccuccccuucgaguuccgcgccaucgaggcccuccuccaguacuggaucaacacccuccagggcaagcucuccauccuccagccccucauccucgagacccucgacgcccucgucgaccccaagcacuccuccgucgaccgcuccaagcuccacauccuccuccagaacggcaagucccucuccgagcucgagaccgacaucaagaucuucaaggaguccauccucgagauccucgacgaggaggagcuccucgaggagcucugcgucuccaagugguccgacccccaggucuucgagaaguccuccgccggcaucgaccacgccgaggagauggagcuccuccucgagaacuacuaccgccucgccgacgaccucuccaacgccgcccgcgagcuccgcguccucaucgacgacucccaguccaucaucuucaucaaccucgacucccaccgcaacgucaugaugcgccucaaccuccagcucaccaugggcaccuucucccucucccucuucggccucaugggcgucgccuucggcaugaaccucgaguccucccucgaggaggaccaccgcaucuucuggcucaucaccggcaucauguucaugggcuccggccucaucuggcgccgccuccucuccuuccucggccgccagcucgaggccccccucccccccaugauggccucccuccccaagaagacccuccucgccgaccgcuccauggagcucaagaacucccuccgccucgacggccucggcuccggccgcuccauccucaccaaccgcuga

SEQ ID NO: 46175 - RNA, 2715 nt, Artificial Sequence
  derived and/or modified sequence opt2 from MRVI1__Homo_sapiens__NP_001092049
augggcauggaccucaccugccccuucggcaucucccccgccugcggcgcccaggccuccugguccaucuucggcgccgacgccgccgagguccccggcacccgcggccacucccagcaggaggccgccaugccccacauccccgaggacgaggagccccccggcgagccccaggccgcccagucccccgccggccagggcccccccgccgccggcgucuccugcucccccacccccaccaucguccucaccggcgacgccaccucccccgagggcgagaccgacaagaaccucgccaaccgcguccacuccccccacaagcgccucucccaccgccaccucaaggucuccaccgccucccucaccuccgucgaccccgccggccacaucaucgaccucgucaacgaccagcuccccgacaucuccaucuccgaggaggacaagaagaagaaccucgcccuccucgaggaggccaagcucgucuccgagcgcuuccucacccgccgcggccgcaagucccgcuccucccccggcgacucccccuccgccgucucccccaaccucucccccuccgccucccccaccuccucccgcuccaacucccucaccguccccaccccccccggccucgacgucugcuccggcccccccuccccccuccccggcgcccccccccagcagaagggcgacgaggccgacgucuccuccccccaccccggcgagcccaacguccccaagggccucgccgaccgcaagcagaacgaccagcgcaaggucucccagggccgccucgccccccgccccccccccgucgagaaguccaaggagaucgccaucgagcagaaggagaacuucgacccccuccaguaccccgagaccacccccaagggccucgcccccgucaccaacuccuccggcaagauggcccucaacuccccccagcccggccccgucgaguccgagcucggcaagcagcuccucaagaccggcugggagggcuccccccucccccgcucccccacccaggacgccgccggcgucggcccccccgccucccagggccgcggccccgccggcgagcccaugggccccgaggccggcuccaaggccgagcucccccccaccgucucccgccccccccuccuccgcggccucuccugggacuccggccccgaggagcccggcccccgccuccagaagguccucgccaagcucccccucgccgaggaggagaagcgcuucgccggcaaggccggcggcaagcucgccaaggcccccggccucaaggacuuccagauccagguccagcccguccgcaugcagaagcucaccaagcuccgcgaggagcacauccucaugcgcaaccagaaccucgucggccucaagcuccccgaccucuccgaggccgccgagcaggagaagggccuccccuccgagcucucccccgccaucgaggaggaggaguccaaguccggccucgacgucaugcccaacaucuccgacguccuccuccgcaagcuccgcguccaccgcucccuccccggcuccgcccccccccucaccgagaaggaggucgagaacgucuucguccagcucucccucgccuuccgcaacgacuccuacacccucgagucccgcaucaaccaggccgagcgcgagcgcaaccucaccgaggagaacaccgagaaggagcucgagaacuucaaggccuccaucaccuccuccgccucccucuggcaccacugcgagcaccgcgagaccuaccagaagcuccucgaggacaucgccguccuccaccgccucgccgcccgccucuccucccgcgccgaggucgucggcgccguccgccaggagaagcgcauguccaaggccaccgaggucaugaugcaguacgucgagaaccucaagcgcaccuacgagaaggaccacgccgagcucauggaguucaagaagcucgccaaccagaacuccucccgcuccugcggccccuccgaggacggcgucccccgcaccgcccgcuccaugucccucacccucggcaagaacaugccccgccgccgcgucuccgucgccgucguccccaaguucaacgcccucaaccuccccggccagacccccuccuccuccuccauccccucccuccccgcccucuccgagucccccaacggcaagggcucccuccccgucaccuccgcccuccccgcccuccucgagaacggcaagaccaacggcgaccccgacugcgaggccuccgcccccgcccucacccucuccugccucgaggagcucucccaggagaccaaggcccgcauggaggaggaggccuacuccaagggcuuccaggagggccucaagaagaccaaggagcuccaggaccucaaggaggaggaggaggagcagaaguccgagucccccgaggagcccgaggaggucgaggagaccgaggaggaggagaagggcccccgcuccuccaagcucgaggagcucguccacuuccuccaggucauguaccccaagcucugccagcacuggcaggucaucuggaugauggccgccgucaugcucguccucaccgucguccucggccucuacaacuccuacaacuccugcgccgagcaggccgacggcccccucggccgcuccaccugcuccgccgcccagcgcgacuccuggugguccuccggccuccagcacgagcagcccaccgagcaguga

SEQ ID NO: 46176 - RNA, 666 nt, Artificial Sequence
  derived and/or modified sequence opt2 from MS4A12__Homo_sapiens__NP_001157942
augauguccuccaagcccaccucccacgccgaggucaacgagaccauccccaaccccuacccccccuccuccuucauggcccccggcuuccagcagccccucggcuccaucaaccucgagaaccaggcccagggcgcccagcgcgcccagcccuacggcaucaccucccccggcaucuucgccuccucccagcccggccagggcaacauccagaugaucaaccccuccgucggcaccgccgucaugaacuucaaggaggaggccaaggcccucggcuucaucaucuccggcucccucuccgucuccgccuccaaggagcucucccgcugccucgucaagggcucccucggcaugaacaucgucuccuccauccucgccuucaucggcgucauccuccuccucgucgacaugugcaucaacggcgucgccggccaggacuacugggccguccucuccggcaagggcaucuccgccacccucaugaucuucucccuccucgaguucuucgucgccugcgccaccgcccacuucgccaaccaggccaacaccaccaccaacauguccguccucgucauccccaacauguacgaguccaaccccgucacccccgccuccuccuccgcccccccccgcugcaacaacuacuccgccaacgcccccaaguga

SEQ ID NO: 46177 - RNA, 894 nt, Artificial Sequence
  derived and/or modified sequence opt2 from MS4A1__Homo_sapiens__NP_068769
augaccaccccccgcaacuccgucaacggcaccuuccccgccgagcccaugaagggccccaucgccaugcaguccggccccaagccccucuuccgccgcauguccucccucgucggccccacccaguccuucuucaugcgcgaguccaagacccucggcgccguccagaucaugaacggccucuuccacaucgcccucggcggccuccucaugauccccgccggcaucuacgcccccaucugcgucaccgucugguacccccucuggggcggcaucauguacaucaucuccggcucccuccucgccgccaccgagaagaacucccgcaagugccucgucaagggcaagaugaucaugaacucccucucccucuucgccgccaucuccggcaugauccucuccaucauggacauccucaacaucaagaucucccacuuccucaagauggagucccucaacuucauccgcgcccacacccccuacaucaacaucuacaacugcgagcccgccaaccccuccgagaagaacucccccuccacccaguacugcuacuccauccagucccucuuccucggcauccucuccgucaugcucaucuucgccuucuuccaggagcucgucaucgccggcaucgucgagaacgaguggaagcgcaccugcucccgccccaaguccaacaucguccuccucuccgccgaggagaagaaggagcagaccaucgagaucaaggaggaggucgucggccucaccgagaccuccucccagcccaagaacgaggaggacaucgagaucauccccauccaggaggaggaggaggaggagaccgagaccaacuuccccgagcccccccaggaccaggaguccucccccaucgagaacgacuccucccccuga

SEQ ID NO: 46178 - RNA, 600 nt, Artificial Sequence
  derived and/or modified sequence opt2 from MS4A2__Homo_sapiens__NP_001243845
auggacaccgaguccaaccgccgcgccaaccucgcccucccccaggagcccuccuccguccccgccuucgagguccucgagaucuccccccaggaggucuccuccggccgccuccucaaguccgccuccucccccccccuccacaccuggcucaccguccucaagaaggagcaggaguuccucggcuucuccaucuccggcaugcucuccaucaucuccgagcgccgcaacgccaccuaccucguccgcggcucccucggcgccaacaccgccuccuccaucgccggcggcaccggcaucaccauccucaucaucaaccucaagaagucccucgccuacauccacauccacuccugccagaaguucuucgagaccaagugcuucauggccuccuucuccaccgagaucgucgucaugaugcucuuccucaccauccucggccucggcuccgccgucucccucaccaucugcggcgccggcgaggagcucaagggcaacaagguccccgaggaccgcgucuacgaggagcucaacaucuacuccgccaccuacuccgagcucgaggaccccggcgagauguccccccccaucgaccucuga

SEQ ID NO: 46179 - RNA, 276 nt, Artificial Sequence
  derived and/or modified sequence opt2 from MS4A3__Homo_sapiens__NP_001026836
augaacaucgccuccgccaccaucgcccucgucggcaccgccuuccucucccucaacaucgccgucaacauccagucccuccgcuccugccacuccuccuccgagucccccgaccucugcaacuacaugggcuccaucuccaacggcauggucucccuccuccucauccucacccuccucgagcucugcgucaccaucuccaccaucgccauguggugcaacgccaacugcugcaacucccgcgaggagaucuccuccccccccaacuccgucuga

SEQ ID NO: 46180 - RNA, 561 nt, Artificial Sequence
  derived and/or modified sequence opt2 from MS4A4A__Homo_sapiens__NP_001230195
augcaccagaccuacucccgccacugccgccccgaggaguccaccuucuccgccgccaugaccaccaugcagggcauggagcaggccaugcccggcgccggccccggcgucccccagcucggcaacauggccgucauccacucccaccucuggaagggccuccaggagaaguuccucaagggcgagcccaagguccucggcgucguccagauccucaccgcccucaugucccucuccaugggcaucaccaugaugugcauggccuccaacaccuacggcuccaaccccaucuccgucuacaucggcuacaccaucuggggcuccgucauguucaucaucuccggcucccucuccaucgccgccggcauccgcaccaccaagggccucggccucgacggcaugguccuccuccucuccguccucgaguucugcaucgccgucucccucuccgccuucggcugcaagguccucugcugcacccccggcggcgucguccucauccuccccucccacucccacauggccgagaccgccucccccaccccccucaacgaggucuga

SEQ ID NO: 46181 - RNA, 762 nt, Artificial Sequence
  derived and/or modified sequence opt2 from MS4A6A__Homo_sapiens__NP_001234928
augguccuccucaagcuccucgaggucuaccgcaagggcuccgccggcaccuuccacaaguccaccaucuucggcaacaccaucaugaccucccagcccguccccaacgagaccaucaucguccuccccuccaacgucaucaacuucucccaggccgagaagcccgagcccaccaaccagggccaggacucccucaagaagcaccuccacgccgagaucaaggucaucggcaccauccagauccucugcggcaugaugguccucucccucggcaucauccucgccuccgccuccuucucccccaacuucacccaggucaccuccacccuccucaacuccgccuaccccuucaucggccccuucuucuucaucaucuccggcucccucuccaucgccaccgagaagcgccucaccaagcuccucguccacuccucccucgucggcuccauccucuccgcccucuccgcccucgucggcuucaucauccucuccgucaagcaggccacccucaaccccgccucccuccagugcgagcucgacaagaacaacauccccacccgcuccuacgucuccuacuucuaccacgacucccucuacaccaccgacugcuacaccgccaaggccucccucgccggcacccucucccucaugcucaucugcacccuccucgaguucugccucgccguccucaccgccguccuccgcuggaagcaggccuacuccgacuuccccggcgucuccguccucgccggcuucaccuga

SEQ ID NO: 46182 - RNA, 753 nt, Artificial Sequence
  derived and/or modified sequence opt2 from MS4A8__Homo_sapiens__NP_113645
augaacuccaugaccuccgccguccccgucgccaacuccguccucgucgucgccccccacaacggcuaccccgucacccccggcaucaugucccacgucccccucuaccccaacucccagccccagguccaccucguccccggcaacccccccucccucgucuccaacgucaacggccagcccguccagaaggcccucaaggagggcaagacccucggcgccauccagaucaucaucggccucgcccacaucggccucggcuccaucauggccaccguccucgucggcgaguaccucuccaucuccuucuacggcggcuuccccuucuggggcggccucugguucaucaucuccggcucccucuccgucgccgccgagaaccagcccuacuccuacugccuccucuccggcucccucggccucaacaucgucuccgccaucugcuccgccgucggcgucauccucuucaucaccgaccucuccaucccccaccccuacgccuaccccgacuacuaccccuacgccuggggcgucaaccccggcauggccaucuccggcguccuccucgucuucugccuccucgaguucggcaucgccugcgccuccucccacuucggcugccagcucgucugcugccaguccuccaacgucuccgucaucuaccccaacaucuacgccgccaaccccgucaucacccccgagcccgucaccuccccccccuccuacuccuccgagauccaggccaacaaguga

SEQ ID NO: 46183 - RNA, 1365 nt, Artificial Sequence
  derived and/or modified sequence opt2 from MSANTD3-TMEFF1__Homo_sapiens__NP_001185741
augcagaacaacgagaucaucaagcccgccaaguacuucuccgagcucgagaaguccauccuccucgcccucgucgagaaguacaaguacguccucgagugcaagaaguccgacgcccgcaccaucgcccucaagcagcgcaccuggcaggcccucgcccacgaguacaacucccagcccuccgucucccuccgcgacuucaagcagcucaagaagugcugggagaacaucaaggcccgcaccaagaagaucauggcccacgagcgccgcgagaaggucaagcgcuccgucuccccccuccucuccacccacguccucggcaaggagaagaucgccuccaugcuccccgagcagcucuacuuccuccaguccccccccgaggaggagcccgaguaccaccccgacgccuccgcccaggagcucaacguccgcgaguccgacguccgcgucugcgacgaguccuccugcaaguacggcggcgucugcaaggaggacggcgacggccucaagugcgccugccaguuccagugccacaccaacuacauccccgucugcggcuccaacggcgacaccuaccagaacgagugcuuccuccgccgcgccgccugcaagcaccagaaggagaucaccgucaucgcccgcggccccugcuacuccgacaacggcuccggcuccggcgagggcgaggaggagggcuccggcgccgagguccaccgcaagcacuccaagugcggccccugcaaguacaaggccgagugcgacgaggacgccgagaacgucggcugcgucugcaacaucgacugcuccggcuacuccuucaaccccgucugcgccuccgacggcuccuccuacaacaaccccugcuucguccgcgaggccuccugcaucaagcaggagcagaucgacauccgccaccucggccacugcaccgacaccgacgacaccucccuccucggcaagaaggacgacggccuccaguaccgccccgacgucaaggacgccuccgaccagcgcgaggacgucuacaucggcaaccacaugcccugccccgagaaccucaacggcuacugcauccacggcaagugcgaguucaucuacuccacccagaaggccuccugccgcugcgaguccggcuacaccggccagcacugcgagaagaccgacuucuccauccucuacgucguccccucccgccagaagcucacccacguccucaucgccgccaucaucggcgccguccagaucgccaucaucgucgccaucgucaugugcaucacccgcaagugccccaagaacaaccgcggccgccgccagaagcagaaccucggccacuucaccuccgacaccuccucccgcauggucuga

SEQ ID NO: 46184 - RNA, 621 nt, Artificial Sequence
  derived and/or modified sequence opt2 from MSC__Homo_sapiens__NP_005089
auguccaccggcuccgucuccgaccccgaggagauggagcuccgcggccuccagcgcgaguaccccguccccgccuccaagcgccccccccuccgcggcgucgagcgcuccuacgccucccccuccgacaacuccuccgccgaggaggaggaccccgacggcgaggaggagcgcugcgcccucggcaccgccggcuccgccgagggcugcaagcgcaagcgcccccgcgucgccggcggcggcggcgccggcggcuccgccggcggcggcggcaagaagccccuccccgccaagggcuccgccgccgagugcaagcagucccagcgcaacgccgccaacgcccgcgagcgcgcccgcaugcgcguccucuccaaggccuucucccgccucaagaccucccuccccugggucccccccgacaccaagcucuccaagcucgacacccuccgccucgccuccuccuacaucgcccaccuccgccagcuccuccaggaggaccgcuacgagaacggcuacguccaccccgucaaccucaccuggcccuucgucgucuccggccgccccgacuccgacaccaaggaggucuccgccgccaaccgccucugcggcaccaccgccuga

SEQ ID NO: 46185 - RNA, 582 nt, Artificial Sequence
  derived and/or modified sequence opt2 from MSGN1__Homo_sapiens__NP_001099039
auggacaaccuccgcgagaccuuccucucccucgaggacggccucggcuccuccgacucccccggccuccucuccuccugggacuggaaggaccgcgccggccccuucgagcucaaccaggccucccccucccagucccucucccccgcccccucccucgaguccuacuccuccucccccugccccgccgucgccggccuccccugcgagcacggcggcgccuccuccggcggcuccgagggcugcuccgucggcggcgccuccggccucgucgaggucgacuacaacaugcucgccuuccagcccacccaccuccagggcggcggcggccccaaggcccagaagggcaccaagguccgcauguccguccagcgccgccgcaaggccuccgagcgcgagaagcuccgcaugcgcacccucgccgacgcccuccacacccuccgcaacuaccucccccccgucuacucccagcgcggccagccccucaccaagauccagacccucaaguacaccaucaaguacaucggcgagcucaccgaccuccucaaccgcggccgcgagccccgcgcccaguccgccuga

SEQ ID NO: 46186 - RNA, 2805 nt, Artificial Sequence
  derived and/or modified sequence opt2 from MSH2__Homo_sapiens__NP_000242
auggccguccagcccaaggagacccuccagcucgaguccgccgccgaggucggcuucguccgcuucuuccagggcaugcccgagaagcccaccaccaccguccgccucuucgaccgcggcgacuucuacaccgcccacggcgaggacgcccuccucgccgcccgcgaggucuucaagacccagggcgucaucaaguacaugggccccgccggcgccaagaaccuccaguccgucguccucuccaagaugaacuucgaguccuucgucaaggaccuccuccucguccgccaguaccgcgucgaggucuacaagaaccgcgccggcaacaaggccuccaaggagaacgacugguaccucgccuacaaggccucccccggcaaccucucccaguucgaggacauccucuucggcaacaacgacauguccgccuccaucggcgucgucggcgucaagauguccgccgucgacggccagcgccaggucggcgucggcuacgucgacuccauccagcgcaagcucggccucugcgaguuccccgacaacgaccaguucuccaaccucgaggcccuccucauccagaucggccccaaggagugcguccuccccggcggcgagaccgccggcgacaugggcaagcuccgccagaucauccagcgcggcggcauccucaucaccgagcgcaagaaggccgacuucuccaccaaggacaucuaccaggaccucaaccgccuccucaagggcaagaagggcgagcagaugaacuccgccguccuccccgagauggagaaccaggucgccgucuccucccucuccgccgucaucaaguuccucgagcuccucuccgacgacuccaacuucggccaguucgagcucaccaccuucgacuucucccaguacaugaagcucgacaucgccgccguccgcgcccucaaccucuuccagggcuccgucgaggacaccaccggcucccagucccucgccgcccuccucaacaagugcaagaccccccagggccagcgccucgucaaccaguggaucaagcagccccucauggacaagaaccgcaucgaggagcgccucaaccucgucgaggccuucgucgaggacgccgagcuccgccagacccuccaggaggaccuccuccgccgcuuccccgaccucaaccgccucgccaagaaguuccagcgccaggccgccaaccuccaggacugcuaccgccucuaccagggcaucaaccagcuccccaacgucauccaggcccucgagaagcacgagggcaagcaccagaagcuccuccucgccgucuucgucaccccccucaccgaccuccgcuccgacuucuccaaguuccaggagaugaucgagaccacccucgacauggaccaggucgagaaccacgaguuccucgucaagcccuccuucgaccccaaccucuccgagcuccgcgagaucaugaacgaccucgagaagaagaugcaguccacccucaucuccgccgcccgcgaccucggccucgaccccggcaagcagaucaagcucgacuccuccgcccaguucggcuacuacuuccgcgucaccugcaaggaggagaagguccuccgcaacaacaagaacuucuccaccgucgacauccagaagaacggcgucaaguucaccaacuccaagcucaccucccucaacgaggaguacaccaagaacaagaccgaguacgaggaggcccaggacgccaucgucaaggagaucgucaacaucuccuccggcuacgucgagcccaugcagacccucaacgacguccucgcccagcucgacgccgucgucuccuucgcccacgucuccaacggcgcccccguccccuacguccgccccgccauccucgagaagggccagggccgcaucauccucaaggccucccgccacgccugcgucgagguccaggacgagaucgccuucauccccaacgacgucuacuucgagaaggacaagcagauguuccacaucaucaccggccccaacaugggcggcaaguccaccuacauccgccagaccggcgucaucguccucauggcccagaucggcugcuucguccccugcgaguccgccgaggucuccaucgucgacugcauccucgcccgcgucggcgccggcgacucccagcucaagggcgucuccaccuucauggccgagaugcucgagaccgccuccauccuccgcuccgccaccaaggacucccucaucaucaucgacgagcucggccgcggcaccuccaccuacgacggcuucggccucgccugggccaucuccgaguacaucgccaccaagaucggcgccuucugcauguucgccacccacuuccacgagcucaccgcccucgccaaccagauccccaccgucaacaaccuccacgucaccgcccucaccaccgaggagacccucaccaugcucuaccaggucaagaagggcgucugcgaccaguccuucggcauccacgucgccgagcucgccaacuuccccaagcacgucaucgagugcgccaagcagaaggcccucgagcucgaggaguuccaguacaucggcgagucccagggcuacgacaucauggagcccgccgccaagaagugcuaccucgagcgcgagcagggcgagaagaucauccaggaguuccucuccaaggucaagcagaugcccuucaccgagauguccgaggagaacaucaccaucaagcucaagcagcucaaggccgaggucaucgccaagaacaacuccuucgucaacgagaucaucucccgcaucaaggucaccaccuga

SEQ ID NO: 46187 - RNA, 3414 nt, Artificial Sequence
  derived and/or modified sequence opt2 from MSH3__Homo_sapiens__NP_002430
augucccgccgcaagcccgccuccggcggccucgccgccuccuccuccgcccccgcccgccaggccguccucucccgcuucuuccaguccaccggcucccucaaguccaccuccuccuccaccggcgccgccgaccaggucgaccccggcgccgccgccgccgccgccgccgccgccgccgccgccccccccgccccccccgcccccgccuuccccccccagcuccccccccacaucgccaccgagaucgaccgccgcaagaagcgcccccucgagaacgacggccccgucaagaagaaggucaagaagguccagcagaaggagggcggcuccgaccucggcauguccggcaacuccgagcccaagaagugccuccgcacccgcaacgucuccaagucccucgagaagcucaaggaguucugcugcgacuccgcccucccccagucccgcguccagaccgagucccuccaggagcgcuucgccguccuccccaagugcaccgacuucgacgacaucucccuccuccacgccaagaacgccgucuccuccgaggacuccaagcgccagaucaaccagaaggacaccacccucuucgaccucucccaguucggcuccuccaacaccucccacgagaaccuccagaagaccgccuccaaguccgccaacaagcgcuccaaguccaucuacaccccccucgagcuccaguacaucgagaugaagcagcagcacaaggacgccguccucugcgucgagugcggcuacaaguaccgcuucuucggcgaggacgccgagaucgccgcccgcgagcucaacaucuacugccaccucgaccacaacuucaugaccgccuccauccccacccaccgccucuucguccacguccgccgccucgucgccaagggcuacaaggucggcgucgucaagcagaccgagaccgccgcccucaaggccaucggcgacaaccgcuccucccucuucucccgcaagcucaccgcccucuacaccaaguccacccucaucggcgaggacgucaacccccucaucaagcucgacgacgccgucaacgucgacgagaucaugaccgacaccuccaccuccuaccuccucugcaucuccgagaacaaggagaacguccgcgacaagaagaagggcaacaucuucaucggcaucgucggcguccagcccgccaccggcgaggucgucuucgacuccuuccaggacuccgccucccgcuccgagcucgagacccgcauguccucccuccagcccgucgagcuccuccuccccuccgcccucuccgagcagaccgaggcccucauccaccgcgccaccuccgucuccguccaggacgaccgcauccgcgucgagcgcauggacaacaucuacuucgaguacucccacgccuuccaggccgucaccgaguucuacgccaaggacaccgucgacaucaagggcucccagaucaucuccggcaucgucaaccucgagaagcccgucaucugcucccucgccgccaucaucaaguaccucaaggaguucaaccucgagaagaugcucuccaagcccgagaacuucaagcagcucuccuccaagauggaguucaugaccaucaacggcaccacccuccgcaaccucgagauccuccagaaccagaccgacaugaagaccaagggcucccuccucuggguccucgaccacaccaagaccuccuucggccgccgcaagcucaagaagugggucacccagccccuccucaagcuccgcgagaucaacgcccgccucgacgccgucuccgagguccuccacuccgaguccuccgucuucggccagaucgagaaccaccuccgcaagcuccccgacaucgagcgcggccucugcuccaucuaccacaagaagugcuccacccaggaguucuuccucaucgucaagacccucuaccaccucaaguccgaguuccaggccaucauccccgccgucaacucccacauccaguccgaccuccuccgcaccgucauccucgagauccccgagcuccucucccccgucgagcacuaccucaagauccucaacgagcaggccgccaaggucggcgacaagaccgagcucuucaaggaccucuccgacuucccccucaucaagaagcgcaaggacgagauccagggcgucaucgacgagauccgcaugcaccuccaggagauccgcaagauccucaagaaccccuccgcccaguacgucaccgucuccggccaggaguucaugaucgagaucaagaacuccgccgucuccugcauccccaccgacugggucaaggucggcuccaccaaggccgucucccgcuuccacucccccuucaucgucgagaacuaccgccaccucaaccagcuccgcgagcagcucguccucgacugcuccgccgaguggcucgacuuccucgagaaguucuccgagcacuaccacucccucugcaaggccguccaccaccucgccaccgucgacugcaucuucucccucgccaaggucgccaagcagggcgacuacugccgccccaccguccaggaggagcgcaagaucgucaucaagaacggccgccaccccgucaucgacguccuccucggcgagcaggaccaguacguccccaacaacaccgaccucuccgaggacuccgagcgcgucaugaucaucaccggccccaacaugggcggcaaguccuccuacaucaagcaggucgcccucaucaccaucauggcccagaucggcuccuacguccccgccgaggaggccaccaucggcaucgucgacggcaucuucacccgcaugggcgccgccgacaacaucuacaagggccaguccaccuucauggaggagcucaccgacaccgccgagaucauccgcaaggccaccucccagucccucgucauccucgacgagcucggccgcggcaccuccacccacgacggcaucgccaucgccuacgccacccucgaguacuucauccgcgacgucaagucccucacccucuucgucacccacuacccccccgucugcgagcucgagaagaacuacucccaccaggucggcaacuaccacaugggcuuccucgucuccgaggacgaguccaagcucgaccccggcgccgccgagcagguccccgacuucgucaccuuccucuaccagaucacccgcggcaucgccgcccgcuccuacggccucaacgucgccaagcucgccgacguccccggcgagauccucaagaaggccgcccacaaguccaaggagcucgagggccucaucaacaccaagcgcaagcgccucaaguacuucgccaagcucuggaccaugcacaacgcccaggaccuccagaaguggaccgaggaguucaacauggaggagacccagaccucccuccuccacuga

SEQ ID NO: 46188 - RNA, 2469 nt, Artificial Sequence
  derived and/or modified sequence opt2 from MSH5__Homo_sapiens__NP_079535
auggccucccucggcgccaacccccgccgcaccccccagggcccccgccccggcgccgccuccuccggcuuccccucccccgcccccguccccggcccccgcgaggccgaggaggaggaggucgaggaggaggaggagcucgccgagauccaccucugcguccucuggaacuccggcuaccucggcaucgccuacuacgacaccuccgacuccaccauccacuucaugcccgacgcccccgaccacgagucccucaagcuccuccagcgcguccucgacgagaucaacccccaguccgucgucaccuccgccaagcaggacgagaacaugacccgcuuccucggcaagcucgccucccaggagcaccgcgagcccaagcgccccgagaucaucuuccuccccuccgucgacuucggccucgagaucuccaagcagcgccuccucuccggcaacuacuccuucauccccgacgccaugaccgccaccgagaagauccucuuccucuccuccaucauccccuucgacugccuccucaccccccccggcgaccuccgcuucacccccaucccccuccucauccccucccagguccgcgcccucggcggccuccucaaguuccucggccgccgccgcaucggcgucgagcucgaggacuacaacgucuccguccccauccucggcuucaagaaguucaugcucacccaccucgucaacaucgaccaggacaccuacuccguccuccagaucuucaaguccgagucccaccccuccgucuacaaggucgccuccggccucaaggagggccucucccucuucggcauccucaaccgcugccacugcaaguggggcgagaagcuccuccgccucugguucacccgccccacccacgaccucggcgagcucuccucccgccucgacgucauccaguucuuccuccucccccagaaccucgacauggcccagaugcuccaccgccuccucggccacaucaagaacgucccccucauccucaagcgcaugaagcucucccacaccaaggucuccgacuggcagguccucuacaagaccgucuacuccgcccucggccuccgcgacgccugccgcucccucccccaguccauccagcucuuccgcgacaucgcccaggaguucuccgacgaccuccaccacaucgccucccucaucggcaaggucgucgacuucgagggcucccucgccgagaaccgcuucaccguccuccccaacaucgaccccgagaucgacgagaagaagcgccgccucaugggccuccccuccuuccucaccgaggucgcccgcaaggagcucgagaaccucgacucccgcauccccuccugcuccgucaucuacaucccccucaucggcuuccuccucuccaucccccgccuccccuccauggucgaggccuccgacuucgagaucaacggccucgacuucauguuccucuccgaggagaagcuccacuaccgcuccgcccgcaccaaggagcucgacgcccuccucggcgaccuccacugcgagauccgcgaccaggagacccuccucauguaccagcuccagugccagguccucgcccgcgccgccguccucacccgcguccucgaccucgccucccgccucgacguccuccucgcccucgccuccgccgcccgcgacuacggcuacucccgcccccgcuacuccccccagguccucggcguccgcauccagaacggccgccacccccucauggagcucugcgcccgcaccuucguccccaacuccaccgagugcggcggcgacaagggccgcgucaaggucaucaccggccccaacuccuccggcaaguccaucuaccucaagcaggucggccucaucaccuucauggcccucgucggcuccuucguccccgccgaggaggccgagaucggcgccgucgacgccaucuucacccgcauccacuccugcgaguccaucucccucggccucuccaccuucaugaucgaccucaaccagcaggucgccaaggccgucaacaacgccaccgcccagucccucguccucaucgacgaguucggcaagggcaccaacaccgucgacggccucgcccuccucgccgccguccuccgccacuggcucgcccgcggccccaccugcccccacaucuucgucgccaccaacuuccucucccucguccagcuccagcuccucccccagggcccccucguccaguaccucaccauggagaccugcgaggacggcaacgaccucgucuucuucuaccaggucuccgaccucauccgcuccggcaagcccaucaagcccgucaaggaccuccucaagaagaaccagauggagaacugccagacccucgucgacaaguucaugaagcucgaccucgaggaccccaaccucgaccucaacgucuucaugucccaggagguccuccccgccgccaccuccauccucuga

SEQ ID NO: 46189 - RNA, 4083 nt, Artificial Sequence
  derived and/or modified sequence opt2 from MSH6__Homo_sapiens__NP_000170
augucccgccaguccacccucuacuccuucuuccccaagucccccgcccucuccgacgccaacaaggccuccgcccgcgccucccgcgagggcggccgcgccgccgccgcccccggcgccucccccucccccggcggcgacgccgccugguccgaggccggccccggcccccgcccccucgcccgcuccgccuccccccccaaggccaagaaccucaacggcggccuccgccgcuccgucgcccccgccgcccccaccuccugcgacuucucccccggcgaccucgucugggccaagauggagggcuaccccugguggcccugccucgucuacaaccaccccuucgacggcaccuucauccgcgagaagggcaaguccguccgcguccacguccaguucuucgacgacucccccacccgcggcugggucuccaagcgccuccucaagcccuacaccggcuccaaguccaaggaggcccagaagggcggccacuucuacuccgccaagcccgagauccuccgcgccaugcagcgcgccgacgaggcccucaacaaggacaagaucaagcgccucgagcucgccgucugcgacgagcccuccgagcccgaggaggaggaggagauggaggucggcaccaccuacgucaccgacaaguccgaggaggacaacgagaucgaguccgaggaggagguccagcccaagacccagggcucccgccgcuccucccgccagaucaagaagcgccgcgucaucuccgacuccgaguccgacaucggcggcuccgacgucgaguucaagcccgacaccaaggaggagggcuccuccgacgagaucuccuccggcgucggcgacuccgaguccgagggccucaacucccccgucaaggucgcccgcaagcgcaagcgcauggucaccggcaacggcucccucaagcgcaaguccucccgcaaggagacccccuccgccaccaagcaggccaccuccaucuccuccgagaccaagaacacccuccgcgccuucuccgccccccagaacuccgagucccaggcccacgucuccggcggcggcgacgacuccucccgccccaccgucugguaccacgagacccucgaguggcucaaggaggagaagcgccgcgacgagcaccgccgccgccccgaccaccccgacuucgacgccuccacccucuacguccccgaggacuuccucaacuccugcacccccggcaugcgcaagugguggcagaucaagucccagaacuucgaccucgucaucugcuacaaggucggcaaguucuacgagcucuaccacauggacgcccucaucggcgucuccgagcucggccucgucuucaugaagggcaacugggcccacuccggcuuccccgagaucgccuucggccgcuacuccgacucccucguccagaagggcuacaaggucgcccgcgucgagcagaccgagacccccgagaugauggaggcccgcugccgcaagauggcccacaucuccaaguacgaccgcgucguccgccgcgagaucugccgcaucaucaccaagggcacccagaccuacuccguccucgagggcgaccccuccgagaacuacuccaaguaccuccucucccucaaggagaaggaggaggacuccuccggccacacccgcgccuacggcgucugcuucgucgacaccucccucggcaaguucuucaucggccaguucuccgacgaccgccacugcucccgcuuccgcacccucgucgcccacuacccccccguccagguccucuucgagaagggcaaccucuccaaggagaccaagaccauccucaaguccucccucuccugcucccuccaggagggccucauccccggcucccaguucugggacgccuccaagacccuccgcacccuccucgaggaggaguacuuccgcgagaagcucuccgacggcaucggcgucaugcucccccagguccucaagggcaugaccuccgaguccgacuccaucggccucacccccggcgagaaguccgagcucgcccucuccgcccucggcggcugcgucuucuaccucaagaagugccucaucgaccaggagcuccucuccauggccaacuucgaggaguacaucccccucgacuccgacaccgucuccaccacccgcuccggcgccaucuucaccaaggccuaccagcgcaugguccucgacgccgucacccucaacaaccucgagaucuuccucaacggcaccaacggcuccaccgagggcacccuccucgagcgcgucgacaccugccacacccccuucggcaagcgccuccucaagcaguggcucugcgccccccucugcaaccacuacgccaucaacgaccgccucgacgccaucgaggaccucauggucguccccgacaagaucuccgaggucgucgagcuccucaagaagcuccccgaccucgagcgccuccucuccaagauccacaacgucggcuccccccucaagucccagaaccaccccgacucccgcgccaucauguacgaggagaccaccuacuccaagaagaagaucaucgacuuccucuccgcccucgagggcuucaaggucaugugcaagaucaucggcaucauggaggaggucgccgacggcuucaaguccaagauccucaagcaggucaucucccuccagaccaagaaccccgagggccgcuuccccgaccucaccgucgagcucaaccgcugggacaccgccuucgaccacgagaaggcccgcaagaccggccucaucacccccaaggccggcuucgacuccgacuacgaccaggcccucgccgacauccgcgagaacgagcagucccuccucgaguaccucgagaagcagcgcaaccgcaucggcugccgcaccaucgucuacuggggcaucggccgcaaccgcuaccagcucgagauccccgagaacuucaccacccgcaaccuccccgaggaguacgagcucaaguccaccaagaagggcugcaagcgcuacuggaccaagaccaucgagaagaagcucgccaaccucaucaacgccgaggagcgccgcgacgucucccucaaggacugcaugcgccgccucuucuacaacuucgacaagaacuacaaggacuggcaguccgccgucgagugcaucgccguccucgacguccuccucugccucgccaacuacucccgcggcggcgacggccccaugugccgccccgucauccuccuccccgaggacaccccccccuuccucgagcucaagggcucccgccaccccugcaucaccaagaccuucuucggcgacgacuucauccccaacgacauccucaucggcugcgaggaggaggagcaggagaacggcaaggccuacugcguccucgucaccggccccaacaugggcggcaaguccacccucaugcgccaggccggccuccucgccgucauggcccagaugggcugcuacguccccgccgaggucugccgccucacccccaucgaccgcgucuucacccgccucggcgccuccgaccgcaucauguccggcgaguccaccuucuucgucgagcucuccgagaccgccuccauccucaugcacgccaccgcccacucccucguccucgucgacgagcucggccgcggcaccgccaccuucgacggcaccgccaucgccaacgccgucgucaaggagcucgccgagaccaucaagugccgcacccucuucuccacccacuaccacucccucgucgaggacuacucccagaacgucgccguccgccucggccacauggccugcauggucgagaacgagugcgaggaccccucccaggagaccaucaccuuccucuacaaguucaucaagggcgccugccccaaguccuacggcuucaacgccgcccgccucgccaaccuccccgaggaggucauccagaagggccaccgcaaggcccgcgaguucgagaagaugaaccagucccuccgccucuuccgcgaggucugccucgccuccgagcgcuccaccgucgacgccgaggccguccacaagcuccucacccucaucaaggagcucuga

SEQ ID NO: 46190 - RNA, 1089 nt, Artificial Sequence
  derived and/or modified sequence opt2 from MSI1__Homo_sapiens__NP_002433
auggagaccgacgccccccagcccggccucgccucccccgacuccccccacgaccccugcaagauguucaucggcggccucuccuggcagaccacccaggagggccuccgcgaguacuucggccaguucggcgaggucaaggagugccucgucaugcgcgacccccucaccaagcgcucccgcggcuucggcuucgucaccuucauggaccaggccggcgucgacaagguccucgcccagucccgccacgagcucgacuccaagaccaucgaccccaaggucgccuucccccgccgcgcccagcccaagauggucacccgcaccaagaagaucuucgucggcggccucuccgucaacaccaccgucgaggacgucaagcaguacuucgagcaguucggcaaggucgacgacgccaugcucauguucgacaagaccaccaaccgccaccgcggcuucggcuucgucaccuucgaguccgaggacaucgucgagaaggucugcgagauccacuuccacgagaucaacaacaagauggucgagugcaagaaggcccagcccaaggaggucaugucccccaccggcuccgcccgcggccgcucccgcgucaugcccuacggcauggacgccuucaugcucggcaucggcaugcucggcuaccccggcuuccaggccaccaccuacgccucccgcuccuacaccggccucgcccccggcuacaccuaccaguuccccgaguuccgcgucgagcgcaccccccuccccuccgcccccguccuccccgagcucaccgccaucccccucaccgccuacggccccauggccgccgccgccgccgccgccgccgucguccgcggcaccggcucccaccccuggaccauggcccccccccccggcuccacccccucccgcaccggcggcuuccucggcaccaccucccccggccccauggccgagcucuacggcgccgccaaccaggacuccggcgucuccuccuacaucuccgccgccucccccgcccccuccaccggcuucggccacucccucggcggcccccucaucgccaccgccuucaccaacggcuaccacuga

SEQ ID NO: 46191 - RNA, 987 nt, Artificial Sequence
  derived and/or modified sequence opt2 from MSI2__Homo_sapiens__NP_620412
auggaggccaacggcucccagggcaccuccggcuccgccaacgacucccagcacgaccccggcaagauguucaucggcggccucuccuggcagaccucccccgacucccuccgcgacuacuucuccaaguucggcgagauccgcgagugcauggucaugcgcgaccccaccaccaagcgcucccgcggcuucggcuucgucaccuucgccgaccccgccuccgucgacaagguccucggccagccccaccacgagcucgacuccaagaccaucgaccccaaggucgccuucccccgccgcgcccagcccaagauggucacccgcaccaagaagaucuucgucggcggccucuccgccaacaccgucgucgaggacgucaagcaguacuucgagcaguucggcaaggucgaggacgccaugcucauguucgacaagaccaccaaccgccaccgcggcuucggcuucgucaccuucgagaacgaggacgucgucgagaaggucugcgagauccacuuccacgagaucaacaacaagauggucgagugcaagaaggcccagcccaaggaggucauguucccccccggcacccgcggccgcgcccgcggccuccccuacaccauggacgccuucaugcucggcaugggcaugcucggcuaccccaacuucgucgccaccuacggccgcggcuaccccggcuucgcccccuccuacggcuaccaguuccccggcuuccccgccgccgccuacggccccgucgccgccgccgccgucgccgccgcccgcggcuccggcuccaaccccgcccgccccggcggcuuccccggcgccaacucccccggccccgucgccgaccucuacggccccgccucccaggacuccggcgucggcaacuacaucuccgccgccuccccccagcccggcuccggcuucggccacggcaucgccggcccccucaucgccaccgccuucaccaacggcuaccacuga

SEQ ID NO: 46192 - RNA, 1866 nt, Artificial Sequence
  derived and/or modified sequence opt2 from MSLN__Homo_sapiens__XP_005255091
auggcccuccccaccgcccgcccccuccucggcuccugcggcacccccgcccucggcucccuccucuuccuccucuucucccucggcuggguccagcccucccgcacccucgccggcgagaccggccaggccgccccccucgacggcguccucgccaacccccccaacaucuccucccucuccccccgccagcuccucggcuuccccugcgccgaggucuccggccucuccaccgagcgcguccgcgagcucgccgucgcccucgcccagaagaacgucaagcucuccaccgagcagcuccgcugccucgcccaccgccucuccgagccccccgaggaccucgacgcccucccccucgaccuccuccucuuccucaaccccgacgccuucuccggcccccaggccugcacccgcuucuucucccgcaucaccaaggccaacgucgaccuccucccccgcggcgcccccgagcgccagcgccuccuccccgccgcccucgccugcuggggcguccgcggcucccuccucuccgaggccgacguccgcgcccucggcggccucgccugcgaccuccccggccgcuucgucgccgaguccgccgagguccuccucccccgccucgucuccugccccggcccccucgaccaggaccagcaggaggccgcccgcgccgcccuccagggcggcggcccccccuacggcccccccuccaccugguccgucuccaccauggacgcccuccgcggccuccuccccguccucggccagcccaucauccgcuccaucccccagggcaucgucgccgccuggcgccagcgcuccucccgcgaccccuccuggcgccagcccgagcgcaccauccuccgcccccgcuuccgccgcgaggucgagaagaccgccugccccuccggcaagaaggcccgcgagaucgacgagucccucaucuucuacaagaagugggagcucgaggccugcgucgacgccgcccuccucgccacccagauggaccgcgucaacgccauccccuucaccuacgagcagcucgacguccucaagcacaagcucgacgagcucuacccccagggcuaccccgaguccgucauccagcaccucggcuaccucuuccucaagaugucccccgaggacauccgcaaguggaacgucaccucccucgagacccucaaggcccuccucgaggucaacaagggccacgagauguccccccaggucgccacccucaucgaccgcuucgucaagggccgcggccagcucgacaaggacacccucgacacccucaccgccuucuaccccggcuaccucugcucccucucccccgaggagcucuccuccgucccccccuccuccaucugggccguccgcccccaggaccucgacaccugcgacccccgccagcucgacguccucuaccccaaggcccgccucgccuuccagaacaugaacggcuccgaguacuucgucaagauccaguccuuccucggcggcgcccccaccgaggaccucaaggcccucucccagcagaacgucuccauggaccucgccaccuucaugaagcuccgcaccgacgccguccucccccucaccgucgccgagguccagaagcuccucggcccccacgucgagggccucaaggccgaggagcgccaccgccccguccgcgacuggauccuccgccagcgccaggacgaccucgacacccucggccucggccuccagggcggcauccccaacggcuaccucguccucgaccucuccaugcaggaggcccucuccggcacccccugccuccucggccccggccccguccucaccguccucgcccuccuccucgccuccacccucgccuga

SEQ ID NO: 46193 - RNA, 345 nt, Artificial Sequence
  derived and/or modified sequence opt2 from MSMB__Homo_sapiens__NP_002434
augaacguccuccucggcuccgucgucaucuucgccaccuucgucacccucugcaacgccuccugcuacuucauccccaacgagggcguccccggcgacuccacccgcaagugcauggaccucaagggcaacaagcaccccaucaacuccgaguggcagaccgacaacugcgagaccugcaccugcuacgagaccgagaucuccugcugcacccucgucuccacccccgucggcuacgacaaggacaacugccagcgcaucuucaagaaggaggacugcaaguacaucgucgucgagaagaaggaccccaagaagaccugcuccgucuccgaguggaucaucuga

SEQ ID NO: 46194 - RNA, 489 nt, Artificial Sequence
  derived and/or modified sequence opt2 from MSMO1__Homo_sapiens__NP_001017369
augccccgcugguacuuccuccucgcccgcugcuucggcugcgccgucaucgaggacaccuggcacuacuuccuccaccgccuccuccaccacaagcgcaucuacaaguacauccacaagguccaccacgaguuccaggcccccuucggcauggaggccgaguacgcccacccccucgagacccucauccucggcaccggcuucuucaucggcaucguccuccucugcgaccacgucauccuccucugggccugggucaccauccgccuccucgagaccaucgacguccacuccggcuacgacaucccccucaacccccucaaccucauccccuucuacgccggcucccgccaccacgacuuccaccacaugaacuucaucggcaacuacgccuccaccuucaccuggugggaccgcaucuucggcaccgacucccaguacaacgccuacaacgagaagcgcaagaaguucgagaagaagaccgaguga

SEQ ID NO: 46195 - RNA, 420 nt, Artificial Sequence
  derived and/or modified sequence opt2 from MSMP__Homo_sapiens__NP_001037729
auggcccuccgcaugcucugggccggccaggccaagggcauccucggcggcuggggcaucaucugccucgucaugucccuccuccuccagcaccccggcgucuacuccaagugcuacuuccaggcccaggcccccugccacuacgagggcaaguacuucacccucggcgaguccuggcuccgcaaggacugcuuccacugcaccugccuccaccccgucggcgucggcugcugcgacaccucccagcaccccaucgacuuccccgccggcugcgagguccgccaggaggccggcaccugccaguucucccucguccagaaguccgacccccgccuccccugcaagggcggcggccccgaccccgaguggggcuccgccaacacccccguccccggcgcccccgccccccacuccuccuga

SEQ ID NO: 46196 - RNA, 1734 nt, Artificial Sequence
  derived and/or modified sequence opt2 from MSN__Homo_sapiens__NP_002435
augcccaagaccaucuccguccgcgucaccaccauggacgccgagcucgaguucgccauccagcccaacaccaccggcaagcagcucuucgaccaggucgucaagaccaucggccuccgcgaggucugguucuucggccuccaguaccaggacaccaagggcuucuccaccuggcucaagcucaacaagaaggucaccgcccaggacguccgcaaggaguccccccuccucuucaaguuccgcgccaaguucuaccccgaggacgucuccgaggagcucauccaggacaucacccagcgccucuucuuccuccaggucaaggagggcauccucaacgacgacaucuacugcccccccgagaccgccguccuccucgccuccuacgccguccaguccaaguacggcgacuucaacaaggagguccacaaguccggcuaccucgccggcgacaagcuccucccccagcgcguccucgagcagcacaagcucaacaaggaccagugggaggagcgcauccaggucuggcacgaggagcaccgcggcaugcuccgcgaggacgccguccucgaguaccucaagaucgcccaggaccucgagauguacggcgucaacuacuucuccaucaagaacaagaagggcuccgagcucuggcucggcgucgacgcccucggccucaacaucuacgagcagaacgaccgccucacccccaagaucggcuuccccugguccgagauccgcaacaucuccuucaacgacaagaaguucgucaucaagcccaucgacaagaaggcccccgacuucgucuucuacgccccccgccuccgcaucaacaagcgcauccucgcccucugcaugggcaaccacgagcucuacaugcgccgccgcaagcccgacaccaucgagguccagcagaugaaggcccaggcccgcgaggagaagcaccagaagcagauggagcgcgccaugcucgagaacgagaagaagaagcgcgagauggccgagaaggagaaggagaagaucgagcgcgagaaggaggagcucauggagcgccucaagcagaucgaggagcagaccaagaaggcccagcaggagcucgaggagcagacccgccgcgcccucgagcucgagcaggagcgcaagcgcgcccaguccgaggccgagaagcucgccaaggagcgccaggaggccgaggaggccaaggaggcccuccuccaggccucccgcgaccagaagaagacccaggagcagcucgcccucgagauggccgagcucaccgcccgcaucucccagcucgagauggcccgccagaagaaggaguccgaggccgucgaguggcagcagaaggcccagaugguccaggaggaccucgagaagacccgcgccgagcucaagaccgccauguccaccccccacgucgccgagcccgccgagaacgagcaggacgagcaggacgagaacggcgccgaggccuccgccgaccuccgcgccgacgccauggccaaggaccgcuccgaggaggagcgcaccaccgaggccgagaagaacgagcgcguccagaagcaccucaaggcccucaccuccgagcucgccaacgcccgcgacgaguccaagaagaccgccaacgacaugauccacgccgagaacaugcgccucggccgcgacaaguacaagacccuccgccagauccgccagggcaacaccaagcagcgcaucgacgaguucgaguccauguga

SEQ ID NO: 46197 - RNA, 1077 nt, Artificial Sequence
  derived and/or modified sequence opt2 from MSR1__Homo_sapiens__NP_002436
auggagcagugggaccacuuccacaaccagcaggaggacaccgacuccugcuccgaguccgucaaguucgacgcccgcuccaugaccgcccuccucccccccaaccccaagaacucccccucccuccaggagaagcucaaguccuucaaggccgcccucaucgcccucuaccuccucgucuucgccguccucaucccccucaucggcaucgucgccgcccagcuccucaagugggagaccaagaacugcuccgucuccuccaccaacgccaacgacaucacccagucccucaccggcaagggcaacgacuccgaggaggagaugcgcuuccaggaggucuucauggagcacauguccaacauggagaagcgcauccagcacauccucgacauggaggccaaccucauggacaccgagcacuuccagaacuucuccaugaccaccgaccagcgcuucaacgacauccuccuccagcucuccacccucuucuccuccguccagggccacggcaacgccaucgacgagaucuccaagucccucaucucccucaacaccacccuccucgaccuccagcucaacaucgagaaccucaacggcaagauccaggagaacaccuucaagcagcaggaggagaucuccaagcucgaggagcgcgucuacaacgucuccgccgagaucauggccaugaaggaggagcagguccaccucgagcaggagaucaagggcgaggucaagguccucaacaacaucaccaacgaccuccgccucaaggacugggagcacucccagacccuccgcaacaucacccucauccagggcccccccggcccccccggcgagaagggcgaccgcggccccaccggcgaguccggcccccgcggcuuccccggccccaucggcccccccggccucaagggcgaccgcggcgccaucggcuuccccggcucccgcggccuccccggcuacgccggccgccccggcaacuccggccccaagggccagaagggcgagaagggcuccggcaacacccuccgccccguccagcucaccgaccacauccgcgccggccccuccuga

SEQ ID NO: 46198 - RNA, 588 nt, Artificial Sequence
  derived and/or modified sequence opt2 from MSRA__Homo_sapiens__NP_001129142
augcucuccgccacccgccgcgccugccagcuccuccuccuccacucccucuuccccgucccccgcaugggcaacuccgccuccaacaucgucuccccccaggaggcccuccccggccgcaaggagcagacccccgucgccgccaagcaccacgucaacggcaaccgcaccgucgagcccuuccccgagggcacccagauggccgucuucgagaagaccggccacgccgaggucguccgcgucgucuaccagcccgagcacauguccuucgaggagcuccucaaggucuucugggagaaccacgaccccacccagggcaugcgccagggcaacgaccacggcacccaguaccgcuccgccaucuaccccaccuccgccaagcagauggaggccgcccucuccuccaaggagaacuaccagaagguccucuccgagcacggcuucggccccaucaccaccgacauccgcgagggccagaccuucuacuacgccgaggacuaccaccagcaguaccucuccaagaaccccaacggcuacugcggccucggcggcaccggcgucuccugccccgucggcaucaagaaguga

SEQ ID NO: 46199 - RNA, 549 nt, Artificial Sequence
  derived and/or modified sequence opt2 from MSRB2__Homo_sapiens__NP_036360
auggcccgccuccucuggcuccuccgcggccucacccucggcaccgccccccgccgcgccguccgcggccaggccggcggcggcggccccggcaccggccccggccucggcgaggccggcucccucgccaccugcgagcucccccucgccaaguccgaguggcagaagaagcucacccccgagcaguucuacgucacccgcgagaagggcaccgagccccccuucuccggcaucuaccucaacaacaaggaggccggcauguaccacugcgucugcugcgacuccccccucuucuccuccgagaagaaguacugcuccggcaccggcuggcccuccuucuccgaggcccacggcaccuccggcuccgacgagucccacaccggcauccuccgccgccucgacaccucccucggcuccgcccgcaccgaggucgucugcaagcagugcgaggcccaccucggccacgucuuccccgacggccccggccccaacggccagcgcuucugcaucaacuccgucgcccucaaguucaagccccgcaagcacuga

SEQ ID NO: 46200 - RNA, 558 nt, Artificial Sequence
  derived and/or modified sequence opt2 from MSRB3__Homo_sapiens__NP_001180390
auguccgccuucaaccuccuccaccucgucaccaagucccagcccgucgcccuccgcgccugcggccuccccuccggcuccugccgcgacaagaagaacugcaaggucgucuucucccagcaggagcuccgcaagcgccucaccccccuccaguaccacgucacccaggagaagggcaccgaguccgccuucgagggcgaguacacccaccacaaggaccccggcaucuacaagugcgucgucugcggcaccccccucuucaaguccgagaccaaguucgacuccggcuccggcuggcccuccuuccacgacgucaucaacuccgaggccaucaccuucaccgacgacuucuccuacggcaugcaccgcgucgagaccuccugcucccagugcggcgcccaccucggccacaucuucgacgacggcccccgccccaccggcaagcgcuacugcaucaacuccgccgcccucuccuucacccccgccgacuccuccggcaccgccgagggcggcuccggcgucgccucccccgcccaggccgacaaggccgagcucuga

SEQ ID NO: 46201 - RNA, 2178 nt, Artificial Sequence
  derived and/or modified sequence opt2 from MST1__Homo_sapiens__NP_066278
augggccucuggugggucaccguccagccccccgcccgccgcaugggcuggcucccccuccuccuccuccucacccagugccucggcguccccggccagcgcuccccccucaacgacuuccagguccuccgcggcaccgagcuccagcaccuccuccacgccgucguccccggccccuggcaggaggacgucgccgacgccgaggagugcgccggccgcugcggcccccucauggacugccgcgccuuccacuacaacgucuccucccacggcugccagcuccuccccuggacccagcacuccccccacacccgccuccgccgcuccggccgcugcgaccucuuccagaagaaggacuacguccgcaccugcaucaugaacaacggcgucggcuaccgcggcaccauggccaccaccgucggcggccuccccugccaggccuggucccacaaguuccccaacgaccacaaguacacccccacccuccgcaacggccucgaggagaacuucugccgcaaccccgacggcgaccccggcggccccuggugcuacaccaccgaccccgccguccgcuuccaguccugcggcaucaaguccugccgcgaggccgccugcgucuggugcaacggcgaggaguaccgcggcgccgucgaccgcaccgaguccggccgcgagugccagcgcugggaccuccagcacccccaccagcaccccuucgagcccggcaaguuccucgaccagggccucgacgacaacuacugccgcaaccccgacggcuccgagcgccccuggugcuacaccaccgacccccagaucgagcgcgaguucugcgaccucccccgcugcggcuccgaggcccagccccgccaggaggccaccaccgucuccugcuuccgcggcaagggcgagggcuaccgcggcaccgccaacaccaccaccgccggcguccccugccagcgcugggacgcccagaucccccaccagcaccgcuucacccccgagaaguacgccugcaaggaccuccgcgagaacuucugccgcaaccccgacggcuccgaggcccccuggugcuucacccuccgccccggcaugcgcgccgccuucugcuaccagauccgccgcugcaccgacgacguccgcccccaggacugcuaccacggcgccggcgagcaguaccgcggcaccgucuccaagacccgcaagggcguccagugccagcgcugguccgccgagaccccccacaagccccaguucaccuucaccuccgagccccacgcccagcucgaggagaacuucugccgcaaccccgacggcgacucccacggccccuggugcuacaccauggacccccgcacccccuucgacuacugcgcccuccgccgcugcgccgacgaccagccccccuccauccucgacccccccgaccagguccaguucgagaagugcggcaagcgcgucgaccgccucgaccagcgccgcuccaagcuccgcgucgucggcggccaccccggcaacucccccuggaccgucucccuccgcaaccgccagggccagcacuucugcggcggcucccucgucaaggagcaguggauccucaccgcccgccagugcuucuccuccugccacaugccccucaccggcuacgaggucuggcucggcacccucuuccagaacccccagcacggcgagcccucccuccagcgcguccccgucgccaagauggucugcggccccuccggcucccagcucguccuccucaagcucgagcgcuccgucacccucaaccagcgcgucgcccucaucugccucccccccgagugguacgucgucccccccggcaccaagugcgagaucgccggcuggggcgagaccaagggcaccggcaacgacaccguccucaacgucgcccuccucaacgucaucuccaaccaggagugcaacaucaagcaccgcggccgcguccgcgaguccgagaugugcaccgagggccuccucgcccccgucggcgccugcgagggcgacuacggcggcccccucgccugcuucacccacaacugcuggguccucgagggcaucaucauccccaaccgcgucugcgcccgcucccgcuggcccgccgucuucacccgcgucuccgucuucgucgacuggauccacaaggucaugcgccucggcuga

SEQ ID NO: 46202 - RNA, 4056 nt, Artificial Sequence
  derived and/or modified sequence opt2 from MST1R__Homo_sapiens__NP_001231866
auggagcuccuccccccccucccccaguccuuccuccuccuccuccuccuccccgccaagcccgccgccggcgaggacuggcagugcccccgcacccccuacgccgccucccgcgacuucgacgucaaguacgucguccccuccuucuccgccggcggccucguccaggccauggucaccuacgagggcgaccgcaacgaguccgccgucuucgucgccauccgcaaccgccuccacguccucggccccgaccucaaguccguccagucccucgccaccggccccgccggcgaccccggcugccagaccugcgccgccugcggccccggcccccacggcccccccggcgacaccgacaccaagguccucguccucgaccccgcccuccccgcccucgucuccugcggcuccucccuccagggccgcugcuuccuccacgaccucgagccccagggcaccgccguccaccucgccgcccccgccugccucuucuccgcccaccacaaccgccccgacgacugccccgacugcgucgccuccccccucggcacccgcgucaccgucgucgagcagggccaggccuccuacuucuacgucgccuccucccucgacgccgccgucgccgccuccuucuccccccgcuccgucuccauccgccgccucaaggccgacgccuccggcuucgcccccggcuucgucgcccucuccguccuccccaagcaccucgucuccuacuccaucgaguacguccacuccuuccacaccggcgccuucgucuacuuccucaccguccagcccgccuccgucaccgacgaccccuccgcccuccacacccgccucgcccgccucuccgccaccgagcccgagcucggcgacuaccgcgagcucguccucgacugccgcuucgcccccaagcgccgccgccgcggcgcccccgagggcggccagcccuaccccguccuccgcgucgcccacuccgcccccgucggcgcccagcucgccaccgagcucuccaucgccgagggccaggagguccucuucggcgucuucgucaccggcaaggacggcggccccggcgucggccccaacuccgucgucugcgccuuccccaucgaccuccucgacacccucaucgacgagggcgucgagcgcugcugcgagucccccguccaccccggccuccgccgcggccucgacuucuuccagucccccuccuucugccccaacccccccggccucgaggcccucucccccaacaccuccugccgccacuucccccuccucgucuccuccuccuucucccgcgucgaccucuucaacggccuccucggccccguccaggucaccgcccucuacgucacccgccucgacaacgucaccgucgcccacaugggcaccauggacggccgcauccuccaggucgagcucguccgcucccucaacuaccuccucuacgucuccaacuucucccucggcgacuccggccagcccguccagcgcgacgucucccgccucggcgaccaccuccucuucgccuccggcgaccaggucuuccagguccccauccagggccccggcugccgccacuuccucaccugcggccgcugccuccgcgccuggcacuucaugggcugcggcuggugcggcaacaugugcggccagcagaaggagugccccggcuccuggcagcaggaccacugcccccccaagcucaccgaguuccacccccacuccggcccccuccgcggcuccacccgccucacccucugcggcuccaacuucuaccuccaccccuccggccucguccccgagggcacccaccaggucaccgucggccagucccccugccgcccccuccccaaggacuccuccaagcuccgccccgucccccgcaaggacuucgucgaggaguucgagugcgagcucgagccccucggcacccaggccgucggccccaccaacgucucccucaccgucaccaacaugccccccggcaagcacuuccgcgucgacggcaccuccguccuccgcggcuucuccuucauggagcccguccucaucgccguccagccccucuucggcccccgcgccggcggcaccugccucacccucgagggccagucccucuccgucggcaccucccgcgccguccucgucaacggcaccgagugccuccucgcccgcgucuccgagggccagcuccucugcgccaccccccccggcgccaccgucgccuccgucccccucucccuccaggucggcggcgcccagguccccggcuccuggaccuuccaguaccgcgaggaccccgucguccucuccaucucccccaacugcggcuacaucaacucccacaucaccaucugcggccagcaccucaccuccgccuggcaccucguccucuccuuccacgacggccuccgcgccgucgagucccgcugcgagcgccagcuccccgagcagcagcucugccgccuccccgaguacgucguccgcgacccccagggcugggucgccggcaaccucuccgcccgcggcgacggcgccgccggcuucacccuccccggcuuccgcuuccucccccccccccacccccccuccgccaaccucgucccccucaagcccgaggagcacgccaucaaguucgaggucugcgucgacggcgagugccacauccucggccgcgucguccgccccggccccgacggcgucccccaguccacccuccucggcauccuccucccccuccuccuccucgucgccgcccucgccaccgcccucgucuucuccuacugguggcgccgcaagcagcucguccucccccccaaccucaacgaccucgccucccucgaccagaccgccggcgccaccccccuccccauccucuacuccggcuccgacuaccgcuccggccucgcccuccccgccaucgacggccucgacuccaccaccugcguccacggcgccuccuucuccgacuccgaggacgaguccugcgucccccuccuccgcaaggaguccauccagcuccgcgaccucgacuccgcccuccucgccgaggucaaggacguccucaucccccacgagcgcgucgucacccacuccgaccgcgucaucggcaagggccacuucggcgucgucuaccacggcgaguacaucgaccaggcccagaaccgcauccagugcgccaucaagucccucucccgcaucaccgagaugcagcaggucgaggccuuccuccgcgagggccuccucaugcgcggccucaaccaccccaacguccucgcccucaucggcaucaugcucccccccgagggccucccccacguccuccuccccuacaugugccacggcgaccuccuccaguucauccgcuccccccagcgcaaccccaccgucaaggaccucaucuccuucggccuccaggucgcccgcggcauggaguaccucgccgagcagaaguucguccaccgcgaccucgccgcccgcaacugcaugcucgacgaguccuucaccgucaaggucgccgacuucggccucgcccgcgacauccucgaccgcgaguacuacuccguccagcagcaccgccacgcccgccuccccgucaaguggauggcccucgagucccuccagaccuaccgcuucaccaccaaguccgacgucugguccuucggcguccuccucugggagcuccucacccgcggcgccccccccuaccgccacaucgaccccuucgaccucacccacuuccucgcccagggccgccgccucccccagcccgaguacugccccgacucccucuaccaggucaugcagcagugcugggaggccgaccccgccguccgccccaccuuccgcguccucgucggcgaggucgagcagaucgucuccgcccuccucggcgaccacuacguccagcuccccgccaccuacaugaaccucggccccuccaccucccacgagaugaacguccgccccgagcagccccaguucucccccaugcccggcaacguccgccgcccccgcccccucuccgagcccccccgccccaccuga

SEQ ID NO: 46203 - RNA, 1128 nt, Artificial Sequence
  derived and/or modified sequence opt2 from MSTN__Homo_sapiens__NP_005250
augcagaagcuccagcucugcgucuacaucuaccucuucaugcucaucgucgccggccccgucgaccucaacgagaacuccgagcagaaggagaacgucgagaaggagggccucugcaacgccugcaccuggcgccagaacaccaaguccucccgcaucgaggccaucaagauccagauccucuccaagcuccgccucgagaccgcccccaacaucuccaaggacgucauccgccagcuccuccccaaggcccccccccuccgcgagcucaucgaccaguacgacguccagcgcgacgacuccuccgacggcucccucgaggacgacgacuaccacgccaccaccgagaccaucaucaccaugcccaccgaguccgacuuccucaugcaggucgacggcaagcccaagugcugcuucuucaaguucuccuccaagauccaguacaacaaggucgucaaggcccagcucuggaucuaccuccgccccgucgagacccccaccaccgucuucguccagauccuccgccucaucaagcccaugaaggacggcacccgcuacaccggcauccgcucccucaagcucgacaugaaccccggcaccggcaucuggcaguccaucgacgucaagaccguccuccagaacuggcucaagcagcccgaguccaaccucggcaucgagaucaaggcccucgacgagaacggccacgaccucgccgucaccuuccccggccccggcgaggacggccucaaccccuuccucgaggucaaggucaccgacacccccaagcgcucccgccgcgacuucggccucgacugcgacgagcacuccaccgagucccgcugcugccgcuacccccucaccgucgacuucgaggccuucggcugggacuggaucaucgcccccaagcgcuacaaggccaacuacugcuccggcgagugcgaguucgucuuccuccagaaguacccccacacccaccucguccaccaggccaacccccgcggcuccgccggccccugcugcacccccaccaagaugucccccaucaacaugcucuacuucaacggcaaggagcagaucaucuacggcaagauccccgccauggucgucgaccgcugcggcugcuccuga

SEQ ID NO: 46204 - RNA, 1677 nt, Artificial Sequence
  derived and/or modified sequence opt2 from MSTO1__Homo_sapiens__NP_001243462
auggccggcggcgcccgcgagguccucacccuccagcucggccacuucgccggcuucgucggcgcccacugguggaaccagcaggacgccgcccucggccgcgccaccgacuccaaggagccccccggcgagcucugccccgacguccucuaccgcaccggccgcacccuccacggccaggagaccuacaccccccgccucauccucauggaccucaagggcucccucuccucccucaaggaggagggcggccucuaccgcgacaagcagcucgacgccgccaucgccuggcagggcaagcucaccacccacaaggaggagcucuaccccaagaaccccuaccuccaggacuuccucuccgccgagggcguccucuccuccgacggcgucuggcgcgucaaguccauccccaacggcaagggcuccuccccccuccccaccgccaccacccccaagccccucauccccaccgaggccuccauccgcgucugguccgacuuccuccgcguccaccuccacccccgcuccaucugcaugauccagaaguacaaccacgacggcgaggccggccgccucgaggccuucggccagggcgaguccguccucaaggagcccaaguaccaggaggagcucgaggaccgccuccacuucuacgucgaggagugcgacuaccuccagggcuuccagauccucugcgaccuccacgacggcuucuccggcgucggcgccaaggccgccgagcuccuccaggacgaguacuccggccgcggcaucaucaccuggggccuccuccccggccccuaccaccgcggcgaggcccagcgcaacaucuaccgccuccucaacaccgccuucggccucguccaccucaccgcccacuccucccucgucugcccccucucccucggcggcucccucggccuccgccccgagccccccgucuccuuccccuaccuccacuacgacgccacccuccccuuccacugcuccgccauccucgccaccgcccucgacaccgucaccguccccuaccgccucugcuccucccccgucuccaugguccaccucgccgacaugcucuccuucugcggcaagaaggucgucaccgccggcgccaucauccccuucccccucgcccccggccagucccuccccgacucccucaugcaguucggcggcgccacccccuggaccccccucuccgccugcggcgagcccuccggcacccgcugcuucgcccaguccgucguccuccgcggcaucgaccgcgccugccacaccucccagcucacccccggcacccccccccccuccgcccuccacgccugcaccaccggcgaggagauccucgcccaguaccuccagcagcagcagcccggcgucauguccuccucccaccuccuccucacccccugccgcgucgccccccccuacccccaccucuucuccuccugcuccccccccgucgaguccauccccgucuucggcgcccucugcuccuccuccucccuccaccagacccucgaggcccucgcccgcgaccucaccaagcucgaccuccgccgcugggccuccuucauggacgccggcgucgagcacgacgacgucgccgagcuccuccaggagcuccagucccucgcccagugcuaccagggcggcgacucccucgucgacuga

SEQ ID NO: 46205 - RNA, 912 nt, Artificial Sequence
  derived and/or modified sequence opt2 from MSX1__Homo_sapiens__NP_002439
auggcccccgccgccgacaugaccucccucccccucggcgucaaggucgaggacuccgccuucggcaagcccgccggcggcggcgccggccaggcccccuccgccgccgccgccaccgccgccgccaugggcgccgacgaggagggcgccaagcccaaggucucccccucccuccuccccuucuccgucgaggcccucauggccgaccaccgcaagcccggcgccaaggaguccgcccucgcccccuccgagggcguccaggccgccggcggcuccgcccagccccucggcgucccccccggcucccucggcgcccccgacgcccccuccuccccccgcccccucggccacuucuccgucggcggccuccucaagcuccccgaggacgcccucgucaaggccgagucccccgagaagcccgagcgcacccccuggaugcaguccccccgcuucucccccccccccgcccgccgccucuccccccccgccugcacccuccgcaagcacaagaccaaccgcaagccccgcacccccuucaccaccgcccagcuccucgcccucgagcgcaaguuccgccagaagcaguaccucuccaucgccgagcgcgccgaguucuccuccucccucucccucaccgagacccaggucaagaucugguuccagaaccgccgcgccaaggccaagcgccuccaggaggccgagcucgagaagcucaagauggccgccaagcccaugcucccccccgccgccuucggccucuccuucccccucggcggccccgccgccgucgccgccgccgccggcgccucccucuacggcgccuccggccccuuccagcgcgccgcccuccccgucgcccccgucggccucuacaccgcccacgucggcuacuccauguaccaccucaccuga

SEQ ID NO: 46206 - RNA, 804 nt, Artificial Sequence
  derived and/or modified sequence opt2 from MSX2__Homo_sapiens__NP_002440
auggccucccccuccaagggcaacgaccucuucucccccgacgaggagggccccgccgucgucgccggccccggccccggccccggcggcgccgagggcgccgccgaggagcgccgcgucaaggucuccucccuccccuucuccgucgaggcccucauguccgacaagaagccccccaaggaggccuccccccuccccgccgaguccgccuccgccggcgccacccuccgcccccuccuccucuccggccacggcgcccgcgaggcccacucccccggcccccucgucaagcccuucgagaccgccuccgucaaguccgagaacuccgaggacggcgccgccuggaugcaggagcccggccgcuacuccccccccccccgccacaugucccccaccaccugcacccuccgcaagcacaagaccaaccgcaagccccgcacccccuucaccaccucccagcuccucgcccucgagcgcaaguuccgccagaagcaguaccucuccaucgccgagcgcgccgaguucuccuccucccucaaccucaccgagacccaggucaagaucugguuccagaaccgccgcgccaaggccaagcgccuccaggaggccgagcucgagaagcucaagauggccgccaagcccaugcuccccuccuccuucucccuccccuuccccaucuccuccccccuccaggccgccuccaucuacggcgccuccuaccccuuccaccgccccguccuccccaucccccccgucggccucuacgccacccccgucggcuacggcauguaccaccucuccuga

SEQ ID NO: 46207 - RNA, 186 nt, Artificial Sequence
  derived and/or modified sequence opt2 from MT1A__Homo_sapiens__NP_005937
auggaccccaacugcuccugcgccaccggcggcuccugcaccugcaccggcuccugcaagugcaaggagugcaagugcaccuccugcaagaaguccugcugcuccugcugccccauguccugcgccaagugcgcccagggcugcaucugcaagggcgccuccgagaagugcuccugcugcgccuga

SEQ ID NO: 46208 - RNA, 186 nt, Artificial Sequence
  derived and/or modified sequence opt2 from MT1B__Homo_sapiens__NP_005938
auggaccccaacugcuccugcaccaccggcggcuccugcgccugcgccggcuccugcaagugcaaggagugcaagugcaccuccugcaagaagugcugcugcuccugcugccccgucggcugcgccaagugcgcccagggcugcgucugcaagggcuccuccgagaagugccgcugcugcgccuga

SEQ ID NO: 46209 - RNA, 186 nt, Artificial Sequence
  derived and/or modified sequence opt2 from MT1E__Homo_sapiens__NP_783316
auggaccccaacugcuccugcgccaccggcggcuccugcaccugcgccggcuccugcaagugcaaggagugcaagugcaccuccugcaagaaguccugcugcuccugcugccccgucggcugcgccaagugcgcccagggcugcgucugcaagggcgccuccgagaagugcuccugcugcgccuga

SEQ ID NO: 46210 - RNA, 186 nt, Artificial Sequence
  derived and/or modified sequence opt2 from MT1F__Homo_sapiens__NP_005940
auggaccccaacugcuccugcgccgccggcgucuccugcaccugcgccggcuccugcaagugcaaggagugcaagugcaccuccugcaagaaguccugcugcuccugcugccccgucggcugcuccaagugcgcccagggcugcgucugcaagggcgccuccgagaagugcuccugcugcgacuga

SEQ ID NO: 46211 - RNA, 189 nt, Artificial Sequence
  derived and/or modified sequence opt2 from MT1G__Homo_sapiens__NP_001288196
auggaccccaacugcuccugcgccgccgccggcgucuccugcaccugcgccuccuccugcaagugcaaggagugcaagugcaccuccugcaagaaguccugcugcuccugcugccccgucggcugcgccaagugcgcccagggcugcaucugcaagggcgccuccgagaagugcuccugcugcgccuga

SEQ ID NO: 46212 - RNA, 186 nt, Artificial Sequence
  derived and/or modified sequence opt2 from MT1H__Homo_sapiens__NP_005942
auggaccccaacugcuccugcgaggccggcggcuccugcgccugcgccggcuccugcaagugcaagaagugcaagugcaccuccugcaagaaguccugcugcuccugcugcccccucggcugcgccaagugcgcccagggcugcaucugcaagggcgccuccgagaagugcuccugcugcgccuga

SEQ ID NO: 46213 - RNA, 186 nt, Artificial Sequence
  derived and/or modified sequence opt2 from MT1M__Homo_sapiens__NP_789846
auggaccccaacugcuccugcaccaccggcgucuccugcgccugcaccggcuccugcaagugcaaggagugcaagugcaccuccugcaagaaguccugcugcuccugcugccccgucggcugcgccaagugcgcccacggcugcgucugcaagggcacccucgagaacugcuccugcugcgccuga

SEQ ID NO: 46214 - RNA, 186 nt, Artificial Sequence
  derived and/or modified sequence opt2 from MT1X__Homo_sapiens__NP_005943
auggaccccaacugcuccugcucccccgucggcuccugcgccugcgccggcuccugcaagugcaaggagugcaagugcaccuccugcaagaaguccugcugcuccugcugccccgucggcugcgccaagugcgcccagggcugcaucugcaagggcaccuccgacaagugcuccugcugcgccuga

SEQ ID NO: 46215 - RNA, 186 nt, Artificial Sequence
  derived and/or modified sequence opt2 from MT2A__Homo_sapiens__NP_005944
auggaccccaacugcuccugcgccgccggcgacuccugcaccugcgccggcuccugcaagugcaaggagugcaagugcaccuccugcaagaaguccugcugcuccugcugccccgucggcugcgccaagugcgcccagggcugcaucugcaagggcgccuccgacaagugcuccugcugcgccuga

SEQ ID NO: 46216 - RNA, 207 nt, Artificial Sequence
  derived and/or modified sequence opt2 from MT3__Homo_sapiens__NP_005945
auggaccccgagaccugccccugccccuccggcggcuccugcaccugcgccgacuccugcaagugcgagggcugcaagugcaccuccugcaagaaguccugcugcuccugcugccccgccgagugcgagaagugcgccaaggacugcgucugcaagggcggcgaggccgccgaggccgaggccgagaagugcuccugcugccaguga

SEQ ID NO: 46217 - RNA, 189 nt, Artificial Sequence
  derived and/or modified sequence opt2 from MT4__Homo_sapiens__NP_116324
auggacccccgcgagugcgucugcauguccggcggcaucugcaugugcggcgacaacugcaagugcaccaccugcaacugcaagaccugccgcaaguccugcugccccugcugcccccccggcugcgccaagugcgcccgcggcugcaucugcaagggcggcuccgacaagugcuccugcugccccuga

SEQ ID NO: 46218 - RNA, 1293 nt, Artificial Sequence
  derived and/or modified sequence opt2 from MTA1__Homo_sapiens__NP_001190187
auggccgccaacauguaccgcgucggcgacuacgucuacuucgagaacuccuccuccaaccccuaccucauccgccgcaucgaggagcucaacaagaccgccaacggcaacgucgaggccaaggucgucugcuucuaccgccgccgcgacaucuccuccacccucaucgcccucgccgacaagcacgccacccucuccgucugcuacaaggccggccccggcgccgacaacggcgaggagggcgagaucgaggaggagauggagaaccccgagauggucgaccuccccgagaagcucaagcaccagcuccgccaccgcgagcucuuccucucccgccagcucgagucccuccccgccacccacauccgcggcaagugcuccgucacccuccucaacgagaccgagucccucaaguccuaccucgagcgcgaggacuucuucuucuacucccucgucuacgacccccagcagaagacccuccucgccgacaagggcgagauccgcgucggcaaccgcuaccaggccgacaucaccgaccuccucaaggagggcgaggaggacggccgcgaccagucccgccucgagacccaggucugggaggcccacaacccccucaccgacaagcagaucgaccaguuccucgucgucgcccgcuccgucggcaccuucgcccgcgcccucgacugcuccuccuccguccgccagcccucccuccacauguccgccgccgccgccucccgcgacaucacccucuuccacgccauggacacccuccacaagaacaucuacgacaucuccaaggccaucuccgcccucgucccccagggcggccccguccucugccgcgacgagauggaggagugguccgccuccgaggccaaccucuucgaggaggcccucgagaaguacggcaaggacuucaccgacauccagcaggacuuccuccccuggaagucccucaccuccaucaucgaguacuacuacauguggaagaccaccgaccgcuacguccagcagaagcgccucaaggccgccgaggccgaguccaagcucaagcaggucuacauccccaacuacaacaagcccaaccccaaccagaucuccgucaacaacgucaaggccggcgucgucaacggcaccggcgcccccggccagucccccggcgccggccgcgccugcgaguccugcuacauguccucccuccgcauccuccucgacauccucgaggagaucugguggcucgagaacgccaaccccguccgcuggcgcgaggcccgcaccaagccccaguga

SEQ ID NO: 46219 - RNA, 2007 nt, Artificial Sequence
  derived and/or modified sequence opt2 from MTA2__Homo_sapiens__NP_004730
auggccgccaacauguaccgcgucggcgacuacgucuacuucgagaacuccuccuccaaccccuaccucguccgccgcaucgaggagcucaacaagaccgccaacggcaacgucgaggccaaggucgucugccucuuccgccgccgcgacaucuccuccucccucaacucccucgccgacuccaacgcccgcgaguucgaggaggaguccaagcagcccggcgucuccgagcagcagcgccaccagcucaagcaccgcgagcucuuccucucccgccaguucgagucccuccccgccacccacauccgcggcaagugcuccgucacccuccucaacgagaccgacauccucucccaguaccucgagaaggaggacugcuucuucuacucccucgucuucgaccccguccagaagacccuccucgccgaccagggcgagauccgcgucggcugcaaguaccaggccgagauccccgaccgccucgucgagggcgaguccgacaaccgcaaccagcagaagauggagaugaaggucugggaccccgacaacccccucaccgaccgccagaucgaccaguuccucgucgucgcccgcgccgucggcaccuucgcccgcgcccucgacugcuccuccuccauccgccagcccucccuccacauguccgccgccgccgccucccgcgacaucacccucuuccacgccauggacacccuccagcgcaacggcuacgaccucgccaaggccauguccacccucgucccccagggcggccccguccucugccgcgacgagauggaggagugguccgccuccgaggccaugcucuucgaggaggcccucgagaaguacggcaaggacuucaacgacauccgccaggacuuccuccccuggaagucccucgccuccaucguccaguucuacuacauguggaagaccaccgaccgcuacauccagcagaagcgccucaaggccgccgaggccgacuccaagcucaagcaggucuacauccccaccuacaccaagcccaaccccaaccagaucaucuccgucggcuccaagcccggcaugaacggcgccggcuuccagaagggccucaccugcgaguccugccacaccacccaguccgcccagugguacgccuggggcccccccaacaugcagugccgccucugcgccuccugcuggaucuacuggaagaaguacggcggccucaagacccccacccagcucgagggcgccacccgcggcaccaccgagccccacucccgcggccaccucucccgccccgaggcccagucccucucccccuacaccaccuccgccaaccgcgccaagcuccucgccaagaaccgccagaccuuccuccuccagaccaccaagcucacccgccucgcccgccgcaugugccgcgaccuccuccagccccgccgcgccgcccgccgccccuacgcccccaucaacgccaacgccaucaaggccgagugcuccauccgccuccccaaggccgccaagaccccccucaagauccacccccucguccgccucccccucgccaccaucgucaaggaccucgucgcccaggccccccucaagcccaagaccccccgcggcaccaagacccccaucaaccgcaaccagcucucccagaaccgcggccucggcggcaucauggucaagcgcgccuacgagaccauggccggcgccggcguccccuucuccgccaacggccgcccccucgccuccggcauccgcuccuccucccagcccgccgccaagcgccagaagcucaaccccgccgacgcccccaaccccgucgucuucgucgccaccaaggacacccgcgcccuccgcaaggcccucacccaccucgagaugcgccgcgccgcccgccgccccaaccucccccucaaggucaagcccacccucaucgccguccgcccccccgucccccuccccgcccccucccaccccgccuccaccaacgagcccaucguccucgaggacuga

SEQ ID NO: 46220 - RNA, 1548 nt, Artificial Sequence
  derived and/or modified sequence opt2 from MTA3__Homo_sapiens__NP_065795
auggccgccaacauguaccgcgucggcgacuacgucuacuucgagaacuccuccuccaaccccuaccucauccgccgcaucgaggagcucaacaagaccgccuccggcaacgucgaggccaaggucgucugcuucuaccgccgccgcgacaucuccaacacccucaucaugcucgccgacaagcacgccaaggagaucgaggaggaguccgagaccaccgucgaggccgaccucaccgacaagcagaagcaccagcucaagcaccgcgagcucuuccucucccgccaguacgagucccuccccgccacccacauccgcggcaagugcuccgucgcccuccucaacgagaccgaguccguccucuccuaccucgacaaggaggacaccuucuucuacucccucgucuacgaccccucccucaagacccuccucgccgacaagggcgagauccgcgucggcccccgcuaccaggccgacauccccgagaugcuccucgagggcgaguccgacgagcgcgagcaguccaagcucgaggucaaggucugggaccccaacuccccccucaccgaccgccagaucgaccaguuccucgucgucgcccgcgccgucggcaccuucgcccgcgcccucgacugcuccuccuccguccgccagcccucccuccacauguccgccgccgccgccucccgcgacaucacccucuuccacgccauggacacccucuaccgccacuccuacgaccucuccuccgccaucuccguccucgucccccucggcggccccguccucugccgcgacgagauggaggagugguccgccuccgaggccucccucuucgaggaggcccucgagaaguacggcaaggacuucaacgacauccgccaggacuuccuccccuggaagucccucaccuccaucaucgaguacuacuacauguggaagaccaccgaccgcuacguccagcagaagcgccucaaggccgccgaggccgaguccaagcucaagcaggucuacauccccaccuacuccaagcccaaccccaaccagaucuccaccuccaacggcaagcccggcgccgucaacggcgccgucggcaccaccuuccagccccagaacccccuccucggccgcgccugcgaguccugcuacgccacccagucccaccagugguacuccuggggcccccccaacaugcagugccgccucugcgccaucugcuggcucuacuggaagaaguacggcggccucaagaugcccacccaguccgaggaggagaagcucucccccucccccaccaccgaggacccccgcguccgcucccacgucucccgccaggccaugcagggcaugcccguccgcaacaccggcucccccaaguccgccgucaagacccgccaggccuucuuccuccacaccaccuacuucaccaaguucgcccgccaggucugcaagaacacccuccgccuccgccaggccgcccgccgccccuucgucgccaucaacuacgccgccauccgcgccgagugcaagaugcuccucaacuccuga

SEQ ID NO: 46221 - RNA, 852 nt, Artificial Sequence
  derived and/or modified sequence opt2 from MTAP__Homo_sapiens__NP_002442
auggccuccggcaccaccaccaccgccgucaagaucggcaucaucggcggcaccggccucgacgaccccgagauccucgagggccgcaccgagaaguacgucgacacccccuucggcaagcccuccgacgcccucauccucggcaagaucaagaacgucgacugcguccuccucgcccgccacggccgccagcacaccaucaugcccuccaaggucaacuaccaggccaacaucugggcccucaaggaggagggcugcacccacgucaucgucaccaccgccugcggcucccuccgcgaggagauccagcccggcgacaucgucaucaucgaccaguucaucgaccgcaccaccaugcgcccccaguccuucuacgacggcucccacuccugcgcccgcggcgucugccacauccccauggccgagcccuucugccccaagacccgcgagguccucaucgagaccgccaagaagcucggccuccgcugccacuccaagggcaccauggucaccaucgagggcccccgcuucuccucccgcgccgaguccuucauguuccgcaccuggggcgccgacgucaucaacaugaccaccguccccgaggucguccucgccaaggaggccggcaucugcuacgccuccaucgccauggccaccgacuacgacugcuggaaggagcacgaggaggccgucuccgucgaccgcguccucaagacccucaaggagaacgccaacaaggccaagucccuccuccucaccaccaucccccagaucggcuccaccgagugguccgagacccuccacaaccucaagaacauggcccaguucuccguccuccucccccgccacuga

SEQ ID NO: 46222 - RNA, 2715 nt, Artificial Sequence
  derived and/or modified sequence opt2 from MTBP__Homo_sapiens__NP_071328
auggaccgcuaccuccuccucgucaucuggggcgagggcaaguuccccuccgccgccucccgcgaggccgagcacggccccgaggucuccuccggcgagggcaccgagaaccagcccgacuucaccgccgccaacgucuaccaccuccucaagcgcuccaucuccgccuccaucaaccccgaggacuccaccuuccccgccugcuccgucggcggcauccccggcuccaagaagugguucuucgccguccaggccaucuacggcuucuaccaguucugcuccuccgacuggcaggagauccacuucgacaccgagaaggacaagaucgaggacguccuccagaccaacaucgaggagugccucggcgccgucgagugcuucgaggaggaggacuccaacucccgcgagucccucucccucgccgaccucuacgaggaggccgccgagaaccuccaccagcucuccgacaagcuccccgcccccggccgcgccauggucgacaucauccuccuccucuccgacaaggacccccccaagcucaaggacuaccuccccaccgucggcgcccucaagcaccuccgcgagugguacuccgccaagaucaccaucgccggcaaccacugcgagaucaacugccagaagaucgccgaguaccucuccgccaacgucgucucccucgaggaccuccgcaacgucaucgacuccaaggagcucuggcgcggcaagauccagaucugggagcgcaaguucggcuucgagaucuccuuccccgaguucugccucaagggcgucacccucaagaacuucuccaccuccaaccucaacaccgacuuccucgccaagaagaucauccccuccaaggacaagaacauccuccccaaggucuuccacuacuacggccccgcccucgaguucguccagaugaucaagcucuccgaccuccccuccugcuacauguccgacaucgaguucgagcucggccucaccaacuccaccaagcagaacuccguccuccuccucgagcagaucuccucccucugcuccaaggucggcgcccucuucguccuccccugcaccaucuccaacauccucauccccccccccaaccagcucuccucccgcaaguggaaggaguacaucgccaagaagcccaagaccaucuccguccccgacgucgaggucaagggcgagugcuccuccuacuaccuccuccuccagggcaacggcaaccgccgcugcaaggccacccucauccacuccgccaaccagaucaacggcuccuucgcccucaaccucauccacggcaagaugaagaccaagaccgaggaggccaagcucuccuuccccuucgaccuccucucccucccccacuucuccggcgagcagaucguccagcgcgagaagcagcucgccaacguccagguccucgcccucgaggagugccucaagcgccgcaagcucgccaagcagcccgagaccgucuccgucgccgagcucaagucccuccucguccucacccgcaagcacuuccucgacuacuucgacgccgucauccccaagaugauccuccgcaagauggacaagaucaagaccuucaacauccucaacgacuucucccccgucgagcccaacuccuccucccucauggagaccaacccccucgaguggcccgagcgccacguccuccagaaccucgagaccuucgagaagaccaagcagaagaugcgcaccggcucccucccccacuccuccgagcagcuccucggccacaaggagggcccccgcgacuccaucacccuccucgacgccaaggagcuccucaaguacuucaccuccgacggccuccccaucggcgaccuccagccccuccccauccagaagggcgagaagaccuucguccucacccccgagcucucccccggcaagcuccagguccuccccuucgagaaggccuccgucugccacuaccacggcaucgaguacugccucgacgaccgcaaggcccucgagcgcgacggcggcuucuccgagcuccagucccgccucauccgcuacgagacccagaccaccugcacccgcgaguccuuccccguccccaccguccucuccccccuccccucccccgucgucuccuccgaccccggcuccguccccgacggcgagguccuccagaacgagcuccgcaccgaggucucccgccucaagcgccgcuccaaggaccucaacugccucuacccccgcaagcgccucgucaaguccgaguccuccgagucccuccucucccagaccaccggcaacuccaaccacuaccaccaccacgucaccucccgcaagccccagaccgagcgcucccuccccgucaccugcccccucguccccauccccuccugcgagacccccaagcucgccaccaagaccuccuccggccagaaguccaugcacgaguccaagaccucccgccagaucaaggagucccgcucccagaagcacacccgcauccucaaggaggucgucaccgagacccucaagaagcacuccaucaccgagacccacgagugcuucaccgccugcucccagcgccucuucgagaucuccaaguucuaccucaaggaccucaagaccucccgcggccucuucgaggagaugaagaagaccgccaacaacaacgccguccaggucaucgacuggguccucgagaagaccuccaagaaguga

SEQ ID NO: 46223 - RNA, 1170 nt, Artificial Sequence
  derived and/or modified sequence opt2 from MTCH1__Homo_sapiens__NP_001258570
augggcgccuccgaccccgaggucgcccccugggcccgcggcggcgccgccggcauggccggcgccggcgccggcgccggcgcccgcggcggcgccgccgccggcgucgaggcccgcgcccgcgaccccccccccgcccaccgcgcccacccccgccacccccgccccgccgcccagcccuccgcccgccgcauggacggcggcuccggcggccucggcuccggcgacaacgcccccaccaccgaggcccucuucgucgcccucggcgccggcgucaccgcccucucccacccccuccucuacgucaagcuccucauccaggucggccacgagcccaugccccccacccucggcaccaacguccucggccgcaagguccucuaccuccccuccuucuucaccuacgccaaguacaucguccaggucgacggcaagaucggccucuuccgcggccucuccccccgccucauguccaacgcccucuccaccgucacccgcggcuccaugaagaaggucuucccccccgacgagaucgagcaggucuccaacaaggacgacaugaagaccucccucaagaaggucgucaaggagaccuccuacgagaugaugaugcagugcgucucccgcaugcucgcccacccccuccacgucaucuccaugcgcugcaugguccaguucgucggccgcgaggccaaguacuccggcguccucuccuccaucggcaagaucuucaaggaggagggccuccucggcuucuucgucggccucaucccccaccuccucggcgacgucgucuuccucuggggcugcaaccuccucgcccacuucaucaacgccuaccucgucgacgacuccgucuccgacacccccggcggccucggcaacgaccagaaccccggcucccaguucucccaggcccucgccauccgcuccuacaccaaguucgucaugggcaucgccgucuccaugcucaccuaccccuuccuccucgucggcgaccucauggccgucaacaacugcggccuccaggccggccucccccccuacucccccgucuucaaguccuggauccacugcuggaaguaccucuccguccagggccagcucuuccgcggcuccucccuccucuuccgccgcgucuccuccggcuccugcuucgcccucgaguga

SEQ ID NO: 46224 - RNA, 912 nt, Artificial Sequence
  derived and/or modified sequence opt2 from MTCH2__Homo_sapiens__NP_055157
auggccgacgccgccucccagguccuccucggcuccggccucaccauccucucccagccccucauguacgucaagguccucauccaggucggcuacgagccccucccccccaccaucggccgcaacaucuucggccgccaggucugccagcuccccggccucuucuccuacgcccagcacaucgccuccaucgacggccgccgcggccucuucaccggccucaccccccgccucugcuccggcguccucggcaccgucguccacggcaagguccuccagcacuaccaggaguccgacaagggcgaggagcucggccccggcaacguccagaaggaggucuccuccuccuucgaccacgucaucaaggagaccacccgcgagaugaucgcccgcuccgccgccacccucaucacccaccccuuccacgucaucacccuccgcuccaugguccaguucaucggccgcgaguccaaguacugcggccucugcgacuccaucaucaccaucuaccgcgaggagggcauccucggcuucuucgccggccucgucccccgccuccucggcgacauccucucccucuggcucugcaacucccucgccuaccucgucaacaccuacgcccucgacuccggcgucuccaccaugaacgagaugaaguccuacucccaggccgucaccggcuucuucgccuccaugcucaccuaccccuucguccucgucuccaaccucauggccgucaacaacugcggccucgccggcggcugcccccccuacucccccaucuacaccuccuggaucgacugcuggugcaugcuccagaaggagggcaacaugucccgcggcaacucccucuucuuccgcaagguccccuucggcaagaccuacugcugcgaccucaagaugcucaucuga

SEQ ID NO: 46225 - RNA, 4761 nt, Artificial Sequence
  derived and/or modified sequence opt2 from MTCL1__Homo_sapiens__NP_056025
auggaggagaugcgcgacuccuaccucgaggaggacgucuaccagcuccaggagcuccgccgcgagcucgaccgcgccaacaagaacugccgcauccuccaguaccgccuccgcaaggccgagcagaagucccucaaggucgccgagaccggccaggucgacggcgagcucauccgcucccucgagcaggaccucaaggucgccaaggacgucuccguccgccuccaccacgagcucaagaccgucgaggagaagcgcgccaaggccgaggacgagaacgagacccuccgccagcagaugaucgaggucgagaucuccaagcaggcccuccagaacgagcucgagcgccucaaggaguccucccucaagcgccgcuccacccgcgagauguacaaggagaagaagaccuucaaccaggacgacuccgccgaccuccgcugccagcuccaguucgccaaggaggaggccuuccucaugcgcaagaagauggccaagcucggccgcgagaaggacgagcucgagcaggagcuccagaaguacaagucccucuacggcgacgucgacuccccccuccccaccggcgaggccggcggcccccccuccacccgcgaggccgagcucaagcuccgccucaagcucgucgaggaggaggccaacauccucggccgcaagaucgucgagcucgaggucgagaaccgcggccucaaggccgagauggaggacaugcgcggccagcaggagcgcgagggccccggccgcgaccacgcccccuccauccccaccucccccuucggcgacucccucgaguccuccaccgagcuccgccgccaccuccaguucgucgaggaggaggccgagcuccuccgccgcuccaucuccgagaucgaggaccacaaccgccagcucacccacgagcucuccaaguucaaguucgagcccccccgcgagcccggcuggcucggcgagggcgccucccccggcgccggcggcggcgccccccuccaggaggagcucaaguccgcccgccuccagaucuccgagcucuccggcaagguccucaagcuccagcacgagaaccacgcccuccucuccaacauccagcgcugcgaccucgccgcccaccucggccuccgcgcccccuccccccgcgacuccgacgccgaguccgacgccggcaagaaggaguccgacggcgaggagucccgccucccccagcccaagcgcgagggccccgucggcggcgaguccgacuccgaggagauguucgagaagaccuccggcuucggcuccggcaagcccuccgaggccuccgagcccugccccaccgagcuccucaaggcccgcgaggacuccgaguaccucgucacccucaagcacgaggcccagcgccucgagcgcaccgucgagcgccucaucaccgacaccgacuccuuccuccacgacgccggccuccgcggcggcgccccccuccccggccccggccuccagggcgaggaggagcagggcgagggcgaccagcaggagccccagcuccucggcaccaucaacgccaagaugaaggccuucaagaaggagcuccaggccuuccucgagcaggucaaccgcaucggcgacggccucuccccccucccccaccucaccgaguccuccuccuuccucuccaccgucaccuccgucucccgcgacucccccaucggcaaccucggcaaggagcucggccccgaccuccagucccgccucaaggagcagcucgaguggcagcucggccccgcccgcggcgacgagcgcgagucccuccgccuccgcgccgcccgcgagcuccaccgccgcgccgacggcgacaccggcucccacggccucggcggccagaccugcuucucccucgagcuccgcggcccccccguccuccccgagcaguccgucuccaucgaggagcuccagggccagcucguccaggccgcccgccuccaccaggaggagaccgagaccuucaccaacaagauccacaagauggaggaggagcaccucuacgcccuccgcuggaaggagcucgagaugcacucccucgcccuccagaacacccuccacgagcgcaccugguccgacgagaagaaccucaugcagcaggagcuccgcucccucaagcagaacaucuuccucuucuacgucaagcuccgcuggcuccucaagcacuggcgccagggcaagcagauggaggaggagggcgaggaguucaccgagggcgagcaccccgagacccucucccgccucggcgagcucggcguccagggcggccaccaggccgacggccccgaccacgacuccgaccgcggcugcggcuuccccgucggcgagcacuccccccacucccgcguccagaucggcgaccacucccuccgccuccagaccgccgaccgcggccagccccacaagcaggucgucgagaaccagcagcucuucuccgccuucaaggcccuccucgaggacuuccgcgccgagcuccgcgaggacgagcgcgcccgccuccgccuccagcagcaguacgccuccgacaaggccgccugggacgucgagugggccguccucaagugccgccucgagcagcucgaggagaagaccgagaacaagcucggcgagcucggcuccuccgccgaguccaagggcgcccucaagaaggagcgcgagguccaccagaagcuccucgccgacucccacucccucgucauggaccuccgcuggcagauccaccacuccgagaagaacuggaaccgcgagaaggucgagcuccucgaccgccucgaccgcgaccgccaggagugggagcgccagaagaaggaguuccucuggcgcaucgagcagcuccagaaggagaacuccccccgccgcggcggcuccuuccucugcgaccagaaggacggcaacguccgccccuucccccaccagggcucccuccgcaugccccgccccgucgccauguggcccugcgccgacgccgacuccauccccuucgaggaccgcccccucuccaagcucaaggaguccgaccgcugcuccgccuccgagaaccucuaccucgacgcccucucccucgacgacgagcccgaggagccccccgcccaccgccccgagcgcgaguuccgcaaccgccuccccgaggaggaggagaaccacaagggcaaccuccagcgcgccgucuccgucuccuccauguccgaguuccagcgccucauggacaucucccccuuccuccccgagaagggccuccccuccaccuccuccaaggaggacgucacccccccccucucccccgacgaccucaaguacaucgaggaguucaacaaguccugggacuacacccccaaccgcggccacaacggcggcggccccgaccucugggccgaccgcaccgaggucggccgcgccggccacgaggacuccaccgagcccuuccccgacuccuccugguaccucaccaccuccgucaccaugaccaccgacaccaugaccucccccgagcacugccagaagcagccccuccgcucccacguccucaccgagcaguccggccuccgcguccuccacuccccccccgccguccgccgcgucgacuccaucaccgccgccggcggcgagggccccuuccccaccucccgcgcccgcggcucccccggcgacaccaagggcggcccccccgagcccaugcucucccgcuggcccugcaccuccccccgccacucccgcgacuacgucgagggcgcccgccgcccccucgacuccccccucugcaccucccucggcuucgccuccccccuccacucccucgagauguccaagaaccucuccgacgacaugaaggaggucgccuucuccguccgcaacgccaucugcuccggccccggcgagcuccaggucaaggacauggccugccagaccaacggcucccgcaccaugggcacccagaccguccagaccaucuccgucggccuccagaccgaggcccuccgcggcuccggcgucaccuccuccccccacaagugccucacccccaaggccggcggcggcgccacccccgucuccucccccucccgcucccuccgcucccgccaggucgcccccgccaucgagaagguccaggccaaguucgagcgcaccugcugcucccccaaguacggcucccccaagcuccagcgcaagccccuccccaaggccgaccagcccaacaaccgcaccucccccggcauggcccagaagggcuacuccgaguccgccugggcccgcuccaccaccacccgcgagucccccguccacaccaccaucaacgacggccucuccucccucuucaacaucaucgaccacucccccgucguccaggaccccuuccagaagggccuccgcgccggcucccgcucccgcuccgccgagccccgccccgagcucggccccggccaggagaccggcaccaacucccgcggccgcucccccucccccaucggcgucggcuccgagaugugccgcgaggagggcggcgagggcacccccgucaagcaggaccucuccgccccccccggcuacacccucaccgagaacgucgcccgcauccucaacaagaagcuccucgagcacgcccucaaggaggagcgccgccaggccgcccacggcccccccggccuccacuccgacucccacucccucggcgacaccgccgagcccggccccauggagaaccagaccguccuccucaccgcccccuggggccucuga

SEQ ID NO: 46226 - RNA, 324 nt, Artificial Sequence
  derived and/or modified sequence opt2 from MTCP1__Homo_sapiens__NP_001018025
auggccggcgaggacgucggcgccccccccgaccaccucuggguccaccaggagggcaucuaccgcgacgaguaccagcgcaccugggucgccgucgucgaggaggagaccuccuuccuccgcgcccgcguccagcagauccaggucccccucggcgacgccgcccgccccucccaccuccucaccucccagcucccccucauguggcagcucuaccccgaggagcgcuacauggacaacaacucccgccucuggcagauccagcaccaccucaugguccgcggcguccaggagcuccuccucaagcuccuccccgacgacuga

SEQ ID NO: 46227 - RNA, 1749 nt, Artificial Sequence
  derived and/or modified sequence opt2 from MTDH__Homo_sapiens__NP_848927
auggccgcccgcuccuggcaggacgagcucgcccagcaggccgaggagggcuccgcccgccuccgcgagaugcucuccgucggccucggcuuccuccgcaccgagcucggccucgaccucggccucgagcccaagcgcuaccccggcugggucauccucgucggcaccggcgcccucggccuccuccuccucuuccuccucggcuacggcugggccgccgccugcgccggcgcccgcaagaagcgccgcucccccccccgcaagcgcgaggaggccgccgccguccccgccgccgcccccgacgaccucgcccuccucaagaaccuccgcuccgaggagcagaagaagaagaaccgcaagaagcucuccgagaagcccaagcccaacggccgcaccgucgaggucgccgagggcgaggccguccgcaccccccaguccgucaccgccaagcagccccccgagaucgacaagaagaacgagaaguccaagaagaacaagaagaaguccaaguccgacgccaaggccguccagaacuccucccgccacgacggcaaggaggucgacgagggcgccugggagaccaagaucucccaccgcgagaagcgccagcagcgcaagcgcgacaagguccucaccgacuccggcucccucgacuccaccauccccggcaucgagaacaccaucaccgucaccaccgagcagcucaccaccgccuccuuccccgucggcuccaagaagaacaagggcgacucccaccucaacguccaggucuccaacuucaaguccggcaagggcgacuccacccuccaggucuccuccggccucaacgagaaccucaccgucaacggcggcggcuggaacgagaaguccgucaagcucuccucccagaucuccgccggcgaggagaaguggaacuccgucucccccgccuccgccggcaagcgcaagaccgagcccuccgccuggucccaggacaccggcgacgccaacaccaacggcaaggacuggggccgcuccugguccgaccgcuccaucuucuccggcaucggcuccaccgccgagcccgucucccaguccaccaccuccgacuaccagugggacgucucccgcaaccagcccuacaucgacgacgagugguccggccucaacggccucuccuccgccgaccccaacuccgacuggaacgcccccgccgaggaguggggcaacugggucgacgaggagcgcgccucccuccucaagucccaggagcccauccccgacgaccagaaggucuccgacgacgacaaggagaagggcgagggcgcccuccccaccggcaaguccaagaagaagaagaagaagaagaagaagcagggcgaggacaacuccaccgcccaggacaccgaggagcucgagaaggagauccgcgaggaccuccccgucaacaccuccaagacccgccccaagcaggagaaggccuucucccucaagaccaucuccaccuccgaccccgccgagguccucgucaagaacucccagcccaucaagacccucccccccgccaccuccaccgagcccuccgucauccucuccaaguccgacuccgacaaguccuccucccaggucccccccauccuccaggagaccgacaaguccaaguccaacaccaagcagaacuccgucccccccucccagaccaaguccgagaccuccugggagucccccaagcagaucaagaagaagaagaaggcccgccgcgagaccuga

SEQ ID NO: 46228 - RNA, 1200 nt, Artificial Sequence
  derived and/or modified sequence opt2 from MTERF1__Homo_sapiens__XP_006716189
augcagucccucucccucggccagaccuccaucuccaagggccucaacuaccucaccaucauggcccccggcaaccucuggcacaugcgcaacaacuuccucuucggcucccgcugcuggaugacccgcuucuccgccgagaacaucuucaaguccgucuccuuccgccucuucggcgucaagugccacaacaccgacuccgagccccucaagaacgaggaccuccucaagaaccuccucaccaugggcgucgacaucgacauggcccgcaagcgccagcccggcgucuuccaccgcaugaucaccaacgagcaggaccucaagauguuccuccucuccaagggcgccuccaaggaggucaucgccuccaucaucucccgcuacccccgcgccaucacccgcacccccgagaaccucuccaagcgcugggaccucuggcgcaagaucgucaccuccgaccucgagaucgucaacauccucgagcgcucccccgaguccuucuuccgcuccaacaacaaccucaaccucgagaacaacaucaaguuccucuacuccgucggccucacccgcaagugccucugccgccuccucaccaacgccccccgcaccuucuccaacucccucgaccucaacaagcagauggucgaguuccuccaggccgccggccucucccucggccacaacgaccccgccgacuucguccgcaagaucaucuucaagaaccccuucauccucauccaguccaccaagcgcgucaaggccaacaucgaguuccuccgcuccaccuucaaccucaacuccgaggagcuccucguccucaucugcggccccggcgccgagauccucgaccucuccaacgacuacgcccgccgcuccuacgccaacaucaaggagaagcucuucucccucggcugcaccgaggaggagguccagaaguucguccucuccuaccccgacgucaucuuccucgccgagaagaaguucaacgacaagaucgacugccucauggaggagaacaucuccaucucccagaucaucgagaacccccgcguccucgacuccuccaucuccacccucaagucccgcaucaaggagcucgucaacgccggcugcaaccucuccacccucaacaucacccuccucuccugguccaagaagcgcuacgaggccaagcucaagaagcucucccgcuucgccuga

SEQ ID NO: 46229 - RNA, 2262 nt, Artificial Sequence
  derived and/or modified sequence opt2 from MTF1__Homo_sapiens__XP_011539794
augggcgagcacucccccgacaacaacaucaucuacuucgaggccgaggaggacgagcucacccccgacgacaagaugcuccgcuucgucgacaagaacggccucguccccuccuccuccggcaccgucuacgaccgcaccaccguccucaucgagcaggaccccggcacccucgaggacgaggacgacgacggccagugcggcgagcaccuccccuuccucgucggcggcgaggagggcuuccaccucaucgaccacgaggccaugucccagggcuacguccagcacaucaucucccccgaccagauccaccucaccaucaaccccggcuccacccccaugccccgcaacaucgagggcgccacccucacccuccaguccgagugccccgagaccaagcgcaaggaggucaagcgcuaccagugcaccuucgagggcugcccccgcaccuacuccaccgccggcaaccuccgcacccaccagaagacccaccgcggcgaguacaccuucgucugcaaccaggagggcugcggcaaggccuuccucaccuccuacucccuccgcauccacguccgcguccacaccaaggagaagcccuucgagugcgacguccagggcugcgagaaggccuucaacacccucuaccgccucaaggcccaccagcgccuccacaccggcaagaccuucaacugcgaguccgagggcugcuccaaguacuucaccacccucuccgaccuccgcaagcacauccgcacccacaccggcgagaagcccuuccgcugcgaccacgacggcugcggcaaggccuucgccgccucccaccaccucaagacccacguccgcacccacaccggcgagcgccccuucuucugccccuccaacggcugcgagaagaccuucuccacccaguacucccucaagucccacaugaagggccacgacaacaagggccacuccuacaacgcccucccccagcacaacggcuccgaggacaccaaccacucccucugccucuccgaccucucccuccucuccaccgacuccgagcuccgcgagaacuccuccaccacccagggccaggaccucuccaccaucucccccgccaucaucuucgaguccauguuccagaacuccgacgacaccgccauccaggaggacccccagcagaccgccucccucaccgaguccuucaacggcgacgccgaguccgucuccgacgucccccccuccaccggcaacuccgccucccucucccucccccucguccuccagcccggccucuccgagcccccccagccccuccuccccgccuccgcccccuccgcccccccccccgcccccucccucggccccggcucccagcaggccgccuucggcaacccccccgcccuccuccagccccccgagguccccgucccccacuccacccaguucgccgccaaccaccaggaguuccucccccacccccaggccccccagcccaucguccccggccucuccgucgucgccggcgccuccgccuccgccgccgccgucgccuccgccgucgccgcccccgcccccccccaguccaccaccgagccccuccccgccaugguccagacccucccccucggcgccaacuccguccucaccaacaaccccaccaucaccaucacccccacccccaacaccgccauccuccaguccucccucgucaugggcgagcagaaccuccaguggauccucaacggcgccaccuccuccccccagaaccaggagcagauccagcaggccuccaaggucgagaaggucuucuucaccaccgccguccccgucgccuccucccccggcuccuccguccagcagaucggccucuccguccccgucaucaucaucaagcaggaggaggccugccagugccagugcgccugccgcgacuccgccaaggagcgcgccuccucccgccgcaagggcugcuccuccccccccccccccgagcccuccccccaggcccccgacggccccucccuccagcuccccgcccagaccuucuccuccgcccccguccccggcuccuccuccuccacccuccccuccuccugcgagcagucccgccaggccgagacccccuccgacccccagaccgagacccucuccgccauggacgucuccgaguuccucucccuccagucccucgacacccccuccaaccucauccccaucgaggcccuccuccagggcgaggaggagaugggccucaccuccuccuucuccaaguga

SEQ ID NO: 46230 - RNA, 1170 nt, Artificial Sequence
  derived and/or modified sequence opt2 from MTFMT__Homo_sapiens__NP_640335
augcgcguccucguccgccgcugcuggggccccccccucgcccacggcgcccgccgcggccgccccuccccccaguggcgcgcccucgcccgccucggcugggaggacugccgcgacucccgcguccgcgagaagccccccuggcgcguccucuucuucggcaccgaccaguucgcccgcgaggcccuccgcgcccuccacgccgcccgcgagaacaaggaggaggagcucaucgacaagcucgaggucgucaccaugcccucccccucccccaagggccuccccgucaagcaguacgccguccagucccagcuccccgucuacgaguggcccgacgucggcuccggcgaguacgacgucggcgucgucgccuccuucggccgccuccucaacgaggcccucauccucaaguuccccuacggcauccucaacguccaccccuccugccucccccgcuggcgcggccccgcccccgucauccacaccguccuccacggcgacaccgucaccggcgucaccaucaugcagauccgccccaagcgcuucgacgucggccccauccucaagcaggagaccguccccgucccccccaaguccaccgccaaggagcucgaggccguccucucccgccucggcgccaacaugcucaucuccguccucaagaaccuccccgagucccucuccaacggccgccagcagcccauggagggcgccaccuacgcccccaagaucuccgccggcaccuccugcaucaagugggaggagcagaccuccgagcagaucuuccgccucuaccgcgccaucggcaacaucaucccccuccagacccucuggauggccaacaccaucaagcuccucgaccucgucgaggucaacuccuccguccucgccgaccccaagcucaccggccaggcccucauccccggcuccgucaucuaccacaagcagucccagauccuccucgucuacugcaaggacggcuggaucggcguccgcuccgucaugcucaagaagucccucaccgccaccgacuucuacaacggcuaccuccaccccugguaccagaagaacucccaggcccagcccucccagugccgcuuccagacccuccgccuccccaccaagaagaagcagaagaagaccgucgccaugcagcagugcaucgaguga

SEQ ID NO: 46231 - RNA, 408 nt, Artificial Sequence
  derived and/or modified sequence opt2 from MTFP1__Homo_sapiens__NP_001003704
auguccgagccccagccccgcggcgccgagcgcgaccucuaccgcgacaccuggguccgcuaccucggcuacgccaacgaggucggcgaggccuuccgcucccucguccccgccgccgucgucuggcucuccuacggcgucgccuccuccuacguccucgccgacgccaucgacaagggcaagaaggccggcgaggucggcggcuucccccccggccuccagcccgcccaggcccuccccaacuccggcgaggcccagcuccuccucaucauccucugguaccucgccugcgccuccgccuccugcuucauguccaccuccuacuccugccagggcauguggacccccggcucccucgucuccaaggaccccggcaccugggucggccucuccuggaccgaggccuga

SEQ ID NO: 46232 - RNA, 1005 nt, Artificial Sequence
  derived and/or modified sequence opt2 from MTG1__Homo_sapiens__NP_612393
augcgccucaccccccgcgcccucugcuccgccgcccaggccgccuggcgcgagaacuucccccucugcggccgcgacgucgcccgcugguuccccggccacauggccaagggccucaagaagaugcaguccucccucaagcucgucgacugcaucaucgagguccacgacgcccgcaucccccucuccggccgcaacccccucuuccaggagacccucggccucaagccccaccuccucguccucaacaagauggaccucgccgaccucaccgagcagcagaagaucaugcagcaccucgagggcgagggccucaagaacgucaucuucaccaacugcgucaaggacgagaacgucaagcagaucauccccauggucaccgagcucaucggccgcucccaccgcuaccaccgcaaggagaaccucgaguacugcaucauggucaucggcguccccaacgucggcaaguccucccucaucaacucccuccgccgccagcaccuccgcaagggcaaggccacccgcgucggcggcgagcccggcaucacccgcgccgucauguccaagauccaggucuccgagcgcccccucauguuccuccucgacacccccggcguccucgccccccgcaucgaguccgucgagaccggccucaagcucgcccucugcggcaccguccucgaccaccucgucggcgaggagaccauggccgacuaccuccucuacacccucaacaagcaccagcgcuucggcuacguccagcacuacggccucggcuccgccugcgacaacgucgagcgcguccucaaguccgucgccgucaagcucggcaagacccagaaggucaagguccucaccggcaccggcaacgucaacaucauccagcccaacuaccccgccgccgcccgcgacuuccuccagaccuuccgccgcggccuccucggcuccgucaugcucgaccucgacguccuccgcggccacccccccgccgagacccuccccuga

SEQ ID NO: 46233 - RNA, 2808 nt, Artificial Sequence
  derived and/or modified sequence opt2 from MTHFD1__Homo_sapiens__NP_005947
auggcccccgccgagauccucaacggcaaggagaucuccgcccagauccgcgcccgccucaagaaccaggucacccagcucaaggagcagguccccggcuucaccccccgccucgccauccuccaggucggcaaccgcgacgacuccaaccucuacaucaacgucaagcucaaggccgccgaggagaucggcaucaaggccacccacaucaagcucccccgcaccaccaccgaguccgaggucaugaaguacaucaccucccucaacgaggacuccaccguccacggcuuccucguccagcucccccucgacuccgagaacuccaucaacaccgaggaggucaucaacgccaucgcccccgagaaggacgucgacggccucaccuccaucaacgccggcaagcucgcccgcggcgaccucaacgacugcuucauccccugcacccccaagggcugccucgagcucaucaaggagaccggcguccccaucgccggccgccacgccgucgucgucggccgcuccaagaucgucggcgcccccaugcacgaccuccuccucuggaacaacgccaccgucaccaccugccacuccaagaccgcccaccucgacgaggaggucaacaagggcgacauccucgucgucgccaccggccagcccgagauggucaagggcgaguggaucaagcccggcgccaucgucaucgacugcggcaucaacuacguccccgacgacaagaagcccaacggccgcaaggucgucggcgacgucgccuacgacgaggccaaggagcgcgccuccuucaucacccccguccccggcggcgucggccccaugaccgucgccaugcucaugcaguccaccgucgaguccgccaagcgcuuccucgagaaguucaagcccggcaaguggaugauccaguacaacaaccucaaccucaagacccccguccccuccgacaucgacaucucccgcuccugcaagcccaagcccaucggcaagcucgcccgcgagaucggccuccucuccgaggaggucgagcucuacggcgagaccaaggccaagguccuccucuccgcccucgagcgccucaagcaccgccccgacggcaaguacgucgucgucaccggcaucacccccaccccccucggcgagggcaaguccaccaccaccaucggccucguccaggcccucggcgcccaccucuaccagaacgucuucgccugcguccgccagcccucccagggccccaccuucggcaucaagggcggcgccgccggcggcggcuacucccaggucauccccauggaggaguucaaccuccaccucaccggcgacauccacgccaucaccgccgccaacaaccucgucgccgccgccaucgacgcccgcaucuuccacgagcucacccagaccgacaaggcccucuucaaccgccucguccccuccgucaacggcguccgccgcuucuccgacauccagauccgccgccucaagcgccucggcaucgagaagaccgaccccaccacccucaccgacgaggagaucaaccgcuucgcccgccucgacaucgaccccgagaccaucaccuggcagcgcguccucgacaccaacgaccgcuuccuccgcaagaucaccaucggccaggcccccaccgagaagggccacacccgcaccgcccaguucgacaucuccgucgccuccgagaucauggccguccucgcccucaccaccucccucgaggacaugcgcgagcgccucggcaagauggucgucgccuccuccaagaagggcgagcccgucuccgccgaggaccucggcgucuccggcgcccucaccguccucaugaaggacgccaucaagcccaaccucaugcagacccucgagggcacccccgucuucguccacgccggccccuucgccaacaucgcccacggcaacuccuccaucaucgccgaccgcaucgcccucaagcucgucggccccgagggcuucgucgucaccgaggccggcuucggcgccgacaucggcauggagaaguucuucaacaucaagugccgcuacuccggccucugcccccacgucgucguccucgucgccaccguccgcgcccucaagaugcacggcggcggccccaccgucaccgccggccucccccuccccaaggccuacauccaggagaaccucgagcucgucgagaagggcuucuccaaccucaagaagcagaucgagaacgcccgcauguucggcauccccgucgucgucgccgucaacgccuucaagaccgacaccgaguccgagcucgaccucaucucccgccucucccgcgagcacggcgccuucgacgccgucaagugcacccacugggccgagggcggcaagggcgcccucgcccucgcccaggccguccagcgcgccgcccaggcccccuccuccuuccagcuccucuacgaccucaagcuccccgucgaggacaagauccgcaucaucgcccagaagaucuacggcgccgacgacaucgagcuccuccccgaggcccagcacaaggccgaggucuacaccaagcagggcuucggcaaccuccccaucugcauggccaagacccaccucucccucucccacaaccccgagcagaagggcguccccaccggcuucauccuccccauccgcgacauccgcgccuccgucggcgccggcuuccucuacccccucgucggcaccauguccaccaugcccggccuccccacccgccccugcuucuacgacaucgaccucgaccccgagaccgagcaggucaacggccucuucuga

SEQ ID NO: 46234 - RNA, 2940 nt, Artificial Sequence
  derived and/or modified sequence opt2 from MTHFD1L__Homo_sapiens__NP_001229696
augggcacccgccucccccucguccuccgccagcuccgccgccccccccagccccccggccccccccgccgccuccgcguccccugccgcgccuccuccggcggcggcggcggcggcggcggcggccgcgagggccuccucggccagcgccgcccccaggacggccaggcccgcuccuccugcucccccggcggccgcacccccgccgcccgcgacuccaucguccgcgaggucauccagaacuccaaggagguccucucccuccuccaggagaagaaccccgccuucaagcccguccucgccaucauccaggccggcgacgacaaccucaugcaggagaucaaccagaaccucgccgaggaggccggccucaacaucacccacaucugccucccccccgacuccuccgaggccgagaucaucgacgagauccucaagaucaacgaggacacccgcguccacggccucgcccuccagaucuccgagaaccucuucuccaacaagguccucaacgcccucaagcccgagaaggacgucgacggcgucaccgacaucaaccucggcaagcucguccgcggcgacgcccacgagugcuucgucucccccgucgccaaggccgucaucgagcuccucgagaaguccgucggcgucaaccucgacggcaagaagauccucgucgucggcgcccacggcucccucgaggccgcccuccagugccucuuccagcgcaagggcuccaugaccauguccauccaguggaagacccgccagcuccaguccaagcuccacgaggccgacaucgucguccucggcucccccaagcccgaggagaucccccucaccuggauccagcccggcaccaccguccucaacugcucccacgacuuccucuccggcaaggucggcugcggcuccccccgcauccacuucggcggccucaucgaggaggacgacgucauccuccucgccgccgcccuccgcauccagaacauggucuccuccggccgccgcuggcuccgcgagcagcagcaccgccgcuggcgccuccacugccucaagcuccagccccucucccccguccccuccgacaucgagaucucccgcggccagacccccaaggccgucgacguccucgccaaggagaucggccuccucgccgacgagaucgagaucuacggcaaguccaaggccaagguccgccucuccguccucgagcgccucaaggaccaggccgacggcaaguacguccucgucgccggcaucacccccaccccccucggcgagggcaaguccaccgucaccaucggccucguccaggcccucaccgcccaccucaacgucaacuccuucgccugccuccgccagcccucccagggccccaccuucggcgucaagggcggcgccgccggcggcggcuacgcccaggucauccccauggaggaguucaaccuccaccucaccggcgacauccacgccaucaccgccgccaacaaccuccucgccgccgccaucgacacccgcauccuccacgagaacacccagaccgacaaggcccucuacaaccgccucgucccccucgucaacggcguccgcgaguucuccgagauccagcucgcccgccucaagaagcucggcaucaacaagaccgaccccuccacccucaccgaggaggaggucuccaaguucgcccgccucgacaucgaccccuccaccaucaccuggcagcgcguccucgacaccaacgaccgcuuccuccgcaagaucaccaucggccagggcaacaccgagaagggccacuaccgccaggcccaguucgacaucgccgucgccuccgagaucauggccguccucgcccucaccgacucccucgccgacaugaaggcccgccucggccgcauggucgucgccuccgacaaguccggccagcccgucaccgccgacgaccucggcgucaccggcgcccucaccguccucaugaaggacgccaucaagcccaaccucaugcagacccucgagggcacccccgucuucguccacgccggccccuucgccaacaucgcccacggcaacuccuccguccucgccgacaagaucgcccucaagcucgucggcgaggagggcuucgucgucaccgaggccggcuucggcgccgacaucggcauggagaaguucuucaacaucaagugccgcgccuccggccucguccccaacgucgucguccucgucgccaccguccgcgcccucaagaugcacggcggcggccccuccgucaccgccggcgucccccucaagaaggaguacaccgaggagaacauccagcucgucgccgacggcugcugcaaccuccagaagcagauccagaucacccagcucuucggcguccccgucgucgucgcccucaacgucuucaagaccgacacccgcgccgagaucgaccucgucugcgagcucgccaagcgcgccggcgccuucgacgccguccccugcuaccacugguccgucggcggcaagggcuccgucgaccucgcccgcgccguccgcgaggccgccuccaagcgcucccgcuuccaguuccucuacgacguccagguccccaucgucgacaagauccgcaccaucgcccaggccgucuacggcgccaaggacaucgagcucucccccgaggcccaggccaagaucgaccgcuacacccagcagggcuucggcaaccuccccaucugcauggccaagacccaccucucccucucccaccagcccgacaagaagggcgucccccgcgacuucauccuccccaucuccgacguccgcgccuccaucggcgccggcuucaucuacccccucgucggcaccauguccaccaugcccggccuccccacccgccccugcuucuacgacaucgaccucgacaccgagaccgagcaggucaagggccucuucuga

SEQ ID NO: 46235 - RNA, 1053 nt, Artificial Sequence
  derived and/or modified sequence opt2 from MTHFD2__Homo_sapiens__NP_006627
auggccgccaccucccucauguccgcccucgccgcccgccuccuccagcccgcccacuccugcucccuccgccuccgccccuuccaccucgccgccguccgcaacgaggccgucgucaucuccggccgcaagcucgcccagcagaucaagcaggagguccgccaggaggucgaggagugggucgccuccggcaacaagcgcccccaccucuccgucauccucgucggcgagaaccccgccucccacuccuacguccucaacaagacccgcgccgccgccgucgucggcaucaacuccgagaccaucaugaagcccgccuccaucuccgaggaggagcuccucaaccucaucaacaagcucaacaacgacgacaacgucgacggccuccucguccagcucccccuccccgagcacaucgacgagcgccgcaucugcaacgccgucucccccgacaaggacgucgacggcuuccacgucaucaacgucggccgcaugugccucgaccaguacuccaugcuccccgccacccccuggggcgucugggagaucaucaagcgcaccggcauccccacccucggcaagaacgucgucgucgccggccgcuccaagaacgucggcaugcccaucgccaugcuccuccacaccgacggcgcccacgagcgccccggcggcgacgccaccgucaccaucucccaccgcuacacccccaaggagcagcucaagaagcacaccauccucgccgacaucgucaucuccgccgccggcauccccaaccucaucaccgccgacaugaucaaggagggcgccgccgucaucgacgucggcaucaaccgcguccacgaccccgucaccgccaagcccaagcucgucggcgacgucgacuucgagggcguccgccagaaggccggcuacaucacccccguccccggcggcgucggccccaugaccgucgccaugcucaugaagaacaccaucaucgccgccaagaagguccuccgccucgaggagcgcgagguccucaaguccaaggagcucggcgucgccaccaacuga

SEQ ID NO: 46236 - RNA, 2091 nt, Artificial Sequence
  derived and/or modified sequence opt2 from MTHFR__Homo_sapiens__XP_011539797
auggaccaccgcaaggcccgcguccuccccgccggccacuacugccccucccucggcaucugggccucccaggucggcuccguccgcuccuccgucccccccuccauccgcaaccccgccauggucaacgaggcccgcggcaacuccucccucaaccccugccucgagggcuccgccuccuccggcuccgaguccuccaaggacuccucccgcugcuccacccccggccucgaccccgagcgccacgagcgccuccgcgagaagaugcgccgccgccucgaguccggcgacaagugguucucccucgaguucuuccccccccgcaccgccgagggcgccgucaaccucaucucccgcuucgaccgcauggccgccggcggcccccucuacaucgacgucaccuggcaccccgccggcgaccccggcuccgacaaggagaccuccuccaugaugaucgccuccaccgccgucaacuacugcggccucgagaccauccuccacaugaccugcugccgccagcgccucgaggagaucaccggccaccuccacaaggccaagcagcucggccucaagaacaucauggcccuccgcggcgaccccaucggcgaccagugggaggaggaggagggcggcuucaacuacgccgucgaccucgucaagcacauccgcuccgaguucggcgacuacuucgacaucugcgucgccggcuaccccaagggccaccccgaggccggcuccuucgaggccgaccucaagcaccucaaggagaaggucuccgccggcgccgacuucaucaucacccagcucuucuucgaggccgacaccuucuuccgcuucgucaaggccugcaccgacaugggcaucaccugccccaucguccccggcaucuuccccauccagggcuaccacucccuccgccagcucgucaagcucuccaagcucgaggucccccaggagaucaaggacgucaucgagcccaucaaggacaacgacgccgccauccgcaacuacggcaucgagcucgccgucucccucugccaggagcuccucgccuccggccucguccccggccuccacuucuacacccucaaccgcgagauggccaccaccgagguccucaagcgccucggcauguggaccgaggacccccgccgcccccuccccugggcccucuccgcccaccccaagcgccgcgaggaggacguccgccccaucuucugggccucccgccccaaguccuacaucuaccgcacccaggagugggacgaguuccccaacggccgcuggggcaacuccuccucccccgccuucggcgagcucaaggacuacuaccucuucuaccucaaguccaagucccccaaggaggagcuccucaagauguggggcgaggagcucaccuccgaggaguccgucuucgaggucuucguccucuaccucuccggcgagcccaaccgcaacggccacaaggucaccugccuccccuggaacgacgagccccucgccgccgagaccucccuccucaaggaggagcuccuccgcgucaaccgccagggcauccucaccaucaacucccagcccaacaucaacggcaagcccuccuccgaccccaucgucggcuggggccccuccggcggcuacgucuuccagaaggccuaccucgaguucuucaccucccgcgagaccgccgaggcccuccuccagguccucaagaaguacgagcuccgcgucaacuaccaccucgucaacgucaagggcgagaacaucaccaacgcccccgagcuccagcccaacgccgucaccuggggcaucuuccccggccgcgagaucauccagcccaccgucgucgaccccgucuccuucauguucuggaaggacgaggccuucgcccucuggaucgagcgcuggggcaagcucuacgaggaggagucccccucccgcaccaucauccaguacauccacgacaacuacuuccucgucaaccucgucgacaacgacuucccccucgacaacugccucuggcaggucgucgaggacacccucgagcuccucaaccgccccacccagaacgcccgcgagaccgaggcccccuga

SEQ ID NO: 46237 - RNA, 612 nt, Artificial Sequence
  derived and/or modified sequence opt2 from MTHFS__Homo_sapiens__NP_006432
auggccgccgccgccgucuccuccgccaagcgcucccuccgcggcgagcucaagcagcgccuccgcgccauguccgccgaggagcgccuccgccagucccgcguccucucccagaaggucaucgcccacuccgaguaccagaaguccaagcgcaucuccaucuuccucuccaugcaggacgagaucgagaccgaggagaucaucaaggacaucuuccagcgcggcaagaucugcuucaucccccgcuaccgcuuccaguccaaccacauggacaugguccgcaucgagucccccgaggagaucucccuccuccccaagaccuccuggaacaucccccagcccggcgagggcgacguccgcgaggaggcccucuccaccggcggccucgaccucaucuucaugcccggccucggcuucgacaagcacggcaaccgccucggccgcggcaagggcuacuacgacgccuaccucaagcgcugccuccagcaccaggaggucaagcccuacacccucgcccucgccuucaaggagcagaucugccuccagguccccgucaacgagaacgacaugaaggucgacgagguccucuacgaggacuccuccaccgccuga

SEQ ID NO: 46238 - RNA, 2184 nt, Artificial Sequence
  derived and/or modified sequence opt2 from MTIF2__Homo_sapiens__NP_001005369
augaaccagaagcuccucaagcucgagaaccuccuccgcuuccacaccaucuaccgccagcuccacucccucugccagcgccgcgcccuccgccaguggcgccacggcuucuccuccgccuaccccgucuggaccgcccagcucugcgccuggcccuggcccaccgacguccucaccggcgccgcccucucccaguaccgccuccucgucaccaagaaggaggagggccccuggaagucccagcucuccuccaccaaguccaagaaggucgucgaggucuggaucggcaugaccaucgaggagcucgcccgcgccauggagaagaacaccgacuacgucuacgaggcccuccucaacaccgacaucgacaucgacucccucgaggccgacucccaccucgacgaggucuggaucaaggaggucaucaccaaggccggcaugaagcucaagugguccaagcucaagcaggacaagguccgcaagaacaaggacgccguccgccgcccccaggccgaccccgcccuccucaccccccgcucccccgucgucaccaucaugggccacgucgaccacggcaagaccacccuccucgacaaguuccgcaagacccaggucgccgccgucgagaccggcggcaucacccagcacaucggcgccuuccucgucucccuccccuccggcgagaagaucaccuuccucgacacccccggccacgccgccuucuccgccaugcgcgcccgcggcgcccaggucaccgacaucgucguccucgucgucgccgccgacgacggcgucaugaagcagaccgucgaguccauccagcacgccaaggacgcccagguccccaucauccucgccgucaacaagugcgacaaggccgaggccgaccccgagaaggucaagaaggagcuccucgccuacgacgucgucugcgaggacuacggcggcgacguccaggccguccccgucuccgcccucaccggcgacaaccucauggcccucgccgaggccaccgucgcccucgccgagaugcucgagcucaaggccgaccccaacggccccgucgagggcaccgucaucgaguccuucaccgacaagggccgcggccucgucaccaccgccaucauccagcgcggcacccuccgcaagggcuccguccucgucgccggcaagugcugggccaagguccgccucauguucgacgagaacggcaagaccaucgacgaggccuaccccuccaugcccgucggcaucaccggcuggcgcgaccuccccuccgccggcgaggagauccucgaggucgaguccgagccccgcgcccgcgaggucgucgacuggcgcaaguacgagcaggagcaggagaagggccaggaggaccucaagaucaucgaggagaagcgcaaggagcacaaggaggcccaccagaaggcccgcgagaaguacggccaccuccucuggaagaagcgcuccauccuccgcuuccucgagcgcaaggagcagaucccccucaagcccaaggagaagcgcgagcgcgacuccaacguccucuccgucaucaucaagggcgacgucgacggcuccgucgaggccauccucaacaucaucgacaccuacgacgccucccacgagugcgagcucgagcucguccacuucggcgucggcgacgucuccgccaacgacgucaaccucgccgagaccuucgacggcgucaucuacggcuucaacgucaacgccggcaacgucauccagcaguccgccgccaagaagggcgucaagaucaagcuccacaagaucaucuaccgccucgucgaggaccuccaggaggagcucuccucccgccuccccugcgccgucgaggagcaccccgucggcgaggccuccauccucgccaccuucuccgucaccgagggcaagaagaagguccccgucgccggcugccgcguccagaagggccagcucgagaagcagaagaaguucaagcucacccgcaacggccacgucaucuggaagggcucccucaccucccucaagcaccacaaggacgacaucuccaucgucaagaccggcauggacugcggccucucccucgacgaggacaacauggaguuccaggucggcgaccgcaucgucugcuacgaggagaagcagauccaggccaagaccuccugggaccccggcuucuga

SEQ ID NO: 46239 - RNA, 837 nt, Artificial Sequence
  derived and/or modified sequence opt2 from MTIF3__Homo_sapiens__XP_011533265
auggccgcccucuuccucaagcgccucacccuccagaccgucaaguccgagaacuccugcauccgcugcuucggcaagcacauccuccagaagaccgcccccgcccagcucucccccaucgccuccgccccccgccucuccuuccucauccacgccaaggccuucuccaccgccgaggacacccagaacgagggcaagaagaccaagaagaacaagaccgccuucuccaacgucggccgcaagaucucccagcgcgucauccaccucuucgacgagaagggcaacgaccucggcaacaugcaccgcgccaacgucauccgccucauggacgagcgcgaccuccgccucguccagcgcaacaccuccaccgagcccgccgaguaccagcucaugaccggccuccagauccuccaggagcgccagcgccuccgcgagauggagaaggccaaccccaagaccggccccacccuccgcaaggagcucauccucuccuccaacaucggccagcacgaccucgacaccaagaccaagcagauccagcaguggaucaagaagaagcaccucguccagaucaccaucaagaagggcaagaacgucgacgucuccgagaacgagauggaggagaucuuccaccagauccuccagaccaugcccggcaucgccaccuucuccucccgcccccaggccguccagggcggcaaggcccucaugugcguccuccgcgccuucuccaagaacgaggagaaggccuacaaggagacccaggagacccaggagcgcgacacccucaacaaggaccacggcaacgacaaggaguccaacguccuccaccaguga

SEQ ID NO: 46240 - RNA, 921 nt, Artificial Sequence
  derived and/or modified sequence opt2 from MTL5__Homo_sapiens__NP_001034745
auggaggagggcccccuccccggcggccuccccucccccgaggacgccauggucaccgagcuccucucccccgagggccccuucgccuccgagaacaucggccucaaggcccccgucaaguacgaggaggacgaguuccacgucuucaaggaggccuaccucggccccgccgaccccaaggagcccguccuccacgccuucaaccccgcccucggcgccgacugcaagggccaggucaaggccaagcucgccggcggcgacuccgacggcggcgagcuccucggcgaguaccccggcauccccgagcucuccgcccucgaggacgucgcccuccuccaggccccccagccccccgccugcaacguccacuuccucuccucccuccuccccgcccaccgcucccccgccguccucccccucggcgccuggguccucgagggcgccucccaccccggcguccgcaugauccccgucgagaucaaggaggccggcggcaccaccaccuccaacaaccccgaggaggccacccuccagaaccuccucgcccaggaguccugcugcaaguuccccuccucccaggagcucgaggacgccuccugcugcucccucaagaaggacuccaaccccauggucaucugccagcucaagggcggcacccagaugcucugcaucgacaacucccgcacccgcgagcucaaggcccuccaccucgucccccaguaccaggaccagaacaacuaccuccaguccgacguccccaagcccaugaccgcccucgucggccgcuuccuccccgccuccaccaagcucaaccucaucacccagcagcucgagggcgcccuccccuccgucgucaacggcuccgccuuccccuccggcuccacccuccccggcccccccaagaucacccucgccggcuga

SEQ ID NO: 46241 - RNA, 1812 nt, Artificial Sequence
  derived and/or modified sequence opt2 from MTM1__Homo_sapiens__XP_011529475
auggccuccgccuccaccuccaaguacaacucccacucccucgagaacgaguccaucaagcgcaccucccgcgacggcgucaaccgcgaccucaccgaggccgucccccgccuccccggcgagacccucaucaccgacaaggaggucaucuacaucugccccuucaacggccccaucaagggccgcgucuacaucaccaacuaccgccucuaccuccgcucccucgagaccgacuccucccucauccucgacgucccccucggcgucaucucccgcaucgagaagaugggcggcgccaccucccgcggcgagaacuccuacggccucgacaucaccugcaaggacaugcgcaaccuccgcuucgcccucaagcaggagggccacucccgccgcgacauguucgagauccucacccgcuacgccuucccccucgcccacucccucccccucuucgccuuccucaacgaggagaaguucaacgucgacggcuggaccgucuacaaccccgucgaggaguaccgccgccagggccuccccaaccaccacuggcgcaucaccuucaucaacaagugcuacgagcucugcgacaccuaccccgcccuccucgucguccccuaccgcgccuccgacgacgaccuccgccgcgucgccaccuuccgcucccgcaaccgcauccccguccucuccuggauccaccccgagaacaagaccgucaucguccgcugcucccagccccucgucggcauguccggcaagcgcaacaaggacgacgagaaguaccucgacgucauccgcgagaccaacaagcagaucuccaagcucaccaucuacgacgcccgccccuccgucaacgccgucgccaacaaggccaccggcggcggcuacgaguccgacgacgccuaccacaacgccgagcucuucuuccucgacauccacaacauccacgucaugcgcgagucccucaagaaggucaaggacaucgucuaccccaacgucgaggagucccacuggcucuccucccucgaguccacccacuggcucgagcacaucaagcucguccucaccggcgccauccaggucgccgacaaggucuccuccggcaaguccuccguccucguccacugcuccgacggcugggaccgcaccgcccagcucaccucccucgccaugcucaugcucgacuccuucuaccgcuccaucgagggcuucgagauccucguccagaaggaguggaucuccuucggccacaaguucgccucccgcaucggccacggcgacaagaaccacaccgacgccgaccgcucccccaucuuccuccaguucaucgacugcgucuggcagauguccaagcaguuccccaccgccuucgaguucaacgagcaguuccucaucaucauccucgaccaccucuacuccugccgcuucggcaccuuccucuucaacugcgaguccgcccgcgagcgccagaaggucaccgagcgcaccgucucccucuggucccucaucaacuccaacaaggagaaguucaagaaccccuucuacaccaaggagaucaaccgcguccucuaccccgucgccuccaugcgccaccucgagcucugggucaacuacuacauccgcuggaacccccgcaucaagcagcagcagcccaaccccgucgagcagcgcuacauggagcuccucgcccuccgcgacgaguacaucaagcgccucgaggagcuccagcucgccaacuccgccaagcucuccgacccccccaccucccccuccucccccucccagaugaugccccacguccagacccacuucuga

SEQ ID NO: 46242 - RNA, 1239 nt, Artificial Sequence
  derived and/or modified sequence opt2 from MTMR11__Homo_sapiens__XP_011507401
augugguggggcggccgcggccaguccuucaacaucgccccccagaaggaggagcccgagaugggcuccguccaggagaaccgcaugcccgagccccgcucccgccagcccuccuccugccucgccucccgcugccuccccggcgagcagauccucgccugggcccccggcguccgcaagggccucgagcccgagcucuccggcacccucaucugcaccaacuuccgcgucaccuuccagcccugcggcuggcaguggaaccaggacaccccccucaacuccgaguacgacuucgcccucgucaacaucggccgccucgaggccgucuccggccucucccgcguccagcuccuccgccccggcucccuccacaaguucauccccgaggagauccucauccacggccgcgacuuccgccuccuccgcgucggcuucgaggccggcggccucgagccccaggccuuccaggucaccauggccaucguccaggcccgcgcccaguccaaccaggcccagcaguacuccggcaucacccucuccaaggccggccagggcuccggcucccgcaagccccccaucccccucauggagaccgccgaggacugggagaccgagcgcaagaagcaggccgcccgcggcuggcgcgucuccaccgucaacgagcgcuucgacgucgccaccucccucccccgcuacuucuggguccccaaccgcauccucgacuccgagguccgccgcgccuucggccacuuccaccagggccgcggcccccgccucuccuggcaccaccccggcggcuccgaccuccuccgcugcggcggcuucuacaccgccuccgaccccaacaaggaggacauccgcgccgucgagcucaugcuccaggccggccacuccgacgucguccucgucgacaccauggacgagcuccccucccucgccgacguccagcucgcccaccuccgccuccgcgcccucugccuccccgacuccuccgucgccgaggacaaguggcucuccgcccucgagggcacccgcuggcucgacuacguccgcgccugccuccgcaaggccuccgacaucuccguccucgucaccucccgcguccgcuccgucauccuccaggccgccuucuccccccgcucccccaacaccgucuggcuccccaucaccuccaccgcccgcgucggcggcuccuggaccucccuccccgacuccgccuggggcaacuggggccaguga

SEQ ID NO: 46243 - RNA, 2244 nt, Artificial Sequence
  derived and/or modified sequence opt2 from MTMR12__Homo_sapiens__NP_001035536
augcucggcaagggcgucgucggcggcggcggcggcaccaaggcccccaagcccuccuucgucuccuacguccgccccgaggagauccacaccaacgagaaggaggucaccgagaaggaggucacccuccaccuccuccccggcgagcagcuccucugcgaggccuccaccguccucaaguacguccaggaggacuccugccagcacggcgucuacggccgccucgucugcaccgacuucaagaucgccuuccucggcgacgacgaguccgcccucgacaacgacgagacccaguucaagaacaaggucaucggcgagaacgacaucacccuccacugcgucgaccagaucuacggcgucuucgacgagaagaagaagacccucuucggccagcucaagaaguaccccgagaagcucaucauccacugcaaggaccuccgcgucuuccaguucugccuccgcuacaccaaggaggaggaggucaagcgcaucgucuccggcaucauccaccacacccaggcccccaagcuccucaagcgccucuuccucuucuccuacgccaccgccgcccagaacaacaccgucaccgaccccaagaaccacaccgucauguucgacacccucaaggacuggugcugggagcucgagcgcaccaagggcaacaugaaguacaaggccgucuccgucaacgagggcuacaaggucugcgagcgccuccccgccuacuucgucguccccaccccccuccccgaggagaacguccagcgcuuccagggccacggcauccccaucuggugcugguccugccacaacggcuccgcccuccucaagauguccgcccuccccaaggagcaggacgacggcauccuccagauccagaaguccuuccucgacggcaucuacaagaccauccaccgcccccccuacgagaucgucaagaccgaggaccucuccuccaacuuccucucccuccaggagauccagaccgccuacuccaaguucaagcagcucuuccucaucgacaacuccaccgaguucugggacaccgacaucaagugguucucccuccucgaguccuccuccuggcucgacaucauccgccgcugccucaagaaggccaucgagaucaccgagugcauggaggcccagaacaugaacguccuccuccucgaggagaacgccuccgaccucugcugccucaucuccucccucguccagcucaugauggacccccacugccgcacccgcaucggcuuccagucccucauccagaaggagugggucaugggcggccacugcuuccucgaccgcugcaaccaccuccgccagaacgacaaggaggagguccccgucuuccuccucuuccucgacugcgucuggcagcucguccaccagcacccccccgccuucgaguucaccgagaccuaccucaccguccucuccgacucccucuacauccccaucuucuccaccuucuucuucaacuccccccaccagaaggacaccaacaugggccgcgagggccaggacacccaguccaagccccucaaccuccucaccgucugggacugguccguccaguucgagcccaaggcccagacccuccucaagaacccccucuacgucgagaagcccaagcucgacaagggccagcgcaagggcaugcgcuucaagcaccagcgccagcucucccucccccucacccaguccaaguccucccccaagcgcggcuucuuccgcgaggagaccgaccaccucaucaagaaccuccucggcaagcgcaucuccaagcucaucaacuccuccgacgagcuccaggacaacuuccgcgaguucuacgacuccuggcacuccaaguccaccgacuaccacggccuccuccucccccacaucgagggccccgagaucaaggucugggcccagcgcuaccuccgcuggauccccgaggcccagauccucggcggcggccaggucgccacccucuccaagcuccucgagaugauggaggagguccagucccuccaggagaagaucgacgagcgccaccacucccagcaggccccccaggccgaggcccccugccuccuccgcaacuccgcccgccucuccucccucuuccccuucgcccuccuccagcgccacuccuccaagcccguccuccccaccuccggcuggaaggcccucggcgacgaggacgaccucgccaagcgcgaggacgaguucgucgaccucggcgacgucuga

SEQ ID NO: 46244 - RNA, 1953 nt, Artificial Sequence
  derived and/or modified sequence opt2 from MTMR14__Homo_sapiens__NP_001070993
auggccggcgcccgcgccgccgccgccgccgccuccgccggcuccuccgccuccuccggcaaccagcccccccaggagcucggccucggcgagcuccucgaggaguucucccgcacccaguaccgcgccaaggacggcuccggcaccggcggcuccaaggucgagcgcaucgagaagcgcugccucgagcucuucggccgcgacuacugcuucuccgucauccccaacaccaacggcgacaucugcggccacuacccccgccacaucgucuuccucgaguacgaguccuccgagaaggagaaggacaccuucgaguccaccguccaggucuccaagcuccaggaccucauccaccgcuccaagauggcccgcugccgcggccgcuucgucugccccgucauccucuucaagggcaagcacaucugccgcuccgccacccucgccggcuggggcgagcucuacggccgcuccggcuacaacuacuucuucuccggcggcgccgacgacgccugggccgacgucgaggacgucaccgaggaggacugcgcccuccgcuccggcgacacccaccucuucgacaagguccgcggcuacgacaucaagcuccuccgcuaccucuccgucaaguacaucugcgaccucauggucgagaacaagaaggucaaguucggcaugaacgucaccuccuccgagaaggucgacaaggcccagcgcuacgccgacuucacccuccucuccauccccuaccccggcugcgaguucuucaaggaguacaaggaccgcgacuacauggccgagggccucaucuucaacuggaagcaggacuacgucgacgccccccucuccauccccgacuuccucacccacucccucaacaucgacuggucccaguaccagugcugggaccucguccagcagacccagaacuaccucaagcuccuccucucccucgucaacuccgacgacgacuccggccuccucguccacugcaucuccggcugggaccgcaccccccucuucaucucccuccuccgccucucccucugggccgacggccucauccacaccucccucaagcccaccgagauccucuaccucaccgucgccuacgacugguuccucuucggccacaugcucgucgaccgccucuccaagggcgaggagaucuucuucuucugcuucaacuuccucaagcacaucaccuccgaggaguucuccgcccucaagacccagcgccgcaagucccuccccgcccgcgacggcggcuucacccucgaggacaucugcaugcuccgccgcaaggaccgcggcuccaccaccucccucggcuccgacuucucccucgucauggaguccucccccggcgccaccggcuccuucaccuacgaggccgucgagcucguccccgccggcgcccccacccaggccgccuggcgcaagucccacuccuccuccccccaguccguccucuggaaccgcccccagcccuccgaggaccgccuccccucccagcagggccucgccgaggcccgcuccuccuccuccuccuccuccaaccacuccgacaacuucuuccgcaugggcuccuccccccucgagguccccaagccccgcuccgucgaccacccccuccccggcuccucccucuccaccgacuacggcuccuggcagauggucaccggcugcggcuccauccaggagcgcgccguccuccacaccgacuccucccuccccuucuccuuccccgacgagcuccccaacuccugccuccucgccgcccucuccgaccgcgagacccgccuccaggagguccgcuccgccuuccucgccgccuacuccuccaccgucggccuccgcgccgucgcccccucccccuccggcgccaucggcggccuccucgagcaguucgcccgcggcgucggccuccgcuccaucuccuccaacgcccucuga

SEQ ID NO: 46245 - RNA, 1998 nt, Artificial Sequence
  derived and/or modified sequence opt2 from MTMR1__Homo_sapiens__NP_003819
auggaccgccccgccgccgccgccgccgccggcugcgagggcggcggcggccccaaccccggccccgccggcggccgccgccccccccgcgccgccggcggcgccaccgccggcucccgccagcccuccgucgagacccucgacucccccaccggcucccacgucgaguggugcaagcagcucaucgccgccaccaucuccucccagaucuccggcuccgucaccuccgagaacgucucccgcgacuacaaggcccuccgcgacggcaacaagcucgcccagauggaggaggccccccucuuccccggcgaguccaucaaggccaucgucaaggacgucauguacaucugccccuucaugggcgccgucuccggcacccucaccgucaccgacuucaagcucuacuucaagaacgucgagcgcgacccccacuucauccucgacgucccccucggcgucaucucccgcgucgagaagaucggcgcccagucccacggcgacaacuccugcggcaucgagaucgucugcaaggacaugcgcaaccuccgccucgccuacaagcaggaggagcaguccaagcucggcaucuucgagaaccucaacaagcacgccuucccccucuccaacggccaggcccucuucgccuucuccuacaaggagaaguuccccaucaacggcuggaaggucuacgaccccgucuccgaguacaagcgccagggccuccccaacgaguccuggaagaucuccaagaucaacuccaacuacgaguucugcgacaccuaccccgccaucaucgucguccccaccuccgucaaggacgacgaccucuccaaggucgccgccuuccgcgccaagggccgcguccccguccucuccuggauccaccccgagucccaggccaccaucacccgcugcucccagccccucgucggccccaacgacaagcgcugcaaggaggacgagaaguaccuccagaccaucauggacgccaacgcccagucccacaagcucaucaucuucgacgcccgccagaacuccgucgccgacaccaacaagaccaagggcggcggcuacgaguccgaguccgccuaccccaacgccgagcucgucuuccucgagauccacaacauccacgucaugcgcgagucccuccgcaagcucaaggagaucgucuaccccuccaucgacgaggcccgcuggcucuccaacgucgacggcacccacuggcucgaguacauccgcaugcuccucgccggcgccguccgcaucgccgacaagaucgaguccggcaagaccuccgucgucguccacugcuccgacggcugggaccgcaccgcccagcucaccucccucgccaugcucaugcucgacuccuacuaccgcaccaucaagggcuucgagacccucgucgagaaggaguggaucuccuucggccaccgcuucgcccuccgcgucggccacggcaacgacaaccacgccgacgccgaccgcucccccaucuuccuccaguucgucgacugcgucuggcagaugacccgccaguuccccuccgccuucgaguucaacgagcucuuccucaucaccauccucgaccaccucuacuccugccucuucggcaccuuccucugcaacugcgagcagcagcgcuucaaggaggacgucuacaccaagaccaucucccucugguccuacaucaacucccagcucgacgaguucuccaaccccuucuucgucaacuacgagaaccacguccucuaccccgucgccucccucucccaccucgagcucugggucaacuacuacguccgcuggaacccccgcaugcgcccccagaugcccauccaccagaaccucaaggagcuccucgccguccgcgccgagcuccagaagcgcgucgagggccuccagcgcgaggucgccacccgcgccgucuccuccuccuccgagcgcggcuccucccccucccacuccgccaccuccguccacaccuccgucuga

SEQ ID NO: 46246 - RNA, 1932 nt, Artificial Sequence
  derived and/or modified sequence opt2 from MTMR2__Homo_sapiens__NP_057240
auggagaaguccuccuccugcgagucccucggcucccagcccgccgccgcccgcccccccuccgucgacucccucuccuccgccuccaccucccacuccgagaacuccguccacaccaaguccgccuccgucgucuccuccgacuccaucuccaccuccgccgacaacuucucccccgaccuccgcguccuccgcgaguccaacaagcucgccgagauggaggagcccccccuccuccccggcgagaacaucaaggacauggccaaggacgucaccuacaucugccccuucaccggcgccguccgcggcacccucaccgucaccaacuaccgccucuacuucaaguccauggagcgcgacccccccuucguccucgacgccucccucggcgucaucaaccgcgucgagaagaucggcggcgccuccucccgcggcgagaacuccuacggccucgagaccgucugcaaggacauccgcaaccuccgcuucgcccacaagcccgagggccgcacccgccgcuccaucuucgagaaccucaugaaguacgccuuccccgucuccaacaaccucccccucuucgccuucgaguacaaggaggucuuccccgagaacggcuggaagcucuacgacccccuccucgaguaccgccgccagggcauccccaacgaguccuggcgcaucaccaagaucaacgagcgcuacgagcucugcgacaccuaccccgcccuccucgucguccccgccaacauccccgacgaggagcucaagcgcgucgccuccuuccgcucccgcggccgcauccccguccucuccuggauccaccccgagucccaggccaccaucacccgcugcucccagcccauggucggcgucuccggcaagcgcuccaaggaggacgagaaguaccuccaggccaucauggacuccaacgcccagucccacaagaucuucaucuucgacgcccgccccuccgucaacgccgucgccaacaaggccaagggcggcggcuacgaguccgaggacgccuaccagaacgccgagcucgucuuccucgacauccacaacauccacgucaugcgcgagucccuccgcaagcucaaggagaucgucuaccccaacaucgaggagacccacuggcucuccaaccucgaguccacccacuggcucgagcacaucaagcucauccucgccggcgcccuccgcaucgccgacaaggucgaguccggcaagaccuccgucgucguccacugcuccgacggcugggaccgcaccgcccagcucaccucccucgccaugcucaugcucgacggcuacuaccgcaccauccgcggcuucgagguccucgucgagaaggaguggcucuccuucggccaccgcuuccagcuccgcgucggccacggcgacaagaaccacgccgacgccgaccgcucccccgucuuccuccaguucaucgacugcgucuggcagaugacccgccaguuccccaccgccuucgaguucaacgaguacuuccucaucaccauccucgaccaccucuacuccugccucuucggcaccuuccucugcaacuccgagcagcagcgcggcaaggagaaccuccccaagcgcaccgucucccucugguccuacaucaacucccagcucgaggacuucaccaacccccucuacggcuccuacuccaaccacguccucuaccccgucgccuccaugcgccaccucgagcucugggucggcuacuacauccgcuggaacccccgcaugaagccccaggagcccauccacaaccgcuacaaggagcuccucgccaagcgcgccgagcuccagaagaaggucgaggagcuccagcgcgagaucuccaaccgcuccaccuccuccuccgagcgcgccuccucccccgcccagugcgucacccccguccagaccgucgucuga

SEQ ID NO: 46247 - RNA, 3597 nt, Artificial Sequence
  derived and/or modified sequence opt2 from MTMR3__Homo_sapiens__NP_066576
auggacgaggagacccgccacucccucgagugcauccaggccaaccagaucuucccccgcaagcagcucauccgcgaggacgagaaccuccagguccccuuccucgagcuccacggcgaguccaccgaguucgucggccgcgccgaggacgccaucaucgcccucuccaacuaccgccuccacaucaaguucaaggagucccucgucaacgucccccuccagcucaucgaguccgucgagugccgcgacaucuuccagcuccaccucaccugcaaggacugcaaggucauccgcugccaguucuccaccuucgagcagugccaggaguggcucaagcgccucaacaacgccauccgcccccccgccaagaucgaggaccucuucuccuucgccuaccacgccuggugcauggaggucuacgccuccgagaaggagcagcacggcgaccucugccgccccggcgagcacgucaccucccgcuucaagaacgaggucgagcgcaugggcuucgacaugaacaacgccuggcgcaucuccaacaucaacgagaaguacaagcucugcggcuccuacccccaggagcucaucguccccgccuggaucaccgacaaggagcucgaguccgucuccuccuuccgcuccuggaagcgcauccccgccgucaucuaccgccaccaguccaacggcgccgucaucgcccgcugcggccagcccgaggucuccugguggggcuggcgcaacgccgacgacgagcaccucguccaguccgucgccaaggccugcgccuccgacucccgcuccuccggcuccaagcucuccacccgcaacaccucccgcgacuuccccaacggcggcgaccucuccgacgucgaguucgacuccucccucuccaacgccuccggcgccgagucccucgccauccagccccagaagcuccucauccucgacgcccgcuccuacgccgccgccgucgccaaccgcgccaagggcggcggcugcgagugccccgaguacuaccccaacugcgaggucgucuucaugggcauggccaacauccacuccauccgccgcuccuuccagucccuccgccuccucugcacccagaugcccgaccccggcaacuggcucuccgcccucgaguccaccaaguggcuccaccaccucuccguccuccucaaguccgcccuccucgucguccacgccgucgaccaggaccagcgccccguccucguccacugcuccgacggcugggaccgcaccccccagaucgucgcccucgccaagcuccuccucgaccccuacuaccgcaccaucgagggcuuccagguccucgucgagauggaguggcucgacuucggccacaaguucgccgaccgcugcggccacggcgagaacuccgacgaccucaacgagcgcugccccgucuuccuccaguggcucgacugcguccaccagcuccagcgccaguuccccugcuccuucgaguucaacgaggccuuccucgucaagcucguccagcacaccuacuccugccucuucggcaccuuccucugcaacaacgccaaggagcgcggcgagaagcacacccaggagcgcaccugcuccgucuggucccuccuccgcgccggcaacaaggccuucaagaaccuccucuacuccucccaguccgaggccguccucuaccccgucugccacguccgcaaccucaugcucugguccgccgucuaccuccccugccccucccccaccacccccgucgacgacuccugcgcccccuaccccgcccccggcaccucccccgacgaccccccccucucccgccuccccaagacccgcuccuacgacaaccucaccaccgccugcgacaacaccgucccccucgccucccgccgcugcuccgaccccucccucaacgagaaguggcaggagcaccgccgcucccucgagcucuccucccucgccggccccggcgaggacccccucuccgccgacucccucggcaagcccacccgcguccccggcggcgccgagcucuccgucgccgccggcgucgccgagggccagauggagaacauccuccaggaggccaccaaggaggaguccggcgucgaggagcccgcccaccgcgccggcaucgagauccaggagggcaaggaggacccccuccucgagaaggagucccgccgcaagacccccgaggccuccgccaucggccuccaccaggaccccgagcucggcgacgccgcccuccgcucccaccucgacauguccuggccccucuucucccagggcaucuccgagcagcaguccggccucuccguccuccucuccucccuccagguccccccccgcggcgaggacucccucgagguccccgucgagcaguuccgcaucgaggagaucgccgagggccgcgaggaggccguccuccccauccccgucgacgccaaggucggcuacggcaccucccaguccugcucccuccuccccucccagguccccuucgagacccgcggccccaacgucgacuccuccaccgacaugcucgucgaggacaaggucaaguccgucuccggcccccagggccaccaccgcuccugccucgucaacuccggcaaggaccgccucccccagaccauggagcccucccccuccgagaccucccucgucgagcgcccccaggucggcuccgucguccaccgcaccucccucggcuccacccucucccucacccgcucccccugcgcccucccccucgccgagugcaaggagggccucgucugcaacggcgcccccgagaccgagaaccgcgccuccgagcagccccccggccucuccacccuccagauguaccccacccccaacggccacugcgccaacggcgaggccggccgcuccaaggacucccucucccgccagcucuccgccauguccugcuccuccgcccaccuccacucccgcaaccuccaccacaaguggcuccacucccacuccggccgccccuccgccaccuccucccccgaccagcccucccgcucccaccucgacgacgacggcauguccgucuacaccgacaccauccagcagcgccuccgccagaucgaguccggccaccagcaggaggucgagacccucaagaagcagguccaggagcucaagucccgccucgagucccaguaccucaccuccucccuccacuucaacggcgacuucggcgacgaggucaccuccauccccgacuccgaguccaaccucgaccagaacugccucucccgcugcuccaccgagaucuucuccgaggccuccugggagcaggucgacaagcaggacaccgagaugacccgcuggcuccccgaccaccucgccgcccacugcuacgccugcgacuccgccuucuggcucgccucccgcaagcaccacugccgcaacugcggcaacgucuucugcuccuccugcugcaaccagaagguccccguccccucccagcagcucuucgagcccucccgcgucugcaaguccugcuacuccucccuccaccccaccuccuccuccaucgaccucgagcucgacaagcccaucgccgccaccuccaacuga

SEQ ID NO: 46248 - RNA, 3588 nt, Artificial Sequence
  derived and/or modified sequence opt2 from MTMR4__Homo_sapiens__XP_006722231
augggcgaggagggcccccccucccucgaguacauccaggccaaggaccucuucccccccaaggagcucgucaaggaggaggagaaccuccagguccccuucaccguccuccagggcgagggcgucgaguuccucggccgcgccgccgacgcccucaucgccaucuccaacuaccgccuccacaucaaguucaaggacuccgucaucaacgucccccuccgcaugaucgacuccgucgagucccgcgacauguuccagcuccacaucuccugcaaggacuccaaggucguccgcugccacuucuccaccuucaagcagugccaggaguggcucucccgccucucccgcgccaccgcccgccccgccaagcccgaggaccucuucgccuucgccuaccacgccuggugccucggccucaccgaggaggaccagcacacccaccucugccagcccggcgagcacauccgcugccgccaggaggccgagcucgcccgcaugggcuucgaccuccagaacgucuggcgcgucucccacaucaacuccaacuacaagcucugccccuccuacccccagaagcuccucguccccgucuggaucaccgacaaggagcucgagaacgucgccuccuuccgcuccuggaagcgcauccccgucgucgucuaccgccaccuccgcaacggcgccgccaucgcccgcugcucccagcccgagaucuccugguggggcuggcgcaacgccgacgacgaguaccucgucaccuccaucgccaaggccugcgcccucgaccccggcacccgcgccaccggcggcucccucuccaccggcaacaacgacaccuccgaggccugcgacgccgacuucgacuccucccucaccgccugcuccggcgucgaguccaccgccgccccccagaagcuccucauccucgacgcccgcuccuacaccgccgccgucgccaaccgcgccaagggcggcggcugcgagugcgaggaguacuaccccaacugcgaggucgucuucaugggcauggccaacauccacgccauccgcaacuccuuccaguaccuccgcgccgucugcucccagaugcccgaccccuccaacuggcucuccgcccucgaguccaccaaguggcuccagcaccucuccgucaugcucaaggccgccguccucgucgccaacaccgucgaccgcgagggccgccccguccucguccacugcuccgacggcugggaccgcaccccccagaucgucgcccucgccaagauccuccucgaccccuacuaccgcacccucgagggcuuccagguccucgucgaguccgacuggcucgacuucggccacaaguucggcgaccgcugcggccaccaggagaacgucgaggaccagaacgagcagugccccgucuuccuccaguggcucgacuccguccaccagcuccucaagcaguuccccugccucuucgaguucaacgaggccuuccucgucaagcucguccagcacaccuacuccugccucuacggcaccuuccucgccaacaaccccugcgagcgcgagaagcgcaacaucuacaagcgcaccugcuccgucugggcccuccuccgcgccggcaacaagaacuuccacaacuuccucuacacccccuccuccgacaugguccuccaccccgucugccacguccgcgcccuccaccucuggaccgccgucuaccuccccgccuccucccccugcacccucggcgaggagaacauggaccucuaccucucccccgucgcccagucccaggaguucuccggccgcucccucgaccgccuccccaagacccgcuccauggacgaccuccucuccgccugcgacaccuccuccccccucacccgcaccuccuccgaccccaaccucaacaaccacugccaggagguccgcgucggccucgagcccuggcacuccaaccccgagggcuccgagaccuccuucgucgacuccggcgucggcggcccccagcagaccgucggcgaggucggccucccccccccccuccccuccucccagaaggacuaccucuccaacaagcccuucaagucccacaaguccugcucccccuccuacaagcuccucaacaccgccgucccccgcgagaugaaguccaacaccuccgaccccgagaucaagguccucgaggagaccaagggccccgcccccgaccccuccgcccaggacgagcucggccgcacccucgacggcaucggcgagccccccgagcacugccccgagaccgaggccgucuccgcccucuccaaggucaucuccaacaagugcgacggcgucugcaacuuccccgaguccucccagaacucccccaccggcaccccccagcaggcccagcccgacuccaugcucggcguccccuccaagugcguccucgaccacucccucuccaccgucugcaacccccccuccgccgccugccagaccccccucgaccccuccaccgacuuccucaaccaggaccccuccggcuccgucgccuccaucucccaccaggagcagcucuccuccguccccgaccucacccacggcgaggaggacaucggcaagcgcggcaacaaccgcaacggccagcuccucgagaacccccgcuucggcaagaugccccucgagcucguccgcaagcccaucucccagucccagaucuccgaguucuccuuccucggcuccaacugggacuccuuccagggcauggucaccuccuuccccuccggcgaggccaccccccgccgccuccucuccuacggcugcugcuccaagcgccccaacuccaagcagaugcgcgccaccggccccugcuucggcggccagugggcccagcgcgagggcgucaagucccccgucugcuccucccacuccaacggccacugcaccggccccggcggcaagaaccagauguggcucuccucccaccccaagcaggucuccuccaccaagcccgucccccucaacugccccucccccguccccccccucuaccucgacgacgacggccuccccuuccccaccgacgucauccagcaccgccuccgccagaucgaggccggcuacaagcaggaggucgagcagcuccgccgccagguccgcgagcuccagaugcgccucgacauccgccacugcugcgccccccccgccgagccccccauggacuacgaggacgacuucaccugccucaaggaguccgacggcuccgacaccgaggacuucggcuccgaccacuccgaggacugccucuccgaggccuccugggagcccgucgacaagaaggagaccgaggucacccgcuggguccccgaccacauggccucccacugcuacaacugcgacugcgaguucuggcucgccaagcgccgccaccacugccgcaacugcggcaacgucuucugcgccggcugcugccaccucaagcuccccauccccgaccagcagcucuacgaccccguccucgucugcaacuccugcuacgagcacauccaggucucccgcgcccgcgagcucaugucccagcagcucaagaagcccaucgccaccgccuccuccuga

SEQ ID NO: 46249 - RNA, 1866 nt, Artificial Sequence
  derived and/or modified sequence opt2 from MTMR6__Homo_sapiens__NP_004676
auggagcacauccgcaccaccaaggucgagcaggucaagcuccucgaccgcuucuccaccuccaacaagucccucaccggcacccucuaccucaccgccacccaccuccucuucaucgacucccaccagaaggagaccuggauccuccaccaccacaucgccuccgucgagaagcucgcccucaccaccuccggcugcccccucgucauccagugcaagaacuuccgcaccguccacuucaucgucccccgcgagcgcgacugccacgacaucuacaacucccuccuccagcucuccaagcaggccaaguacgaggaccucuacgccuucuccuacaaccccaagcagaacgacuccgagcgccuccagggcuggcagcucaucgaccucgccgaggaguacaagcgcaugggcguccccaacucccacuggcagcucuccgacgccaaccgcgacuacaagaucugcgagaccuacccccgcgagcucuacgucccccgcaucgccuccaagcccaucaucgucggcuccuccaaguuccgcuccaagggccgcuuccccguccucuccuacuaccaccaggacaaggaggccgccaucugccgcugcucccagccccucuccggcuucuccgcccgcugccucgaggacgagcaccuccuccaggccaucuccaaggccaaccccgucaaccgcuacauguacgucauggacacccgccccaagcucaacgccauggccaaccgcgccgccggcaagggcuacgagaacgaggacaacuacuccaacauccgcuuccaguucgucggcaucgagaacauccacgucaugcgcuccucccuccagaagcuccucgaggucaacggcaccaagggccucuccgucaacgacuucuacuccggccucgaguccuccggcuggcuccgccacaucaaggccgucauggacgccgccaucuuccucgccaaggccaucaccgucgagaacgccuccguccucguccacugcuccgacggcugggaccgcaccucccaggucugcucccucggcucccuccuccucgacuccuacuaccgcaccaucaagggcuucaugguccucaucgagaaggacuggaucuccuucggccacaaguucuccgagcgcugcggccagcucgacggcgaccccaaggaggucucccccgucuucacccaguuccucgagugcgucuggcaccucaccgagcaguucccccaggccuucgaguucuccgaggccuuccuccuccagauccacgagcacauccacuccugccaguucggcaacuuccucggcaacugccagaaggagcgcgaggagcucaagcucaaggagaagaccuacucccucuggcccuuccuccucgaggaccagaagaaguaccucaacccccucuacuccuccgagucccaccgcuucaccguccucgagcccaacaccgucuccuucaacuucaaguucuggcgcaacauguaccaccaguucgaccgcacccuccacccccgccaguccgucuucaacaucaucaugaacaugaacgagcagaacaagcagcucgagaaggacaucaaggaccucgaguccaagaucaagcagcgcaagaacaagcagaccgacggcauccucaccaaggagcuccuccacuccguccaccccgagucccccaaccucaagaccucccucugcuucaaggagcagacccuccuccccgucaacgacgcccuccgcaccaucgagggcuccucccccgccgacaaccgcuacuccgaguacgccgaggaguucuccaaguccgagcccgccgucgucucccucgaguacggcgucgcccgcaugaccugcuga

SEQ ID NO: 46250 - RNA, 1983 nt, Artificial Sequence
  derived and/or modified sequence opt2 from MTMR7__Homo_sapiens__NP_004677
auggagcacauccgcacccccaaggucgagaacguccgccucgucgaccgcgucucccccaagaaggccgcccucggcacccucuaccucaccgccacccacgucaucuucgucgagaacucccccgacccccgcaaggagaccuggauccuccacucccagaucuccaccaucgagaagcaggccaccaccgccaccggcugcccccuccucauccgcugcaagaacuuccagaucauccagcucaucaucccccaggagcgcgacugccacgacgucuacaucucccucauccgccucgcccgccccgucaaguacgaggagcucuacugcuucuccuucaaccccaugcucgacaaggaggagcgcgagcagggcuggguccucaucgaccucuccgaggaguacacccgcaugggccuccccaaccacuacuggcagcucuccgacgucaaccgcgacuaccgcgucugcgacuccuaccccaccgagcucuacguccccaaguccgccaccgcccacaucaucgucggcuccuccaaguuccgcucccgccgccgcuuccccguccucuccuacuacuacaaggacaaccacgccuccaucugccgcuccucccagccccucuccggcuucuccgcccgcugccucgaggacgagcagaugcuccaggccauccgcaaggccaaccccggcuccgacuucgucuacgucgucgacacccgccccaagcucaacgccauggccaaccgcgccgccggcaagggcuacgagaacgaggacaacuacuccaacaucaaguuccaguucaucggcaucgagaacauccacgucaugcgcaacucccuccagaagaugcucgaggucugcgagcucaagucccccuccauguccgacuuccucuggggccucgagaacuccggcuggcuccgccacaucaaggccaucauggacgccggcaucuucaucgccaaggccgucuccgaggagggcgccuccguccucguccacugcuccgacggcugggaccgcaccgcccaggucugcuccgucgccucccuccuccucgacccccacuaccgcacccucaagggcuucaugguccucaucgagaaggacuggaucuccuucggccacaaguucaaccaccgcuacggcaaccucgacggcgaccccaaggagaucucccccgucaucgaccaguucaucgagugcgucuggcagcucauggagcaguuccccugcgccuucgaguucaacgagcgcuuccucauccacauccagcaccacaucuacuccugccaguucggcaacuuccucugcaacucccagaaggagcgccgcgagcucaagauccaggagcgcaccuacucccucugggcccaccucuggaagaaccgcgccgacuaccucaacccccucuuccgcgccgaccacucccagacccagggcacccuccaccuccccaccacccccugcaacuucauguacaaguucugguccggcauguacaaccgcuucgagaagggcaugcagccccgccaguccgucaccgacuaccucauggccgucaaggaggagacccagcagcucgaggaggagcucgaggcccucgaggagcgccucgagaagauccagaagguccagcucaacugcaccaaggucaaguccaagcaguccgagcccuccaagcacuccggcuucuccaccuccgacaacuccaucgccaacaccccccaggacuacuccggcaacaugaaguccuuccccucccgcucccccucccagggcgacgaggacuccgcccucauccucacccaggacaaccucaaguccuccgaccccgaccucuccgccaacuccgaccaggaguccggcgucgaggaccucuccugccgcucccccuccggcggcgagcacgcccccuccgaggacuccggcaaggaccgcgacuccgacgaggccgucuuccucaccgccuga

SEQ ID NO: 46251 - RNA, 2115 nt, Artificial Sequence
  derived and/or modified sequence opt2 from MTMR8__Homo_sapiens__NP_060147
auggaccacaucaccguccccaaggucgagaacgucaagcucgucgaccgcuacgucuccaagaagcccgccaacggcauccucuaccucaccgccacccaccucaucuacgucgaggccuccggcgccgcccgcaaggagaccuggaucgcccuccaccacaucgccaccgucgagaagcuccccaucaccucccucggcugcccccucacccuccgcugcaagaacuuccgcgucgcccacuucguccucgacuccgaccucgucugccacgaggucuacaucucccuccucaagcucucccagcccgcccuccccgaggaccucuacgccuucuccuacaaccccaaguccuccaaggagaugcgcgaguccggcuggaagcucaucgaccccaucuccgacuucggccgcaugggcauccccaaccgcaacuggaccaucaccgacgccaaccgcaacuacgagaucugcuccaccuacccccccgagaucgucguccccaaguccgucacccucggcaccgucgucggcuccuccaaguuccgcuccaaggagcgcguccccguccucuccuaccucuacaaggagaacaacgccgccaucugccgcugcucccagccccucuccggcuucuacacccgcugcgucgacgacgagcuccuccucgaggccaucucccagaccaaccccggcucccaguucauguacgucgucgacacccgccccaagcucaacgccauggccaaccgcgccgccggcaagggcuacgagaacgaggacaacuacgccaacauccgcuuccgcuucaugggcaucgagaacauccacgucaugcgcuccucccuccagaagcuccucgaggucugcgagcucaagacccccaccauguccgaguuccucuccggccucgaguccuccggcuggcuccgccacaucaaggccaucauggacgccggcaucuucaucaccaaggccgucaaggucgagaaggccuccguccucguccacugcuccgacggcugggaccgcaccgcccaggucugcuccgucgccuccauccuccucgaccccuucuaccgcaccuucaagggccucaugauccucaucgagaaggaguggaucuccaugggccacaaguucucccagcgcugcggccaccucgacggcgacuccaaggaggucucccccaucuucacccaguuccucgacugcaucuggcagcucauggagcaguuccccugcgccuucgaguucaacgagaacuuccuccucgagauccacgaccacgucuucuccugccaguucggcaacuuccucggcaacugccagaaggaccgcgaggaccuccgcgucuacgagaagacccacuccgucuggcccuuccucguccagcgcaagcccgacuuccgcaacccccucuacaagggcuucaccauguacggcguccucaaccccuccaccguccccuacaacauccaguucuggugcggcauguacaaccgcuucgacaagggccuccagcccaagcaguccaugcucgagucccuccucgagaucaagaagcagcgcgccaugcucgagaccgacguccacgagcucgagaagaagcucaagguccgcgacgagccccccgaggagaucugcaccugcucccagcucggcaacauccucucccagcaccucggcuccccccucaccaacccccucggcuucaugggcaucaacggcgaccucaacacccucauggagaacggcacccucucccgcgagggcggccuccgcgcccagauggaccaggucaagucccagggcgccgaccuccaccacaacugcugcgagaucgucggcucccuccgcgccaucaacaucuccggcgacgucggcaucuccgaggccaugggcaucuccggcgacaugugcaccuucgaggccaccggcuucuccaaggaccucggcaucugcggcgccauggacaucuccgaggccaccggcaucuccggcaaccucggcaucuccgaggcccgcggcuucuccggcgacaugggcauccucggcgacaccggcaucuccaaggccuccaccaaggaggccgacuacuccaagcaccaguga

SEQ ID NO: 46252 - RNA, 1650 nt, Artificial Sequence
  derived and/or modified sequence opt2 from MTMR9__Homo_sapiens__NP_056273
auggaguucgccgagcucaucaagaccccccgcgucgacaacgucguccuccaccgccccuucuaccccgccgucgagggcacccucugccucaccggccaccaccucauccucuccucccgccaggacaacaccgaggagcucuggcuccuccacuccaacaucgacgccaucgacaagcgcuucgucggcucccucggcaccaucaucaucaagugcaaggacuuccgcaucauccagcucgacauccccggcauggaggagugccucaacaucgccuccuccaucgaggcccucuccacccucgacuccaucacccucauguaccccuucuucuaccgccccauguucgaggucaucgaggacggcuggcacuccuuccuccccgagcaggaguucgagcucuacuccuccgccaccuccgaguggcgccucuccuacgucaacaaggaguucgccgucugccccuccuacccccccaucgucaccguccccaaguccaucgacgacgaggcccuccgcaaggucgccaccuuccgccacggcggccgcuuccccguccucuccuacuaccacaagaagaacggcauggucaucaugcgcuccggccagccccucaccggcaccaacggccgccgcugcaaggaggacgagaagcucaucaacgccacccuccgcgccggcaagcgcggcuacaucaucgacacccgcucccucaacgucgcccagcagacccgcgccaagggcggcggcuucgagcaggaggcccacuacccccaguggcgccgcauccacaaguccaucgagcgcuaccacauccuccaggagucccucaucaagcucgucgaggccugcaacgaccagacccacaacauggaccgcuggcucuccaagcucgaggccuccaacuggcucacccacaucaaggagauccucaccaccgccugccucgccgcccagugcaucgaccgcgagggcgccuccauccucauccacggcaccgagggcaccgacuccacccuccaggucaccucccucgcccagaucauccucgagccccgcucccgcaccauccgcggcuucgaggcccucaucgagcgcgaguggcuccaggccggccaccccuuccagcagcgcugcgcccaguccgccuacugcaacaccaagcagaagugggaggcccccgucuuccuccucuuccucgacugcgucuggcagauccuccgccaguuccccugcuccuucgaguucaacgagaacuuccucaucaugcucuucgagcacgccuacgccucccaguucggcaccuuccucggcaacaacgaguccgagcgcugcaagcucaagcuccagcagaagaccaugucccucugguccugggucaaccagcccuccgagcucuccaaguucaccaacccccucuucgaggccaacaaccucgucaucuggcccuccgucgccccccagucccucccccucugggagggcaucuuccuccgcuggaaccgcuccuccaaguaccucgacgaggccuacgaggagauggucaacaucaucgaguacaacaaggagcuccaggccaaggucaacauccuccgccgccagcucgccgagcucgagaccgaggacggcaugcaggagucccccuga

SEQ ID NO: 46253 - RNA, 1053 nt, Artificial Sequence
  derived and/or modified sequence opt2 from MTNR1A__Homo_sapiens__NP_005949
augcagggcaacggcuccgcccuccccaacgccucccagcccguccuccgcggcgacggcgcccgccccuccuggcucgccuccgcccucgccugcguccucaucuucaccaucgucgucgacauccucggcaaccuccucgucauccucuccgucuaccgcaacaagaagcuccgcaacgccggcaacaucuucgucgucucccucgccgucgccgaccucgucgucgccaucuaccccuacccccucguccucauguccaucuucaacaacggcuggaaccucggcuaccuccacugccaggucuccggcuuccucaugggccucuccgucaucggcuccaucuucaacaucaccggcaucgccaucaaccgcuacugcuacaucugccacucccucaaguacgacaagcucuacuccuccaagaacucccucugcuacguccuccucaucuggcuccucacccucgccgccguccuccccaaccuccgcgccggcacccuccaguacgacccccgcaucuacuccugcaccuucgcccaguccgucuccuccgccuacaccaucgccgucgucgucuuccacuuccucguccccaugaucaucgucaucuucugcuaccuccgcaucuggauccucguccuccagguccgccagcgcgucaagcccgaccgcaagcccaagcucaagccccaggacuuccgcaacuucgucaccauguucgucgucuucguccucuucgccaucugcugggccccccucaacuucaucggccucgccgucgccuccgaccccgccuccauggucccccgcauccccgaguggcucuucgucgccuccuacuacauggccuacuucaacuccugccucaacgccaucaucuacggccuccucaaccagaacuuccgcaaggaguaccgccgcaucaucgucucccucugcaccgcccgcgucuucuucgucgacuccuccaacgacgucgccgaccgcgucaaguggaagcccuccccccucaugaccaacaacaacgucgucaaggucgacuccgucuga

SEQ ID NO: 46254 - RNA, 1089 nt, Artificial Sequence
  derived and/or modified sequence opt2 from MTNR1B__Homo_sapiens__NP_005950
auguccgagaacggcuccuucgccaacugcugcgaggccggcggcugggccguccgccccggcugguccggcgccggcuccgcccgccccucccgcaccccccgcccccccugggucgcccccgcccucuccgccguccucaucgucaccaccgccgucgacgucgucggcaaccuccucgucauccucuccguccuccgcaaccgcaagcuccgcaacgccggcaaccucuuccucgucucccucgcccucgccgaccucgucgucgccuucuaccccuacccccucauccucgucgccaucuucuacgacggcugggcccucggcgaggagcacugcaaggccuccgccuucgucaugggccucuccgucaucggcuccgucuucaacaucaccgccaucgccaucaaccgcuacugcuacaucugccacuccauggccuaccaccgcaucuaccgccgcuggcacaccccccuccacaucugccucaucuggcuccucaccgucgucgcccuccuccccaacuucuucgucggcucccucgaguacgacccccgcaucuacuccugcaccuucauccagaccgccuccacccaguacaccgccgccgucgucgucauccacuuccuccuccccaucgccgucgucuccuucugcuaccuccgcaucuggguccucguccuccaggcccgccgcaaggccaagcccgagucccgccucugccucaagcccuccgaccuccgcuccuuccucaccauguucgucgucuucgucaucuucgccaucugcugggccccccucaacugcaucggccucgccgucgccaucaacccccaggagauggccccccagauccccgagggccucuucgucaccuccuaccuccucgccuacuucaacuccugccucaacgccaucgucuacggccuccucaaccagaacuuccgccgcgaguacaagcgcauccuccucgcccucuggaacccccgccacugcauccaggacgccuccaagggcucccacgccgagggccuccagucccccgccccccccaucaucggcguccagcaccaggccgacgcccucuga

SEQ ID NO: 46255 - RNA, 2199 nt, Artificial Sequence
  derived and/or modified sequence opt2 from MTO1__Homo_sapiens__NP_001116698
auguucuacuuccgcggcugcggccgcugggucgccgucuccuucaccaagcagcaguucccccucgcccgccucuccuccgacuccgccgccccccgcaccccccacuucgacgucaucgucaucggcggcggccacgccggcaccgaggccgccaccgccgccgcccgcugcggcucccgcacccuccuccucacccaccgcgucgacaccaucggccagauguccugcaaccccuccuucggcggcaucggcaagggccaccucaugcgcgaggucgacgcccucgacggccucugcucccgcaucugcgaccaguccggcguccacuacaagguccucaaccgccgcaagggccccgccgucuggggccuccgcgcccagaucgaccgcaagcucuacaagcagaacaugcagaaggagauccucaacaccccccuccucaccguccaggagggcgccgucgaggaccucauccucaccgagcccgagcccgagcacaccggcaagugccgcgucuccggcgucguccucgucgacggcuccaccgucuacgccgaguccgucauccucaccaccggcaccuuccuccgcggcaugaucgucaucggccucgagacccaccccgccggccgccucggcgaccagcccuccaucggccucgcccagacccucgagaagcucggcuucgucgucggccgccucaagaccggcacccccccccgcaucgccaaggaguccaucaacuucuccauccucaacaagcacauccccgacaaccccuccauccccuucuccuucaccaacgagaccgucuggaucaagcccgaggaccagcuccccugcuaccucacccacaccaacccccgcgucgacgagaucguccucaagaaccuccaccucaacucccacgucaaggagaccacccgcggcccccgcuacugccccuccaucgaguccaagguccuccgcuuccccaaccgccuccaccaggucuggcucgagcccgagggcauggacuccgaccucaucuacccccagggccucuccaugacccuccccgccgagcuccaggagaagaugaucaccugcauccgcggccucgagaaggccaaggucauccagcccggcuacggcguccaguacgacuaccucgacccccgccagaucacccccucccucgagacccaccucguccagcgccucuucuucgccggccagaucaacggcaccaccggcuacgaggaggccgccgcccagaccgagugcugcuccgucgcccgccucgagugcuccgacaugaucucccagcuccaggccauccuccucccccagcccucccucgucgccggcaccgccggcaugcaccacaacacccagggcgucaucgccggcaucaacgccucccuccgcgucucccgcaagccccccuucgucgucucccgcaccgagggcuacaucggcguccucaucgacgaccucaccacccucggcaccuccgagcccuaccgcauguucaccucccgcgucgaguuccgccucucccuccgccccgacaacgccgacucccgccucacccuccgcggcuacaaggacgccggcugcgucucccagcagcgcuacgagcgcgccugcuggaugaaguccucccucgaggagggcaucuccguccucaaguccaucgaguuccucuccuccaaguggaagaagcucauccccgaggccuccaucuccaccucccgcucccuccccguccgcgcccucgacguccucaaguacgaggaggucgacauggacucccucgccaaggccguccccgagccccucaagaaguacaccaagugccgcgagcucgccgagcgccucaagaucgaggccaccuacgaguccguccucuuccaccagcuccaggagaucaagggcguccagcaggacgaggcccuccagcuccccaaggaccucgacuaccucaccauccgcgacgucucccucucccacgagguccgcgagaagcuccacuucucccgcccccagaccaucggcgccgccucccgcauccccggcgucacccccgccgccaucaucaaccuccuccgcuucgucaagaccacccagcgccgccaguccgccaugaacgaguccuccaagaccgaccaguaccucugcgacgccgaccgccuccaggagcgcgagcucuga

SEQ ID NO: 46256 - RNA, 1749 nt, Artificial Sequence
  derived and/or modified sequence opt2 from MTPAP__Homo_sapiens__NP_060579
auggccguccccggcgucggccuccucacccgccucaaccucugcgcccgccgccgcacccgcguccagcgccccaucguccgccuccucuccugccccggcaccgucgccaaggaccuccgccgcgacgagcagcccuccggcuccgucgagaccggcuucgaggacaagauccccaagcgccgcuucuccgagaugcagaacgagcgccgcgagcaggcccagcgcaccguccucauccacugccccgagaagaucuccgagaacaaguuccucaaguaccucucccaguucggccccaucaacaaccacuucuucuacgaguccuucggccucuacgccgucgucgaguucugccagaaggaguccaucggcucccuccagaacggcacccacacccccuccaccgccauggagaccgccauccccuuccgcucccgcuucuucaaccucaagcucaagaaccagaccuccgagcgcucccgcguccgcuccuccaaccagcucccccgcuccaacaagcagcucuucgagcuccucugcuacgccgaguccaucgacgaccagcucaacacccuccucaaggaguuccagcucaccgaggagaacaccaagcuccgcuaccucaccugcucccucaucgaggacauggccgccgccuacuuccccgacugcaucguccgccccuucggcuccuccgucaacaccuucggcaagcucggcugcgaccucgacauguuccucgaccucgacgagacccgcaaccucuccgcccacaagaucuccggcaacuuccucauggaguuccaggucaagaacguccccuccgagcgcaucgccacccagaagauccucuccguccucggcgagugccucgaccacuucggccccggcugcgucggcguccagaagauccucaacgcccgcugcccccucguccgcuucucccaccaggccuccggcuuccagugcgaccucaccaccaacaaccgcaucgcccucaccuccuccgagcuccucuacaucuacggcgcccucgacucccgcguccgcgcccucgucuucuccguccgcugcugggcccgcgcccacucccucaccuccuccauccccggcgccuggaucaccaacuucucccucaccaugauggucaucuucuuccuccagcgccgcuccccccccauccuccccacccucgacucccucaagacccucgccgacgccgaggacaagugcgucaucgagggcaacaacugcaccuucguccgcgaccucucccgcaucaagcccucccagaacaccgagacccucgagcuccuccucaaggaguucuucgaguacuucggcaacuucgccuucgacaagaacuccaucaacauccgccagggccgcgagcagaacaagcccgacuccuccccccucuacauccagaaccccuucgagaccucccucaacaucuccaagaacgucucccagucccagcuccagaaguucgucgaccucgcccgcgaguccgccuggauccuccagcaggaggacaccgaccgccccuccaucuccuccaaccgccccuggggccucgucucccuccuccuccccuccgcccccaaccgcaaguccuucaccaagaagaaguccaacaaguucgccaucgagaccgucaagaaccuccucgagucccucaagggcaaccgcaccgagaacuucaccaagaccuccggcaagcgcaccaucuccacccagaccuga

SEQ ID NO: 46257 - RNA, 357 nt, Artificial Sequence
  derived and/or modified sequence opt2 from MTPN__Homo_sapiens__NP_665807
augugcgacaaggaguucaugugggcccucaagaacggcgaccucgacgaggucaaggacuacgucgccaagggcgaggacgucaaccgcacccucgagggcggccgcaagccccuccacuacgccgccgacugcggccagcucgagauccucgaguuccuccuccucaagggcgccgacaucaacgcccccgacaagcaccacaucaccccccuccucuccgccgucuacgagggccacgucuccugcgucaagcuccuccucuccaagggcgccgacaagaccgucaagggccccgacggccucaccgccuucgaggccaccgacaaccaggccaucaaggcccuccuccaguga

SEQ ID NO: 46258 - RNA, 1338 nt, Artificial Sequence
  derived and/or modified sequence opt2 from MTRF1__Homo_sapiens__XP_006719963
augaaccgccaccucugcgucuggcucuuccgccaccccucccucaacggcuaccuccagugccacauccagcuccacucccaccaguuccgccagauccaccucgacacccgccuccaggucuuccgccagaaccgcaacugcauccuccaccuccucuccaagaacuggucccgccgcuacugccaccaggacaccaagaugcucuggaagcacaaggcccuccagaaguacauggagaaccucuccaaggaguaccagacccucgagcagugccuccagcacauccccgucaacgaggagaaccgccgcucccucaaccgccgccacgccgagcucgccccccucgccgccaucuaccaggagauccaggagaccgagcaggccaucgaggagcucgaguccaugugcaagucccucaacaagcaggacgagaagcagcuccaggagcucgcccucgaggagcgccagaccaucgaccagaagaucaacaugcucuacaacgagcucuuccagucccucguccccaaggagaaguacgacaagaacgacgucauccucgaggucaccgccggccgcaccaccggcggcgacaucugccagcaguucacccgcgagaucuucgacauguaccagaacuacuccugcuacaagcacuggcaguucgagcuccucaacuacacccccgccgacuacggcggccuccaccacgccgccgcccgcaucuccggcgacggcgucuacaagcaccucaaguacgagggcggcauccaccgcguccagcgcauccccgaggucggccucuccucccgcaugcagcgcauccacaccggcaccauguccgucaucguccucccccagcccgacgaggucgacgucaagcucgaccccaaggaccuccgcaucgacaccuuccgcgccaagggcgccggcggccagcacgucaacaagaccgacuccgccguccgccucguccacauccccaccggccucgucgucgagugccagcaggagcgcucccagaucaagaacaaggagaucgccuuccgcguccuccgcgcccgccucuaccagcagaucaucgagaaggacaagcgccagcagcaguccgcccgcaagcuccaggucggcacccgcgcccaguccgagcgcauccgcaccuacaacuucacccaggaccgcgucuccgaccaccgcaucgccuacgagguccgcgacaucaaggaguuccucugcggcggcaagggccucgaccagcucauccagcgccuccuccaguccgccgacgaggaggccaucgccgagcuccucgacgagcaccucaaguccgccaaguga

SEQ ID NO: 46259 - RNA, 3798 nt, Artificial Sequence
  derived and/or modified sequence opt2 from MTR__Homo_sapiens__NP_000245
augucccccgcccuccaggaccucucccagcccgagggccucaagaagacccuccgcgacgagaucaacgccauccuccagaagcgcaucaugguccucgacggcggcaugggcaccaugauccagcgcgagaagcucaacgaggagcacuuccgcggccaggaguucaaggaccacgcccgcccccucaagggcaacaacgacauccucuccaucacccagcccgacgucaucuaccagauccacaaggaguaccuccucgccggcgccgacaucaucgagaccaacaccuucuccuccaccuccaucgcccaggccgacuacggccucgagcaccucgccuaccgcaugaacaugugcuccgccggcgucgcccgcaaggccgccgaggaggucacccuccagaccggcaucaagcgcuucgucgccggcgcccucggccccaccaacaagacccucuccgucucccccuccgucgagcgccccgacuaccgcaacaucaccuucgacgagcucgucgaggccuaccaggagcaggccaagggccuccucgacggcggcgucgacauccuccucaucgagaccaucuucgacaccgccaacgccaaggccgcccucuucgcccuccagaaccucuucgaggagaaguacgccccccgccccaucuucaucuccggcaccaucgucgacaaguccggccgcacccucuccggccagaccggcgagggcuucgucaucuccgucucccacggcgagccccucugcaucggccucaacugcgcccucggcgccgccgagaugcgccccuucaucgagaucaucggcaagugcaccaccgccuacguccucugcuaccccaacgccggccuccccaacaccuucggcgacuacgacgagacccccuccaugauggccaagcaccucaaggacuucgccauggacggccucgucaacaucgucggcggcugcugcggcuccacccccgaccacauccgcgagaucgccgaggccgucaagaacugcaagccccgcgucccccccgccaccgccuucgagggccacaugcuccucuccggccucgagcccuuccgcaucggccccuacaccaacuucgucaacaucggcgagcgcugcaacgucgccggcucccgcaaguucgccaagcucaucauggccggcaacuacgaggaggcccucugcgucgccaagguccaggucgagaugggcgcccagguccucgacgucaacauggacgacggcaugcucgacggccccuccgccaugacccgcuucugcaaccucaucgccuccgagcccgacaucgccaaggucccccucugcaucgacuccuccaacuucgccgucaucgaggccggccucaagugcugccagggcaagugcaucgucaacuccaucucccucaaggagggcgaggacgacuuccucgagaaggcccgcaagaucaagaaguacggcgccgccauggucgucauggccuucgacgaggagggccaggccaccgagaccgacaccaagauccgcgucugcacccgcgccuaccaccuccucgucaagaagcucggcuucaaccccaacgacaucaucuucgaccccaacauccucaccaucggcaccggcauggaggagcacaaccucuacgccaucaacuucauccacgccaccaaggucaucaaggagacccuccccggcgcccgcaucuccggcggccucuccaaccucuccuucuccuuccgcggcauggaggccauccgcgaggccaugcacggcgucuuccucuaccacgccaucaaguccggcauggacaugggcaucgucaacgccggcaaccuccccgucuacgacgacauccacaaggagcuccuccagcucugcgaggaccucaucuggaacaaggaccccgaggccaccgagaagcuccuccgcuacgcccagacccagggcaccggcggcaagaaggucauccagaccgacgaguggcgcaacggccccgucgaggagcgccucgaguacgcccucgucaagggcaucgagaagcacaucaucgaggacaccgaggaggcccgccucaaccagaagaaguacccccgcccccucaacaucaucgagggcccccucaugaacggcaugaagaucgucggcgaccucuucggcgccggcaagauguuccucccccaggucaucaaguccgcccgcgucaugaagaaggccgucggccaccucauccccuucauggagaaggagcgcgaggagacccgcguccucaacggcaccgucgaggaggaggaccccuaccagggcaccaucguccucgccaccgucaagggcgacguccacgacaucggcaagaacaucgucggcgucguccucggcugcaacaacuuccgcgucaucgaccucggcgucaugacccccugcgacaagauccucaaggccgcccucgaccacaaggccgacaucaucggccucuccggccucaucacccccucccucgacgagaugaucuucgucgccaaggagauggagcgccucgccauccgcaucccccuccucaucggcggcgccaccaccuccaagacccacaccgccgucaagaucgccccccgcuacuccgcccccgucauccacguccucgacgccuccaaguccgucgucgucugcucccagcuccucgacgagaaccucaaggacgaguacuucgaggagaucauggaggaguacgaggacauccgccaggaccacuacgagucccucaaggagcgccgcuaccucccccucucccaggcccgcaaguccggcuuccagauggacuggcucuccgagccccaccccgucaagcccaccuucaucggcacccaggucuucgaggacuacgaccuccagaagcucgucgacuacaucgacuggaagcccuucuucgacgucuggcagcuccgcggcaaguaccccaaccgcggcuuccccaagaucuucaacgacaagaccgucggcggcgaggcccgcaaggucuacgacgacgcccacaacaugcucaacacccucaucucccagaagaagcuccgcgcccgcggcgucgucggcuucuggcccgcccaguccauccaggacgacauccaccucuacgccgaggccgccgucccccaggccgccgagcccaucgccaccuucuacggccuccgccagcaggccgagaaggacuccgccuccaccgagcccuacuacugccucuccgacuucaucgccccccuccacuccggcauccgcgacuaccucggccucuucgccgucgccugcuucggcgucgaggagcucuccaaggccuacgaggacgacggcgacgacuacuccuccaucauggucaaggcccucggcgaccgccucgccgaggccuucgccgaggagcuccacgagcgcguccgccgcgagcucugggccuacugcggcuccgagcagcucgacgucgccgaccuccgccgccuccgcuacaagggcauccgccccgcccccggcuaccccucccagcccgaccacaccgagaagcucaccauguggcgccucgccgacaucgagcaguccaccggcauccgccucaccgagucccucgccauggcccccgccuccgccgucuccggccucuacuucuccaaccucaaguccaaguacuucgccgucggcaagaucuccaaggaccaggucgaggacuacgcccuccgcaagaacaucuccgucgccgaggucgagaaguggcucggccccauccucggcuacgacaccgacuga

SEQ ID NO: 46260 - RNA, 75 nt, Artificial Sequence
  derived and/or modified sequence opt2 from MTRNR2L7__Homo_sapiens__NP_001177418
auggccaccggcggcuucggcugccuccuccuccucauccgcgagaucgaccucuccgucaagcgccagaucuga

SEQ ID NO: 46261 - RNA, 2097 nt, Artificial Sequence
  derived and/or modified sequence opt2 from MTRR__Homo_sapiens__NP_002445
augcgccgcuuccuccuccucuacgccacccagcagggccaggccaaggccaucgccgaggagaucugcgagcaggccgucguccacggcuucuccgccgaccuccacugcaucuccgaguccgacaaguacgaccucaagaccgagaccgccccccucgucgucgucgucuccaccaccggcaccggcgacccccccgacaccgcccgcaaguucgucaaggagauccagaaccagacccuccccgucgacuucuucgcccaccuccgcuacggccuccucggccucggcgacuccgaguacaccuacuucugcaacggcggcaagaucaucgacaagcgccuccaggagcucggcgcccgccacuucuacgacaccggccacgccgacgacugcgucggccucgagcucgucgucgagcccuggaucgccggccucuggcccgcccuccgcaagcacuuccgcuccucccgcggccaggaggagaucuccggcgcccuccccgucgccucccccgccuccucccgcaccgaccucgucaaguccgagcuccuccacaucgagucccaggucgagcuccuccgcuucgacgacuccggccgcaaggacuccgagguccucaagcagaacgccgucaacuccaaccaguccaacgucgucaucgaggacuucgaguccucccucacccgcuccguccccccccucucccaggccucccucaacauccccggccucccccccgaguaccuccagguccaccuccaggagucccucggccaggaggagucccaggucuccgucaccuccgccgaccccgucuuccagguccccaucuccaaggccguccagcucaccaccaacgacgccaucaagaccacccuccucgucgagcucgacaucuccaacaccgacuucuccuaccagcccggcgacgccuucuccgucaucugccccaacuccgacuccgagguccagucccuccuccagcgccuccagcucgaggacaagcgcgagcacugcguccuccucaagaucaaggccgacaccaagaagaagggcgccacccucccccagcacauccccgccggcugcucccuccaguucaucuucaccuggugccucgagauccgcgccauccccaagaaggccuuccuccgcgcccucgucgacuacaccuccgacuccgccgagaagcgccgccuccaggagcucugcuccaagcagggcgccgccgacuacucccgcuucguccgcgacgccugcgccugccuccucgaccuccuccucgccuuccccuccugccagcccccccucucccuccuccucgagcaccuccccaagcuccagccccgccccuacuccugcgccuccuccucccucuuccaccccggcaagcuccacuucgucuucaacaucgucgaguuccucuccaccgccaccaccgagguccuccgcaagggcgucugcaccggcuggcucgcccuccucgucgccuccguccuccagcccaacauccacgccucccacgaggacuccggcaaggcccucgcccccaagaucuccaucuccccccgcaccaccaacuccuuccaccuccccgacgaccccuccauccccaucaucauggucggccccggcaccggcaucgcccccuucaucggcuuccuccagcaccgcgagaagcuccaggagcagcaccccgacggcaacuucggcgccauguggcucuucuucggcugccgccacaaggaccgcgacuaccucuuccgcaaggagcuccgccacuuccucaagcacggcauccucacccaccucaaggucuccuucucccgcgacgcccccgucggcgaggaggaggcccccgccaaguacguccaggacaacauccagcuccacggccagcaggucgcccgcauccuccuccaggagaacggccacaucuacgucugcggcgacgccaagaacauggccaaggacguccacgacgcccucguccagaucaucuccaaggaggucggcgucgagaagcucgaggccaugaagacccucgccacccucaaggaggagaagcgcuaccuccaggacaucugguccuga

SEQ ID NO: 46262 - RNA, 2193 nt, Artificial Sequence
  derived and/or modified sequence opt2 from MTSS1__Homo_sapiens__NP_001269903
auggaggccgucaucgagaaggagugcuccgcccucggcggccucuuccagaccaucaucuccgacaugaagggcuccuaccccgucugggaggacuucaucaacaaggccggcaagcuccagucccagcuccgcaccaccgucgucgccgccgccgccuuccucgacgccuuccagaaggucgccgacauggccaccaacacccgcggcggcacccgcgagaucggcuccgcccucacccgcaugugcaugcgccaccgcuccaucgaggccaagcuccgccaguucuccuccgcccucaucgacugccucaucaacccccuccaggagcagauggaggaguggaagaaggucgccaaccagcucgacaaggaccacgccaaggaguacaagaaggcccgccaggagaucaagaagaaguccuccgacacccucaagcuccagaagaaggccaagaagggccgcggcgacauccagccccagcucgacuccgcccuccaggacgucaacgacaaguaccuccuccucgaggagaccgagaagcaggccguccgcaaggcccucaucgaggagcgcggccgcuucugcaccuucaucuccaugcuccgccccgucaucgaggaggagaucuccaugcucggcgagaucacccaccuccagaccaucuccgaggaccucaagucccucaccauggacccccacaagcuccccuccuccuccgagcaggucauccucgaccucaagggcuccgacuacuccugguccuaccagaccccccccuccucccccuccaccaccaugucccgcaaguccuccgucugcuccucccucaacuccgucaacuccuccgacucccgcuccuccggcucccacucccacucccccuccucccacuaccgcuaccgcuccuccaaccucgcccagcaggcccccguccgccucuccuccgucuccucccacgacuccggcuucaucucccaggacgccuuccaguccaagucccccucccccaugccccccgaggcccccaaccagaacuccuccuccuccgccuccuccgaggccuccgagaccugccaguccgucuccgagugcuccucccccaccuccgucuccuccggcuccaccaugggcgccugggucuccaccgagaaggacugggccaagcccggccccuacgaccagccccucgucaacacccuccagcgccgcaaggagaagcgcgagcccgaccccaacggcggcggccccaccaccgccuccggcccccccgccgccgccgaggaggcccagcgcccccgcuccaugaccgucuccgccgccacccgccccggcgaggagauggaggccugcgaggagcucgcccucgcccucucccgcggccuccagcucgacacccagcgcuccucccgcgacucccuccagugcuccuccggcuacuccacccagaccaccacccccugcugcuccgaggacaccauccccucccaggucuccgacuacgacuacuucuccgucuccggcgaccaggaggccgaccagcaggaguucgacaaguccuccaccaucccccgcaacuccgacaucucccaguccuaccgccgcauguuccaggccaagcgccccgccuccaccgccggccuccccaccacccucggccccgccauggucacccccggcgucgccaccauccgccgcacccccuccaccaagcccuccguccgccgcggcaccaucggcgccggccccauccccaucaagacccccgucauccccgucaagacccccaccguccccgaccuccccggcguccuccccgccccccccgacggccccgaggagcgcggcgagcacucccccgagucccccuccgucggcgagggcccccagggcgucaccuccaugcccuccuccaugugguccggccaggccuccgucaaccccccccuccccggccccaagcccuccauccccgaggagcaccgccaggccauccccgaguccgaggccgaggaccaggagcgcgagccccccuccgccaccgucucccccggccagauccccgaguccgaccccgccgaccucuccccccgcgacaccccccagggcgaggacaugcucaacgccauccgccgcggcgucaagcucaagaagaccaccaccaacgaccgcuccgccccccgcuucuccuga

SEQ ID NO: 46263 - RNA, 2685 nt, Artificial Sequence
  derived and/or modified sequence opt2 from MTTP__Homo_sapiens__NP_000244
augauccuccucgccguccucuuccucugcuucaucuccuccuacuccgccuccgucaagggccacaccaccggccucucccucaacaacgaccgccucuacaagcucaccuacuccaccgagguccuccucgaccgcggcaagggcaagcuccaggacuccgucggcuaccgcaucuccuccaacgucgacgucgcccuccucuggcgcaaccccgacggcgacgacgaccagcucauccagaucaccaugaaggacgucaacgucgagaacgucaaccagcagcgcggcgagaaguccaucuucaagggcaagucccccuccaagaucaugggcaaggagaaccucgaggcccuccagcgccccacccuccuccaccucauccacggcaaggucaaggaguucuacuccuaccagaacgaggccgucgccaucgagaacaucaagcgcggccucgccucccucuuccagacccagcucuccuccggcaccaccaacgaggucgacaucuccggcaacugcaaggucaccuaccaggcccaccaggacaaggucaucaagaucaaggcccucgacuccugcaagaucgcccgcuccggcuucaccacccccaaccagguccucggcgucuccuccaaggccaccuccgucaccaccuacaagaucgaggacuccuucgucaucgccguccucgccgaggagacccacaacuucggccucaacuuccuccagaccaucaagggcaagaucgucuccaagcagaagcucgagcucaagaccaccgaggccggcccccgccucauguccggcaagcaggccgccgccaucaucaaggccgucgacuccaaguacaccgccauccccaucgucggccaggucuuccagucccacugcaagggcugccccucccucuccgagcucuggcgcuccacccgcaaguaccuccagcccgacaaccucuccaaggccgaggccguccgcaacuuccucgccuucauccagcaccuccgcaccgccaagaaggaggagauccuccagauccucaagauggagaacaaggagguccucccccagcucgucgacgccgucaccuccgcccagaccuccgacucccucgaggccauccucgacuuccucgacuucaaguccgacuccuccaucauccuccaggagcgcuuccucuacgccugcggcuucgccucccaccccaacgaggagcuccuccgcgcccucaucuccaaguucaagggcuccaucggcuccuccgacauccgcgagaccgucaugaucaucaccggcacccucguccgcaagcucugccagaacgagggcugcaagcucaaggccgucgucgaggccaagaagcucauccucggcggccucgagaaggccgagaagaaggaggacacccgcauguaccuccucgcccucaagaacgcccuccuccccgagggcauccccucccuccucaaguacgccgaggccggcgagggccccaucucccaccucgccaccaccgcccuccagcgcuacgaccuccccuucaucaccgacgaggucaagaagacccucaaccgcaucuaccaccagaaccgcaagguccacgagaagaccguccgcaccgccgccgccgccaucauccucaacaacaaccccuccuacauggacgucaagaacauccuccucuccaucggcgagcucccccaggagaugaacaaguacaugcucgccaucguccaggacauccuccgcuucgagaugcccgccuccaagaucguccgccgcguccucaaggagauggucgcccacaacuacgaccgcuucucccgcuccggcuccuccuccgccuacaccggcuacaucgagcgcuccccccgcuccgccuccaccuacucccucgacauccucuacuccggcuccggcauccuccgccgcuccaaccucaacaucuuccaguacaucggcaaggccggccuccacggcucccaggucgucaucgaggcccagggccucgaggcccucaucgccgccacccccgacgagggcgaggagaaccucgacuccuacgccggcauguccgccauccucuucgacguccagcuccgccccgucaccuucuucaacggcuacuccgaccucauguccaagaugcucuccgccuccggcgaccccaucuccgucgucaagggccucauccuccucaucgaccacucccaggagcuccagcuccaguccggccucaaggccaacaucgagguccagggcggccucgccaucgacaucuccggcgccauggaguucucccucugguaccgcgaguccaagacccgcgucaagaaccgcgucaccgucgucaucaccaccgacaucaccgucgacuccuccuucgucaaggccggccucgagaccuccaccgagaccgaggccggccucgaguucaucuccaccguccaguucucccaguaccccuuccucgucugcaugcagauggacaaggacgaggcccccuuccgccaguucgagaagaaguacgagcgccucuccaccggccgcggcuacgucucccagaagcgcaaggaguccguccucgccggcugcgaguucccccuccaccaggagaacuccgagaugugcaaggucgucuucgccccccagcccgacuccaccuccuccggcugguucuga

SEQ ID NO: 46264 - RNA, 396 nt, Artificial Sequence
  derived and/or modified sequence opt2 from MTURN__Homo_sapiens__NP_690006
auggacuuccagcagcucgccgacgucgccgagaaguggugcuccaacacccccuucgagcucaucgccaccgaggagaccgagcgccgcauggacuucuacgccgaccccggcgucuccuucuacguccucugccccgacaacggcugcggcgacaacuuccacgucugguccgaguccgaggacugccuccccuuccuccagcucgcccaggacuacaucuccuccugcggcaagaagacccuccacgagguccucgagaaggucuucaaguccuuccgcccccuccucggccuccccgacgccgacgacgacgccuucgaggaguacuccgccgacgucgaggaggaggagcccgaggccgaccacccccagaugggcgucucccagcaguga

SEQ ID NO: 46265 - RNA, 1554 nt, Artificial Sequence
  derived and/or modified sequence opt2 from MTUS1__Homo_sapiens__NP_001001931
augaccguccccggcggcuuccgcuccugcaccgagaccgacaucuccuccaagaucuucaucaacuccacccucaccccccccgccggcuccgagcgccacuacgacgccacccuccucacccuccucgucgucggcuccuacucccucugcaucaucccccuccucgccaccuucaccggcaagaagaccggcaacgccgccgucaucaaguacgaggagaagccccccaagcccgccuuccagaacggcuccuccggcuccuucuaccucaagccccucgucucccgcgcccacguccaccucaugaagaccccccccaagggccccucccgcaagaaccucuucaccgcccucaacgccgucgagaagucccgccagaagaacccccgcucccucugcauccagccccagaccgcccccgacgcccucccccccgagaagacccucgagcucacccaguacaagaccaagugcgagaaccaguccggcuucauccuccagcucaagcagcuccucgccugcggcaacaccaaguucgaggcccucaccgucgucauccagcaccuccucuccgagcgcgaggaggcccucaagcagcacaagacccucucccaggagcucgucaaccuccgcggcgagcucgucaccgccuccaccaccugcgagaagcucgagaaggcccgcaacgagcuccagaccgucuacgaggccuucguccagcagcaccaggccgagaagaccgagcgcgagaaccgccucaaggaguucuacacccgcgaguacgagaagcuccgcgacaccuacaucgaggaggccgagaaguacaagaugcagcuccaggagcaguucgacaaccucaacgccgcccacgagaccuccaagcucgagaucgaggccucccacuccgagaagcucgagcuccucaagaaggccuacgaggccucccucuccgagaucaagaagggccacgagaucgagaagaagucccucgaggaccuccucuccgagaagcaggagucccucgagaagcagaucaacgaccucaaguccgagaacgacgcccucaacgagaagcucaaguccgaggagcagaagcgccgcgcccgcgagaaggccaaccucaagaacccccagaucauguaccucgagcaggagcucgagucccucaaggccguccucgagaucaagaacgagaagcuccaccagcaggacaucaagcucaugaagauggagaagcucgucgacaacaacaccgcccucgucgacaagcucaagcgcuuccagcaggagaacgaggagcucaaggcccgcauggacaagcacauggccaucucccgccagcucuccaccgagcaggccguccuccaggagucccucgagaaggaguccaaggucaacaagcgccucuccauggagaacgaggagcuccucuggaagcuccacaacggcgaccucugcucccccaagcgcucccccaccuccuccgccaucccccuccaguccccccgcaacuccggcuccuuccccucccccuccaucuccccccgcuga

SEQ ID NO: 46266 - RNA, 4140 nt, Artificial Sequence
  derived and/or modified sequence opt2 from MTUS2__Homo_sapiens__NP_001028774
auggccuccucccccaccaagggccucaccauguccguccccgucgcccccaagaaguccugcuacacccagcuccgcgacaaccgcaacgccgcccgcaacaacaacgaguccauccucucccucggcgacaccaacgccaaccagaucaugcucgaggucuccuccucccacgacgaguccaagaccugcgaccucggcgacgagaucggcaacaccaacuccuccgagcccgagaaccgcacccacuuccacaaggaguuccaccagcuccagggcuucggcaagggcucccaggccggcuccgccucccucaaggacuuccgccucuccuccaccauccagcgcgagcucaacgaggagcacaccgucgagcgcggcaccgacucccuccagaccacccgcuccauccagggccccucccucuccuccuggcgcaacgucauguccgaggccucccucgacguccucgccaagcgcgacgccgagaucccccgccacguccccaaggacaagcucgccaagacccucgacaacgaggagcuccgccgccacucccucgagcgcgccuccuccuccgucgccgccgucggcucccucaccccccagcacccccagccccucucccucgacucccgcgaggcccgcggccagauccccggcggcggcgagggcccccagaagacccuccccgaccacgccguccccgccgccuuccccgccaccgacuccaccuccgagggcaaguccguccgccaccccaagcccuccaccuccgaguccaagcaguccacccccuccgagacccagaccgucggcgcccacguccuccaggucugcuccgagcacaccucccacuccgcccaccccgagcccgcccucaaccucacccucgccuccaaggagauccccuccaagcucgaggcccagcucggccagggcaagggcgaggccaagcucgaccucaaguacguccccccccgccgcgucgagcaggagggcaaggccgcccaggagggcuaccucggcugccacaaggaggagaaccucuccgcccucgagggccgcgaccccugcggcgaggcccaccccgaggccaccgacgcccucggccaccuccucaacuccgaccuccaccaccucggcgucggccgcggcaacugcgaggagaagcgcggcgucaaccccggcgagcaggacucccuccacaccacccccaagcagggcuccgccucccucggcggcgccgacaaccagcccaccggcaagaucucccccugcgccggcgagaagcucggcgagcgcaccuccuccuccuucucccccggcgacucccacgucgccuucauccccaacaaccucaccgacuccaagccccucgacgucaucgaggaggagcgccgccucggcuccggcaacaaggacuccgucaugguccucgucuucaaccccuccgucggcgagaacaagaccgagguccccgagccccucgacccccaguccggccgcuccgaggcccgcgaguccaaggaggucaccaccuccgucgccgagaaccgcaaccuccucgagaacgccgacaagaucgaguccaccuccgcccgcgccgacuccguccucaacauccccgccccccuccaccccgagaccaccgucaacaugaccuaccagcccaccacccccuccuccuccuuccaggacgucuccgucuucggcauggacgccggcuccccccucgucguccccccccccaccgacuccgcccgccuccucaacaccucccccaagguccccgacaagaacaccugccccuccggcauccccaagcccgucuucacccacuccaaggacacccccuccucccaggagggcauggagaacuaccaggucgagaagaccgaggagcgcaccgagaccaagcccaucaucaugcccaagcccaagcacguccgccccaagaucaucaccuacauccgccgcaacccccaggcccucggccaggucgacgccucccucguccccgucggccuccccuacgccccccccaccugcaccaugccccucccccacgaggagaaggccgccggcggcgaccucaagcccuccgccaaccucuacgagaaguucaagcccgaccuccagaagccccgcgucuucuccuccggccucauggucuccggcaucaagccccccggccaccccuucucccagauguccgagaaguuccuccaggaggucaccgaccaccccggcaaggaggaguucugcuccccccccuacgcccacuacgaggucccccccaccuucuaccgcuccgccaugcuccucaagccccagcucggccucggcgccaugucccgccuccccuccgccaagucccgcauccucaucgccucccagcgcuccuccgccuccgccauccacccccccggccccaucaccaccgccaccucccucuacuccuccgaccccuccgccgaccucaagaaggccuccuccuccaacgccgccaaguccaaccuccccaaguccggccuccgcccccccggcuacucccgccuccccgccgccaagcucgccgccuucggcuucguccgcuccuccuccgucuccuccgucuccuccacccaguccggcgacuccgcccagcccgagcagggccgccccgccacccgcuccaccuucggcaacgaggagcagcccguccucaaggccucccuccccuccaaggacacccccaagggcgccggccgcgucgccccccccgccuccuccuccgucaccgccccccgccgcucccuccuccccgcccccaaguccaccuccacccccgccggcaccaagaaggacgcccagaaggaccaggacaccaacaagcccgccgucuccucccccaagcgcgucgccgccuccaccaccaagcuccacucccccggcuaccccaagcagcgcaccgccgccgcccgcaacggcuucccccccaagcccgacccccaggcccgcgaggccgagcgccagcucguccuccgccucaaggagcgcugcgagcagcagacccgccagcucggcgucgcccagggcgagcucaagcgcgccaucugcggcuucgacgcccucgccgucgccacccagcacuucuuccgcaagaacgaguccgcccucgucaaggagaaggagcucuccaucgagcucgccaacauccgcgacgaggucgccuuccacaccgccaagugcgagaagcuccagaaggagaaggaggagcucgagcgccgcuucgaggacgaggucaagcgccucggcuggcagcagcaggccgagcuccaggagcucgaggagcgccuccagcuccaguucgaggccgagauggcccgccuccaggaggagcacggcgaccagcuccucuccauccgcugccagcaccaggagcaggucgaggaccucaccgccucccacgacgccgcccuccucgagauggagaacaaccacaccgucgccaucaccauccuccaggacgaccacgaccacaagguccaggagcucauguccacccacgagcucgagaagaaggagcucgaggagaacuucgagaagcuccgccucucccuccaggaccaggucgacacccucaccuuccagucccagucccuccgcgaccgcgcccgccgcuucgaggaggcccuccgcaagaacaccgaggagcagcucgagaucgcccucgcccccuaccagcaccucgaggaggacaugaagucccucaagcagguccucgagaugaagaaccagcagauccacgagcaggagaagaagauccucgagcucgagaagcucgccgagaagaacaucauccucgaggagaagauccagguccuccagcagcagaacgaggaccucaaggcccgcaucgaccagaacaccgucgucacccgccagcucuccgaggagaacgccaaccuccaggaguacgucgagaaggagacccaggagaagaagcgccucucccgcaccaacgaggagcuccucuggaagcuccagaccggcgaccccaccucccccaucaagcucucccccaccucccccgucuaccgcggcuccuccuccggccccuccucccccgcccgcgucuccaccaccccccgcuga

SEQ ID NO: 46267 - RNA, 1401 nt, Artificial Sequence
  derived and/or modified sequence opt2 from MTX1__Homo_sapiens__NP_002446
augcuccucggcggccccccccgcuccccccgcuccggcaccucccccaagggccccugguccuccaccggccacguccaguucggcaaguccccccagaccuggccccgccgcacccgcccccgcucccccgagcccgccgcccccuccggcguccgcggcuccaccuggacccgccgccgcgacuccccccgccgcgccggccccaccgcccucucccgcuacgucggccaccucuggaugggccgccgcccccccucccccgaggcccgcggccccgucccccgcuccuccgccgccucccgcgcccgccgcucccucgccucccccggcaucucccccggcccccucaccgccaccaucggcggcgccgucgccggcggcggcccccgccagggccgcgccgaggcccacaaggaggucuuccccggccagcgcgucggcaagauggccgcccccauggagcucuucugcugguccggcggcuggggccuccccuccgucgaccucgacucccucgccguccucaccuacgcccgcuucaccggcgccccccucaagguccacaagaucuccaaccccuggcagucccccuccggcacccuccccgcccuccgcaccucccacggcgaggucaucuccgucccccacaagaucaucacccaccuccgcaaggagaaguacaacgccgacuacgaccucuccgcccgccagggcgccgacacccucgccuucaugucccuccucgaggagaagcuccuccccguccucguccacaccuucuggaucgacaccaagaacuacgucgaggucacccgcaagugguacgccgaggccaugcccuucccccucaacuucuuccuccccggccgcaugcagcgccaguacauggagcgccuccagcuccucaccggcgagcaccgccccgaggacgaggaggagcucgagaaggagcucuaccgcgaggcccgcgagugccucacccuccucucccagcgccucggcucccagaaguucuucuucggcgacgcccccgccucccucgacgccuucgucuucuccuaccucgcccuccuccuccaggccaagcuccccuccggcaagcuccagguccaccuccgcggccuccacaaccucugcgccuacugcacccacauccucucccucuacuuccccugggacggcgccgagguccccccccagcgccagacccccgccggccccgagaccgaggaggagcccuaccgccgccgcaaccagauccucuccguccucgccggccucgccgccauggucggcuacgcccuccucuccggcaucgucuccauccagcgcgccacccccgcccgcgcccccggcacccgcacccucggcauggccgaggaggacgaggaggaguga

SEQ ID NO: 46268 - RNA, 792 nt, Artificial Sequence
  derived and/or modified sequence opt2 from MTX2__Homo_sapiens__NP_006545
augucccucgucgccgaggccuucgucucccagaucgccgccgccgagcccuggcccgagaacgccacccucuaccagcagcucaagggcgagcagauccuccucuccgacaacgccgccucccucgccguccaggccuuccuccagaugugcaaccuccccaucaaggucgucugccgcgccaacgccgaguacaugucccccuccggcaagguccccuucauccacgucggcaaccaggucgucuccgagcucggccccaucguccaguucgucaaggccaagggccacucccucuccgacggccucgaggagguccagaaggccgagaugaaggccuacauggagcucgucaacaacaugcuccucaccgccgagcucuaccuccaguggugcgacgaggccaccgucggcgagaucacccacgcccgcuacggcucccccuaccccuggccccucaaccacauccucgccuaccagaagcagugggaggucaagcgcaagaugaaggccaucggcuggggcaagaagacccucgaccagguccucgaggacgucgaccagugcugccaggcccucucccagcgccucggcacccagcccuacuucuucaacaagcagcccaccgagcucgacgcccucgucuucggccaccucuacaccauccucaccacccagcucaccaacgacgagcucuccgagaaggucaagaacuacuccaaccuccucgccuucugccgccgcaucgagcagcacuacuucgaggaccgcggcaagggccgccucuccuga

SEQ ID NO: 46269 - RNA, 16008 nt, Artificial Sequence
  derived and/or modified sequence opt2 from MUC12__Homo_sapiens__NP_001157934
augcucgucaucuggauccucacccucgcccuccgccucugcgccuccgucaccaccgucacccccggcuccaccgucaacaccuccaucggcggcaacaccaccuccgccuccacccccuccuccuccgaccccuucaccaccuucuccgacuacggcgucuccgucaccuucaucaccggcuccaccgccaccaagcacuuccucgacuccuccaccaacuccggccacuccgaggaguccaccgucucccacuccggccccggcgccaccggcaccacccucuuccccucccacuccgccaccuccgucuucgucggcgagcccaagaccucccccaucaccuccgccuccauggagaccaccgcccuccccggcuccaccaccaccgccggccucuccgagaaguccaccaccuucuacuccuccccccgcucccccgaccgcacccucucccccgcccgcaccaccuccuccggcgucuccgagaaguccaccaccucccacucccgccccggccccacccacaccaucgccuuccccgacuccaccaccaugcccggcgucucccaggaguccaccgccucccacuccauccccggcuccaccgacaccacccucucccccggcaccaccacccccuccucccucggccccgaguccaccaccuuccacuccucccccggcuacaccaagaccacccgccuccccgacaacaccaccaccuccggccuccucgaggccuccacccccguccacuccuccaccggcuccccccacaccacccucucccccuccuccuccaccacccacgagggcgagcccaccaccuuccaguccuggcccuccuccaaggacaccucccccgcccccuccggcaccaccuccgccuucgucaagcucuccaccaccuaccacuccucccccuccuccacccccaccacccacuucuccgccuccuccaccacccucggccacuccgaggaguccacccccguccacuccucccccgucgccaccgccaccacccccccccccgcccgcuccgccaccuccggccacgucgaggaguccaccgccuaccaccgcucccccggcuccacccagaccaugcacuuccccgaguccuccaccaccuccggccacuccgaggaguccgccaccuuccacggcuccaccacccacaccaaguccuccacccccuccaccaccgccgcccucgcccacaccuccuaccacuccucccucggcuccaccgagaccacccacuuccgcgacuccuccaccaucuccggccgcuccgaggaguccaaggccucccacuccucccccgacgccauggccaccaccguccuccccgccggcuccacccccuccguccucgucggcgacuccacccccucccccaucuccuccggcuccauggagaccaccgcccuccccggcuccaccaccaagcccggccucuccgagaaguccaccaccuucuacuccuccccccgcucccccgacaccacccaccuccccgccuccaugaccuccuccggcgucuccgaggaguccaccaccucccacucccgccccggcuccacccacaccaccgccuuccccggcuccaccaccaugcccggccucucccaggaguccaccgccucccacuccucccccggccccaccgacaccacccucucccccggcuccaccaccgccuccucccucggccccgaguacaccaccuuccacucccgccccggcuccaccgagaccacccuccuccccgacaacaccaccgccuccggccuccucgaggccuccaugcccguccacuccuccacccgcuccccccacaccacccucucccccgccggcuccaccacccgccagggcgaguccaccaccuuccacuccuggcccuccuccaaggacacccgccccgccccccccaccaccaccuccgccuucgucgagcccuccaccaccucccacggcucccccuccuccauccccaccacccacaucuccgcccgcuccaccaccuccggccucgucgaggaguccaccaccuaccacuccucccccggcuccacccagaccaugcacuuccccgaguccgacaccaccuccggccgcggcgaggaguccaccaccucccacuccuccaccacccacaccaucuccuccgcccccuccaccaccuccgcccucgucgaggagcccaccuccuaccacuccucccccggcuccaccgccaccacccacuuccccgacuccuccaccaccuccggccgcuccgaggaguccaccgccucccacuccucccaggacgccaccggcaccaucguccuccccgcccgcuccaccaccuccguccuccucggcgaguccaccaccucccccaucuccuccggcuccauggagaccaccgcccuccccggcuccaccaccacccccggccucuccgagcgcuccaccaccuuccacuccuccccccgcucccccgccaccacccucucccccgccuccaccaccuccuccggcgucuccgaggaguccaccaccucccgcucccgccccggcuccacccacaccaccgccuuccccgacuccaccaccacccccggccucucccgccacuccaccaccucccacuccucccccggcuccaccgacaccacccuccuccccgccuccaccaccaccuccggccccucccaggaguccaccaccucccacuccuccuccggcuccaccgacaccgcccucucccccggcuccaccaccgcccucuccuucggccaggaguccaccaccuuccacuccaaccccggcuccacccacaccacccucuuccccgacuccaccaccuccuccggcaucgucgaggccuccacccgcguccacuccuccaccggcuccccccgcaccacccucucccccgccuccuccaccucccccggccuccagggcgaguccaccgccuuccagacccaccccgccuccacccacaccacccccuccccccccuccaccgccaccgcccccgucgaggaguccaccaccuaccaccgcucccccggcuccacccccaccacccacuuccccgccuccuccaccaccuccggccacuccgagaaguccaccaucuuccacuccucccccgacgccuccggcaccacccccuccuccgcccacuccaccaccuccggccgcggcgaguccaccaccucccgcaucucccccggcuccaccgagaucaccacccuccccggcuccaccaccacccccggccucuccgaggccuccaccaccuucuacuccuccccccgcucccccaccaccacccucucccccgccuccaugaccucccucggcgucggcgaggaguccaccaccucccgcucccagcccggcuccacccacuccaccgucucccccgccuccaccaccacccccggccucuccgaggaguccaccaccgucuacuccuccucccgcggcuccaccgagaccaccgucuucccccacuccaccaccaccuccguccacggcgaggagcccaccaccuuccacucccgccccgccuccacccacaccacccucuucaccgaggacuccaccaccuccggccucaccgaggaguccaccgccuuccccggcucccccgccuccacccagaccggccuccccgccacccucaccaccgccgaccucggcgaggaguccaccaccuuccccuccuccuccggcuccaccggcaccaagcucucccccgcccgcuccaccaccuccggccucgucggcgaguccacccccucccgccucucccccuccuccaccgagaccaccacccuccccggcucccccaccacccccucccucuccgagaaguccaccaccuucuacaccuccccccgcucccccgacgccacccucucccccgccaccaccaccuccuccggcgucuccgaggaguccuccaccucccacucccagcccggcuccacccacaccaccgccuuccccgacuccaccaccaccuccgaccucucccaggagcccaccaccucccacuccucccagggcuccaccgaggccacccucucccccggcuccaccaccgccuccucccucggccagcaguccaccaccuuccacuccucccccggcgacaccgagaccacccuccuccccgacgacaccaucaccuccggccucgucgaggccuccacccccacccacuccuccaccggcucccuccacaccacccucacccccgccuccuccaccuccgccggccuccaggaggaguccaccaccuuccaguccuggcccuccuccuccgacaccacccccuccccccccggcaccaccgccgcccccgucgaggucuccaccaccuaccacucccgccccuccuccacccccaccacccacuucuccgccuccuccaccacccucggccgcuccgaggaguccaccaccguccacuccucccccggcgccaccggcaccgcccucuuccccacccgcuccgccaccuccguccucgucggcgagcccaccaccucccccaucuccuccggcuccaccgagaccaccgcccuccccggcuccaccaccaccgccggccucuccgagaaguccaccaccuucuacuccuccccccgcucccccgacaccacccucucccccgccuccaccaccuccuccggcgucuccgaggaguccaccaccucccacucccgccccggcuccacccacaccaccgccuuccccggcuccaccaccaugcccggcgucucccaggaguccaccgccucccacuccucccccggcuccaccgacaccacccucucccccggcuccaccaccgccuccucccucggccccgaguccaccaccuuccacuccucccccggcuccaccgagaccacccuccuccccgacaacaccaccgccuccggccuccucgaggccuccacccccguccacuccuccaccggcuccccccacaccacccucucccccgccggcuccaccacccgccagggcgaguccaccaccuuccaguccuggcccuccuccaaggacaccaugcccgccccccccaccaccaccuccgccuucgucgagcucuccaccaccucccacggcucccccuccuccacccccaccacccacuucuccgccuccuccaccacccucggccgcuccgaggaguccaccaccguccacuccucccccgucgccaccgccaccacccccucccccgcccgcuccaccaccuccggccucgucgaggaguccaccgccuaccacuccucccccggcuccacccagaccaugcacuuccccgaguccuccaccgccuccggccgcuccgaggagucccgcaccucccacuccuccaccacccacaccaucuccuccccccccuccaccaccuccgcccucgucgaggagcccaccuccuaccacuccucccccggcuccaccgccaccacccacuuccccgacuccuccaccaccuccggccgcuccgaggaguccaccgccucccacuccucccaggacgccaccggcaccaucguccuccccgcccgcuccaccaccuccguccuccucggcgaguccaccaccucccccaucuccuccggcuccauggagaccaccgcccuccccggcuccaccaccacccccggccucuccgagaaguccaccaccuuccacuccuccccccgcucccccgccaccacccucucccccgccuccaccaccuccuccggcgucuccgaggaguccaccaccucccacucccgccccggcuccacccacaccaccgccuuccccgacuccaccaccacccccggccucucccgccacuccaccaccucccacuccucccccggcuccaccgacaccacccuccuccccgccuccaccaccaccuccggccccucccaggaguccaccaccucccacuccucccccggcuccaccgacaccgcccucucccccggcuccaccaccgcccucuccuucggccaggaguccaccaccuuccacuccucccccggcuccacccacaccacccucuuccccgacuccaccaccuccuccggcaucgucgaggccuccacccgcguccacuccuccaccggcuccccccgcaccacccucucccccgccuccuccaccucccccggccuccagggcgaguccaccgccuuccagacccaccccgccuccacccacaccacccccuccccccccuccaccgccaccgcccccgucgaggaguccaccaccuaccaccgcucccccggcuccacccccaccacccacuuccccgccuccuccaccaccuccggccacuccgagaaguccaccaucuuccacuccucccccgacgccuccggcaccacccccuccuccgcccacuccaccaccuccggccgcggcgaguccaccaccucccgcaucucccccggcuccaccgagaucaccacccuccccggcuccaccaccacccccggccucuccgaggccuccaccaccuucuacuccuccccccgcucccccaccaccacccucucccccgccuccaugaccucccucggcgucggcgaggaguccaccaccucccgcucccagcccggcuccacccacuccaccgucucccccgccuccaccaccacccccggccucuccgaggaguccaccaccgucuacuccuccucccccggcuccaccgagaccaccgucuucccccgcacccccaccaccuccguccgcggcgaggagcccaccaccuuccacucccgccccgccuccacccacaccacccucuucaccgaggacuccaccaccuccggccucaccgaggaguccaccgccuuccccggcucccccgccuccacccagaccggccuccccgccacccucaccaccgccgaccucggcgaggaguccaccaccuuccccuccuccuccggcuccaccggcaccacccucucccccgcccgcuccaccaccuccggccucgucggcgaguccacccccucccgccucucccccuccuccaccgagaccaccacccuccccggcucccccaccacccccucccucuccgagaaguccaccaccuucuacaccuccccccgcucccccgacgccacccucucccccgccaccaccaccuccuccggcgucuccgaggaguccuccaccucccacucccagcccggcuccacccacaccaccgccuuccccgacuccaccaccacccccggccucucccgccacuccaccaccucccacuccucccccggcuccaccgacaccacccuccuccccgccuccaccaccaccuccggccccucccaggaguccaccaccucccacuccucccccggcuccaccgacaccgcccucucccccggcuccaccaccgcccucuccuucggccaggaguccaccaccuuccacuccucccccggcuccacccacaccacccucuuccccgacuccaccaccuccuccggcaucgucgaggccuccacccgcguccacuccuccaccggcuccccccgcaccacccucucccccgccuccuccaccucccccggccuccagggcgaguccaccaccuuccagacccaccccgccuccacccacaccacccccuccccccccuccaccgccaccgcccccgucgaggaguccaccaccuaccaccgcucccccggcuccacccccaccacccacuuccccgccuccuccaccaccuccggccacuccgagaaguccaccaucuuccacuccucccccgacgccuccggcaccacccccuccuccgcccacuccaccaccuccggccgcggcgaguccaccaccucccgcaucucccccggcuccaccgagaucaccacccuccccggcuccaccaccacccccggccucuccgaggccuccaccaccuucuacuccuccccccgcucccccaccaccacccucucccccgccuccaugaccucccucggcgucggcgaggaguccaccaccucccgcucccagcccggcuccacccacuccaccgucucccccgccuccaccaccacccccggccucuccgaggaguccaccaccgucuacuccuccucccccggcuccaccgagaccaccgucuucccccgcuccaccaccaccuccguccgcggcgaggagcccaccaccuuccacucccgccccgccuccacccacaccacccucuucaccgaggacuccaccaccuccggccucaccgaggaguccaccgccuuccccggcucccccgccuccacccagaccggccuccccgccacccucaccaccgccgaccucggcgaggaguccaccaccuuccccuccuccuccggcuccaccggcaccacccucucccccgcccgcuccaccaccuccggccucgucggcgaguccacccccucccgccucucccccuccuccaccgagaccaccacccuccccggcucccccaccacccccucccucuccgagaaguccaccaccuucuacaccuccccccgcucccccgacgccacccucucccccgccaccaccaccuccuccggcgucuccgaggaguccuccaccucccacucccagcccggcuccacccacaccaccgccuuccccgacuccaccaccaccuccggccucucccaggagcccaccgccucccacuccucccagggcuccaccgaggccacccucucccccggcuccaccaccgccuccucccucggccagcaguccaccaccuuccacuccucccccggcgacaccgagaccacccuccuccccgacgacaccaucaccuccggccucgucgaggccuccacccccacccacuccuccaccggcucccuccacaccacccucacccccgccuccuccaccuccgccggccuccaggaggaguccaccaccuuccaguccuggcccuccuccuccgacaccacccccuccccccccggcaccaccgccgcccccgucgaggucuccaccaccuaccacucccgccccuccuccacccccaccacccacuucuccgccuccuccaccacccucggccgcuccgaggaguccaccaccguccacuccucccccggcgccaccggcaccgcccucuuccccacccgcuccgccaccuccguccucgucggcgagcccaccaccucccccaucuccuccggcuccaccgagaccaccgcccuccccggcuccaccaccaccgccggccucuccgagaaguccaccaccuucuacuccuccccccgcucccccgacaccacccucucccccgccuccaccaccuccuccggcgucuccgaggaguccaccaccucccacucccgccccggcuccacccacaccaccgccuuccccggcuccaccaccaugcccggcgucucccaggaguccaccgccucccacuccucccccggcuccaccgacaccacccucucccccggcuccaccaccgccuccucccucggccccgaguccaccaccuuccacuccggccccggcuccaccgagaccacccuccuccccgacaacaccaccgccuccggccuccucgaggccuccacccccguccacuccuccaccggcuccccccacaccacccucucccccgccggcuccaccacccgccagggcgaguccaccaccuuccaguccuggcccaacuccaaggacaccacccccgccccccccaccaccaccuccgccuucgucgagcucuccaccaccucccacggcucccccuccuccacccccaccacccacuucuccgccuccuccaccacccucggccgcuccgaggaguccaccaccguccacuccucccccgucgccaccgccaccacccccucccccgcccgcuccaccaccuccggccucgucgaggaguccaccaccuaccacuccucccccggcuccacccagaccaugcacuuccccgaguccgacaccaccuccggccgcggcgaggaguccaccaccucccacuccuccaccacccacaccaucuccuccgcccccuccaccaccuccgcccucgucgaggagcccaccuccuaccacuccucccccggcuccaccgccaccacccacuuccccgacuccuccaccaccuccggccgcuccgaggaguccaccgccucccacuccucccaggacgccaccggcaccaucguccuccccgcccgcuccaccaccuccguccuccucggcgaguccaccaccucccccaucuccuccggcuccauggagaccaccgcccuccccggcuccaccaccacccccggccucuccgagaaguccaccaccuuccacuccuccccccgcucccccgccaccacccucucccccgccuccaccaccuccuccggcgucuccgaggaguccaccaccucccacucccgccccggcuccacccacaccaccgccuuccccgacuccaccaccacccccggccucucccgccacuccaccaccucccacuccucccccggcuccaccgacaccacccuccuccccgccuccaccaccaccuccggcuccucccaggaguccaccaccucccacuccuccuccggcuccaccgacaccgcccucucccccggcuccaccaccgcccucuccuucggccaggaguccaccaccuuccacuccucccccggcuccacccacaccacccucuuccccgacuccaccaccuccuccggcaucgucgaggccuccacccgcguccacuccuccaccggcuccccccgcaccacccucucccccgccuccuccaccucccccggccuccagggcgaguccaccgccuuccagacccaccccgccuccacccacaccacccccuccccccccuccaccgccaccgcccccgucgaggaguccaccaccuaccaccgcucccccggcuccacccccaccacccacuuccccgccuccuccaccaccuccggccacuccgagaaguccaccaucuuccacuccucccccgacgccuccggcaccacccccuccuccgcccacuccaccaccuccggccgcggcgaguccaccaccucccgcaucucccccggcuccaccgagaucaccacccuccccggcuccaccaccacccccggccucuccgaggccuccaccaccuucuacuccuccccccgcucccccaccaccacccucucccccgccuccaugaccucccucggcgucggcgaggaguccaccaccucccgcucccagcccggcuccacccacuccaccgucucccccgccuccaccaccacccccggccucuccgaggaguccaccaccgucuacuccuccucccccggcuccaccgagaccaccgucuucccccgcuccaccaccaccuccguccgccgcgaggagcccaccaccuuccacucccgccccgccuccacccacaccacccucuucaccgaggacuccaccaccuccggccucaccgaggaguccaccgccuuccccggcucccccgccuccacccagaccggccuccccgccacccucaccaccgccgaccucggcgaggaguccaccaccuuccccuccuccuccggcuccaccggcaccaagcucucccccgcccgcuccaccaccuccggccucgucggcgaguccacccccucccgccucucccccuccuccaccgagaccaccacccuccccggcucccccaccacccccucccucuccgagaaguccaccaccuucuacaccuccccccgcucccccgacgccacccucucccccgccaccaccaccuccuccggcgucuccgaggaguccuccaccucccacucccagcccggcuccacccacaccaccgccuuccccgacuccaccaccaccuccggccucucccaggagcccaccaccucccacuccucccagggcuccaccgaggccacccucucccccggcuccaccaccgccuccucccucggccagcaguccaccaccuuccacuccucccccggcgacaccgagaccacccuccuccccgacgacaccaucaccuccggccucgucgaggccuccacccccacccacuccuccaccggcucccuccacaccacccucacccccgccuccuccaccuccaccggccuccaggaggaguccaccaccuuccaguccuggcccuccuccuccgacaccacccccuccccccccuccaccaccgccguccccgucgaggucuccaccaccuaccacucccgccccuccuccacccccaccacccacuucuccgccuccuccaccacccucggccgcuccgaggaguccaccaccguccacuccucccccggcgccaccggcaccgcccucuuccccacccgcuccgccaccuccguccucgucggcgagcccaccaccucccccaucuccuccggcuccaccgagaccaccgcccuccccggcuccaccaccaccgccggccucuccgagaaguccaccaccuucuacuccuccccccgcucccccgacaccacccucucccccgccuccaccaccuccuccggcgucuccgaggaguccaccaccucccacucccgccccggcuccaugcacaccaccgccuuccccuccuccaccaccaugcccggcgucucccaggaguccaccgccucccacuccucccccggcuccaccgacaccacccucucccccggcuccaccaccgccuccucccucggccccgaguccaccaccuuccacuccucccccggcuccaccgagaccacccuccuccccgacaacaccaccgccuccggccuccucgaggccuccacccccguccacuccuccaccggcuccccccacaccacccucucccccgccggcuccaccacccgccagggcgaguccaccaccuuccaguccuggcccaacuccaaggacaccacccccgccccccccaccaccaccuccgccuucgucgagcucuccaccaccucccacggcucccccuccuccacccccaccacccacuucuccgccuccuccaccacccucggccgcuccgaggaguccaccaccguccacuccucccccgucgccaccgccaccacccccucccccgcccgcuccaccaccuccggccucgucgaggaguccaccaccuaccacuccucccccggcuccacccagaccaugcacuuccccgaguccaacaccaccuccggccgcggcgaggaguccaccaccucccacuccuccaccacccacaccaucuccuccgcccccuccaccaccuccgcccucgucgaggagcccaccuccuaccacuccucccccggcuccaccgccaccacccacuuccccgacuccuccaccaccuccggccgcuccgaggaguccaccgccucccacuccucccaggacgccaccggcaccaucguccuccccgcccgcuccaccaccuccguccuccucggcgaguccaccaccucccccaucuccuccggcuccauggagaccaccgcccuccccggcuccaccaccacccccggccucuccgagaaguccaccaccuuccacuccucccccuccuccacccccaccacccacuucuccgccuccuccaccacccucggccgcuccgaggaguccaccaccguccacuccucccccgucgccaccgccaccacccccucccccgcccgcuccaccaccuccggccucgucgaggaguccaccgccuaccacuccucccccggcuccacccagaccaugcacuuccccgaguccuccaccgccuccggccgcuccgaggagucccgcaccucccacuccuccaccacccacaccaucuccuccccccccuccaccaccuccgcccucgucgaggagcccaccuccuaccacuccucccccggcuccaucgccaccacccacuuccccgaguccuccaccaccuccggccgcuccgaggaguccaccgccucccacuccucccccgacaccaacggcaucaccccccuccccgcccacuucaccaccuccggccgcaucgccgaguccaccaccuucuacaucucccccggcuccauggagaccacccucgccuccaccgccaccacccccggccucuccgccaaguccaccauccucuacuccuccucccgcucccccgaccagacccucucccccgccuccaugaccuccuccuccaucuccggcgagcccaccucccucuacucccaggccgaguccacccacaccaccgccuuccccgccuccaccaccaccuccggccucucccaggaguccaccaccuuccacuccaagcccggcuccaccgagaccacccucucccccggcuccaucaccaccuccuccuucgcccaggaguucaccaccccccacucccagcccggcuccgcccucuccaccgucucccccgccuccaccaccguccccggccucuccgaggaguccaccaccuucuacuccucccccggcuccaccgagaccaccgccuucucccacuccaacaccauguccauccacucccagcaguccacccccuuccccgacucccccggcuucacccacaccguccuccccgccacccucaccaccaccgacaucggccaggaguccaccgccuuccacuccuccuccgacgccaccggcaccaccccccuccccgcccgcuccaccgccuccgaccucgucggcgagcccaccaccuucuacaucucccccucccccaccuacaccacccucuuccccgccuccuccuccaccuccggccucaccgaggaguccaccaccuuccacaccucccccuccuucaccuccaccaucgucuccaccgagucccucgagacccucgcccccggccucugccaggagggccagaucuggaacggcaagcagugcgucugcccccagggcuacgucggcuaccagugccucuccccccucgaguccuuccccgucgagacccccgagaagcucaacgccacccucggcaugaccgucaaggucaccuaccgcaacuucaccgagaagaugaacgacgccuccucccaggaguaccagaacuucuccacccucuucaagaaccgcauggacgucguccucaagggcgacaaccucccccaguaccgcggcgucaacauccgccgccuccucaacggcuccaucgucgucaagaacgacgucauccucgaggccgacuacacccucgaguacgaggagcucuucgagaaccucgccgagaucgucaaggccaagaucaugaacgagacccgcaccacccuccucgaccccgacuccugccgcaaggccauccucugcuacuccgaggaggacaccuucgucgacuccuccgucacccccggcuucgacuuccaggagcagugcacccagaaggccgccgagggcuacacccaguucuacuacgucgacguccucgacggcaagcucgccugcgucaacaagugcaccaagggcaccaagucccagaugaacugcaaccucggcaccugccagcuccagcgcuccggcccccgcugccucugccccaacaccaacacccacugguacuggggcgagaccugcgaguucaacaucgccaagucccucgucuacggcaucgucggcgccgucauggccguccuccuccucgcccucaucauccucaucauccucuucucccucucccagcgcaagcgccaccgcgagcaguacgacgucccccaggaguggcgcaaggagggcacccccggcaucuuccagaagaccgccaucugggaggaccagaaccuccgcgagucccgcuucggccucgagaacgccuacaacaacuuccgccccacccucgagaccgucgacuccggcaccgagcuccacauccagcgccccgagauggucgccuccaccgucuga

SEQ ID NO: 46270 - RNA, 1539 nt, Artificial Sequence
  derived and/or modified sequence opt2 from MUC13__Homo_sapiens__NP_149038
augaaggccaucauccaccucacccuccucgcccuccucuccgucaacaccgccaccaaccagggcaacuccgccgacgccgucaccaccaccgagaccgccaccuccggccccaccgucgccgccgccgacaccaccgagaccaacuuccccgagaccgccuccaccaccgccaacacccccuccuuccccaccgccaccucccccgccccccccaucaucuccacccacuccuccuccaccauccccacccccgccccccccaucaucuccacccacuccuccuccaccauccccauccccaccgccgccgacuccgaguccaccaccaacgucaacucccucgccaccuccgacaucaucaccgccuccucccccaacgacggccucaucaccaugguccccuccgagacccaguccaacaacgagaugucccccaccaccgaggacaaccaguccuccggcccccccaccggcaccgcccuccucgagaccuccacccucaacuccaccggccccuccaaccccugccaggacgaccccugcgccgacaacucccucugcgucaagcuccacaacaccuccuucugccucugccucgagggcuacuacuacaacuccuccaccugcaagaagggcaaggucuuccccggcaagaucuccgucaccgucuccgagaccuucgaccccgaggagaagcacuccauggccuaccaggaccuccacuccgagaucaccucccucuucaaggacgucuucggcaccuccgucuacggccagaccgucauccucaccgucuccaccucccucuccccccgcuccgagaugcgcgccgacgacaaguucgucaacgucaccaucgucaccauccucgccgagaccaccuccgacaacgagaagaccgucaccgagaagaucaacaaggccauccgcuccuccuccuccaacuuccucaacuacgaccucacccuccgcugcgacuacuacggcugcaaccagaccgccgacgacugccucaacggccucgccugcgacugcaaguccgaccuccagcgccccaacccccagucccccuucugcgucgccuccucccucaagugccccgacgccugcaacgcccagcacaagcagugccucaucaagaaguccggcggcgcccccgagugcgccugcguccccggcuaccaggaggacgccaacggcaacugccagaagugcgccuucggcuacuccggccucgacugcaaggacaaguuccagcucauccucaccaucgucggcaccaucgccggcaucgucauccucuccaugaucaucgcccucaucgucaccgcccgcuccaacaacaagaccaagcacaucgaggaggagaaccucaucgacgaggacuuccagaaccucaagcuccgcuccaccggcuucaccaaccucggcgccgagggcuccgucuuccccaagguccgcaucaccgccucccgcgacucccagaugcagaaccccuacucccgccacuccuccaugccccgccccgacuacuga

SEQ ID NO: 46271 - RNA, 1086 nt, Artificial Sequence
  derived and/or modified sequence opt2 from MUC15__Homo_sapiens__NP_001128563
augggcaucauccaguccauccucgccaccucccgcgacugcuacuccuucaagaagaagcccauccccaagaagcccaccaugcucgcccucgccaagauccuccucaucuccacccucuucuacucccuccucuccggcucccacggcaaggagaaccaggacaucaacaccacccagaacaucgccgaggucuucaagaccauggagaacaagcccaucucccucgaguccgaggccaaccucaacuccgacaaggagaacaucaccaccuccaaccucaaggccucccacucccccccccucaaccuccccaacaacucccacggcaucaccgacuucuccuccaacuccuccgccgagcacucccucggcucccucaagcccaccuccaccaucuccaccucccccccccucauccacuccuucgucuccaagguccccuggaacgcccccaucgccgacgaggaccuccuccccaucuccgcccaccccaacgccacccccgcccucuccuccgagaacuucaccuggucccucgucaacgacaccgucaagacccccgacaacuccuccaucaccgucuccauccucuccuccgagcccaccucccccuccgucaccccccucaucgucgagcccuccggcuggcucaccaccaacuccgacuccuucaccggcuucacccccuaccaggagaagaccacccuccagcccacccucaaguucaccaacaacuccaagcucuuccccaacaccuccgacccccagaaggagaaccgcaacaccggcaucgucuucggcgccauccucggcgccauccucggcgucucccuccucacccucgucggcuaccuccucugcggcaagcgcaagaccgacuccuucucccaccgccgccucuacgacgaccgcaacgagcccguccuccgccucgacaacgcccccgagcccuacgacgucuccuucggcaacuccuccuacuacaaccccacccucaacgacuccgccaugcccgaguccgaggagaacgcccgcgacggcauccccauggacgacauccccccccuccgcaccuccgucuga

SEQ ID NO: 46272 - RNA, 13482 nt, Artificial Sequence
  derived and/or modified sequence opt2 from MUC17__Homo_sapiens__NP_001035194
augccccgccccggcaccauggcccucugccuccucacccucguccucucccuccuccccccccaggccgccgccgagcaggaccucuccgucaaccgcgccgucugggacggcggcggcugcaucucccagggcgacguccucaaccgccagugccagcagcucucccagcacguccgcaccggcuccgccgccaacaccgccaccggcaccaccuccaccaacgucgucgagccccgcauguaccucuccugcuccaccaaccccgagaugaccuccaucgaguccuccgucaccuccgacacccccggcgucuccuccacccgcaugacccccaccgagucccgcaccaccuccgaguccaccuccgacuccaccacccucuuccccuccuccaccgaggacaccuccucccccaccacccccgagggcaccgacguccccauguccacccccuccgaggaguccaucuccuccaccauggccuucgucuccaccgccccccuccccuccuucgaggccuacaccucccucaccuacaaggucgacauguccaccccccucaccaccuccacccaggccuccuccucccccaccacccccgaguccaccaccauccccaaguccaccaacuccgagggcuccaccccccucaccuccaugcccgccuccaccaugaaggucgccuccuccgaggccaucacccuccucaccacccccgucgagaucuccacccccgucaccaucuccgcccaggccuccuccucccccaccaccgccgagggccccucccucuccaacuccgcccccuccggcggcuccaccccccucacccgcaugccccucuccgucaugcucgucgucuccuccgaggccuccacccucuccaccacccccgccgccaccaacauccccgucaucaccuccaccgaggccuccuccucccccaccaccgccgagggcaccuccauccccaccuccaccuacaccgagggcuccaccccccucaccuccacccccgccuccaccaugcccgucgccaccuccgagauguccacccucuccaucacccccgucgacaccuccacccucgucaccaccuccaccgagcccuccucccuccccaccaccgccgaggccaccuccaugcucaccuccacccucuccgagggcuccaccccccucaccaacaugcccgucuccaccauccucgucgccuccuccgaggccuccaccaccuccaccauccccgucgacuccaagaccuucgucaccaccgccuccgaggccuccuccucccccaccaccgccgaggacaccuccaucgccaccuccacccccuccgagggcuccaccccccucaccuccaugcccgucuccaccacccccgucgccuccuccgaggccuccaaccucuccaccacccccgucgacuccaagacccaggucaccaccuccaccgaggccuccuccuccccccccaccgccgaggucaacuccaugcccaccuccacccccuccgagggcuccaccccccucaccuccauguccgucuccaccaugcccgucgccuccuccgaggccuccacccucuccaccacccccgucgacaccuccacccccgucaccaccuccuccgaggccuccuccuccuccaccacccccgagggcaccuccauccccaccuccacccccuccgagggcuccaccccccucaccaacaugcccgucuccacccgccucgucgucuccuccgaggccuccaccaccuccaccacccccgccgacuccaacaccuucgucaccaccuccuccgaggccuccuccuccuccaccaccgccgagggcaccuccaugcccaccuccaccuacuccgagcgcggcaccaccaucaccuccauguccgucuccaccacccucgucgccuccuccgaggccuccacccucuccaccacccccgucgacuccaacacccccgucaccaccuccaccgaggccaccuccuccuccaccaccgccgagggcaccuccaugcccaccuccaccuacaccgagggcuccaccccccucaccuccaugcccgucaacaccacccucgucgccuccuccgaggccuccacccucuccaccacccccgucgacaccuccacccccgucaccaccuccaccgaggccuccuccucccccaccaccgccgacggcgccuccaugcccaccuccacccccuccgagggcuccaccccccucaccuccaugcccgucuccaagacccuccucaccuccuccgaggccuccacccucuccaccaccccccucgacaccuccacccacaucaccaccuccaccgaggccuccugcucccccaccaccaccgagggcaccuccaugcccaucuccacccccuccgagggcuccccccuccucaccuccauccccgucuccaucacccccgucaccucccccgaggccuccacccucuccaccacccccgucgacuccaacucccccgucaccaccuccaccgaggucuccuccucccccacccccgccgagggcaccuccaugcccaccuccaccuacuccgagggccgcaccccccucaccuccaugcccgucuccaccacccucgucgccaccuccgccaucuccacccucuccaccacccccgucgacaccuccacccccgucaccaacuccaccgaggcccgcuccucccccaccaccuccgagggcaccuccaugcccaccuccacccccggcgagggcuccaccccccucaccuccaugcccgacuccaccacccccgucgucuccuccgaggcccgcacccucuccgccacccccgucgacaccuccacccccgucaccaccuccaccgaggccaccuccucccccaccaccgccgagggcaccuccauccccaccuccacccccuccgagggcaccaccccccucaccuccacccccgucucccacacccucgucgccaacuccgaggccuccacccucuccaccacccccgucgacuccaacaccccccucaccaccuccaccgaggccuccucccccccccccaccgccgagggcaccuccaugcccaccuccacccccuccgagggcuccaccccccucacccgcaugcccgucuccaccaccauggucgccuccuccgagaccuccacccucuccaccacccccgccgacaccuccacccccgucaccaccuacucccaggccuccuccuccuccaccaccgccgacggcaccuccaugcccaccuccaccuacuccgagggcuccaccccccucaccuccguccccgucuccacccgccucgucgucuccuccgaggccuccacccucuccaccacccccgucgacaccuccauccccgucaccaccuccaccgaggccuccuccucccccaccaccgccgagggcaccuccauccccaccuccccccccuccgagggcaccaccccccucgccuccaugcccgucuccaccacccucgucgucuccuccgaggccaacacccucuccaccacccccgucgacuccaagacccaggucgccaccuccaccgaggccuccucccccccccccaccgccgaggucaccuccaugcccaccuccacccccggcgagcgcuccaccccccucaccuccaugcccguccgccacacccccgucgccuccuccgaggccuccacccucuccaccucccccgucgacaccuccacccccgucaccaccuccgccgagaccuccuccucccccaccaccgccgagggcaccucccuccccaccuccaccaccuccgagggcuccacccuccucaccuccauccccgucuccaccacccucgucaccucccccgaggccuccacccuccucaccacccccgucgacaccaagggccccgucgucaccuccaacgaggucuccuccucccccacccccgccgagggcaccuccaugcccaccuccaccuacuccgagggccgcaccccccucaccuccauccccgucaacaccacccucgucgccuccuccgccaucuccauccucuccaccacccccgucgacaacuccacccccgucaccaccuccaccgaggccugcuccucccccaccaccuccgagggcaccuccaugcccaacuccaaccccuccgagggcaccaccccccucaccuccauccccgucuccaccacccccgucgucuccuccgaggccuccacccucuccgccacccccgucgacaccuccacccccggcaccaccuccgccgaggccaccuccucccccaccaccgccgagggcaucuccauccccaccuccacccccuccgagggcaagaccccccucaaguccauccccgucuccaacacccccgucgccaacuccgaggccuccacccucuccaccacccccgucgacuccaacucccccgucgucaccuccaccgccgucuccuccucccccacccccgccgagggcaccuccaucgccaucuccacccccuccgagggcuccaccgcccucaccuccauccccgucuccaccaccaccgucgccuccuccgagaucaacucccucuccaccacccccgccgucaccuccacccccgucaccaccuacucccaggccuccuccucccccaccaccgccgacggcaccuccaugcagaccuccaccuacuccgagggcuccaccccccucaccucccuccccgucuccaccaugcucgucgucuccuccgaggccaacacccucuccaccacccccaucgacuccaagacccaggucaccgccuccaccgaggccuccuccuccaccaccgccgagggcuccuccaugaccaucuccacccccuccgagggcuccccccuccucaccuccauccccgucuccaccacccccgucgccucccccgaggccuccacccucuccaccacccccgucgacuccaacucccccgucaucaccuccaccgaggucuccuccucccccacccccgccgagggcaccuccaugcccaccuccaccuacaccgagggccgcaccccccucaccuccaucaccguccgcaccacccccgucgccuccuccgccaucuccacccucuccaccacccccgucgacaacuccacccccgucaccaccuccaccgaggcccgcuccucccccaccaccuccgagggcaccuccaugcccaacuccacccccuccgagggcaccaccccccucaccuccauccccgucuccaccacccccguccucuccuccgaggccuccacccucuccgccacccccaucgacaccuccacccccgucaccaccuccaccgaggccaccuccucccccaccaccgccgagggcaccuccauccccaccuccacccucuccgagggcaugaccccccucaccuccacccccgucucccacacccucgucgccaacuccgaggccuccacccucuccaccacccccgucgacuccaacucccccgucgucaccuccaccgccgucuccuccucccccacccccgccgagggcaccuccaucgccaccuccacccccuccgagggcuccaccgcccucaccuccauccccgucuccaccaccaccgucgccuccuccgagaccaacacccucuccaccacccccgccgucaccuccacccccgucaccaccuacgcccaggucuccuccucccccaccaccgccgacggcuccuccaugcccaccuccaccccccgcgagggccgccccccccucaccuccauccccgucuccaccaccaccgucgccuccuccgagaucaacacccucuccaccacccucgccgacacccgcacccccgucaccaccuacucccaggccuccuccucccccaccaccgccgacggcaccuccaugcccacccccgccuacuccgagggcuccaccccccucaccuccaugccccucuccaccacccucgucgucuccuccgaggccuccacccucuccaccacccccgucgacaccuccacccccgccaccaccuccaccgagggcuccuccucccccaccaccgccggcggcaccuccauccagaccuccacccccuccgagcgcaccaccccccucgccggcaugcccgucuccaccacccucgucgucuccuccgagggcaacacccucuccaccacccccgucgacuccaagacccaggucaccaacuccaccgaggccuccuccuccgccaccgccgagggcuccuccaugaccaucuccgcccccuccgagggcuccccccuccucaccuccaucccccucuccaccacccccgucgccucccccgaggccuccacccucuccaccacccccgucgacuccaacucccccgucaucaccuccaccgaggucuccuccucccccauccccaccgagggcaccuccaugcagaccuccaccuacuccgaccgccgcaccccccucaccuccaugcccgucuccaccaccgucgucgccuccuccgccaucuccacccucuccaccacccccgucgacaccuccacccccgucaccaacuccaccgaggcccgcuccucccccaccaccuccgagggcaccuccaugcccaccuccacccccuccgagggcuccacccccuucaccuccaugcccgucuccaccaugcccgucgucaccuccgaggccuccacccucuccgccacccccgucgacaccuccacccccgucaccaccuccaccgaggccaccuccucccccaccaccgccgagggcaccuccauccccaccuccacccucuccgagggcaccaccccccucaccuccauccccgucucccacacccucgucgccaacuccgaggucuccacccucuccaccacccccgucgacuccaacacccccuucaccaccuccaccgaggccuccucccccccccccaccgccgagggcaccuccaugcccaccuccaccuccuccgagggcaacaccccccucacccgcaugcccgucuccaccaccauggucgccuccuucgagaccuccacccucuccaccacccccgccgacaccuccacccccgucaccaccuacucccaggccggcuccucccccaccaccgccgacgacaccuccaugcccaccuccaccuacuccgagggcuccaccccccucaccuccguccccgucuccaccaugcccgucgucuccuccgaggccuccacccacuccaccacccccgucgacaccuccacccccgucaccaccuccaccgaggccuccuccucccccaccaccgccgagggcaccuccauccccaccuccccccccuccgagggcaccaccccccucgccuccaugcccgucuccaccacccccgucgucuccuccgaggccggcacccucuccaccacccccgucgacaccuccacccccaugaccaccuccaccgaggccuccuccucccccaccaccgccgaggacaucgucguccccaucuccaccgccuccgagggcuccacccuccucaccuccauccccgucuccaccacccccgucgccucccccgaggccuccacccucuccaccacccccgucgacuccaacucccccgucgucaccuccaccgagaucuccuccuccgccaccuccgccgagggcaccuccaugcccaccuccaccuacuccgagggcuccaccccccuccgcuccaugcccgucuccaccaagccccucgccuccuccgaggccuccacccucuccaccacccccgucgacaccuccauccccgucaccaccuccaccgagaccuccuccucccccaccaccgccaaggacaccuccaugcccaucuccacccccuccgaggucuccaccucccucaccuccauccucgucuccaccaugcccgucgccuccuccgaggccuccacccucuccaccacccccgucgacacccgcacccucgucaccaccuccaccggcaccuccuccucccccaccaccgccgagggcuccuccaugcccaccuccacccccggcgagcgcuccaccccccucaccaacauccucgucuccaccacccuccucgccaacuccgaggccuccacccucuccaccacccccgucgacaccuccacccccgucaccaccuccgccgaggccuccuccucccccaccaccgccgagggcaccuccaugcgcaucuccacccccuccgacggcuccaccccccucaccuccauccucgucuccacccuccccgucgccuccuccgaggccuccaccgucuccaccaccgccgucgacaccuccauccccgucaccaccuccaccgaggccuccuccucccccaccaccgccgaggucaccuccaugcccaccuccacccccuccgagaccuccaccccccucaccuccaugcccgucaaccacacccccgucgccuccuccgaggccggcacccucuccaccacccccgucgacaccuccacccccgucaccaccuccaccaaggccuccuccucccccaccaccgccgagggcaucgucguccccaucuccaccgccuccgagggcuccacccuccucaccuccauccccgucuccaccacccccgucgccuccuccgaggccuccacccucuccaccacccccgucgacaccuccauccccgucaccaccuccaccgagggcuccuccucccccaccaccgccgagggcaccuccaugcccaucuccacccccuccgaggucuccaccccccucaccuccauccucgucuccaccguccccgucgccggcuccgaggccuccacccucuccaccacccccgucgacacccgcacccccgucaccaccuccgccgaggccuccuccucccccaccaccgccgagggcaccuccaugcccaucuccacccccggcgagcgccgcaccccccucaccuccauguccgucuccaccaugcccgucgccuccuccgaggccuccacccucucccgcacccccgccgacaccuccacccccgucaccaccuccaccgaggccuccuccucccccaccaccgccgagggcaccggcauccccaucuccacccccuccgagggcuccaccccccucaccuccauccccgucuccaccacccccgucgccauccccgaggccuccacccucuccaccacccccgucgacuccaacucccccgucgucaccuccaccgaggucuccuccucccccacccccgccgagggcaccuccaugcccaucuccaccuacuccgagggcuccaccccccucaccggcguccccgucuccaccacccccgucaccuccuccgccaucuccacccucuccaccacccccgucgacaccuccacccccgucaccaccuccaccgaggcccacuccucccccaccaccuccgagggcaccuccaugcccaccuccacccccuccgagggcuccaccccccucaccuacaugcccgucuccaccaugcucgucgucuccuccgaggacuccacccucuccgccacccccgucgacaccuccacccccgucaccaccuccaccgaggccaccuccuccaccaccgccgagggcaccuccauccccaccuccacccccuccgagggcaugaccccccucaccuccguccccgucuccaacacccccgucgccuccuccgaggccuccauccucuccaccacccccgucgacuccaacaccccccucaccaccuccaccgaggccuccuccuccccccccaccgccgagggcaccuccaugcccaccuccacccccuccgagggcuccaccccccucaccuccaugcccgucuccaccaccaccgucgccuccuccgagaccuccacccucuccaccacccccgccgacaccuccacccccgucaccaccuacucccaggccuccuccuccccccccaucgccgacggcaccuccaugcccaccuccaccuacuccgagggcuccaccccccucaccaacauguccuucuccaccacccccgucgucuccuccgaggccuccacccucuccaccacccccgucgacaccuccacccccgucaccaccuccaccgaggccucccucucccccaccaccgccgagggcaccuccauccccaccuccucccccuccgagggcaccaccccccucgccuccaugcccgucuccaccacccccgucgucuccuccgaggucaacacccucuccaccacccccgucgacuccaacacccucgucaccaccuccaccgaggccuccuccucccccaccaucgccgagggcaccucccuccccaccuccaccaccuccgagggcuccaccccccucuccaucaugccccucuccaccacccccgucgccuccuccgaggccuccacccucuccaccacccccgucgacaccuccacccccgucaccaccuccucccccaccaacuccucccccaccaccgccgaggucaccuccaugcccaccuccaccgccggcgagggcuccaccccccucaccaacaugcccgucuccaccacccccgucgccuccuccgaggccuccacccucuccaccacccccgucgacuccaacaccuucgucaccuccuccucccaggccuccuccucccccgccacccuccaggucaccaccaugcgcauguccacccccuccgagggcuccuccucccucaccaccaugcuccucuccuccaccuacgucaccuccuccgaggccuccacccccuccacccccuccgucgaccgcuccacccccgucaccaccuccacccaguccaacuccacccccaccccccccgaggucaucacccuccccauguccacccccuccgaggucuccaccccccucaccaucaugcccgucuccaccaccuccgucaccaucuccgaggccggcaccgccuccacccuccccgucgacaccuccacccccgucaucaccuccacccaggucuccuccucccccgucacccccgagggcaccaccaugcccaucuggacccccuccgagggcuccaccccccucaccaccaugcccgucuccaccacccgcgucaccuccuccgagggcuccacccucuccacccccuccgucgucaccuccacccccgucaccaccuccaccgaggccaucuccuccuccgccacccucgacuccaccaccauguccgucuccaugcccauggagaucuccacccucggcaccaccauccucgucuccaccacccccgucacccgcuuccccgaguccuccacccccuccauccccuccgucuacaccuccauguccaugaccaccgccuccgagggcuccuccucccccaccacccucgagggcaccaccaccaugcccauguccaccaccuccgagcgcuccacccuccucaccaccguccucaucucccccaucuccgucaugucccccuccgaggccuccacccucuccaccccccccggcgacaccuccaccccccuccucaccuccaccaaggccggcuccuucuccauccccgccgaggucaccaccauccgcaucuccaucaccuccgagcgcuccaccccccucaccacccuccucgucuccaccacccuccccaccuccuuccccggcgccuccaucgccuccacccccccccucgacaccuccaccaccuucacccccuccaccgacaccgccuccacccccaccauccccgucgccaccaccaucuccgucuccgucaucaccgagggcuccacccccggcaccaccaucuucauccccuccacccccgucaccuccuccaccgccgacgucuuccccgccaccaccggcgccgucuccacccccgucaucaccuccaccgagcucaacacccccuccaccuccuccuccuccaccaccaccuccuucuccaccaccaaggaguucaccacccccgccaugaccaccgccgccccccucaccuacgucaccauguccaccgcccccuccaccccccgcaccaccucccgcggcugcaccaccuccgccuccacccucuccgccaccuccaccccccacaccuccaccuccgucaccacccgccccgucacccccuccuccgaguccucccgccccuccaccaucaccucccacaccaucccccccaccuucccccccgcccacuccuccaccccccccaccaccuccgccuccuccaccaccgucaaccccgaggccgucaccaccaugaccacccgcaccaagcccuccacccgcaccaccuccuuccccaccgucaccaccaccgccguccccaccaacaccaccaucaaguccaaccccaccuccacccccaccgucccccgcaccaccaccugcuucggcgacggcugccagaacaccgccucccgcugcaagaacggcggcaccugggacggccucaagugccagugccccaaccucuacuacggcgagcucugcgaggaggucgucuccuccaucgacaucggcccccccgagaccaucuccgcccagauggagcucaccgucaccgucaccuccgucaaguucaccgaggagcucaagaaccacuccucccaggaguuccaggaguucaagcagaccuucaccgagcagaugaacaucgucuacuccggcauccccgaguacgucggcgucaacaucaccaagcuccgccucggcuccgucgucgucgagcacgacguccuccuccgcaccaaguacacccccgaguacaagaccguccucgacaacgccaccgaggucgucaaggagaagaucaccaaggucaccacccagcagaucaugaucaacgacaucugcuccgacaugaugugcuucaacaccaccggcacccagguccagaacaucaccgucacccaguacgaccccgaggaggacugccgcaagauggccaaggaguacggcgacuacuucgucgucgaguaccgcgaccagaagcccuacugcaucucccccugcgagcccggcuucuccgucuccaagaacugcaaccucggcaagugccagaugucccucuccggcccccagugccucugcgucaccaccgagacccacugguacuccggcgagaccugcaaccagggcacccagaagucccucgucuacggccucgucggcgccggcgucguccucaugcucaucauccucgucgcccuccucaugcucgucuuccgcuccaagcgcgaggucaagcgccagaaguaccgccucucccagcucuacaaguggcaggaggaggacuccggccccgcccccggcaccuuccagaacaucggcuucgacaucugccaggacgacgacuccauccaccucgaguccaucuacuccaacuuccagcccucccuccgccacaucgaccccgagaccaagauccgcauccagcgcccccaggucaugaccaccuccuucuga

SEQ ID NO: 46273 - RNA, 25155 nt, Artificial Sequence
  derived and/or modified sequence opt2 from MUC19__Homo_sapiens__NP_775871
augaagcucauccucugguaccucgucgucgcccucuggugcuucuucaaggacgucgaggcccuccucuaccgccagaaguccgacggcaagaucgccgccucccgcuccggcggcuucuccuacggcuccuccuccuccggcgaccucgaccgcaagaagccccucuucucccucgaguucggcucccccggcgagaccgaggacaagucccgccagcgccaggacgccggcucccccaaguccgaggacacccccgccggcggcuucuucaacuccuccuccuccuccggcgacuccgaccgcaccaagcccuucuucucccucggccucggcgcccccggcaaggccgaggacaaguccggcgacucccaggacgccggcggcuccaaguccgaggacaccccccccggcggcuucuucuacggcuccuccuccuccggcgacuccgacaagaagaagccccucuucuccuucgaguucggcgccaccggcgaggacgaggacaagucccgcgagcgcugggacgccggcaacucccgcuccgaggacucccccgccgacuccaccaacacccgcuacggcgccggcuucuccuccuccggcgccucccucgacgucggcuucggcuggggcaucuccgacgagaagggccucgaggucuccaaggccgacggccgcgagacccgcggcuccggcuccgccggcggcgagaccaucgucuucggccccgacgccggcuccuccgucggcaccggcuccuccggccucaagcucggcgccggcaagggcgacgccgccuucggcuucgaggucuccgacuccaacuccuucggcgacaccggcaucuccuccaagaccgucgagggcaaccagaccuccuccuccggcggcuccgucuccaucgaccucggcgacaccuccuuccgcuccgagaaccaguucgucggcggcggcucccucaacuccaucuccaaccucugggacuccggccaggagggcuucggcaucaacgagaucggcggcaacggcauguccggcuccgucuccgccgaggccggcuucaagggcuucggcuccgacuccuccuccuccggcgacuccuccgcccgcaacggcuucgagaacuccuccggcaucuccgaggacuccggcgucauccucggcuccuccgaccagcacgaggucgagcucucccgcaccggcggcaaccgcaagcgcuccuccgaccccgacgaggccggcaaccucucccccggcuccgacgucuccgacuccggcggcaacaccugguccuccgacuccggcuccggcggcggcggcgucaccuccuccuccgaguacuccaccuccggcccccucaacacccccgagaagggcucccacauccccgaggccacccccaaguacuccgagaccaacgccaucaucggcgagaucuccaccugguccaagggcgccuacaaguccuucaacggccgcaucuucuucuucgaguccuccugccccuacaccuucugccgccacugcaucgaguccggcggcgacuucaacaucgagaucaagcgcaacaacgacuccgagaucgagaagaucaccguccucaucgacaacaacgacgucuccaucuucggcgacaccauccucgucaacggcgaguccguccagauccccuacaacaacaagcucauccacaucaagaaguacggcgagcacaacguccucaacucccgccgcggcauccucacccucaugugggacaagaacaacaagcucucccucacccuccacaagcaguaccccaccugcggccucugcggcaacuucaacuccacccccggccaggacaucaacgagcacaucgccaacuccaagauccccggcgacugccccaacgccgucggcaaguccuacgaggucugcgaggacggcauccagcacugcaacaagaucaucggcaccuacuucgagaagugcggcaaggucgccgcccucuccaacgacuacaagaugaucugcaucgacgaguacugccagacccgcgacaagaccuccaccugcgacaccuacuccgagcucucccgccucugcgccuccgacggccccggcaccuucgaguccuggcgcuccgacuccgacgucgucugcggcacccagcgcugccccgagcagcacaucuacaaggagugcggccccuccaaccccgccaccugcuccaacgucgcccccuuccaggacuccgagugcgucuccggcugcaccugccccgagggcuaccuccucgacgacaucggcgagaagggcaagugcguccucaaggccgagugccccugcgaguccuccggcaccgucuaccagcccggcgagguccgcgagggccccugcggcucccagugcaccugccaggacgccaagugguccugcaccgaggcccucugccccggccgcugcaaggucgagggcuccucccucaccaccuucgacggcgucaaguacaacuuccccggcaacugccacuuccucgccguccacaacgaggacugguccaucuccgucgagcuccgccccugccccuccggccagaccggcaccugccucaacuccgucacccuccuccucaacuccuccguccccgucgacaaguacgucuucaacuccgacggcaccgucaccaacgacaagauccgcaaccagggcuacuacuacuccgacaagauccagaucuucaacgccuccuccuccuaccuccaggucgagaccuacuuccacgucaagcuccagauccagaucguccccgucaugcagcucuacgucuccaugccccccaaccaguucaccgacaccgucggccucugcggcuccuacaacaacaaggccgaggacgacuucauguccucccagaacauccucgagaagaccucccaggccuucgccaacuccugggagaugauguccugccccaagggcaaccccuccuccugcaucuccaucgagaaggagaaguucgccgagcgccacugcggcauccuccucgacuccuccggcccccucgccuccugccaccccaucgucaaccccaagcccuaccacgaggagugcaagaaguacaccugcaccugcgagaacucccaggacugccucugcaccauccucggcaacuacgucaaggccugcgccgagaaggagaccuacaucgucggcuggcgcaccggccucugcgagcacuccugccccuccggccucgucuucaaguacaacgucaaggccugcaacuccuccugccgcucccucuccgagcgcgaccgcuccugcgacgucgaggacguccccgucgacggcugcaccugccccgacgccauguaccagaacaacgagggcaacugcguccucaagucccagugcgacugcuacaucaacgacgaggucaugcagcccggcaagcucauccacaucgacgacaacaagugcgucugccgcgacggcauccuccucugccagauccccaucgaccucacccuccagaacugcuccggcggcgccgaguacgucgacugcuccgaccccaaggcccagcgccgcaccaaccgcaccugcuccacccgcaacauccccgucuucgacgagaaccuccccugcaagcgcggcugcuucugccccgagggcaugguccgcaacuccaagggcaucugcgucuuccccaacgacugccccugcuccuucggcggccgcgaguacgacgagggcuccgucaccuccgucggcugcaacgagugcaccugcaucaagggcuccugguccugcacccagaacgagugccagaccaucugccacaucuacggcgagggccacguccgcaccuucgacggcaaguccuacuccuucgacggccucugccaguacuccuuccucgaggacuacugcggccacgagaacggcaccuuccgcauccucaccgaguccguccccugcugcgaggacggccucaccugcucccgcaagaucaucgucgccuuccaggaccagaacaucguccuccaggacggcaaggucaccgccgucaaguccaccgaguccaagaagugcgagcucaacgccaacgccuacuccauccacaccgucggccucuaccucauccucaaguuccagaacggcaucaucgucaucugggacaagaacacccgccucuccgucauccucgaccccaacuggaacggcaaggucugcggccucugcggcaacaacaacggcgaccucaaggacgacuucaccacccgcuacuccuccgucgccuccggcgcccucgaguucggcaacuccuggaagaccucccaggagugcuccgacaccgucgcccagaccuuccccugcgacuccaaccccuacugcaaggccugggccguccgcaagugcgagauccuccgcgacuccaccuuccgcgacugccacaacaaggucgaccccuccgccuaccacgacgccugcaucgaggaggccugcgccugcgacauggagggcaaguaccucggcuucugcaccgccgucgccauguacgccgaggccugcuccgccgucggcgucugcgucuccuggcgcaagcccaaccucugccccgucuacugcgacuacuacaacgcccccggcgagugccgcuggcacuacgagcccugcggcaccgucaccgccaagaccugcaaggaccagcucgucggccagaaguucuccucccuccucgagggcugcuacgccaagugccccgacuccgcccccuaccucgacgagaacaccaugaagugcgucucccucuccgagugcuccugcuucuacaacgacgucauccccgccggcggcgucaucgaggacaacugcggccgcaccugcuacugcaucgccggccagcucgagugcuccgagaccgcccccaccaacuccaccuucgccgucuccaccaccaccgccaccaccauccucuccaccggcgccgccaucacccucgucaccggcggccccuccaccgccgccuccauccccgccaucaccaccuccuccuccgagaccaccggcaccacccucggcccccucaccgagcccuucaccaccggcaucaccgagaccuccguccccaucaucuccaccuccggcaacgccggcaugaccggcgucgucucccccaccgucaccggcgccuccggcauggccggcaccaccggcggcgucgacgccgccaccaccggcgccgccuccgagaacaccuccgagcgcgccggcaccccccgcgucuccggcgagacccccgccgucggcggcggcuccacccccggcgaggccggccccggcgccaccgucuccggcuccaccggcgucuccgccggcuccaucaccgccucccccggcgccuccgccaccuccuccgaguccuccaaguccggcaccaccggccccuccgucggcggcaagaccggcgccaccuccuccgaggccaccuccuccgagggcauguccggcgucaccggccagucccucggcuccaccgccggcuccgacuccgagaucaccgccaagaccuccuucaccggcuccuccccccccggcaagcucacccgccccucccccggcucccccggccacuucuccggcggcaccaccgaguggggcaacgucgccaccaccggcgccgccggcgagaacaccuccggcgcccucggcuccaccgagggcuccgucgaggccaccaccuccgccggcuccggcaacaccgccggcaccuccggcaccggcgacaccggccccggcaacaccgccgucuccggcacccccgucgucucccccggcgccacccccggcgcccccggcuccuccacccccggcgaggccgacaucggcaacaccuccuucggcaaguccggcacccccaccgucuccgccgccuccaccaccuccucccccgucuccaagcacaccgacgccgccuccgccaccgccgucaccaucuccggcuccaagcccggcacccccggcacccccggcggcgccaccuccggcggcaagaucaccuccggcugguccuccuccggcaccuccaccggcgccuccaacacccccggcgccaccggcuccuccaccggccagaccgacaccuccggccccuccgccaaggucaccggcaacuacggccaguccuccgagauccccggcaccaucaaguccuccuccgacgucuccggcaccaugggccaguccgacaccaccuccggccccuccgucgccgucacccgcaccuccgagcaguccuccggcgucaccgucgccuccgagcccuccgucggcgucuccggcaccaccggcccccucgccgagaucuccggcaccacccgcccccucgucuccggccuccgcaccaccggcuccuccgccgagggcuccggcaccaccggccccuccucccgcgaguccgucaccacccgcccccucgccgagggcuccggcaccuccggccaguccgucaccggcucccgcgccaccggccucuccgccaccgagcucggcaccaccgucuccuucaccggcggccucggcaccucccgcuccuccgcccgcgagacccgcaccaccggccccuccgccgacggcuccggcaccaccggccccuccgucguccgcuccggcaccacccgccucuccgucggcgucacccgcgccaccgaguccucccccggcgucaccggcaccaccacccccuccgccgaggagucccgcaccaccggccccuccguccucgucaccggcaccaccggccaguccggccagggcuccggcaccaccggcaaguccuucaucgaguccggccccuccgucgucggcuccggcaccaccggccccaccuccgccggccucggcaccaccgcccccuccacccgccgcuccuccaccaccaagcccuccgucggccgcaccggcaccaccggccaguccggcgccgaguccggcaccaccgagcccuccgcccgcgucgccggcgucaccggcaccuccgccgaggucuccggccgcaucgagcccuccgccaccgaguccuccaccucccgcccccucggcgagaccaccggcaccaccauccccuccauggagggcuccgaggccaccggccccuccgucaucggcuccgagaccacccgccucuccgucaucggcuccggcaccaccggcaccuccuccggcggcuccggcgccacccgcuccuccggcggcggcaugggcaccaccggccaguccaccgcccgcuccgagaccaccggcccccucuucggccucaccggcaccuucggccaguccgccaccgucaccggcaccuccuccaacuccgccggcgucaccacccccgagaagucccccggcgucgccaugaccaccggccuccucgucgagggcuccgccaccacccagccccgcauccucgaguccgagaccaccgaguccuccgccggcgucaucgucaccuccggccaguccgcccgcgucaccggcgccaccggccccuccgccggcgagaccggcaccaccgagcccuccaccgagggcuccgucgccgccguccucuucgucaucggcuccgagaccacccgcccccucgacaucggcuccggcaccaccggcacccucuccggcggcuccuccaccacccgcuccuccgacggcaccaccggcaccacccgcaaguccaccgcccgcuccgagaccaccggccucuccggccucaccggcaccuccggccagcucgccggcgucaccggcaccuccuccaaguccgccggcgucaccgucaccuccgagaaguccgccggcgucgccgucaucaccggcuccuucgucgagcgccccgucaccaccggccccccccuccucgaguccgagaccacccgccccuccggcggcgucaccgucaccuccggccaguccgcccgcgucaccgagaccgucggcgccuccgccggcgucaccggcaccaccggccccuccaccgagggcuccggcgccaccggccccuccgucgucggcuccggcaccacccgcccccucgccggcgaguccggcaccaccgaguccuccgccggcgucaccggcacccgccccuccuccucccgcgaguccgccaccaccggccccuccgacgagggcuccggcaccaccggccucuccgccggcgucaccgucaccuccggccaguccguccgcaagaccggcaccaccggcgcccccgccggcgucaccgagaccacccgccccuccgucgucaaguccggcaccaccggccccuccgucaucggcacccgcaccaccggcaccuccuccggcggcuccggcgccacccgcuccuccggcggcgagaccgagaccaccggccaguccgccgucaaguccggcaccaccgaguccuucacccgccucacccgcaccuccggccaguccgccggcaugaccggcaccuccgcccaguccgccggcgucgcccucaccucccccuucgucgagggccucgucaccaccggcuccuccaccgucggccucgagaccacccgccccuccgccgucggcuccggcaagaccggcccccccgucgucaaggcccagaccaccggccccuccgccggcgucaccgucaccuccggccaguccgcccgcaugaccggcgccuccggccccuccgucggcgucaccggcaccaccggccccgccuccaagggccucggcaccauccgccccuccgucgucggccucgagaccaccgagcucuccgccgagggcuccggcaccaccggcccccccaucgucggcgagaccaccguccccuccgccggcgucaccgucaccuccggcuacuccgaccgcgucaccggcgccaccgagccccucgccggcgucaccggcaccaucaagcccuccgucgccggcuccgucaccaccggccccuccgucaccggcgucgagaccaccgccaagaccaccuccggcggccucuccaccaccaucuccuccgucggcggcaccggcaccaccggccagucccccgagcgcuccggcaccaccggccccuucaccggccucaccggcaccuccgcccaguccgccggcgucaccaugaccuccauccaguccgccggcguccucgucaccaccggccucaacgucgacggccucggcaccaccggcaaggcccucaucggcuccggcaccaccggccucuccgccgaggccaccggcaccaucggccccuccaccgagggccucgagaagaccggccccuccaucaccggcuccggcaccacccgcccccucgucaccgaguccuggaccgccggcaccuccuccggcggccacuccaccaccucccccuccguccgcggcaccgagaccaccggccaguccgccgccgaguccgucaccaccggccccgucaccggcuacaccgagaccuccggccccuccgccggcgucaccgucaccccccgccagucccccaccgucacccagaccaccggcuccuccgccgccgucuccggcaccaccguccagucccucaccgucuccggcaccacccgccccuccuccggccagaccgagaucaccggcuccuccgucaaggaguccggcaccaccgaguccuccgccguccgcuccggcaccaccggccccaccgccggcgucaccggcaccaacggccccuccuccgccggcgucaccggcaucaccggcuccucccccggcgucaccggcaccaccggcuccucccccggcgucaccggcaccaccggcuccuccgcccgcuccggcaccuccauccccuccgucggcaagaccggcaccacccgcaccuccgucgaggagucccgcaccacccgccccuccgccggcaucaccggcaccaacggccucuccgccgaggucaccggcaccaccggcccccucgccggcgucaccggcaccaccggccccuccgccggcgucacccgcaccaccggccucuccgccggcgagaccggcaccaccggccucucccccggcgucacccgcaccacccgcuccuccgccggccucaccggcaagaccggccucuccgccggcgucaccggcaagaccggccucuccgccgaggucaccggcaccacccgccucuccgccggcgucaccggcaccaccggccccucccccggcgucaccggcaccaccggcacccccgccggcgucaccggcaccaccgagcucuccgccggcgucaccggcaagaccggccucuccuccgaggucaccgagaccaccggccucuccuacggcgucaagcgcaccaucggccucuccgccggcuccaccggcaccuccggccaguccgccggcgucgccggcaccaccacccucuccgccgaggucaccggcaccacccgccccuccgccggcgucaccggcaccaccggccucuccgccgaggucaccgagaucaccggcaucuccgccgucgucaccggcaccaccggccccuccgccggcgucaccgagaccaccggcuccuccgccggcgucgccggcaccacccgccucuccgccggcgucaccggcaucaccggccucuccgccggcgucaccggcaccaccggccucuccaccgaggucaccggcaccaccggccccuccgccggcgccaccggcaccaccggccucuccgucggcgucaccggcaucaccggccucuccgacgucgucaccgagaccaccggcuccuccgcccgcuccggcaccggcauccccuccgucggcgagacccgcaccaccuccaccuccgucgaggagucccgcaccacccgccccuccgccggcaucaugggcaccaacggccuccccgccgaggucaccggcaccaccgagccccucgccggcggcaccggcaccaccggcauccucgccggcgucaccggcaccaccggccucuccgccggcgagaccggcaagaucggcuccuccgccggcgucaccggcaagaccggcuccuccgcccgcgucaccggcaagaccggccccuccgccgaggucaccggcaagaccggccucuccgccggcgucaccggcaccaccggccucucccccggcgucaccggcaccuccggccucuccgccgaggucaccggcaccaccggccccuccgccgaggccaccggccuccccggcgucuccgccggcgucaccggcaccaccggcucccucgccggcggcaccggcaccaucggccucuccgccggcgucaccggcaccaccggcuccuccgccggcgucaccggcaccaccggccucuccgccggcgucaccggcaucgccggccucuccgccggcgucaccggcaucaccggccccuccgccggcgucaccggcaccaccaccgucuccgccggcgucaccggcaccaccggccucuccgccgaggccaccgagaucaccggccucuccgccggcgucaccggcaccaccggccucuccgccggcgucaccgagaccauccgccucuccgccggcgucaccggcaccauccgcuccuccgccggcgucaccggcaucaccggccucuccgccggcgucaccggcaccaccggccccuccgccggcgucaccggcuccaccggccuccucgccggcgucaccgagaccaccggccaguccgccaaggucaccggcaccaccggccaguccgucggcgucaccggcaccacccgcuccuccggcggcgucaccggcaucaccggccucuccgccggcgucaccggcaccaacggccucuccgccgucaccggcaugaccggccucuccgccgaggucaccggcaccaccggccucuccgucggcgucaccggcaucgccggccucuccgccggcgucaccggcaucaccggccccuccgccggcaucaccggcaccaccaccaucuccgccggcgucaccggcaccuccggccucuccgccgaggccaccggcaucaccggccucuccgccggcgucaccggcaagaccggccucuccgccggcgucaccgagaccaucggccucuccgccgaggccaccggcaccaucggcuccucccccggcgucaccggcaccaccggcuccuccaccggcgucaccggcaucaccggccucuccgccggcgucaccggcaccaccggccucuccaccgaggucaccggcaccaccggccccuccgccggcgucacccgcaccaccggccucuccgccggcgucaccggcaucaccggccucuccgccaucgucaccgagaccaccggcuccuccgcccgcuccggcaccuccauccccuccgucggcgagaccggcaccacccgcaccuccgucgaggagucccgcaccacccgccccuccgccggcaucaccggcaccaacggccucuccgccgaggucaccggcaccaucggcccccucgccggcggcaccggcaccaccggccucuccgccggcgucaccggcaccgucggcuccuccgccgucgucaccggcaccaccggccucuccgccggcgucaccggcaccaccggccccuccgccgaggagaccggcgccaccggccccuccgccgaggucaccgagaccaccggccccuccgccggcgucaccggcaccggccgccucuccgccgaggucaccggcaccaccggccccuccgccgaggucaccggccuccccggcgaguccgccgaggucaccggcaccaucggcucccccgccggcgucaccggcaccacccagcucuccgccgucgucaccggcaucaccggccucuccgccgaggucaccggcaccaccggccucuccgccggcgucaccggcaucaccggccucuccgccgaggucacccgcaccaccggccucuccgccggcgucaccggcaccaucggccucuccgccggcgucaccggcaccacccgccccuccgccggcgucaccggcaccaccggccaguccgccgaggucaccggcaccaccgagcccuccgccggccucaccgagaccaccggcuccuccaccggcgucaccggcgccaccggcccccucgccggcgucaccggcaccaccggcaucuccaccgaggucaccggcaccaccggccccuccgcccgcgucaccggcaccaccguccucuccgccggcgucaccggcaucaccggccucuccgccaucgucaccgagaccaccggcuccuccgcccgcuccggcaccuccacccccuccgucggcgagaccggcaccacccgcaccuccgucgaggagucccgcgccacccgccccuccgccggcaucaccggcaccaacggccaguccgccgaggucaccuggaucaccggcccccucgccggcgucaccggcaccaccggcaucuccgccggcgucaccggcaccaccggccucuccgccggcgucaccggcaccaucggcuccuccgccgucgucaccggcaucaacggccucuccgccggcgucaccggcaccaccggccccuccgccgaggagaccggcgccaccggccccuccgccgaggucaccggcaccaccggccccuccgccgaggagaccggcgccaccggccccuccgccgaggucaccggcaccaccggccccuccggcggcgucaccggcaccaacggccucuccgccgaggucaccggcaccaccggccccuccgccgaggucaccggccuccccggcgucuccgccggcgucaccggcaccaucggcucccccgccgccgucaccggcaccauccgccccuccgccgucgucaccggcaucaccggccucuccgccgaggucaccggcaccaccggccucuccgccugggucaccggcaucgccggccucuccgccggcgucaccgagaccaucggcuccuccgccggcgucaccggcaccaacggccucuccgccgaggccaccggcaccaccggccccuccgccggcgucaccggcaccaccggccucuccgccggcgucaccggcaccgccggccucuccgcccgcgucaccgaguccaccggccucuccgccggcgucaccggcaccaccggccucuccgccggcgucaccggcaccaccggccccuccgccggcaucaccggcaccaacggccucuccgccgaggucaccggcaccaccggcccccucgccggcgucaccggcaccaucggccucuccgccggcgucaccggcaucgccggccucuccgccggcgucaccgaguccaccggccucuccgccggcgucaccggcaccauccgcuccuccgccgucgucaccggcaucaacggccucuccgccggcgucaccggcaccaccggccccuccgccgaggagaccggcgccaccggccccuccgccgaggucaccggcaccaccggccccuccggcggcgucaccggcaccuccggcaucuccgccgaggucaccggcaccaccggccccuccgccgaggucaccggccuccccggcgucuccgccggcgucaccggcaccaucggcucccccgccgccgucaccggcaccacccgccccuccgccgucgucaccggcaucuccggccucuccgccgaggucaccggcaccaccggccucuccgccggcgucaccgagaccaucggcuccuccgccggcgucaccggcaccaacggccucuccgccgaggccaccgagaccaccggccccuccgccggcgucaccggcaccaccggccucuccgccggcgucaccggcaccaccggccccuccgccggcaucgccggcaccaacggccucuccgccggcgucaccggcaccaccggccucuccgcccgcgucaccgaguccaccggccucuccgccggcgucaccggcaccaucggcuccuccgccgucgucaccgagaccacccgccucuccuccggcgucaccggcaccaucggccccuccgccgaggagaccggcgccaccggccucuccgccgaggucaccggcaccaccggcucccucgccgaggucaccggcaccaccggccucuccgccggcgucaccggcaccaucggcuccuccgccgucgucaccggcaccaccggccucuccgccggcaucaccggcaccaacggccucuccgccgaggucaccggcaccgccggcccccucgccggcgucaccggcaccaccggccucuccgccggcgucaccggcaccaccggccucuccgccggcgucaccgagaccaccggccaguccgccggcgucaccgaguccaccggccucucccccggcgucaccggcaccaucggcuccuccgccgucgucaccggcaucaagggccucuccgccggcgucaccggcaccaccggccccuccgccgaggagaccggcgccaccggccccuccgccgaggucaccggcaccaccggccccuccggcggcgucaccggcaccuccguccucuccgucgaggucaccggcaccaccggccccuccgccgaggucaccggccuccccggcgucuccgccggccucaccggcaccaucggcucccccgccgccguccgcggcaccaccuggcccuccgccgucgucaccggcaucuccggccucuccggcgaggucaccggcaccaccggccucuccgccggcgucaccggcaucggcggccucuccgccggcgucaccggcaccaucggcuccuccgccggcgucaccggcaccaacgcccucuccgccgaggccaccggcaccaccggccccuccgccggcgucaccggcaccaccggccucuccgccggcgucaccggcaccaccggccucuccgccggcgucaccggcaccauccgcuccuccgccgucgucaccgagaccaccggccucuccgccggcgucaccggcaccaccggccccuccgccggcaucgccggcaccaacggccucuccgccgaggucaccggcaccaccggccucuccgccggcaugaccggcaccaccggccucuccgcccgcgucaccgaguccaccggccucuccgccggcgucaccggcaccaucggcuccuccgccgucgucaccgagaccacccgccucuccgccggcgucaccggcaccaucggccccuccgccgaggagaccggcgccaccggccucuccgccgaggucacccgcaccaccggcucccucgccggcgucaccggcaccaccggccccuccgccgucgucaccggcaagaccgagcucuccgccgaggucaccggcaccaccgagcucuccgccgaggucaccgagaagaccggccccuccgccgaggucaccggcaagaccggccucuccgccggcgucauggagaccaccggccccuccgccgaggucaccggcaccaccggcuccuccgccggcgucaccggcaccaccggccccuccgccggcgucaccggcaccaccggccccuccgccgaggccaccggccuccccggcgucuccgccggcgucaccggcaccaucggcucccccgccggcgucaccggcaccgcccgccucuccgccgucgucaccggcaucuccggccucuccgccgaggucaccggcaccaccggccucuccaccggcgucaccggcaucgccggccacuccgccgccgucaccggcaucacccgccccuccgccggcgucaccggcaccaccaccgucuccgccggcgucaccggcaccaucggccucuccgccgaggccaccggcaucacccuccccuccgccggcgucaccgagaccaccggccucuccgccggcgucaccgagaccaucggccucuccgccggcgucaccggcaccaucggcuccuccgccggcgucaccgagaucaccggccucuccgccggcgucaccggcaccaccggccccuccgccggcgucaccggcuccaccguccucuccgccggcgucaccgccaccaccggccaguccgucggcgucaccggcaccaccggccccuccgccggcgucaccggcaccaccggccucuccgccggcgucaccggcaucgccggccucuccgccggcgucaccggcaucaccggccccuccgccggcgucaccggcaccaccaccgucuccgccggcgucaccggcaccaccggccucuccgccgaggccaccgagaucaccggccucuccgccggcgucaccggcaccaccggccucuccgccggcgucaccggcaucgccggccucuccgccggcgucaccgagaccaucggcuccuccgccggcgucaccggcaccaacggccucuccgccgaggccaccggcaagaccggccccuccgccggcgucaccggcaccaccggccucuccgccggcgucaccggcaccaccggccucuccgccggcgucaccgagaccaucggccucuccgccggcgucaccggcaccaucggcuccuccgccggcgucaagggcaccaccggccaguccgccgaggucaccggcgccaccggccaguccgucggcgucaccggcaccacccgcuccuccggcggcgucaccggcaucaccggccucuccgccggccuccgcggcaccaccgucuccuccgccaaggccggcaccuccaucccccucaccggcaagaccggcaccacccgcaccuccgucgaggaguccaccaccaccggccccuccgccggcaucaccggcaccaacggccucuccgccgagaugaccggcaccaacgagcucuccgccggcgucaccggcaccaucggcuccuccgccggcgucaccggcaccaccggccucuccgucgaggccaccgucaccaccggccucuccgccggcgucaccggcaccaccgucccccucgccggcgucaccuggacccccggccccuccgccggcgucaccggcaucgccgcccucuccgccggcgucaccggcaaguccggccucuccgccggcgucaccggcaagaccggccucuccgccggcgucaccggcaccaccggccccuccgccgaggccaccggcaagaccggccucuccgccggcgucaccggcaucaccggccccuucgccgaggucaccggcaccaccggccucuccgccggcgucaucggcaccaccggcuccuccgccgaggucaccggcaucaccggccucuccgccggcgucaccggcaagacccgcuccuccgccggcgucaccggcaccaccggccucuccgccaaguccggcaccuccauccccuccgccggcaagaccggcaccaccaagaccuccgucgaggagucccgcaccacccgccccuccgccggcaucaccgccaccaccggcguccccgccgccaccucccccggcgccgagggcgaguccaucgccuccaccuccgucgccaccggcgccaucccccgcuccaccaucgcccccggcuccaccaccaccggcaccaccggcgucaccaccggcaccacccucgccccccgcuccuucaacaucggcaccuccggcggcaucuccggcaagacccucaagcccggcuccuacgucuccgaggccaccaccgccaccggcacccccggcgccggccccuccggcggcaccaccaucuccucccccgaggucuccaccaucuccgaggucuccaacaccggcaucaccggcgucggcuccgagaccuccaucgagaccggcaucuccaacaccgccaccaccggcgucgcccccggcaccacccucgcccccggcuccuccuccaccgaggccaccaccuccaucggcggcuccgccuccacccgcggcggcaucgccaccgaggccaccggcuccacccgcggcguccgcaccaccggcuccgaggcccccgagggcaccuccggcgaguucuccggcaccaccaucuccuccggcggcuuccacaccgaggccaccacccucaccggcggccgcggcuccaucggcaccgagucccgcgccgaguccaccaccucccucccccaguccgccaagacccgcggcggcauccucaccgaggccaccuccuccaccggccgcauccgcgccaccggcuccgaggcccccggcggcaccucccgcaaguucuccggcaccaccaucuccuccggcggcucccacaccgaggccaccacccucgccggcggccgcgacuccaccgaguccgaguuccgcaccgccaccaucggcgucguccccgccaccaccgucgcccccggcuccuccaagaccgaggccaccaccuuccucggcgucuccggcaccaccuccgucggccgcgccaccggcgccaccaccuccaucgccggcuccgacaccucccaggccgagcaccccggcggcaccuccggcgaguuccccggcaccaccaucaccuccggcgacucccacaccgaggccaccgcccucaccggcucccgcggcuccaucggcaccgaguccaccgucgagaccaccaccuacaucggcgaguccggcaccacccgcggcggccucgccaccgccaccaccggcgccuucuccggcaagacccucgagcccggcaacgacaacaccgaggccaccggcuccaccggcggcauccgcgccacccgcaccgaggcccccggcggcaccuccggcgaguuccccggcaccaccuucaccuccggcggcucccacaccgaggccaccaccuucaccggcggcaagggcuccaccggcaccgagucccgcgccgccaccacccgcgccgcccccggcaccacccucguccccggcuccuccaacaccggcgccaccgccucccccggcggcuccgccaccacccgcggccgcaucaccaccgccaccaccggcgccuucuccggcaagacccucgaguccgagaacgacaacaccgaggccaccuccuccacccgcggcguccgcaccacccgcuccgaggcccccggcggcaccuccggcgaguuccccggcacccgcaucaccuccggcggcuccuacaccgccaccacccgcgccgcccccggcaccacccucgcccccggcuccuccaacaccggcgccaccgccucccucggcggcuccgccaugacccgcggccgcaucaccaccgccaccaccggcgccuucuccggcaagacccucgagcccggcaacaacaacaccgaggccaccuccuccacccgcggcguccgcaccacccgcuccgaggcccccggcgaggccaccacccucaccggcgaccgcuccuccaccggcuccgagucccgcaccgccaccaccggcgucgcccccggcaccaccgucgcccccggcuccuccaagaccgaggccaccaccuuccucggcgucuccggcaccaccaacaucggccgcgccaccggcgccaccaccuccaucgucggcuccgacaccucccaggccgagcgccccggcggcaccaccgucgucucccccggcgccuccuccaccucccaguccucccgccccggcaccuccgucacccccgacuccuccgccuccgaguccgagaccgucaccaccaaggaguucuccggcaccaccgccaucucccgcaccucccacaccggcacccccgccgccuccggcggccaggccaccggcucccucaccgccaccaccggcgucgcccccggcaccaccgucgcccccggcuccuccaacaccgaggccaccaccuccgucggcgagcgcgagaccaccaaggccgagaucaucaccggcgacaccggcgagcucuccggcaccaccaucaucuccgagaacuccaccaccgccggcaucaccgccgccaccggcaagcaggccggcaccuccgaggucgcccccuccaccaccgucgcccccggcuccuucuccaccgccgccaccaccucccccggcgccuccggcaccaccggcgucaccaccaccaccaagaccaccaccucccucggcggcuccggcaccaccggcgccgagaucaaguccgccaccaccggcgcccccggcucccgcaccggcaccgccggcguccccuccgccaccaccgucucccccggcuccuccaacuccgaggccaccaccuccgucggcgaguccggcaagaccggcgccgagaccaucaccgaggccaccaccuccaccgagggcaccggcaccuccggcaccggcuucaagaccggcaccuccgaggucgcccccgccaccaccgucgcccccggcuccuucuccaccgccgccaccaccucccccggcgccuccggcaugaccggcgucaccaccaccaccaagaccaccaccucccucggcggcuccggcaccaccggcgccaagaucaagcucgucggcaccaccaccaccgcccccgagucccgcaccgccggcguccccuccggcacccgcgucacccccggcuccuccaacuccgaggccaccaccuccgucgaggagucccgcaucacccgcgccgaggucaucaccgaggccaccaccuucuccggcggcuccggcgccacccgcgccggccucccccgcggcaccaccggcgaguucuccggcaccaacuucaucuccggcuccuccaacaccgaggccaccaccuccaccgagggcaccggcaccuccggcaccggcuucaagaucgccggcaucaccuccgcccccggcaagcaggccggcaccuccggcgucucccucgccaccaccgucgcccccggcuccuucuccaccgccaccaccuccuccggcgccuccggcaucacccgcgccggccccaccuccgagaccaccaccucccucggcggcuccggcaccaccggcgccgagaucaaguccgccgccguccccuccggcaccaccgucgcccccggcuccuccaacuccgaggccaccaccuccgucggcgagaacggcaagacccgcggcgagaucaucaccgacaccaccgagggcaccuccggcaagguccucgagcccggcuccgcccacaccgaggccaccaccuuccccggcggcuccggcaccacccgcgccggcccccccggcggcaccaccggcgagcucucccgcaugaccaucauccccggcuccuccaacaccgaggccaccaccuccaccaagggcaccggcaccuccggcaccggcuucaagaccggcaccuccugggucgcccccggcaccaccgucucccccggcuccuucuccaccgccaccaucucccccggcgccucccgcaccaccggcgccgcccccgccgccgagaccaccaccucccucgagggcggcggcaccaccggcgccgagaucaaguccggcgccaccuccggcguccccggcuccaagaccggcaccgccggcguccccuccgccaccaccaucgcccccggcuccuccaacuccgaggccaccaccucccucggcgaguccggcaagacccgcgucgagaccaucaccggcaccaccgagggcaagacccucgccgccggcuccgcccacaccgaggccaccaccuucuccggcggcuccggcuccacccgcgccggcccccucggcggcgccuccggcaccuccggcggcuacguccccggccgcgagaccgagcccaccaccuccaucgaggagaccggcaccucccgcaccaucuucaagaccgucggcaucaccuccgcccccggccgccaggccggcaccuccgucgucgcccccuccaccaccgucgcccccggcuccuucuccaccgccgccaccaccucccccggcgccuccggcaugaccggcguccgcaccaccuccaagaccaccaccucccucggcggcaccggcaccacccgcaccgagaucaaguccggcgccaccaccggcgcccccggcaucaagaccgacaucaugggcgaguccucccgcaccaccauccucuccggcuccuccaacaccgaggccaccaacuccaucgaggagaccggcaccuccggcaccggcuucaagaccgccggcaucaccgccgcccccggcaagcaggccggcaccuccggcgucgcccccggcaccaccgucgcccccggcuccuucuccaccgccgccaccaccucccccggcgccuccggcgucaccggcaccggccccaccgccgagaccaccaccuuccucggcggcuccuccaccaccggcgccgagaucaaguccggcgccaccaccggcgcccccggcuccaagaccggcaccgccaagguccucuccggcaccaccgucgccuccggcuccuccaacuccgaggccaccaccuucuccggcaucaccgaggccgucaccguccccuccaagaacggcuccaugaccaccgcccucggcucccagcucuccuccucccagaccgucauccccggcuccuccggcaccaucucccacaccaccgucgcccccggcuccuccgucaccggcaccaccaccggcgccuccgacgaccaggucaccggcuccaagaccggcaccaccggcgucgcccucuccaccaccgucgcccccggcuccuccuccaccgaggccaccaccuccaccggcguccaccgcaccaccgucgucggccagaagaccggcgccaccacccgcggcuccgccaagcagggcacccgcuccaccaucgaggccaccaccuccuuccgcggcaccggcaccaccggcuccggcaugaacaccggcaccaccggcgucgucuccggcaacaccaucucccccuccuccuucaacaccgaggccaccuccggcaccuccgagcgccccaaccccggcuccgagaucggcaccaccggcaucgucuccggcaccaccgucgcccccggcuccuccaacaccgaggccaccaccucccucggcaacggcggcaccaccgaggccggcuccaagaucgucaccaccggcaucaccaccggcaccaccaucguccccggcuccuucaacaccaaggccaccaccuccaccgacgucggcgucgccaccggcgucggcauggccaccggcaucaccaacaucaucuccggccgcucccagcccaccggcuccaagaccggcuacaccgucaccggcuccggcaccaccgcccuccccggcggcuuccgcaccggcaacacccccggcuccaccggcgucaccuccucccaggagggcaccaccgucgucuccuccggcaucaccggcauccccgagaccuccaucuccggccccuccaaggaggccuccgacaagaccaccgcccccggcccccccaccaccgucaccgccuccaccggcgucaaggagaccuccgagaccggcguccagaccggcuccacccucgucaccgccggcguccccacccgcccccaggucucccagcccgagaccaccgucgucgccacccgcgaggucgagaccgagaacaagaccgagugccucgccucccucccccccgcccccgucugccacggcccccucggcgaggagaagucccccggcgacaucuggaccgccaacugccaccgcggcaccugcaccgacgccaagaccaucgacugcaagcccgaggagugccccuccccccccaccugcaagaccggcgagaagcucgucaaguuccaguccaacgacaccugcugcgagaucggcuacugcgagccccgcaccugccucuucaacaacaccgacuacgagaucggcgccuccuucgacgaccccuccaaccccugcgucuccuacuccugcaaggacaccggcuucgccgccgucguccaggacugccccaagcagaccuggugcgccgaggccaaccgcaucuacgacuccaagaagugcugcuacaccugcaagaacaacugccgcuccucccucgucaacgucaccgucaucuacuccggcugcaagaagcgcguccagauggccaagugcaccggcgagugcgagaagaccgccaaguacaacuacgacauccuccuccucgagcacuccugccucugcugccgcgaggagaacuacgagcuccgcgacaucguccucgacugccccgacggcuccaccauccccuaccaguacaagcacaucaccaccugcuccugccucgacaucugccagcucuacaccaccuucauguacuccuga

SEQ ID NO: 46274 - RNA, 795 nt, Artificial Sequence
  derived and/or modified sequence opt2 from MUC1__Homo_sapiens__NP_001018016
augacccccggcacccagucccccuucuuccuccuccuccuccucaccguccucaccgccaccaccgcccccaagcccgccaccgucgucaccggcuccggccacgccuccuccacccccggcggcgagaaggagaccuccgccacccagcgcuccuccguccccuccuccaccgagaagaacgccuucaacuccucccucgaggaccccuccaccgacuacuaccaggagcuccagcgcgacaucuccgagauguuccuccagaucuacaagcagggcggcuuccucggccucuccaacaucaaguuccgccccggcuccgucgucguccagcucacccucgccuuccgcgagggcaccaucaacguccacgacgucgagacccaguucaaccaguacaagaccgaggccgccucccgcuacaaccucaccaucuccgacgucuccgucuccgacguccccuuccccuucuccgcccaguccggcgccggcguccccggcuggggcaucgcccuccucguccucgucugcguccucgucgcccucgccaucgucuaccucaucgcccucgccgucugccagugccgccgcaagaacuacggccagcucgacaucuuccccgcccgcgacaccuaccaccccauguccgaguaccccaccuaccacacccacggccgcuacgucccccccuccuccaccgaccgcucccccuacgagaaggucuccgccggcaacggcggcuccucccucuccuacaccaaccccgccgucgccgccaccuccgccaaccucuga

SEQ ID NO: 46275 - RNA, 2130 nt, Artificial Sequence
  derived and/or modified sequence opt2 from MUC20__Homo_sapiens__NP_001269435
augggcugccucuggggccucgcccucccccucuucuucuucugcugggaggucggcgucuccggcuccuccgccggccccuccacccgccgcgccgacaccgccaugaccaccgacgacaccgagguccccgccaugacccucgcccccggccacgccgcccucgagacccagacccucuccgccgagaccuccucccgcgccuccacccccgccggccccauccccgaggccgagacccgcggcgccaagcgcaucucccccgcccgcgagacccgcuccuucaccaagaccucccccaacuucaugguccucaucgccaccuccgucgagaccuccgccgccuccggcucccccgagggcgccggcaugaccaccguccagaccaucaccggcuccgacccccgcgaggccaucuucgacacccucugcaccgacgacuccuccgaggaggccaagacccucaccauggacauccucacccucgcccacaccuccaccgaggccaagggccucuccuccgaguccuccgccuccuccgacuccccccaccccgucaucacccccucccgcgccuccgaguccuccgccuccuccgacggcccccaccccgucaucacccccucccgcgccuccgaguccuccgccuccuccgacggcccccaccccgucaucacccccucccgcgccuccgaguccuccgccuccuccgacggcccccaccccgucaucacccccucccgcgccuccgaguccuccgccuccuccgacggcccccaccccgucaucacccccucccgcgccuccgaguccuccgccuccuccgacggcccccaccccgucaucacccccucccgcgccuccgaguccuccgccuccuccgacggcccccaccccgucaucacccccucccgcgccuccgaguccuccgccuccuccgacggcccccaccccgucaucacccccucccgcgccuccgaguccuccgccuccuccgacggcccccaccccgucaucacccccucccgcgccuccgaguccuccgccuccuccgacggccuccaccccgucaucacccccucccgcgccuccgaguccuccgccuccuccgacggcccccaccccgucaucacccccucccgcgccuccgaguccuccgccuccuccgacggcccccaccccgucaucacccccuccuggucccccggcuccgacgucacccuccucgccgaggcccucgucaccgucaccaacaucgaggucaucaacugcuccaucaccgagaucgagaccaccaccuccuccauccccggcgccuccgacaccgaccucauccccaccgagggcgucaaggccuccuccaccuccgacccccccgcccuccccgacuccaccgaggccaagccccacaucaccgaggucaccgccuccgccgagacccucuccaccgccggcaccaccgaguccgccgcccccgacgccaccgucggcaccccccuccccaccaacuccgccaccgagcgcgaggucaccgcccccggcgccaccacccucuccggcgcccucgucaccgucucccgcaacccccucgaggagaccuccgcccucuccgucgagacccccuccuacgucaaggucuccggcgccgcccccgucuccaucgaggccggcuccgccgucggcaagaccaccuccuucgccggcuccuccgccuccuccuacucccccuccgaggccgcccucaagaacuucacccccuccgagacccccaccauggacaucgccaccaagggccccuuccccaccucccgcgacccccuccccuccgucccccccaccaccaccaacuccucccgcggcaccaacuccacccucgccaagaucaccaccuccgccaagaccaccaugaagccccccaccgccacccccaccaccgcccgcacccgccccaccaccgacgucuccgccggcgagaacggcggcuuccuccuccuccgccucuccgucgccucccccgaggaccucaccgacccccgcgucgccgagcgccucaugcagcagcuccaccgcgagcuccacgcccacgccccccacuuccaggucucccuccuccgcguccgccgcggcuga

SEQ ID NO: 46276 - RNA, 1701 nt, Artificial Sequence
  derived and/or modified sequence opt2 from MUC21__Homo_sapiens__NP_001010909
augaagaugcagaagggcaacguccuccucauguucggccuccuccuccaccucgaggccgccaccaacuccaacgagaccuccaccuccgccaacaccggcuccuccgucaucuccuccggcgccuccaccgccaccaacuccggcuccuccgucaccuccuccggcgucuccaccgccaccaucuccggcuccuccgucaccuccaacggcgucuccaucgucaccaacuccgaguuccacaccaccuccuccggcaucuccaccgccaccaacuccgaguucuccaccgucuccuccggcaucuccaucgccaccaacuccgaguccuccaccaccuccuccggcgccuccaccgccaccaacuccgaguccuccacccccuccuccggcgccuccaccgccaccaacuccgacuccuccaccaccuccuccggcgccuccaccgccaccaacuccgacuccuccaccaccuccuccgaggccuccaccgccaccaacuccgaguccuccaccaccuccuccggcgccuccaccgccaccaacuccgaguccuccaccgucuccucccgcgccuccaccgccaccaacuccgaguccuccaccaccuccuccggcgccuccaccgccaccaacuccgagucccgcaccaccuccaacggcgccggcaccgccaccaacuccgaguccuccaccaccuccuccggcgccuccaccgccaccaacuccgaguccuccacccccuccuccggcgccggcaccgccaccaacuccgaguccuccaccaccuccuccggcgccggcaccgccaccaacuccgaguccuccaccgucuccuccggcaucuccaccgucaccaacuccgaguccuccacccccuccuccggcgccaacaccgccaccaacuccgaguccuccaccaccuccuccggcgccaacaccgccaccaacuccgacuccuccaccaccuccuccggcgccuccaccgccaccaacuccgaguccuccaccaccuccuccggcgccuccaccgccaccaacuccgaguccuccaccaccuccuccggcgccuccaccgccaccaacuccggcuccuccaccaccuccuccggcaccuccaccgccaccaacuccgaguccuccaccgucuccuccggcgccuccaccgccaccaccuccgaguccuccaccaccuccuccggcgccuccaccgccaccaacuccgaguccuccaccgucuccuccggcgccuccaccgccaccaacuccgaguccuccaccaccuccuccggcgccaacaccgccaccaacuccggcuccuccgucaccuccgccggcuccggcaccgccgcccucaccggcaugcacaccaccucccacuccgccuccaccgccgucuccgaggccaagcccggcggcucccucguccccugggagaucuuccucaucacccucgucuccgucgucgccgccgucggccucuucgccggccucuucuucugcguccgcaacucccucucccuccgcaacaccuucaacaccgccgucuaccacccccacggccucaaccacggccucggccccggccccggcggcaaccacggcgccccccaccgcccccgcuggucccccaacugguucuggcgccgccccgucuccuccaucgccauggagauguccggccgcaacuccggccccuga

SEQ ID NO: 46277 - RNA, 5322 nt, Artificial Sequence
  derived and/or modified sequence opt2 from MUC22__Homo_sapiens__NP_001185744
augcgccgcggcaacaucucccccgccuucugguuccucuggcuccuccucuucggccuccucggccccuccuccgagaacaccaccgccuucaccaagggcuccgacaccaccaccgccuccaucaccggcuccgagaccaccauggccuccaccauggccuccaccuccgcccucaccaccggcuccaagaucaccaccgacuccaccaccggcuccgagaccaccuccgccuccaccauggccuccaccgccgccuucaccaccggcuccgagaccaacaccgccuccaccaccgacuccggcaccaccaucgccuccacccgcaccuucaccaccggcuccgacaccaccaccggcuccaccgccggcuccgagaccaucgucgccuccaccaccgucuccggcaccaccaccaccuucaccaucgccuccaccaccguccccgagaccaccauggccuccuccaccaccuccaccgccggcuccgagaagaccauggccuccuccaucaucuccgagaccaccauggccuccaccaccggcuccgagaccgccaccgucuccaccaccggcuccgagaccaccaccaccuccaccgccuccuccgaggccaccaaggucuccaccaccggcuccgagaccaccaccgccuccaccgccggcuccgagaccaccaccaccuccaccuccauggccggcuccgaggccaccaccaccuccaccgccgacuccaaggucaucaccgccuccuccauguccuccgagaccaccgucgcccccgccgccggcuccaacaccaccaccgccuccaccaccggcuccgagaccaccaccauccucaucaaggccuccgagaccaccaccgccuccaccgccggcuccgagaccaccacccccucccccaccggcucccagaccaccaucgucuccaucuccggcuccgagaucaccaccaccuccaccgccggcuccgagaacaccaccgucuccuccgccggcuccggcaccaccaccgccuccauggccggcuccgagaccaccgucuccaccgccggcuccgagaccaccaccgucuccaucaccggcaccgagaccaccauggucuccgccaugggcuccgagaccaccaccaacuccaccaccuccuccgagaccaccgucaccuccaccgccggcuccgagaccaccaccgucuccaccgucggcuccgagaccaccaccgccuacaccgccgacuccgagaccaccgccgccuccaccaccggcuccgagaugaccaccgucuucaccgccggcuccgagaccaucacccccuccaccgccggcuccgagaccaccaccgucuccaccgccggcuccgagaccaccaccgucuccaccaccggcuccgagaccaccaccgccuccaccgcccacuccgagaccaccgccgccuccaccaugggcuccgagaccaccaaggucuccaccgccggcuccgagaccaccgucuccaccgccggcuccgagaccaccgccgccuccaccgaggacuccgagaccaacaccgccuucaccgaggacuccaagaccaccaccgccuccaccaccggcuucgagaccaccgccgccuccaccaccggcuccgagcccaccauggccuccaccaugggcuccgagaccaccauggccuccaccaucggccccgagaccaccaaggucuccaccgccuccuccgaggucaccaccgucuucgccgccggcuccgagaccauccgcgccuccaccgucggcuccgagaccaccaccgucuccaccaccggcuccgagaccaccaccgccuccaucaugggcuccgagaccuccaccgacuccaccaccggcuccgagaccaccaccgccuccaccgagggcuccgagaccaccaccgccuccaccgagggcuccgaggccaccaccgucuccaccaccggcuccgagaccaccaccgucuccaucaccgacuccgagaccaccaccaccugcaccgagggcuccgagaugaccgccgucuccaccaccgucuucgagaccaccaccgccuccaccgagggcuccgagaucaccaucgccuccaccuccgacuccgagaccaccaccgccuccaccgagggcuccgagaccaccaccgucaccaccgccggcuccgagaccaagaccgccuacaccaccggcuccgagaccaccaccgccuccaacaccggccucgagaccaccaccgucuucaccaucggcuccgacaccaccaccgccuccaccgagggcuccgagaccaccgccgucuccgccaccggcuccgagaugaccaccgucuccaccgagggcuccgagaacaccaccgucuccaccaccggcuccgagaccaccaccgucuccaccaccggccucgagaccaccaccaccuccaccgagggcuccgagaugaccaccgucuccaccaccggcgccgagaccaccaccgacuccaccgagggcuccggcaccaccgccgccuccaccgccggcuccgagaccaccaccgucuccaccgccgacuccgagaacaccaccgccuccaccgccgacuccgagaccaccuccgccuccaccaccggcuccgagaccaccaccgccuccaccaccuccuccgagaccaccaccgccuccaccgagggcuccgagaccaccaccgucuccaccaccgacuccgagaccaccauggucuccaccaccggcuccgagcgcaccaucaccuccaccgagggcuccgagaccaccaccgucuccgccaccggcuccgagaccaccgucuccaccgagggcuccggcaccaccaccgucuccaucaccggcuccgagaccaccaaggucuccaccaccggcuccgagaccaccaccaccuccaccgagggcuccgagaucaccaccgccuccaucaccggcuccgagaccaccaccgccuccaccgagggcuccgagaccaccaccgccuccaccgagggcuccgagaccaccuccgccuccaccaccggcuccgagaccaccaccgccuccaccaccuccuccgagaccaccauggccuccaucaugggcuccgagaccaccauggccuccaccaucggcuccgagaccaccaaggucuccaccgccuccuccaagaugaccaccgucuucaccgagaacuccgagaccaccaucgccuccaccaccgccuccgagaccaccaccgucuccaccgccggcuccgagaccauccccgccuccaccgccggcuccgagaccaccaccaccaccuccaccgagggcuccgagaccaccaccgccuccaccgagggcuccgagaccaccaccgccuccaccgaguccuccgagaccaccaccgccaccaccaucggcuccgagaccaccaccgccuccaccgagggcuccgagaccaccaccaccuccaccgagggcuccgagaccaccaccgccuccaccgagggcuccgagaucaccaccgucuccaccaccggcuccgagaccaccaccgccuccaccgagggcuccgagaccaccaccgccuccaccgagggcuccgagcucaccaccgucuccaccaccggcuccgagaccaucaccgucuccgccgagggcuccgagaccaccaccgucaccaccaugggcuccgagaccaccaccgccuccaccgccggcuccgagaccaccaccgucuccaccgccggcuccgagaccaccaccgccuccaucgagggcuccgagaccaccaccgucuccuccaccggcuccgagaccaccaccgucuccaccaccggcaccgagaccaccaucaccuccaccgagggcuccgagaccaccaccgucaccaccgccggcuccgagaccaccgccgucuacaccaccggcuccgagaccaccaccaccuccaccgagggcuccgagaccaccaccgucuccaccaccggcuccgagaccaccaccgccuccaccgccgaccucgagaccaccaccgucuccaccuccggcuccggcaccaccaccgccuccaccgccggcuccgagaccaccaccgucuacaucaccggcuccaagaccaccaccgccuccaccgagggcuccgaggccaccaccgucuccaccaccuccuccgagaccaccaccgccuccaccaccggcuccgagaugaccaccgucuucaccaccgucuccgagaccaccaccgucuccaccaucggcuccgaggccaccaccuccuccgccgccggcuccgaggccaccaccaccuccaccgagggcuccgagaccaccaccgccuccaccgccggcuccgagaccaccaccgccuccaccgccggcuccgagaccaccaccgccuccaccuccggcuccgagaccaacaccgccugcaccaccggcuccgagaccuccacccccuccuccgccggcuccgagaccaacaccgccuucaucaucggcuccgaguccaccaucgccuccaccgccucccucgagcccaccgccaccucccucaccggcuccgagaccaccaccgucuccaucaccgccuccggcgccaccgccgccuccaccaccgucuccuccaccaccuucguccucaccaaggccaccgacgucuccauccagcccaucaccaacacccccauguccggcacccgcaccaccggcacccgccucaccgccuccuccuccgucaccauggcccccggcauggacuucaccgccuccgccgccucccacaccguccccggcaucguccucaacaccuccggccucggcaccuccaccaugggcgccuccuccaccaccuccgcccacggcguccgcaccaccaccggcuccacccgcgagcccaccuccuccaccuuccaggagaccggccccgucuccaugggcaccaacaccgucuccaugucccacacccccaccaacgucaucaagcccuccggcuaccuccagcccugggccaucauccucaucucccucgccgccgucgucgccgccgucggccucuccgucggccucuccuucugccuccgcaaccucuucuucccccuccgcuacugcggcaucuacuacccccacggccacucccacucccucggccucgaccucaaccucggccucggcuccggcaccuuccacucccucggcaacgcccucguccacggcggcgagcucgagaugggccacggcggcacccacggcuucggcuacggcgucggccacggccucucccacauccacggcgacggcuacggcgucaaccacggcggccacuacggccacggcggcggccacuga

SEQ ID NO: 46278 - RNA, 15540 nt, Artificial Sequence
  derived and/or modified sequence opt2 from MUC2__Homo_sapiens__NP_002448
augggccucccccucgcccgccucgccgccgucugccucgcccucucccucgccggcggcuccgagcuccagaccgagggccgcacccgcaaccacggccacaacgucugcuccaccuggggcaacuuccacuacaagaccuucgacggcgacgucuuccgcuuccccggccccugcgacuacaacuucgccuccgacugccgcggcuccuacaaggaguucgccguccaccucaagcgcggccccggccaggccgaggcccccgccggcgucgaguccauccuccucaccaucaaggacgacaccaucuaccucacccgccaccucgccguccucaacggcgccgucgucuccaccccccacuacucccccggccuccucaucgagaaguccgacgccuacaccaaggucuacucccgcgccggccucacccucauguggaaccgcgaggacgcccucaugcucgagcucgacaccaaguuccgcaaccacaccugcggccucugcggcgacuacaacggccuccaguccuacuccgaguuccucuccgacggcguccucuucuccccccucgaguucggcaacaugcagaagaucaaccagcccgacgucgucugcgaggaccccgaggaggaggucgcccccgccuccugcuccgagcaccgcgccgagugcgagcgccuccucaccgccgaggccuucgccgacugccaggaccucgucccccucgagcccuaccuccgcgccugccagcaggaccgcugccgcugccccggcggcgacaccugcgucugcuccaccgucgccgaguucucccgccagugcucccacgccggcggccgccccggcaacuggcgcaccgccacccucugccccaagaccugccccggcaaccucgucuaccucgaguccggcucccccugcauggacaccugcucccaccucgaggucuccucccucugcgaggagcaccgcauggacggcugcuucugccccgagggcaccgucuacgacgacaucggcgacuccggcugcguccccgucucccagugccacugccgccuccacggccaccucuacacccccggccaggagaucaccaacgacugcgagcagugcgucugcaacgccggccgcugggucugcaaggaccuccccugccccggcaccugcgcccucgagggcggcucccacaucaccaccuucgacggcaagaccuacaccuuccacggcgacugcuacuacguccucgccaagggcgaccacaacgacuccuacgcccuccucggcgagcucgcccccugcggcuccaccgacaagcagaccugccucaagaccgucguccuccucgccgacaagaagaagaacgucgucgucuucaaguccgacggcuccguccuccucaacgagcuccaggucaaccucccccacgucaccgccuccuucuccgucuuccgccccuccuccuaccacaucauggucuccauggccaucggcguccgccuccagguccagcucgcccccgucaugcagcucuucgucacccucgaccaggccucccagggccagguccagggccucugcggcaacuucaacggccucgagggcgacgacuucaagaccgccuccggccucgucgaggccaccggcgccggcuucgccaacaccuggaaggcccaguccaccugccacgacaagcucgacuggcucgacgaccccugcucccucaacaucgaguccgccaacuacgccgagcacuggugcucccuccucaagaagaccgagacccccuucggccgcugccacuccgccgucgaccccgccgaguacuacaagcgcugcaaguacgacaccugcaacugccagaacaacgaggacugccucugcgccgcccucuccuccuacgcccgcgccugcaccgccaagggcgucaugcucuggggcuggcgcgagcacgucugcaacaaggacgucggcuccugccccaacucccaggucuuccucuacaaccucaccaccugccagcagaccugccgcucccucuccgaggccgacucccacugccucgagggcuucgcccccgucgacggcugcggcugccccgaccacaccuuccucgacgagaagggccgcugcgucccccucgccaagugcuccugcuaccaccgcggccucuaccucgaggccggcgacgucgucguccgccaggaggagcgcugcgucugccgcgacggccgccuccacugccgccagauccgccucaucggccaguccugcaccgcccccaagauccacauggacugcuccaaccucaccgcccucgccaccuccaagccccgcgcccucuccugccagacccucgccgccggcuacuaccacaccgagugcgucuccggcugcgucugccccgacggccucauggacgacggccgcggcggcugcgucgucgagaaggagugccccugcguccacaacaacgaccucuacuccuccggcgccaagaucaaggucgacugcaacaccugcaccugcaagcgcggccgcugggucugcacccaggccgucugccacggcaccugcuccaucuacggcuccggccacuacaucaccuucgacggcaaguacuacgacuucgacggccacugcuccuacgucgccguccaggacuacugcggccagaacuccucccucggcuccuucuccaucaucaccgagaacguccccugcggcaccaccggcgucaccugcuccaaggccaucaagaucuucaugggccgcaccgagcucaagcucgaggacaagcaccgcgucgucauccagcgcgacgagggccaccacgucgccuacaccacccgcgaggucggccaguaccucgucgucgaguccuccaccggcaucaucgucaucugggacaagcgcaccaccgucuucaucaagcucgcccccuccuacaagggcaccgucugcggccucugcggcaacuucgaccaccgcuccaacaacgacuucaccacccgcgaccacauggucgucuccuccgagcucgacuucggcaacuccuggaaggaggcccccaccugccccgacgucuccaccaaccccgagcccugcucccucaacccccaccgccgcuccugggccgagaagcagugcuccauccucaaguccuccgucuucuccaucugccacuccaaggucgaccccaagcccuucuacgaggccugcguccacgacuccugcuccugcgacaccggcggcgacugcgagugcuucugcuccgccgucgccuccuacgcccaggagugcaccaaggagggcgccugcgucuucuggcgcacccccgaccucugccccaucuucugcgacuacuacaaccccccccacgagugcgaguggcacuacgagcccugcggcaaccgcuccuucgagaccugccgcaccaucaacggcauccacuccaacaucuccgucuccuaccucgagggcugcuacccccgcugccccaaggaccgccccaucuacgaggaggaccucaagaagugcgucaccgccgacaagugcggcugcuacgucgaggacacccacuacccccccggcgccuccguccccaccgaggagaccugcaaguccugcgucugcaccaacuccucccaggucgucugccgccccgaggagggcaagauccucaaccagacccaggacggcgccuucugcuacugggagaucugcggccccaacggcaccgucgagaagcacuucaacaucugcuccaucaccacccgccccuccacccucaccaccuucaccaccaucacccuccccaccacccccaccaccuucaccaccaccaccaccaccaccacccccaccuccuccaccguccucuccaccacccccaagcucugcugccucugguccgacuggaucaacgaggaccaccccuccuccggcuccgacgacggcgaccgcgagaccuucgacggcgucugcggcgcccccgaggacaucgagugccgcuccgucaaggacccccaccucucccucgagcagcucggccagaagguccagugcgacgucuccgucggcuucaucugcaagaacgaggaccaguucggcaacggccccuucggccucugcuacgacuacaagauccgcgucaacugcugcuggcccauggacaagugcaucaccacccccuccccccccaccaccacccccucccccccccccaccuccaccaccacccucccccccaccaccacccccuccccccccaccaccaccaccaccacccccccccccaccaccacccccuccccccccaucaccaccaccaccacccccccccccaccaccacccccuccccccccaucuccaccaccaccacccccccccccaccaccacccccuccccccccaccaccacccccuccccccccaccaccacccccuccccccccaccaccaccaccaccacccccccccccaccaccacccccuccccccccaccaccacccccaucaccccccccgccuccaccaccacccucccccccaccaccacccccuccccccccaccaccaccaccaccacccccccccccaccaccacccccuccccccccaccaccacccccaucaccccccccaccuccaccaccacccucccccccaccaccacccccucccccccccccaccaccaccaccacccccccccccaccaccacccccuccccccccaccaccaccacccccuccccccccaccaucaccaccaccacccccccccccaccaccacccccuccccccccaccaccaccaccaccacccccccccccaccaccacccccuccccccccaccaccacccccaucaccccccccaccuccaccaccacccucccccccaccaccacccccucccccccccccaccaccaccaccacccccccccccaccaccacccccuccccccccaccaccaccacccccuccccccccaucaccaccaccaccacccccccccccaccaccacccccuccucccccaucaccaccacccccuccccccccaccaccaccaugaccacccccucccccaccaccacccccuccucccccaucaccaccaccaccacccccuccuccaccaccacccccucccccccccccaccaccaugaccacccccucccccaccaccacccccuccccccccaccaccaccaugaccacccucccccccaccaccaccuccuccccccucaccaccaccccccucccccccuccaucaccccccccaccuucucccccuucuccaccaccacccccaccacccccugcgucccccucugcaacuggaccggcuggcucgacuccggcaagcccaacuuccacaagcccggcggcgacaccgagcucaucggcgacgucugcggccccggcugggccgccaacaucuccugccgcgccaccauguaccccgacguccccaucggccagcucggccagaccgucgucugcgacgucuccgucggccucaucugcaagaacgaggaccagaagcccggcggcgucauccccauggccuucugccucaacuacgagaucaacguccagugcugcgagugcgucacccagcccaccaccaugaccaccaccaccaccgagaaccccaccccccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagacccccaccaccacccccaucaccaccaccaccaccgucacccccacccccacccccaccggcacccagaccggcccccccacccacaccuccaccgcccccaucgccgagcucaccaccuccaaccccccccccgaguccuccaccccccagaccucccgcuccaccuccuccccccucaccgaguccaccacccuccucuccacccucccccccgccaucgagaugaccuccaccgccccccccuccacccccaccgcccccaccaccaccuccggcggccacacccucucccccccccccuccaccaccaccuccccccccggcacccccacccgcggcaccaccaccggcuccuccuccgcccccacccccuccaccguccagaccaccaccaccuccgccuggacccccacccccaccccccucuccacccccuccaucauccgcaccaccggccuccgccccuaccccuccuccguccucaucugcugcguccucaacgacaccuacuacgcccccggcgaggaggucuacaacggcaccuacggcgacaccugcuacuucgucaacugcucccucuccugcacccucgaguucuacaacugguccugccccuccacccccucccccacccccacccccuccaaguccacccccacccccuccaagcccuccuccacccccuccaagcccacccccggcaccaagccccccgagugccccgacuucgaccccccccgccaggagaacgagaccugguggcucugcgacugcuucauggccaccugcaaguacaacaacaccgucgagaucgucaaggucgagugcgagcccccccccaugcccaccugcuccaacggccuccagcccguccgcgucgaggaccccgacggcugcugcuggcacugggagugcgacugcuacugcaccggcuggggcgacccccacuacgucaccuucgacggccucuacuacuccuaccagggcaacugcaccuacguccucgucgaggagaucucccccuccgucgacaacuucggcgucuacaucgacaacuaccacugcgaccccaacgacaaggucuccugcccccgcacccucaucguccgccacgagacccaggagguccucaucaagaccguccacaugaugcccaugcagguccagguccaggucaaccgccaggccgucgcccuccccuacaagaaguacggccucgaggucuaccaguccggcaucaacuacgucgucgacauccccgagcucggcguccucgucuccuacaacggccucuccuucuccguccgccuccccuaccaccgcuucggcaacaacaccaagggccagugcggcaccugcaccaacaccaccuccgacgacugcauccuccccuccggcgagaucgucuccaacugcgaggccgccgccgaccaguggcucgucaacgaccccuccaagccccacugcccccacuccuccuccaccaccaagcgccccgccgucaccguccccggcggcggcaagaccaccccccacaaggacugcacccccuccccccucugccagcucaucaaggacucccucuucgcccagugccacgcccucguccccccccagcacuacuacgacgccugcgucuucgacuccugcuucaugcccggcuccucccucgagugcgccucccuccaggccuacgccgcccucugcgcccagcagaacaucugccucgacuggcgcaaccacacccacggcgccugccucgucgagugccccucccaccgcgaguaccaggccugcggccccgccgaggagcccaccugcaaguccuccuccucccagcagaacaacaccguccucgucgagggcugcuucugccccgagggcaccaugaacuacgcccccggcuucgacgucugcgucaagaccugcggcugcgucggccccgacaacgucccccgcgaguucggcgagcacuucgaguucgacugcaagaacugcgucugccucgagggcggcuccggcaucaucugccagcccaagcgcugcucccagaagcccgucacccacugcgucgaggacggcaccuaccucgccaccgaggucaaccccgccgacaccugcugcaacaucaccgucugcaagugcaacaccucccucugcaaggagaagcccuccgucugcccccucggcuucgaggucaaguccaagaugguccccggccgcugcugccccuucuacuggugcgaguccaagggcgucugcguccacggcaacgccgaguaccagcccggcucccccgucuacuccuccaagugccaggacugcgucugcaccgacaaggucgacaacaacacccuccucaacgucaucgccugcacccacguccccugcaacaccuccugcucccccggcuucgagcucauggaggcccccggcgagugcugcaagaagugcgagcagacccacugcaucaucaagcgccccgacaaccagcacgucauccucaagcccggcgacuucaaguccgaccccaagaacaacugcaccuucuucuccugcgucaagauccacaaccagcucaucuccuccgucuccaacaucaccugccccaacuucgacgccuccaucugcauccccggcuccaucaccuucaugcccaacggcugcugcaagaccugcaccccccgcaacgagacccgcguccccugcuccaccguccccgucaccaccgaggucuccuacgccggcugcaccaagaccguccucaugaaccacugcuccggcuccugcggcaccuucgucauguacuccgccaaggcccaggcccucgaccacuccugcuccugcugcaaggaggagaagaccucccagcgcgaggucguccucuccugccccaacggcggcucccucacccacaccuacacccacaucgaguccugccagugccaggacaccgucugcggccuccccaccggcaccucccgccgcgcccgccgcuccccccgccaccucggcuccggcuga

SEQ ID NO: 46279 - RNA, 9972 nt, Artificial Sequence
  derived and/or modified sequence opt2 from MUC3A__Homo_sapiens__NP_005951
augcagcuccucggccuccucggccuccucuggaugcucaaggccucccccugggccaccggcacccucuccaccgccaccuccaucucccagguccccuucccccgcgccgaggccgccuccgccguccucuccaacuccccccacucccgcgaccucgccggcuggccccucggcgucccccagcucgccucccccgcccccggccaccgcgagaacgcccccaugacccucaccaccuccccccacgacacccucaucuccgagacccuccucaacucccccgucuccuccaacaccuccaccacccccaccuccaaguucgccuucaaggucgagaccaccccccccaccguccucgucuacuccgccaccaccgagugcgucuaccccaccuccuucaucaucaccaucucccaccccaccuccaucugcgucaccaccacccaggucgccuucaccuccuccuacaccuccacccccgucacccagaagcccgucaccaccgucaccuccaccuacuccaugaccaccaccgagaagggcaccuccgccaugaccuccucccccuccaccaccaccgcccgcgagacccccaucgucaccgucacccccuccuccgucuccgccaccgacaccaccuuccacaccaccaucuccuccaccacccgcaccaccgagcgcaccccccuccccaccggcuccauccacaccaccaccucccccacccccgucuucaccacccucaagaccgccgucaccuccaccucccccaucaccuccuccaucaccuccaccaacaccgucaccuccaugaccaccaccgccucccagcccaccgccaccaacacccucuccucccccacccgcaccauccucuccuccacccccguccucuccaccgagaccaucaccuccggcaucaccaacaccaccccccucuccacccucgucaccacccuccccaccaccaucucccgcuccacccccaccuccgagaccaccuacaccaccucccccaccuccaccgucaccgacuccaccaccaagaucgccuacuccaccuccaugaccggcacccucuccaccgagaccucccucccccccaccuccuccucccuccccaccaccgagaccgccaccacccccaugaccaaccucgucaccaccaccaccgagaucuccucccacuccacccccuccuucuccuccuccaccaucuacuccaccgucuccaccuccaccaccgccaucuccucccucccccccaccuccggcaccauggucaccuccaccaccaugacccccuccucccucuccaccgacauccccuucaccacccccaccaccaucacccaccacuccgucggcuccaccggcuuccucaccaccgccaccgaccucaccuccaccuucaccgucuccuccuccuccgccauguccaccuccgucauccccuccucccccuccauccagaacaccgagaccuccucccucgucuccaugaccuccgccaccacccccaacguccgccccaccuucgucuccacccucuccacccccaccuccucccuccucaccaccuuccccgccaccuacuccuucuccuccuccauguccgccuccuccgccggcaccacccacaccgaguccaucuccuccccccccgccuccaccuccacccuccacaccaccgccgaguccacccucgcccccaccaccaccaccuccuucaccaccuccaccaccauggagccccccuccaccaccgccgccaccaccggcaccggccagaccaccuucaccuccuccaccgccaccuuccccgagaccaccacccccacccccaccaccgacauguccaccgagucccucaccaccgccaugaccuccccccccaucaccuccuccgucaccuccaccaacaccgucaccuccaugaccaccaccaccuccccccccaccaccaccaacuccuucaccucccucaccuccaugccccucuccuccacccccguccccuccaccgaggucgucaccuccggcaccaucaacaccaucccccccuccauccucgucaccacccuccccacccccaacgccuccuccaugaccaccuccgagaccaccuaccccaacucccccaccggccccggcaccaacuccaccaccgagaucaccuaccccaccaccaugaccgagaccuccuccaccgccaccucccucccccccaccuccccccucgucuccaccgccaagaccgccaagacccccaccaccaaccucgucaccaccaccaccaagaccaccucccacuccaccaccuccuucaccuccuccaccgucuacuccaccgccuccaccuacaccaccgccaucaccuccguccccaccacccucggcaccauggucaccuccaccuccaugaucuccuccaccgucuccaccggcauccccaccucccagcccaccaccaucacccccuccuccgucggcaucuccggcucccuccccaugaugaccgaccucaccuccgucuacaccgucuccaacauguccgcccgccccaccaccgucauccccuccucccccaccguccagaacaccgagaucuccaucuccgucuccaugaccuccgccaccacccccuccggcggccccaccuucaccuccaccgagaacacccccacccgcucccuccucaccuccuuccccaugacccacuccuucuccuccuccauguccgaguccuccgccggcaccacccacaccgaguccaucuccuccccccgcggcaccaccuccacccuccacaccaccgucgaguccacccccucccccaccaccaccaccuccuucaccaccuccaccaugauggagccccccuccuccaccgucuccaccaccggccgcggccagaccaccuuccccuccuccaccgccaccuuccccgagaccaccacccucacccccaccaccgacaucuccaccgucucccucaccaccgccaugaccucccccccccccgucuccuccuccaucacccccaccaacaccaugaccuccaugcgcaccaccaccuacuggcccaccgccaccaacacccucuccccccucaccuccuccauccucuccuccacccccguccccuccaccgagaugaucaccucccacaccaccaacaccaccccccucuccacccucgucaccacccuccucaccaccaucacccgcuccacccccaccuccgagaccaccuaccccaccucccccaccuccaucgucuccgacuccaccaccgagaucaccuacuccaccuccaucaccggcacccucuccaccgccaccacccucccccccaccuccuccucccuccccaccaccgagaccgccaccaugacccccaccaccacccucaucaccaccacccccaacaccaccucccucuccacccccuccuucaccuccuccaccaucuacuccaccgucuccaccuccaccaccgccaucuccuccgccucccccaccuccggcaccauggucaccuccaccaccaugacccccuccucccucuccaccgacacccccuccaccacccccaccaccaucaccuaccccuccgucggcuccaccggcuuccucaccaccgccaccgaccucaccuccaccuucaccgucuccuccuccuccgccauguccaccuccgucauccccuccucccccuccauccagaacaccgagaccuccucccucgucuccaugaccuccgccaccacccccucccuccgccccaccaucaccuccaccgacuccacccucaccuccucccuccucaccaccuuccccuccaccuacuccuucuccuccuccauguccgccuccuccgccggcaccacccacaccgagaccaucuccucccuccccgccuccaccaacaccauccacaccaccgccgaguccgcccucgcccccaccaccaccaccuccuucaccaccucccccaccauggagccccccuccaccaccgucgccaccaccggcaccggccagaccaccuuccccuccuccaccgccaccuuccucgagaccaccacccucacccccaccaccgacuucuccaccgagucccucaccaccgccaugaccuccaccccccccaucaccuccuccaucacccccaccgacaccaugaccuccaugcgcaccaccaccuccuggcccaccgccaccaacacccucuccccccucaccuccuccauccucuccuccacccccguccccuccaccgaggucaccaccucccacaccaccaacaccaaccccgucuccacccucgucaccacccuccccaucaccaucacccgcuccacccucaccuccgagaccgccuaccccuccucccccaccuccaccgucaccgaguccaccaccgagaucaccuaccccaccaccaugaccgagaccuccuccaccgccaccucccucccccccaccuccucccucgucuccaccgccgagaccgccaagacccccaccaccaaccucgucaccaccaccaccaagaccaccucccacuccaccaccuccuucaccuccuccaccaucuacuccaccgccuccacccccaccaccgccaucaccuccguccccaccacccucggcaccauggucaccuccaccuccaugauccccuccaccgucuccaccggcauccccaccucccagcccaccaccaucacccccuccuccgucggcaucuccggcucccuccccaugaugaccgaccucaccuccgucuacaccgucuccuccauguccgcccgccccaccuccgucauccccuccucccccaccguccagaacaccgagaccuccaucuucgucuccaugauguccgccaccacccccuccggcggccccaccuucaccuccaccgagaacacccccacccgcucccuccucaccuccuuccccgucacccacuccuucuccuccuccauguccgccuccuccgucggcaccacccacacccaguccaucuccuccccccccgccaucaccuccacccuccacaccaccgccgaguccacccccucccccaccaccaccauguccuucaccaccuucaccaagauggagacccccuccuccaccgucgccaccaccggcaccggccagaccaccuucaccuccuccaccgccaccucccccaagaccaccacccucacccccaccuccgacaucuccaccggcuccuucaagaccgccgucuccuccaccccccccaucaccuccuccaucaccuccaccuacaccgucaccuccaugaccaccaccaccccccucggccccaccgccaccaacacccuccccuccuucaccuccuccgucuccuccuccacccccguccccuccaccgaggccaucaccuccggcaccaccaacaccaccccccucuccacccucgucaccaccuucuccaacuccgacaccuccuccacccccaccuccgagaccaccuaccccaccucccucaccuccgcccucaccgacuccaccacccgcaccaccuacuccaccaacaugaccggcacccucuccaccgucaccucccuccgccccaccuccuccucccuccucaccaccgucaccgccaccguccccaccaccaaccucgucaccaccaccaccaagaucaccucccacuccacccccuccuucaccuccuccaucgccaccaccgagacccccucccacuccaccccccgcuucaccuccuccaucaccaccaccgagacccccucccacuccaccccccgcuucaccuccuccaucaccaacaccaagaccaccucccacuccucccccuccuucaccuccuccaucaccaccaccgagaccaccucccacaacacccccucccucaccuccuccaucaccaccaccaagaccaccucccacuccacccccuccuacaccucccucaucaccaccaccaccaccaccucccacuccacccccuccuucaccuccuccaucaccaccaccgagaccaccucccacaacacccccucccucaccuccuccaucaccaccaccgagaccaccucccacuccacccccuccuucaccuccuccaucaccaccgagaccaccucccacuccacccccuccuucaccucccucaucaccaucaccgagaucaccucccacuccacccucuccuacaccaccuccaucaccaccaccgagacccccucccacuccacccucuccuucaccuccuccaucaccaccaccgagaccaccucccacuccacccccuccuucaccuccuccaucaccaccuccgagaugcccucccacuccacccccuccuucaccuccuccaucaccaccaccgagaacgccacccacuccacccccaacuucaccuccuccaucaccaccaccgagaccaccucccacuccacccccuccuucaccucccucaucaccaccaccgagaccaccucccaccgcuggggcaccaccgagaccaccuccuacuccacccccuccuucaccuccuccaacaccaucaccgagaccaccucccacuccacccccuccuacaucaccuccaucaccaccaccgagacccccuccuccuccacccccuccuucuccuccuccaucaccaccaccgagaccaccucccacuccacccccggcuucaccuccuccaucaccaccaccgagaccaccucccacuccacccccuccuucaccuccuccaucaccaccaccgagaccaccucccacgacacccccuccuucaccuccuccaucaccaccuccgagacccccucccacuccacccccuccuccaccucccucaucaccaccaccaagaccaccucccacuccacccccuccuucaccuccuccaucaccaccaccgagaccaccucccacuccgcccacuccuucaccuccuccaucaccaccaccgagaccaccucccacaacacccgcuccuucaccuccuccaucaccaccaccgagaccaacucccacuccaccaccuccuucaccuccuccaucaccaccaccgagaccaccucccacuccacccccuccuucuccuccuccaucaccaccaccgagaccccccuccacuccacccccggccucaccuccugggucaccaccaccaagaccaccucccacaucacccccggccucaccuccuccaucaccaccaccgagaccaccucccacuccacccccggcuucaccuccuccaucaccaccaccgagaccaccuccgaguccacccccucccucuccuccuccaccaucuacuccaccgucuccaccuccaccaccgccaucaccucccacuucaccaccuccgagaccgccgucacccccacccccgucacccccuccucccucuccaccgacauccccaccaccucccuccgcacccucacccccuccuccgucggcaccuccaccucccucaccaccaccaccgacuuccccuccauccccaccgacaucuccacccuccccacccgcacccacaucaucuccuccucccccuccauccaguccaccgagaccuccucccucgucggcaccaccucccccaccauguccaccguccgcaugacccuccgcaucaccgagaacacccccaucuccuccuucuccaccuccaucgucgucauccccgagacccccacccagaccccccccguccucaccuccgccaccggcacccagaccucccccgcccccaccaccgucaccuucggcuccaccgacuccuccaccuccacccuccacacccucacccccuccaccgcccucuccaccaucgucuccaccucccagguccccauccccuccacccacuccuccacccuccagaccacccccuccacccccucccuccagaccucccucaccuccaccuccgaguucaccaccgaguccuucacccgcggcuccaccuccaccaacgccauccucaccuccuucuccaccaucaucugguccuccacccccaccaucaucauguccuccucccccuccuccgccuccaucacccccgucuucuccaccaccauccacuccguccccuccucccccuacaucuucuccaccgagaacgucggcuccgccuccaucaccggcuuccccucccucuccuccuccgccaccaccuccaccuccuccaccuccuccucccucaccaccgcccucaccgagaucacccccuucuccuacaucucccuccccuccaccacccccugccccggcaccaucaccaucaccaucguccccgccucccccaccgaccccugcgucgagauggaccccuccaccgaggccaccuccccccccaccaccccccucaccgucuuccccuucaccaccgagauggucaccugccccaccuccaucuccauccagaccacccucaccaccuacauggacaccuccuccaugaugcccgaguccgaguccuccaucucccccaacgccuccuccuccaccggcaccggcaccguccccaccaacaccgucuucaccuccacccgccuccccaccuccgagaccuggcucuccaacuccuccgucaucccccucccccuccccggcgucuccaccaucccccucaccaugaagcccuccuccucccuccccaccauccuccgcaccuccuccaaguccacccaccccuccccccccaccacccgcaccuccgagacccccgucgccaccacccagacccccaccacccucaccucccgccgcaccacccgcaucaccucccagaugaccacccaguccacccucaccaccaccgccggcaccugcgacaacggcggcaccugggagcagggccagugcgccugccuccccggcuucuccggcgaccgcugccagcuccagacccgcugccagaacggcggccagugggacggccucaagugccagugccccuccaccuucuacggcuccuccugcgaguucgccgucgagcaggucgaccucgacgucgucgagaccgaggucggcauggaggucuccgucgaccagcaguucucccccgaccucaacgacaacaccucccaggccuaccgcgacuucaacaagaccuucuggaaccagaugcagaagaucuucgccgacaugcagggcuucaccuucaagggcgucgagauccucucccuccgcaacggcuccaucgucgucgacuaccucguccuccucgagaugcccuucuccccccagcucgaguccgaguacgagcaggucaagaccacccucaaggagggccuccagaacgccucccaggacgucaacuccugccaggacucccagacccucugcuucaagcccgacuccaucaaggucaacaacaacuccaagaccgagcucacccccgccgccaucugccgccgcgccgcccccaccggcuacgaggaguucuacuucccccucgucgaggccacccgccuccgcugcgucaccaagugcaccuccggcgucgacaacgccaucgacugccaccagggccagugcguccucgagaccuccggccccaccugccgcugcuacuccaccgacacccacugguucuccggcccccgcugcgaggucgccguccacuggcgcgcccucgucggcggccucaccgccggcgccgcccuccucguccuccuccuccucgcccucggcguccgcgccguccgcuccggcugguggggcggccagcgccgcggccgcuccugggaccaggaccgcaagugguucgagaccugggacgaggaggucgucggcaccuucuccaacuggggcuucgaggacgacggcaccgacaaggacaccaacuucuacgucgcccucgagaacgucgacaccaccaugaagguccacaucaagcgccccgagaugaccuccuccuccgucuga

SEQ ID NO: 46280 - RNA, 3531 nt, Artificial Sequence
  derived and/or modified sequence opt2 from MUC4__Homo_sapiens__NP_004523
augaagggcgcccgcuggcgccgcguccccugggucucccucuccugccucugccucugccuccucccccacgucguccccggcaugaccacccccucccucaagaccgacggcggccgccgcaccgccaccucccccccccccaccaccucccagaccaucaucuccaccauccccuccaccgccaugcacacccgcuccaccgccgcccccauccccauccuccccgagcgcggcgucucccucuuccccuacggcgccggcgccggcgaccucgaguucguccgccgcaccgucgacuucaccuccccccucuucaagcccgccaccggcuucccccucggcuccucccuccgcgacucccucuacuucaccgacaacggccagaucaucuuccccgaguccgacuaccagaucuucuccuaccccaacccccuccccaccggcuucaccggccgcgaccccgucgcccucgucgcccccuucugggacgacgccgacuucuccaccggccgcggcaccaccuucuaccaggaguacgagaccuucuacggcgagcacucccuccucguccagcaggccgaguccuggauccgcaagaugaccaacaacggcggcuacaaggcccgcugggcccucaaggucaccugggucaacgcccacgccuaccccgcccaguggacccucggcuccaacaccuaccaggccauccucuccaccgacggcucccgcuccuacgcccucuuccucuaccaguccggcggcaugcagugggacgucgcccagcgcuccggcaaccccguccucaugggcuucuccuccggcgacggcuacuucgagaacuccccccucaugucccagcccgucugggagcgcuaccgccccgaccgcuuccucaacuccaacuccggccuccagggccuccaguucuaccgccuccaccgcgaggagcgccccaacuaccgccucgagugccuccaguggcucaagucccagccccgcuggcccuccuggggcuggaaccaggucuccugccccugcuccuggcagcagggccgccgcgaccuccgcuuccagcccgucuccaucggccgcuggggccucggcucccgccagcucugcuccuucaccuccuggcgcggcggcgucugcugcuccuacggccccuggggcgaguuccgcgagggcuggcacguccagcgccccuggcagcucgcccaggagcucgagccccaguccuggugcugccgcuggaacgacaagcccuaccucugcgcccucuaccagcagcgccgcccccacgucggcugcgccaccuaccgccccccccagcccgccuggauguucggcgacccccacaucaccacccucgacggcgucuccuacaccuucaacggccucggcgacuuccuccucgucggcgcccaggacggcaacuccuccuuccuccuccagggccgcaccgcccagaccggcuccgcccaggccaccaacuucaucgccuucgccgcccaguaccgcuccuccucccucggccccgucaccguccaguggcuccucgagccccacgacgccauccgcguccuccucgacaaccagaccgucaccuuccagcccgaccacgaggacggcggcggccaggagaccuucaacgccaccggcguccuccucucccgcaacggcuccgaggucuccgccuccuucgacggcugggccaccgucuccgucaucgcccucuccaacauccuccacgccuccgccucccucccccccgaguaccagaaccgcaccgagggccuccucggcgucuggaacaacaaccccgaggacgacuuccgcaugcccaacggcuccaccaucccccccggcucccccgaggagaugcucuuccacuucggcaugaccuggcagaucaacggcaccggccuccucggcaagcgcaacgaccagcuccccuccaacuucacccccgucuucuacucccagcuccagaagaacuccuccugggccgagcaccucaucuccaacugcgacggcgacuccuccugcaucuacgacacccucgcccuccgcaacgccuccaucggccuccacacccgcgaggucuccaagaacuacgagcaggccaacgccacccucaaccaguacccccccuccaucaacggcggccgcgucaucgaggccuacaagggccagaccacccucauccaguacaccuccaacgccgaggacgccaacuucacccuccgcgacuccugcaccgaccucgagcucuucgagaacggcacccuccucuggacccccaagucccucgagcccuucacccucgagauccucgcccgcuccgccaagaucggccucgccuccgcccuccagccccgcaccgucgucugccacugcaacgccgagucccagugccucuacaaccagaccucccgcgucggcaacuccucccucgaggucgccggcugcaagugcgacggcggcaccuucggccgcuacugcgagggcuccgaggacgccugcgaggagcccugcuuccccuccguccacugcguccccggcaagggcugcgaggccugcccccccaaccucaccggcgacggccgccacugcgccgcccucggcuccuccuuccucugccagaaccaguccugccccgucaacuacugcuacaaccagggccacugcuacaucucccagacccucggcugccagcccaugugcaccugcccccccgccuucaccgacucccgcugcuuccucgccggcaacaacuucucccccaccgucaaccucgagcucccccuccgcgucauccagcuccuccucuccgaggaggagaacgccuccauggccgaggucaacgccuccgucgccuaccgccucggcacccucgacaugcgcgccuuccuccgcaacucccaggucgagcgcaucgacuccgccgcccccgccuccggcucccccauccagcacuggauggucaucuccgaguuccaguaccgcccccgcggccccgucaucgacuuccucaacaaccagcuccucgccgccgucgucgaggccuuccucuaccacgucccccgccgcuccgaggagccccgcaacgacgucgucuuccagcccaucuccggcgaggacguccgcgacgucaccgcccucaacgucuccacccucaaggccuacuuccgcugcgacggcuacaagggcuacgaccucgucuacuccccccaguccggcuucaccugcgucucccccugcucccgcggcuacugcgaccacggcggccagugccagcaccuccccuccggcccccgcugcuccugcgucuccuucuccaucuacaccgccuggggcgagcacugcgagcaccucuccaugaagcucgacgccuucuucggcaucuucuucggcgcccucggcggccuccuccuccucggcgucggcaccuucgucguccuccgcuucuggggcugcuccggcgcccgcuucuccuacuuccucaacuccgccgaggcccuccccuga

SEQ ID NO: 46281 - RNA, 16965 nt, Artificial Sequence
  derived and/or modified sequence opt2 from MUC5AC__Homo_sapiens__NP_001291288
auguccgucggccgccgcaagcucgcccuccucugggcccucgcccucgcccucgccugcacccgccacaccggccacgcccaggacggcuccuccgaguccuccuacaagcaccaccccgcccucucccccaucgcccgcggccccuccggcgucccccuccgcggcgccaccgucuuccccucccuccgcaccauccccgucguccgcgccuccaaccccgcccacaacggccgcgucugcuccaccuggggcuccuuccacuacaagaccuucgacggcgacgucuuccgcuuccccggccucugcaacuacgucuucuccgagcacugcggcgccgccuacgaggacuucaacauccagcuccgccgcucccaggaguccgccgcccccacccucucccgcguccucaugaaggucgacggcgucgucauccagcucaccaagggcuccguccucgucaacggccaccccguccuccuccccuucucccaguccggcguccucauccagcaguccuccuccuacaccaaggucgaggcccgccucggccucguccucauguggaaccacgacgacucccuccuccucgagcucgacaccaaguacgccaacaagaccugcggccucugcggcgacuucaacggcaugcccgucgucuccgagcuccucucccacaacaccaagcucacccccauggaguucggcaaccuccagaagauggacgaccccaccgaccagugccaggaccccguccccgagcccccccgcaacugcuccaccggcuucggcaucugcgaggagcuccuccacggccagcucuucuccggcugcgucgcccucgucgacgucggcuccuaccucgaggccugccgccaggaccucugcuucugcgaggacaccgaccuccucuccugcgucugccacacccucgccgaguacucccgccagugcacccacgccggcggccucccccaggacuggcgcggccccgacuucugcccccagaagugccccaacaacaugcaguaccacgagugccgcucccccugcgccgacaccugcuccaaccaggagcacucccgcgccugcgaggaccacugcgucgccggcugcuucugccccgagggcaccguccucgacgacaucggccagaccggcugcguccccgucuccaagugcgccugcgucuacaacggcgccgccuacgcccccggcgccaccuacuccaccgacugcaccaacugcaccugcuccggcggccgcugguccugccaggagguccccugccccggcaccugcuccguccucggcggcgcccacuucuccaccuucgacggcaagcaguacaccguccacggcgacugcuccuacguccucaccaagcccugcgacuccuccgccuucaccguccucgccgagcuccgccgcugcggccucaccgacuccgagaccugccucaaguccgucacccucucccucgacggcgcccagaccgucgucgucaucaaggccuccggcgaggucuuccucaaccagaucuacacccagcuccccaucuccgccgccaacgucaccaucuuccgccccuccaccuucuucaucaucgcccagaccucccucggccuccagcucaaccuccagcucguccccaccaugcagcucuucaugcagcucgcccccaagcuccgcggccagaccugcggccucugcggcaacuucaacuccauccaggccgacgacuuccgcacccucuccggcgucgucgaggccaccgccgccgccuucuucaacaccuucaagacccaggccgccugccccaacauccgcaacuccuucgaggaccccugcucccucuccgucgagaacgagaaguacgcccagcacuggugcucccagcucaccgacgccgacggccccuucggccgcugccacgccgccgucaagcccggcaccuacuacuccaacugcauguucgacaccugcaacugcgagcgcuccgaggacugccucugcgccgcccucuccuccuacguccacgccugcgccgccaagggcguccagcucggcggcuggcgcgacggcgucugcaccaagcccaugaccaccugccccaaguccaugaccuaccacuaccacgucuccaccugccagcccaccugccgcucccucuccgagggcgacaucaccugcuccgucggcuucauccccgucgacggcugcaucugccccaagggcaccuuccucgacgacaccggcaagugcguccaggccuccaacugccccugcuaccaccgcggcuccaugauccccaacggcgaguccguccacgacuccggcgccaucugcaccugcacccacggcaagcucuccugcaucggcggccaggcccccgcccccgucugcgccgcccccauggucuucuucgacugccgcaacgccacccccggcgacaccggcgccggcugccagaaguccugccacacccucgacaugaccugcuacuccccccagugcguccccggcugcgucugccccgacggccucgucgccgacggcgagggcggcugcaucaccgccgaggacugccccugcguccacaacgaggccuccuaccgcgccggccagaccauccgcgucggcugcaacaccugcaccugcgacucccgcauguggcgcugcaccgacgaccccugccucgccaccugcgccgucuacggcgacggccacuaccucaccuucgacggccaguccuacuccuucaacggcgacugcgaguacacccucguccagaaccacugcggcggcaaggacuccacccaggacuccuuccgcgucgucaccgagaacguccccugcggcaccaccggcaccaccugcuccaaggccaucaagaucuuccucggcggcuucgagcucaagcucucccacggcaaggucgaggucaucggcaccgacgagucccaggagguccccuacaccauccgccagaugggcaucuaccucgucgucgacaccgacaucggccucguccuccucugggacaagaagaccuccaucuucaucaaccucucccccgaguucaagggccgcgucugcggccucugcggcaacuucgacgacaucgccgucaacgacuucgccacccgcucccgcuccgucgucggcgacguccucgaguucggcaacuccuggaagcucucccccuccugccccgacgcccucgcccccaaggaccccugcaccgccaaccccuuccgcaaguccugggcccagaagcagugcuccauccuccacggccccaccuucgccgccugccacgcccacgucgagcccgcccgcuacuacgaggccugcgucaacgacgccugcgccugcgacuccggcggcgacugcgagugcuucugcaccgccgucgccgccuacgcccaggccugccacgaggucggccucugcgucuccuggcgcacccccuccaucugcccccucuucugcgacuacuacaaccccgagggccagugcgaguggcacuaccagcccugcggcguccccugccuccgcaccugccgcaacccccgcggcgacugccuccgcgacguccgcggccucgagggcugcuaccccaagugcccccccgaggcccccaucuucgacgaggacaagaugcagugcgucgccaccugccccacccccccccuccccccccgcugccacguccacggcaaguccuaccgccccggcgccgucguccccuccgacaagaacugccaguccugccucugcaccgagcgcggcgucgagugcaccuacaaggccgaggccugcgucugcaccuacaacggccagcgcuuccaccccggcgacgucaucuaccacaccaccgacggcaccggcggcugcaucuccgcccgcugcggcgccaacggcaccaucgagcgccgcgucuaccccugcucccccaccacccccgucccccccaccaccuucuccuucuccacccccccccucgucgucuccuccacccacacccccuccaacggccccuccuccgcccacaccggcccccccuccuccgccuggcccaccaccgccggcaccuccccccgcacccgccuccccaccgccuccgccucccucccccccgucugcggcgagaagugccucuggucccccuggauggacgucucccgccccggccgcggcaccgacuccggcgacuucgacacccucgagaaccuccgcgcccacggcuaccgcgucugcgaguccccccgcuccgucgagugccgcgccgaggacgcccccggcgucccccuccgcgcccucggccagcgcguccagugcucccccgacgucggccucaccugccgcaaccgcgagcaggccuccggccucugcuacaacuaccagauccgcguccagugcugcaccccccuccccugcuccaccuccuccucccccgcccagaccaccccccccaccaccuccaagaccaccgagacccgcgccuccggcuccuccgcccccuccuccacccccggcaccgucucccucuccaccgcccgcaccacccccgcccccggcaccgccaccuccgucaagaagaccuucuccacccccucccccccccccguccccgccaccuccaccuccuccauguccaccaccgcccccggcaccuccgucgucuccuccaagcccacccccaccgagcccuccaccuccuccugccuccaggagcucugcaccuggaccgaguggaucgacggcuccuaccccgcccccggcaucaacggcggcgacuucgacaccuuccagaaccuccgcgacgagggcuacaccuucugcgaguccccccgcuccguccagugccgcgccgaguccuuccccaacaccccccucgccgaccucggccaggacgucaucugcucccacaccgagggccucaucugccucaacaagaaccagcucccccccaucugcuacaacuacgagauccgcauccagugcugcgagaccgucaacgucugccgcgacaucacccgccuccccaagaccgucgccaccacccgccccaccccccaccccaccggcgcccagacccagaccaccuucaccacccacaugcccuccgccuccaccgagcagcccaccgccaccucccgcggcggccccaccgccaccuccgucacccagggcacccacaccacccucgucacccgcaacugccacccccgcugcaccuggaccaagugguucgacgucgacuuccccucccccggcccccacggcggcgacaaggagaccuacaacaacaucauccgcuccggcgagaagaucugccgccgccccgaggagaucacccgccuccagugccgcgccaagucccaccccgaggucuccaucgagcaccucggccaggucguccagugcucccgcgaggagggccucgucugccgcaaccaggaccagcagggccccuucaagaugugccucaacuacgagguccgcguccucugcugcgagaccccccgcggcugccacaugaccuccacccccggcuccaccuccuccucccccgcccagaccacccccuccaccaccuccaagaccaccgagacccaggccuccggcuccuccgcccccuccuccacccccggcaccgucucccucuccaccgcccgcaccacccccgcccccggcaccgccaccuccgucaagaagaccuucuccacccccucccccccccccguccccgccaccuccaccuccuccauguccaccaccgcccccggcaccuccgucgucuccuccaagcccacccccaccgagcccuccaccuccuccugccuccaggagcucugcaccuggaccgaguggaucgacggcuccuaccccgcccccggcaucaacggcggcgacuucgacaccuuccagaaccuccgcgacgagggcuacaccuucugcgaguccccccgcuccguccagugccgcgccgaguccuuccccaacaccccccucgccgaccucggccaggacgucaucugcucccacaccgagggccucaucugccucaacaagaaccagcucccccccaucugcuacaacuacgagauccgcauccagugcugcgagaccgucaacgucugccgcgacaucacccgcccccccaagaccgucgccaccacccgccccaccccccaccccaccggcgcccagacccagaccaccuucaccacccacaugcccuccgccuccaccgagcagcccaccgccaccucccgcggcggccccaccgccaccuccgucacccagggcacccacaccacccccgucacccgcaacugccacccccgcugcaccuggaccaccugguucgacgucgacuuccccucccccggcccccacggcggcgacaaggagaccuacaacaacaucauccgcuccggcgagaagaucugccgccgccccgaggagaucacccgccuccagugccgcgccaagucccaccccgaggucuccaucgagcaccucggccaggucguccagugcucccgcgaggagggccucgucugccgcaaccaggaccagcagggccccuucaagaugugccucaacuacgagguccgcguccucugcugcgagacccccaagggcugccccgucaccuccacccccgucaccgcccccuccacccccuccggccgcgccaccucccccacccaguccaccuccuccuggcagaagucccgcaccaccacccucgucaccaccuccaccaccuccaccccccagaccuccaccaccuacgcccacaccaccuccaccaccuccgcccccaccgcccgcaccaccuccgcccccaccacccgcaccaccuccgccucccccgccuccaccaccuccggccccggcaacacccccucccccguccccaccaccuccaccaucuccgcccccaccaccuccaucaccuccgcccccaccaccuccaccaccuccgcccccaccuccuccaccaccuccggccccggcaccacccccucccccguccccaccaccuccaucaccuccgcccccaccaccuccaccaccuccgcccccaccaccuccaccaccuccgcccgcaccuccuccaccaccuccgccaccaccaccucccgcaucuccggccccgagaccacccccucccccguccccaccaccuccaccaccuccgccaccaccaccuccaccaccuccgcccccaccaccuccaccaccuccgcccccaccuccuccaccaccuccuccccccagaccuccaccaccuccgcccccaccaccuccaccaccuccggccccggcaccacccccucccccguccccaccaccuccaccaccuccgcccccaccacccgcaccaccuccgcccccaaguccuccaccaccuccgccgccaccaccuccaccaccuccggccccgagaccaccccccgccccguccccaccaccuccaccaccuccucccccaccaccuccaccaccuccgcccccaccaccuccaccaccuccgccuccaccaccuccaccaccuccggcgccggcaccacccccucccccguccccaccaccuccaccaccuccgcccccaccaccuccaccaccuccgcccccaucuccuccaccaccuccgccaccaccaccuccaccaccuccggccccggcaccacccccucccccguccccaccaccuccaccaccuccgcccccaccaccuccaccaccuccggccccggcaccacccccuccgccguccccaccaccuccaucaccuccgcccccaccaccuccaccaacuccgcccccaucuccuccaccaccuccgccaccaccaccucccgcaucuccggccccgagaccacccccucccccguccccaccgccuccaccaccuccgccuccaccaccuccaccaccuccggccccggcaccacccccucccccguccccaccaccuccaccaucuccguccccaccaccuccaccaccuccgccuccaccaccuccaccaccuccgccuccaccaccuccaccaccuccggccccggcaccacccccucccccguccccaccaccuccaccaccuccgcccccaccaccuccaccaccuccgcccccaccaccuccaccaucuccgcccccaccaccuccaccaccuccgccaccaccaccuccaccaccuccgcccccaccccccgccgcaccuccgcccccaccaccuccaccaucuccgccuccaccaccuccaccaccuccgccaccaccaccuccaccaccuccgccaccaccaccuccaccaucuccgcccccaccaccuccaccacccucucccccaccaccuccaccaccuccaccaccaucaccuccaccaccuccgcccccaucuccuccaccaccuccaccccccagaccuccaccaccuccgcccccaccaccuccaccaccuccggccccggcaccaccuccucccccguccccaccaccuccaccaccuccgcccccaccaccuccaccaccuccgcccccaccacccgcaccaccuccguccccaccuccuccaccaccuccaccgccaccaccuccaccaccuccggccccggcaccacccccucccccguccccaccaccuccaccaccuccgcccccaccacccgcaccaccuccgcccccaccaccuccaccaccuccgcccccaccaccuccaccaccuccgcccccaccuccuccaccaccuccgccaccaccaccuccaccaucuccguccccaccaccuccaccaccuccguccccggcaccacccccucccccguccccaccaccuccaccaucuccguccccaccaccuccaccaccuccgccuccaccaccuccaccaccuccggccccggcaccacccccucccccguccccaccaccuccaccaccuccgcccccaccaccuccaccaccuccgcccccaccaccuccaccaucuccgcccccaccaccuccacccccuccgcccccaccaccuccaccacccucgcccccaccaccuccaccaccuccgcccccaccaccuccaccaccuccacccccaccuccuccaccaccuccuccccccagaccuccaccaccuccgccuccaccaccuccaucaccuccggccccggcaccacccccucccccguccccaccaccuccaccaccuccgcccccaccaccuccaccaccuccgccgccaccaccuccaccaucuccgcccccaccaccuccaccaccuccgcccccaccaccuccaccaccuccgccuccaccgccuccaagaccuccggccucggcaccacccccucccccauccccaccaccuccaccaccuccccccccaccaccuccaccaccuccgccuccaccgccuccaagaccuccggccccggcaccacccccucccccguccccaccaccuccaccaucuucgccccccgcaccuccaccaccuccgccuccaccaccuccaccacccccggccccggcaccacccccucccccguccccaccaccuccaccgccuccgucuccaagaccuccaccucccacgucuccaucuccaagaccacccacucccagcccgucacccgcgacugccaccuccgcugcaccuggaccaagugguucgacaucgacuuccccucccccggcccccacggcggcgacaaggagaccuacaacaacaucauccgcuccggcgagaagaucugccgccgccccgaggagaucacccgccuccagugccgcgccgagucccaccccgaggucuccaucgagcaccucggccaggucguccagugcucccgcgaggagggccucgucugccgcaaccaggaccagcagggccccuucaagaugugccucaacuacgagguccgcguccucugcugcgagacccccaagggcugccccgucaccuccacccccgucaccgcccccuccacccccuccggccgcgccaccucccccacccaguccaccuccuccuggcagaagucccgcaccaccacccucgucaccaccuccaccaccuccaccccccagaccuccaccaccuccgcccccaccaccuccaccaccuccgcccccaccaccuccaccaccuccgcccccaccaccuccaccaccuccaccccccagaccuccaucuccuccgcccccaccuccuccaccaccuccgcccccaccuccuccaccaucuccgcccgcaccaccuccaucaucuccgcccccaccaccuccaccaccuccucccccaccaccuccaccaccuccgccaccaccaccuccaccaccuccgcccccaccuccuccaccaccuccaccccccagaccuccaagaccuccgccgccaccuccuccaccaccuccggcuccggcaccacccccucccccgucaccaccaccuccaccgccuccgucuccaagaccuccaccucccacgucuccgucuccaagaccacccacucccagcccgucacccgcgacugccacccccgcugcaccuggaccaagugguucgacgucgacuuccccucccccggcccccacggcggcgacaaggagaccuacaacaacaucauccgcuccggcgagaagaucugccgccgccccgaggagaucacccgccuccagugccgcgccaagucccaccccgaggucuccaucgagcaccucggccaggucguccagugcucccgcgaggagggccucgucugccgcaaccaggaccagcagggccccuucaagaugugccucaacuacgagguccgcguccucugcugcgagacccccaagggcugccccgucaccuccaccuccgucaccgcccccuccacccccuccggccgcgccaccucccccacccaguccaccuccuccuggcagaagucccgcaccaccacccucgucaccuccuccaucaccuccaccacccagaccuccaccaccuccgcccccaccaccuccaccacccccgccuccauccccuccaccaccuccgcccccaccaccuccaccaccuccgcccccaccaccuccaccaccuccgcccccaccaccuccaccaccuccaccccccagaccaccaccuccuccgcccccaccuccuccaccaccuccgcccccaccaccuccaccaucuccgcccccaccaccuccaccaucuccgcccccaccaccuccaccaccuccgcccccaccgccuccaccaccuccgcccccaccuccaccuccuccgcccccaccaccaacaccaccuccgcccccaccaccuccaccaccuccgcccccaucaccuccaccaucuccgcccccaccaccuccaccaccuccaccccccagaccuccaccaucuccucccccaccaccuccaccaccuccaccccccagaccuccaccaccuccucccccaccaccuccaccaccuccgcccccaccaccuccaccaccuccgcccccaccaccuccaccaccuccaccccccagaccuccaucuccuccgcccccaccuccuccaccaccuccgcccccaccgccuccaccaucuccgcccccaccaccuccaccaccuccuuccacaccaccuccaccaccuccccccccaccuccuccaccuccuccaccccccagaccuccaagaccuccgccgccaccuccuccaccaccuccggcuccggcaccacccccucccccguccccaccaccuccaccgccuccgucuccaagaccuccaccucccacgucuccgucuccaagaccacccacucccagcccgucacccgcgacugccacccccgcugcaccuggaccaagugguucgacgucgacuuccccucccccggcccccacggcggcgacaaggagaccuacaacaacaucauccgcuccggcgagaagaucugccgccgccccgaggagaucacccgccuccagugccgcgccgagucccaccccgaggucuccaucgagcaccucggccaggucguccagugcucccgcgaggagggccucgucugccgcaaccaggaccagcagggccccuucaagaugugccucaacuacgagguccgcguccucugcugcgagacccccaagggcugccccgucaccuccacccccgucaccgcccccuccacccccuccggccgcgccaccucccccacccaguccaccuccuccuggcagaagucccgcaccaccacccucgucaccaccuccaccaccuccaccccccagaccuccaccaccuccgcccccaccaccuccaccauccccgccuccacccccuccaccaccuccgcccccaccaccuccaccaccuccgcccccaccaccuccaccaccuccgcccccacccaccgcaccaccuccggccccaccaccuccaccacccucgcccccaccaccuccaccaccuccgcccccaccaccuccaccaacuccgcccccaccaccuccaccaucuccgccuccaccaccuccaccaucuccgcccccaccaccuccaccaucuccucccccaccuccuccaccaccuccaccccccagaccuccaagaccuccgccgccaccuccuccaccaccuccggcuccggcaccacccccucccccguccccaccaccuccaccaccuccgccuccaccaccuccaccaccuccgcccccaccaccuccaccaccuccggccccggcaccacccccucccccguccccuccaccuccaccaccuccgccgccaccaccuccaccaccuccgcccccaccacccgcaccaccuccgcccccaccuccuccaugaccuccggccccggcaccacccccucccccguccccaccaccuccaccaccuccgcccccaccaccuccaccaccuccggccccggcaccacccccucccccguccccaccaccuccaccaccuccgcccccaucaccuccaccaccuccggccccggcuccacccccucccccguccccaccaccuccaccaccuccgcccccaccaccuccaccaccuccgccuccaccgccuccaccaccuccggccccggcaccacccccucccccguccccaccaccuccaccaccuccgcccccaccacccgcaccaccuccgccuccaccgccuccaccaccuccggccccggcuccacccccucccccguccccaccaccuccaccaccuccgcccccaccacccgcaccacccccgccuccaccgccuccaccaccuccggccccggcaccacccccucccccguccccaccaccuccaccaccuccgccuccaccaccuccaccaucucccuccccaccaccuccaccaccuccgcccccaucaccuccaugaccuccggccccggcaccacccccucccccguccccaccaccuccaccaccuccgcccccaccaccuccaccaccuccgccuccaccgccuccaccaccuccggccccggcaccacccccucccccguccccaccaccuccaccaccuccgcccccaccaccuccaccaccuccgccuccaccgccuccaccaccuccggccccggcaccucccucucccccguccccaccaccuccaccaccuccgcccccaccaccuccaccaccuccggccccggcaccacccccucccccguccccaccaccuccaccaccuccgcccccaccaccuccaccaccuccggccccggcaccacccccucccccguccccaccaccuccaccacccccgucuccaagaccuccaccucccaccucuccgucuccaagaccacccacucccagcccgucaccuccgacugccacccccucugcgccuggaccaagugguucgacgucgacuuccccucccccggcccccacggcggcgacaaggagaccuacaacaacaucauccgcuccggcgagaagaucugccgccgccccgaggagaucacccgccuccagugccgcgccgagucccaccccgaggucaacaucgagcaccucggccaggucguccagugcucccgcgaggagggccucgucugccgcaaccaggaccagcagggccccuucaagaugugccucaacuacgagguccgcguccucugcugcgagaccccccgcggcugccccgucaccuccgucacccccuacggcaccucccccaccaacgcccucuaccccucccucuccaccuccauggucuccgccuccgucgccuccaccuccgucgccuccuccuccgucgccuccuccuccgucgccuacuccacccagaccugcuucugcaacgucgccgaccgccucuaccccgccggcuccaccaucuaccgccaccgcgaccucgccggccacugcuacuacgcccucugcucccaggacugccaggucguccgcggcgucgacuccgacugccccuccaccacccucccccccgcccccgccaccucccccuccaucuccaccuccgagcccgucaccgagcucggcugccccaacgccguccccccccgcaagaagggcgagaccugggccacccccaacugcuccgaggccaccugcgagggcaacaacgucaucucccuccgcccccgcaccugcccccgcgucgagaagcccaccugcgccaacggcuaccccgccgucaaggucgccgaccaggacggcugcugccaccacuaccagugccagugcgucugcuccggcuggggcgacccccacuacaucaccuucgacggcaccuacuacaccuuccucgacaacugcaccuacguccucguccagcagaucguccccgucuacggccacuuccgcguccucgucgacaacuacuucugcggcgccgaggacggccucuccugcccccgcuccaucauccucgaguaccaccaggaccgcgucguccucacccgcaagcccguccacggcgucaugaccaacgagaucaucuucaacaacaaggucgucucccccggcuuccgcaagaacggcaucgucgucucccgcaucggcgucaagauguacgccaccauccccgagcucggcguccaggucauguucuccggccucaucuucuccgucgagguccccuucuccaaguucgccaacaacaccgagggccagugcggcaccugcaccaacgaccgcaaggacgagugccgcaccccccgcggcaccgucgucgccuccugcuccgagauguccggccucuggaacgucuccauccccgaccagcccgccugccaccgcccccaccccacccccaccaccgucggccccaccaccgucggcuccaccaccgucggccccaccaccgucggcuccaccaccgucggccccaccaccccccccgcccccugccuccccucccccaucugccagcucauccucuccaaggucuucgagcccugccacaccgucauccccccccuccucuucuacgagggcugcgucuucgaccgcugccacaugaccgaccucgacgucgucugcuccucccucgagcucuacgccgcccucugcgccucccacgacaucugcaucgacuggcgcggccgcaccggccacaugugccccuucaccugccccgccgacaaggucuaccagcccugcggccccuccaaccccuccuacugcuacggcaacgacuccgccucccucggcgcccuccccgaggccggccccaucaccgagggcugcuucugccccgagggcaugacccucuucuccaccuccgcccaggucugcguccccaccggcugcccccgcugccucggcccccacggcgagcccgucaaggucggccacaccgucggcauggacugccaggagugcaccugcgaggccgccaccuggacccucaccugccgccccaagcucugcccccucccccccgccugcccccuccccggcuucguccccguccccgccgccccccaggccggccagugcugcccccaguacuccugcgccugcaacaccucccgcugccccgcccccgucggcugccccgagggcgcccgcgccauccccaccuaccaggagggcgccugcugccccguccagaacugcuccuggaccgucugcuccaucaacggcacccucuaccagcccggcgccgucgucuccuccucccucugcgagaccugccgcugcgagcuccccggcggcccccccuccgacgccuucgucgucuccugcgagacccagaucugcaacacccacugccccgucggcuucgaguaccaggagcaguccggccagugcugcggcaccugcguccaggucgccugcgucaccaacaccuccaagucccccgcccaccucuucuaccccggcgagaccugguccgacgccggcaaccacugcgucacccaccagugcgagaagcaccaggacggccucgucgucgucaccaccaagaaggccugccccccccucuccugcucccucgacgaggcccgcauguccaaggacggcugcugccgcuucugcccccccccccccccccccuaccagaaccaguccaccugcgccgucuaccaccgcucccucaucauccagcagcagggcugcuccuccuccgagcccguccgccucgccuacugccgcggcaacugcggcgacuccuccuccauguacucccucgagggcaacaccgucgagcaccgcugccagugcugccaggagcuccgcaccucccuccgcaacgucacccuccacugcaccgacggcuccucccgcgccuucuccuacaccgaggucgaggagugcggcugcaugggccgccgcugccccgcccccggcgacacccagcacuccgaggaggccgagcccgagcccucccaggaggccgaguccggcuccugggagcgcggcguccccgucucccccaugcacuga

SEQ ID NO: 46282 - RNA, 17289 nt, Artificial Sequence
  derived and/or modified sequence opt2 from MUC5B__Homo_sapiens__NP_002449
augggcgcccccuccgccugccgcacccucguccucgcccucgccgccaugcucgucgucccccaggccgagacccagggccccgucgagcccuccugggagaacgccggccacaccauggacggcggcgcccccaccuccucccccacccgccgcgucuccuucgucccccccgucaccgucuuccccucccucuccccccucaaccccgcccacaacggccgcgucugcuccaccuggggcgacuuccacuacaagaccuucgacggcgacgucuuccgcuuccccggccucugcaacuacgucuucuccgagcacugccgcgccgccuacgaggacuucaacguccagcuccgccgcggccucgucggcucccgccccgucgucacccgcgucgucaucaaggcccagggccucguccucgaggccuccaacggcuccguccucaucaacggccagcgcgaggagcuccccuacucccgcaccggccuccucgucgagcaguccggcgacuacaucaaggucuccauccgccucguccucaccuuccucuggaacggcgaggacuccgcccuccucgagcucgaccccaaguacgccaaccagaccugcggccucugcggcgacuucaacggccuccccgccuucaacgaguucuacgcccacaacgcccgccucaccccccuccaguucggcaaccuccagaagcucgacggccccaccgagcagugccccgacccccucccccuccccgccggcaacugcaccgacgaggagggcaucugccaccgcacccuccucggccccgccuucgccgagugccacgcccucgucgacuccaccgccuaccucgccgccugcgcccaggaccucugccgcugccccaccugccccugcgccaccuucgucgaguacucccgccagugcgcccacgccggcggccagccccgcaacuggcgcugccccgagcucugcccccgcaccugcccccucaacaugcagcaccaggagugcggcucccccugcaccgacaccugcuccaacccccagcgcgcccagcucugcgaggaccacugcgucgacggcugcuucugcccccccggcaccguccucgacgacaucacccacuccggcugccucccccucggccagugccccugcacccacggcggccgcaccuacucccccggcaccuccuucaacaccaccugcuccuccugcaccugcuccggcggccucuggcagugccaggaccuccccugccccggcaccugcuccguccagggcggcgcccacaucuccaccuacgacgagaagcucuacgaccuccacggcgacugcuccuacguccucuccaagaagugcgccgacuccuccuucaccguccucgccgagcuccgcaagugcggccucaccgacaacgagaacugccucaaggccgucacccucucccucgacggcggcgacaccgccauccgcguccaggccgacggcggcgucuuccucaacuccaucuacacccagcucccccucuccgccgccaacaucacccucuucacccccuccuccuucuucaucgucguccagaccggccucggccuccagcuccucguccagcucgucccccucaugcaggucuucguccgccucgaccccgcccaccagggccagaugugcggccucugcggcaacuucaaccagaaccaggccgacgacuucaccgcccucuccggcgucgucgaggccaccggcgccgccuucgccaacaccuggaaggcccaggccgccugcgccaacgcccgcaacuccuucgaggaccccugcucccucuccgucgagaacgagaacuacgcccgccacuggugcucccgccucaccgaccccaacuccgccuucucccgcugccacuccaucaucaaccccaagcccuuccacuccaacugcauguucgacaccugcaacugcgagcgcuccgaggacugccucugcgccgcccucuccuccuacguccacgccugcgccgccaagggcguccagcucuccgacuggcgcgacggcgucugcaccaaguacaugcagaacugccccaagucccagcgcuacgccuacgucgucgacgccugccagcccaccugccgcggccucuccgaggccgacgucaccugcuccgucuccuucguccccgucgacggcugcaccugccccgccggcaccuuccucaacgacgccggcgccugcguccccgcccaggagugccccugcuacgcccacggcaccguccucgcccccggcgaggucguccacgacgagggcgccgucugcuccugcaccggcggcaagcucuccugccucggcgccucccuccagaaguccaccggcugcgccgcccccauggucuaccucgacugcuccaacuccuccgccggcacccccggcgccgagugccuccgcuccugccacacccucgacgucggcugcuucuccacccacugcgucuccggcugcgucugcccccccggccucgucuccgacggcuccggcggcugcaucgccgaggaggacugccccugcguccacaacgaggccaccuacaagcccggcgagaccauccgcgucgacugcaacaccugcaccugccgcaaccgccgcugggagugcucccaccgccucugccucggcaccugcgucgccuacggcgacggccacuucaucaccuucgacggcgaccgcuacuccuucgagggcuccugcgaguacauccucgcccaggacuacugcggcgacaacaccacccacggcaccuuccgcaucgucaccgagaacauccccugcggcaccaccggcaccaccugcuccaaggccaucaagcucuucgucgaguccuacgagcucauccuccaggagggcaccuucaaggccgucgcccgcggccccggcggcgacccccccuacaagauccgcuacaugggcaucuuccucgucaucgagacccacggcauggccgucuccugggaccgcaagaccuccgucuucauccgccuccaccaggacuacaagggccgcgucugcggccucugcggcaacuucgacgacaacgccaucaacgacuucgccacccgcucccgcuccgucgucggcgacgcccucgaguucggcaacuccuggaagcucucccccuccugccccgacgcccucgcccccaaggaccccugcaccgccaaccccuuccgcaaguccugggcccagaagcagugcuccauccuccacggccccaccuucgccgccugccgcucccaggucgacuccaccaaguacuacgaggccugcgucaacgacgccugcgccugcgacuccggcggcgacugcgagugcuucugcaccgccgucgccgccuacgcccaggccugccacgacgccggccucugcgucuccuggcgcacccccgacaccugcccccucuucugcgacuucuacaacccccacggcggcugcgaguggcacuaccagcccugcggcgcccccugccucaagaccugccgcaaccccuccggccacugccucgucgaccuccccggccucgagggcugcuaccccaagugcccccccucccagcccuucuucaacgaggaccagaugaagugcgucgcccagugcggcugcuacgacaaggacggcaacuacuacgacgucggcgcccgcguccccaccgccgagaacugccaguccugcaacugcacccccuccggcauccagugcgcccacucccucgaggccugcaccugcaccuacgaggaccgcaccuacuccuaccaggacgucaucuacaacaccaccgacggccucggcgccugccucaucgccaucugcggcuccaacggcaccaucauccgcaaggccgucgccugccccggcacccccgccaccacccccuucaccuucaccaccgccugggucccccacuccaccaccucccccgcccuccccgucuccaccgucugcguccgcgaggucugccgcugguccuccugguacaacggccaccgccccgagcccggccucggcggcggcgacuucgagaccuucgagaaccuccgccagcgcggcuaccaggucugccccguccucgccgacaucgagugccgcgccgcccagcuccccgacaugccccucgaggagcucggccagcaggucgacugcgaccgcaugcgcggccucaugugcgccaacucccagcagucccccccccucugccacgacuacgagcuccgcguccucugcugcgaguacguccccugcggccccucccccgcccccggcaccuccccccagcccucccucuccgccuccaccgagcccgccguccccacccccacccagaccaccgccaccgagaagaccacccucugggucacccccuccauccgcuccaccgccgcccucaccucccagaccggcuccuccuccggccccgucaccgucacccccuccgcccccggcaccaccaccugccagccccgcugccaguggaccgagugguucgacgaggacuaccccaaguccgagcagcucggcggcgacgucgaguccuacgacaagauccgcgccgccggcggccaccucugccagcagcccaaggacaucgagugccaggccgaguccuuccccaacuggacccucgcccaggucggccagaagguccacugcgacguccacuucggccucgucugccgcaacugggagcaggagggcgucuucaagaugugcuacaacuaccgcauccgcguccucugcugcuccgacgaccacugccgcggccgcgccaccacccccccccccaccaccgagcucgagaccgccaccaccaccaccacccaggcccucuucuccaccccccagcccaccuccucccccggccucacccgcgccccccccgccuccaccaccgccguccccacccucuccgagggccucaccuccccccgcuacaccuccacccucggcaccgccaccaccggcggccccaccacccccgccggcuccaccgagcccaccguccccggcgucgccaccuccacccuccccacccgcuccgcccuccccggcaccaccggcucccucggcaccuggcgccccucccagccccccacccucgcccccaccaccauggccaccucccgcgcccgccccaccggcaccgccuccaccgccuccaaggagccccucaccaccucccucgcccccacccucaccuccgagcucuccaccucccaggccgagaccuccaccccccgcaccgagaccaccauguccccccucaccaacaccaccaccucccagggcaccacccgcugccagcccaagugcgaguggaccgagugguucgacgucgacuuccccaccuccggcgucgccggcggcgacauggagaccuucgagaacauccgcgccgccggcggcaagaugugcugggcccccaaguccaucgagugccgcgccgagaacuaccccgaggucuccaucgaccaggucggccagguccucaccugcucccucgagaccggccucaccugcaagaacgaggaccagaccggccgcuucaacaugugcuucaacuacaacguccgcguccucugcugcgacgacuacucccacugccccuccacccccgccaccuccuccaccgccacccccuccuccacccccggcaccaccuggauccucaccaagcccaccaccaccgccaccaccaccgccuccaccggcuccaccgccacccccaccuccacccuccgcaccgcccccccccccaagguccucaccaccaccgccaccacccccaccgucaccuccuccaaggccacccccuccuccucccccggcaccgccaccgcccuccccgcccuccgcuccaccgccaccacccccaccgccaccuccgucacccccauccccuccuccucccucggcaccaccuggacccgccucucccagaccaccacccccaccgccaccauguccaccgccacccccuccuccacccccgagaccgcccacaccuccaccguccucaccgccaccgccaccaccaccggcgccaccggcuccgucgccacccccuccuccacccccggcaccgcccacaccaccaagguccccaccaccaccaccaccggcuucaccgccacccccuccuccucccccggcaccgcccucaccccccccgucuggaucuccaccaccaccacccccaccacccgcggcuccaccgucacccccuccuccauccccggcaccacccacaccgccaccguccucaccaccaccaccaccaccgucgccaccggcuccauggccacccccuccuccuccacccagaccuccggcaccccccccucccucaccaccaccgccaccaccaucaccgccaccggcuccaccaccaaccccuccuccacccccggcaccacccccaucccccccguccucaccaccaccgccaccacccccgccgccaccuccaacaccgucacccccuccuccgcccucggcaccacccacaccccccccguccccaacaccauggccaccacccacggccgcucccucccccccuccuccccccacaccguccgcaccgccuggaccuccgccaccuccggcauccucggcaccacccacaucaccgagcccuccaccgucaccucccacacccucgccgccaccaccggcaccacccagcacuccacccccgcccucuccuccccccaccccuccucccgcaccaccgaguccccccccucccccggcaccaccacccccggccacaccaccgccaccucccgcaccaccgccaccgccacccccuccaagacccgcaccuccacccuccuccccuccucccccaccuccgcccccaucaccaccgucgucaccaugggcugcgagccccagugcgccugguccgaguggcucgacuacuccuaccccaugcccggccccuccggcggcgacuucgacaccuacuccaacauccgcgccgccggcggcgccgucugcgagcagccccucggccucgagugccgcgcccaggcccagcccggcgucccccuccgcgagcucggccaggucgucgagugcucccucgacuucggccucgucugccgcaaccgcgagcaggucggcaaguucaagaugugcuucaacuacgagauccgcgucuucugcugcaacuacggccacugccccuccacccccgccaccuccuccaccgccaugcccuccuccacccccggcaccaccuggauccucaccgagcucaccaccaccgccaccaccaccgaguccaccggcuccaccgccacccccuccuccacccccggcaccaccuggauccucaccgagcccuccaccaccgccaccgucaccguccccaccggcuccaccgccaccgccuccuccacccaggccaccgccggcaccccccacgucuccaccaccgccaccacccccaccgucaccuccuccaaggccacccccuucuccucccccggcaccgccaccgcccuccccgcccuccgcuccaccgccaccacccccaccgccaccuccuucaccgccauccccuccuccucccucggcaccaccuggacccgccucucccagaccaccacccccaccgccaccauguccaccgccacccccuccuccacccccgagaccguccacaccuccaccguccucaccaccaccgccaccaccaccggcgccaccggcuccgucgccacccccuccuccacccccggcaccgcccacaccaccaagguccucaccaccaccaccaccggcuucaccgccacccccuccuccucccccggcaccgcccgcacccuccccgucuggaucuccaccaccaccacccccaccacccgcggcuccaccgucacccccuccuccauccccggcaccacccacacccccaccguccucaccaccaccaccaccaccgucgccaccggcuccauggccacccccuccuccuccacccagaccuccggcaccccccccucccucaccaccaccgccaccaccaucaccgccaccggcuccaccaccaaccccuccuccacccccggcaccacccccaucccccccguccucaccaccaccgccaccacccccgccgccaccuccuccaccgucacccccuccuccgcccucggcaccacccacaccccccccguccccaacaccaccgccaccacccacggccgcucccucucccccuccuccccccacaccguccgcaccgccuggaccuccgccaccuccggcacccucggcaccacccacaucaccgagcccuccaccggcaccucccacacccccgccgccaccaccggcaccacccagcacuccacccccgcccucuccuccccccaccccuccucccgcaccaccgaguccccccccucccccggcaccaccacccccggccacacccgcgccaccucccgcaccaccgccaccgccacccccuccaagacccgcaccuccacccuccuccccuccucccccaccuccgcccccaucaccaccgucgucaccaugggcugcgagccccagugcgccugguccgaguggcucgacuacuccuaccccaugcccggccccuccggcggcgacuucgacaccuacuccaacauccgcgccgccggcggcgccgucugcgagcagccccucggccucgagugccgcgcccaggcccagcccggcgucccccuccgcgagcucggccaggucgucgagugcucccucgacuucggccucgucugccgcaaccgcgagcaggucggcaaguucaagaugugcuucaacuacgagauccgcgucuucugcugcaacuacggccacugccccuccacccccgccaccuccuccaccgccacccccuccuccacccccggcaccaccuggauccucaccgagcagaccaccgccgccaccaccaccgccaccaccggcuccaccgccauccccuccuccacccccggcaccgcccccccccccaagguccucaccuccaccgccaccacccccaccgccaccuccuccaaggccaccuccuccuccuccccccgcaccgccaccacccuccccguccucaccuccaccgccaccaaguccaccgccaccuccuucacccccauccccuccuucacccucggcaccaccggcacccuccccgagcagaccaccacccccauggccaccauguccaccauccaccccuccuccacccccgagaccacccacaccuccaccguccucaccaccaaggccaccaccacccgcgccaccuccuccauguccacccccuccuccacccccggcaccaccuggauccucaccgagcucaccaccgccgccaccaccaccgccgccaccggccccaccgccacccccuccuccacccccggcaccaccuggauccucaccgagcccuccaccaccgccaccgucaccguccccaccggcuccaccgccaccgccuccuccacccgcgccaccgccggcacccucaagguccucaccuccaccgccaccacccccaccgucaucuccucccgcgccacccccuccuccucccccggcaccgccaccgcccuccccgcccuccgcuccaccgccaccacccccaccgccaccuccgucaccgccauccccuccuccucccucggcaccgccuggacccgccucucccagaccaccacccccaccgccaccauguccaccgccacccccuccuccacccccgagaccguccacaccuccaccguccucaccaccaccaccaccaccacccgcgccaccggcuccgucgccacccccuccuccacccccggcaccgcccacaccaccaagguccccaccaccaccaccaccggcuucaccgccacccccuccuccucccccggcaccgcccucaccccccccgucuggaucuccaccaccaccacccccaccacccgcggcuccaccgucacccccuccuccauccccggcaccacccacaccgccaccguccucaccaccaccaccaccaccgucgccaccggcuccauggccacccccuccuccuccacccagaccuccggcaccccccccucccucaccaccaccgccaccaccaucaccgccaccggcuccaccaccaaccccuccuccacccccggcaccacccccaucccccccguccucaccaccaccgccaccacccccgccgccaccuccuccaccgucacccccuccuccgcccucggcaccacccacaccccccccguccccaacaccaccgccaccacccacggccgcucccucccccccuccuccccccacaccguccgcaccgccuggaccuccgccaccuccggcauccucggcaccacccacaucaccgagcccuccaccgucaccucccacacccccgccgccaccaccuccaccacccagcacuccacccccgcccucuccuccccccaccccuccucccgcaccaccgaguccccccccucccccggcaccaccacccccggccacacccgcggcaccucccgcaccaccgccaccgccacccccuccaagacccgcaccuccacccuccuccccuccucccccaccuccgcccccaucaccaccgucgucaccaccggcugcgagccccagugcgccugguccgaguggcucgacuacuccuaccccaugcccggccccuccggcggcgacuucgacaccuacuccaacauccgcgccgccggcggcgccgucugcgagcagccccucggccucgagugccgcgcccaggcccagcccggcgucccccuccgcgagcucggccaggucgucgagugcucccucgacuucggccucgucugccgcaaccgcgagcaggucggcaaguucaagaugugcuucaacuacgagauccgcgucuucugcugcaacuacggccacugccccuccacccccgccaccuccuccaccgccacccccuccuccacccccggcaccaccuggauccucaccaagcucaccaccaccgccaccaccaccgaguccaccggcuccaccgccacccccuccuccacccccggcaccaccuggauccucaccgagcccuccaccaccgccaccgucaccguccccaccggcuccaccgccaccgccuccuccacccaggccaccgccggcaccccccacgucuccaccaccgccaccacccccaccgucaccuccuccaaggccacccccuucuccucccccggcaccgccaccgcccuccccgcccuccgcuccaccgccaccacccccaccgccaccuccuucaccgccauccccuccuccucccucggcaccaccuggacccgccucucccagaccaccacccccaccgccaccauguccaccgccacccccuccuccacccccgagaccgcccacaccuccaccguccucaccaccaccgccaccaccacccgcgccaccggcuccgucgccacccccuccuccacccccggcaccgcccacaccaccaagguccccaccaccaccaccaccggcuucaccgucacccccuccuccucccccggcaccgcccgcaccccccccgucuggaucuccaccaccaccacccccaccaccuccggcuccaccgucacccccuccuccguccccggcaccacccacacccccaccguccucaccaccaccaccaccaccgucgccaccggcuccauggccacccccuccuccuccacccagaccuccggcaccccccccucccucaucaccaccgccaccaccaucaccgccaccggcuccaccaccaaccccuccuccacccccggcaccacccccaucccccccguccucaccaccaccgccaccacccccgccgccaccuccuccaccgucacccccuccuccgcccucggcaccacccacaccccccccguccccaacaccaccgccaccacccacggccgcucccucucccccuccuccccccacaccguccgcaccgccuggaccuccgccaccuccggcacccucggcaccacccacaucaccgagcccuccaccggcaccucccacacccccgccgccaccaccggcaccacccagcacuccacccccgcccucuccuccccccaccccuccucccgcaccaccgaguccccccccucccccggcaccaccacccccggccacaccaccgccaccucccgcaccaccgccaccgccacccccuccaagacccgcaccuccacccuccuccccuccucccccaccuccgcccccaucaccaccgucgucaccaccggcugcgagccccagugcgccugguccgaguggcucgacuacuccuaccccaugcccggccccuccggcggcgacuucgacaccuacuccaacauccgcgccgccggcggcgccgucugcgagcagccccucggccucgagugccgcgcccaggcccagcccggcgucccccucggcgagcucggccaggucgucgagugcucccucgacuucggccucgucugccgcaaccgcgagcaggucggcaaguucaagaugugcuucaacuacgagauccgcgucuucugcugcaacuacggccacugccccuccacccccgccaccuccuccaccgccaugcccuccuccacccccggcaccaccuggauccucaccgagcucaccaccaccgccaccaccaccgccuccaccggcuccaccgccacccccuccuccacccccggcaccgcccccccccccaagguccucaccucccccgccaccacccccaccgccaccuccuccaaggccaccuccuccuccuccccccgcaccgccaccacccuccccguccucaccuccaccgccaccaaguccaccgccaccuccgucacccccauccccuccuccacccucggcaccaccggcacccuccccgagcagaccaccacccccgucgccaccauguccaccauccaccccuccuccacccccgagaccacccacaccuccaccguccucaccaccaaggccaccaccacccgcgccaccuccuccaccuccacccccuccuccacccccggcaccaccuggauccucaccgagcucaccaccgccgccaccaccaccgccgccaccggccccaccgccacccccuccuccacccccggcaccaccuggauccucaccgagcucaccaccaccgccaccaccaccgccuccaccggcuccaccgccacccccuccuccacccccggcaccaccuggauccucaccgagcccuccaccaccgccaccgucaccguccccaccggcuccaccgccaccgccuccuccacccaggccaccgccggcaccccccacgucuccaccaccgccaccacccccaccgucaccuccuccaaggccacccccuccuccucccccggcaccgccaccgcccuccccgcccuccgcuccaccgccaccacccccaccgccaccuccuucaccgccauccccuccuccucccucggcaccaccuggacccgccucucccagaccaccacccccaccgccaccauguccaccgccacccccuccuccacccccgagaccguccacaccuccaccguccucaccgccaccgccaccaccaccggcgccaccggcuccgucgccacccccuccuccacccccggcaccgcccacaccaccaagguccccaccaccaccaccaccggcuucaccgccacccccuccuccucccccggcaccgcccucaccccccccgucuggaucuccaccaccaccacccccaccaccaccacccccaccaccuccggcuccaccgucacccccuccuccauccccggcaccacccacaccgcccgcguccucaccaccaccaccaccaccgucgccaccggcuccauggccacccccuccuccuccacccagaccuccggcaccccccccucccucaccaccaccgccaccaccaucaccgccaccggcuccaccaccaaccccuccuccacccccggcaccacccccaucacccccguccucaccuccaccgccaccacccccgccgccaccuccuccaaggccaccuccuccuccuccccccgcaccgccaccacccuccccguccucaccuccaccgccaccaaguccaccgccaccuccuucacccccauccccuccuccacccucuggaccaccuggaccguccccgcccagaccaccacccccauguccaccauguccaccauccacaccuccuccacccccgagaccacccacaccuccaccguccucaccaccaccgccaccaugacccgcgccaccaacuccaccgccacccccuccuccacccucggcaccacccgcauccucaccgagcucaccaccaccgccaccaccaccgccgccaccggcuccaccgccacccucuccuccacccccggcaccaccuggauccucaccgagcccuccaccaucgccaccgucaugguccccaccggcuccaccgccaccgccuccuccacccucggcaccgcccacacccccaaggucgucaccaccauggccaccaugcccaccgccaccgccuccaccguccccuccuccuccaccgucggcaccacccgcacccccgccguccuccccuccucccuccccaccuucuccgucuccaccgucuccuccuccguccucaccacccuccgccccaccggcuuccccuccucccacuucuccacccccugcuucugccgcgccuucggccaguucuucucccccggcgaggucaucuacaacaagaccgaccgcgccggcugccacuucuacgccgucugcaaccagcacugcgacaucgaccgcuuccagggcgccugccccaccucccccccccccgucuccuccgccccccucuccucccccucccccgcccccggcugcgacaacgccaucccccuccgccaggucaacgagaccuggacccucgagaacugcaccgucgcccgcugcgucggcgacaaccgcgucguccuccucgaccccaagcccgucgccaacgucaccugcgucaacaagcaccuccccaucaaggucuccgaccccucccagcccugcgacuuccacuacgagugcgagugcaucugcuccauguggggcggcucccacuacuccaccuucgacggcaccuccuacaccuuccgcggcaacugcaccuacguccucaugcgcgagauccacgcccgcuucggcaaccucucccucuaccucgacaaccacuacugcaccgccuccgccaccgccgccgccgcccgcugcccccgcgcccucuccauccacuacaaguccauggacaucguccucaccgucaccaugguccacggcaaggaggagggccucauccucuucgaccagauccccgucuccuccggcuucuccaagaacggcguccucgucuccguccucggcaccaccaccaugcgcgucgacauccccgcccucggcgucuccgucaccuucaacggccaggucuuccaggcccgccuccccuacucccucuuccacaacaacaccgagggccagugcggcaccugcaccaacaaccagcgcgacgacugccuccagcgcgacggcaccaccgccgccuccugcaaggacauggccaagaccuggcucguccccgacucccgcaaggacggcugcugggcccccaccggcaccccccccaccgccucccccgccgcccccgucuccuccacccccacccccacccccugccccccccagccccucugcgaccucaugcucucccaggucuucgccgagugccacaaccucgucccccccggccccuucuucaacgccugcaucuccgaccacugccgcggccgccucgagguccccugccagucccucgaggccuacgccgagcucugccgcgcccgcggcgucugcuccgacuggcgcggcgccaccggcggccucugcgaccucaccugcccccccaccaaggucuacaagcccugcggccccauccagcccgccaccugcaacucccgcaaccaguccccccagcucgagggcauggccgagggcugcuucugccccgaggaccagauccucuucaacgcccacaugggcaucugcguccaggccugccccugcgucggccccgacggcuuccccaaguuccccggcgagcgcugggucuccaacugccaguccugcgucugcgacgagggcuccgucuccguccagugcaagccccuccccugcgacgcccagggccagcccccccccugcaaccgccccggcuucgucaccgucacccgcccccgcgccgagaaccccugcugccccgagaccgucugcgucugcaacaccaccaccugcccccagucccuccccgucugcccccccggccaggaguccaucugcacccaggaggagggcgacugcugccccaccuuccgcugccgcccccagcucugcuccuacaacggcaccuucuacggcgucggcgccaccuuccccggcgcccuccccugccacaugugcaccugccucuccggcgacacccaggaccccaccguccagugccaggaggacgccugcaacaacaccaccugcccccagggcuucgaguacaagcgcgucgccggccagugcugcggcgagugcguccagaccgccugccucacccccgacggccagcccguccagcucaacgagaccugggucaacucccacgucgacaacugcaccgucuaccucugcgaggccgagggcggcguccaccuccucaccccccagcccgccuccugccccgacgucuccuccugccgcggcucccuccgcaagaccggcugcugcuacuccugcgaggaggacuccugccagguccgcaucaacaccaccauccucuggcaccagggcugcgagaccgaggucaacaucaccuucugcgagggcuccugccccggcgccuccaaguacuccgccgaggcccaggccaugcagcaccagugcaccugcugccaggagcgccgcguccacgaggagaccgucccccuccacugccccaacggcuccgccauccuccacaccuacacccacgucgacgagugcggcugcacccccuucugcguccccgcccccauggcccccccccacacccgcggcuuccccgcccaggaggccaccgccgucuga

SEQ ID NO: 46283 - RNA, 7320 nt, Artificial Sequence
  derived and/or modified sequence opt2 from MUC6__Homo_sapiens__NP_005952
augguccagcgcuggcuccuccucuccugcugcggcgcccuccucuccgccggccucgccaacaccuccuacaccucccccggccuccagcgccucaaggacuccccccagaccgcccccgacaagggccagugcuccaccuggggcgccggccacuucuccaccuucgaccaccacgucuacgacuucuccggcaccugcaacuacaucuucgccgccaccugcaaggacgccuuccccaccuucuccguccagcuccgccgcggccccgacggcuccaucucccgcaucaucgucgagcucggcgccuccgucgucaccgucuccgaggccaucaucuccgucaaggacaucggcgucaucucccuccccuacaccuccaacggccuccagaucacccccuucggccaguccguccgccucgucgccaagcagcucgagcucgagcucgaggucgucuggggccccgacucccaccucaugguccucgucgagcgcaaguacaugggccagaugugcggccucugcggcaacuucgacggcaaggucaccaacgaguucgucuccgaggagggcaaguuccucgagccccacaaguucgccgcccuccagaagcucgacgaccccggcgagaucugcaccuuccaggacauccccuccacccacguccgccaggcccagcacgcccgcaucugcacccagcuccucacccucgucgcccccgagugcuccgucuccaaggagcccuucguccucuccugccaggccgacgucgccgccgccccccagcccggcccccagaacuccuccugcgccacccucuccgaguacucccgccagugcuccauggucggccagcccguccgccgcuggcgcucccccggccucugcuccgucggccagugccccgccaaccaggucuaccaggagugcggcuccgccugcgucaagaccugcuccaacccccagcacuccugcuccuccuccugcaccuucggcugcuucugccccgagggcaccguccucaacgaccucuccaacaaccacaccugcguccccgucacccagugccccugcguccuccacggcgccauguacgcccccggcgaggucaccaucgccgccugccagaccugccgcugcacccucggccgcugggucugcaccgagcgccccugccccggccacugcucccucgagggcggcuccuucgucaccaccuucgacgcccgccccuaccgcuuccacggcaccugcaccuacauccuccuccaguccccccagcuccccgaggacggcgcccucauggccgucuacgacaaguccggcgucucccacuccgagaccucccucgucgccgucgucuaccucucccgccaggacaagaucgucaucucccaggacgaggucgucaccaacaacggcgaggccaaguggcuccccuacaagacccgcaacaucaccgucuuccgccagaccuccacccaccuccagauggccaccuccuucggccucgagcucgucguccagcuccgccccaucuuccaggccuacgucaccgucggcccccaguuccgcggccagacccgcggccucugcggcaacuucaacggcgacaccaccgacgacuucaccaccuccaugggcaucgccgagggcaccgccucccucuucgucgacuccuggcgcgccggcaacugccccgccgcccucgagcgcgagaccgaccccugcuccaugucccagcucaacaaggucugcgccgagacccacugcuccaugcuccuccgcaccggcaccgucuucgagcgcugccacgccaccgucaaccccgcccccuucuacaagcgcugcgucuaccaggccugcaacuacgaggagaccuucccccacaucugcgccgcccucggcgacuacguccacgccugcucccuccgcggcguccuccucuggggcuggcgcuccuccgucgacaacugcaccauccccugcaccggcaacaccaccuucuccuacaacucccaggccugcgagcgcaccugccucucccucuccgaccgcgccaccgagugccaccacuccgccguccccgucgacggcugcaacugccccgacggcaccuaccucaaccagaagggcgagugcguccgcaaggcccagugccccugcauccucgagggcuacaaguucauccucgccgagcaguccaccgucaucaacggcaucaccugccacugcaucaacggccgccucuccugcccccagcgcccccagauguuccucgccuccugccaggcccccaagaccuucaaguccugcucccaguccuccgagaacaaguucggcgccgccugcgcccccaccugccagaugcucgccaccggcgucgccugcguccccaccaagugcgagcccggcugcgucugcgccgagggccucuacgagaacgccgacggccagugcgucccccccgaggagugccccugcgaguucuccggcgucuccuaccccggcggcgccgagcuccacaccgacugccgcaccugcuccugcucccgcggccgcugggccugccagcagggcacccacugccccuccaccugcacccucuacggcgagggccacgucaucaccuucgacggccagcgcuucgucuucgacggcaacugcgaguacauccucgccaccgacgucugcggcgucaacgacucccagcccaccuucaagauccucaccgagaacgucaucugcggcaacuccggcgucaccugcucccgcgccaucaagaucuuccucggcggccucuccgucguccucgccgaccgcaacuacaccgucaccggcgaggagccccacguccagcucggcgucacccccggcgcccucucccucgucgucgacaucuccauccccggccgcuacaaccucacccucaucuggaaccgccacaugaccauccucauccgcaucgcccgcgccucccaggacccccucugcggccucugcggcaacuucaacggcaacaugaaggacgacuucgagacccgcucccgcuacgucgccuccuccgagcucgagcucgucaacuccuggaaggaguccccccucugcggcgacgucuccuucgucaccgaccccugcucccucaacgccuuccgccgcuccugggccgagcgcaagugcuccgucaucaacucccagaccuucgccaccugccacuccaaggucuaccaccuccccuacuacgaggccugcguccgcgacgccugcggcugcgacuccggcggcgacugcgagugccucugcgacgccgucgccgccuacgcccaggccugccucgacaagggcgucugcgucgacuggcgcacccccgccuucugccccaucuacugcggcuucuacaacacccacacccaggacggccacggcgaguaccaguacacccaggaggccaacugcaccuggcacuaccagcccugccucugccccucccagccccaguccguccccggcuccaacaucgagggcugcuacaacugcucccaggacgaguacuucgaccacgaggagggcgucugcguccccugcaugccccccaccaccccccagccccccaccaccccccagcuccccaccaccggcucccgccccacccaggucuggcccaugaccggcaccuccaccaccaucggccuccucuccuccaccggccccucccccuccuccaaccacacccccgccucccccacccagaccccccuccuccccgccacccucaccuccuccaagcccaccgccuccuccggcgagcccccccgccccaccaccgccgucaccccccaggccaccuccggccucccccccaccgccacccuccgcuccaccgccaccaagcccaccgucacccaggccaccacccgcgccaccgccuccaccgccucccccgccaccaccuccaccgcccaguccaccacccgcaccaccaugacccuccccacccccgccaccuccggcaccucccccacccuccccaaguccaccaaccaggagcuccccggcaccaccgccacccagaccaccggcccccgccccacccccgccuccaccaccggccccaccaccccccagcccggccagcccacccgccccaccgccaccgagaccacccagacccgcaccaccaccgaguacaccaccccccagaccccccacaccacccacuccccccccaccgccggcucccccguccccuccaccggccccgucaccgccaccuccuuccacgccaccaccaccuaccccacccccucccaccccgagaccacccuccccacccacgucccccccuucuccaccucccucgucacccccuccacccacaccgucaucacccccacccacgcccagauggccaccuccgccuccaaccacuccgcccccaccggcaccauccccccccccaccacccucaaggccaccggcuccacccacaccgccccccccaucacccccaccaccuccggcaccucccaggcccacuccuccuucuccaccaacaagacccccaccucccuccacucccacaccuccuccacccaccaccccgaggucacccccaccuccaccaccaccaucacccccaaccccaccuccacccgcacccgcacccccgucgcccacaccaacuccgccaccuccucccgcccccccccccccuucaccacccacuccccccccaccggcuccucccccuucuccuccaccggccccaugaccgccaccuccuucaagaccaccaccaccuaccccacccccucccacccccagaccacccuccccacccacgucccccccuucuccaccucccucgucacccccuccacccacaccgucaucacccccacccacgcccagauggccaccuccgccuccauccacuccaugcccaccggcaccauccccccccccaccacccucaaggccaccggcuccacccacaccgcccccaccaugacccucaccaccuccggcaccucccaggcccucuccucccucaacaccgccaagaccuccaccucccuccacucccacaccuccuccacccaccacgccgaggccaccuccaccuccaccaccaacaucacccccaaccccaccuccaccggcaccccccccaugaccgucaccaccuccggcaccucccagucccgcuccuccuucuccaccgccaagaccuccaccucccuccacucccacaccuccuccacccaccaccccgaggucaccuccaccuccaccaccuccaucacccccaaccacaccuccaccggcacccgcacccccgucgcccacaccaccuccgccaccuccucccgccuccccacccccuucaccacccacuccccccccaccggcaccacccccaucuccuccaccggccccgucaccgccaccuccuuccagaccaccaccaccuaccccacccccucccacccccacaccacccuccccacccacguccccuccuucuccaccucccucgucacccccuccacccacaccgucaucauccccacccacacccagauggccaccuccgccuccauccacuccaugcccaccggcaccauccccccccccaccaccaucaaggccaccggcuccacccacaccgccccccccaugacccccaccaccuccggcaccucccagucccccuccuccuucuccaccgccaagaccuccaccucccuccccuaccacaccuccuccacccaccaccccgaggucacccccaccuccaccaccaacaucacccccaagcacaccuccaccggcacccgcacccccgucgcccacaccaccuccgccuccuccucccgccuccccacccccuucaccacccacuccccccccaccggcuccucccccuucuccuccaccggccccaugaccgccaccuccuuccagaccaccaccaccuaccccacccccucccacccccagaccacccuccccacccacgucccccccuucuccaccucccucgucacccccuccacccacaccgucaucaucaccacccacacccagauggccaccuccgccuccauccacuccacccccaccggcaccguccccccccccaccacccucaaggccaccggcuccacccacaccgccccccccaugaccgucaccaccuccggcaccucccagacccacuccuccuucuccaccgccaccgccuccuccuccuucaucuccuccuccuccuggcucccccagaacuccuccucccgcccccccuccucccccaucaccacccagcucccccaccucuccuccgccaccacccccgucuccaccaccaaccagcucuccuccuccuucucccccucccccuccgcccccuccaccgucuccuccuacguccccuccucccacuccuccccccagaccuccucccccuccgucggcaccuccuccuccuucgucuccgcccccguccacuccaccacccucuccuccggcucccacuccucccucuccacccaccccaccaccgccuccgucuccgccuccccccucuuccccuccucccccgccgccuccaccaccauccgcgccacccucccccacaccaucuccucccccuucacccucuccgcccuccuccccaucuccaccgucaccgucucccccacccccuccucccaccucgccuccuccaccaucgccuuccccuccaccccccgcaccaccgccuccacccacaccgcccccgccuucuccucccaguccaccaccucccgcuccaccucccucaccacccgcguccccaccuccggcuucgucucccucaccuccggcgucaccggcauccccaccucccccgucaccaaccucaccacccgccaccccggccccacccucucccccaccacccgcuuccucaccuccucccucaccgcccacggcuccacccccgccuccgcccccgucuccucccucggcacccccacccccaccucccccggcgucugcuccguccgcgagcagcaggaggagaucaccuucaagggcugcauggccaacgucaccgucacccgcugcgagggcgccugcaucuccgccgccuccuucaacaucaucacccagcaggucgacgcccgcugcuccugcugccgcccccuccacuccuacgagcagcagcucgagcuccccugccccgaccccuccacccccggccgccgccucguccucacccuccaggucuucucccacugcgucugcuccuccgucgccugcggcgacuga

SEQ ID NO: 46284 - RNA, 1134 nt, Artificial Sequence
  derived and/or modified sequence opt2 from MUC7__Homo_sapiens__NP_001138479
augaagacccucccccucuucgucugcaucugcgcccucuccgccugcuucuccuucuccgagggccgcgagcgcgaccacgagcuccgccaccgccgccaccaccaccagucccccaagucccacuucgagcucccccacuaccccggccuccucgcccaccagaagcccuucauccgcaaguccuacaagugccuccacaagcgcugccgccccaagcucccccccucccccaacaacccccccaaguuccccaacccccaccagccccccaagcaccccgacaagaacuccuccgucgucaaccccacccucgucgccaccacccagauccccuccgucaccuuccccuccgccuccaccaagaucaccacccuccccaacgucaccuuccucccccagaacgccaccaccaucuccucccgcgagaacgucaacaccuccuccuccgucgccacccucgcccccgucaacucccccgccccccaggacaccaccgccgccccccccacccccuccgccaccacccccgccccccccuccuccuccgccccccccgagaccaccgccgccccccccacccccuccgccaccacccaggccccccccuccuccuccgccccccccgagaccaccgccgccccccccaccccccccgccaccacccccgccccccccuccuccuccgccccccccgagaccaccgccgccccccccacccccuccgccaccacccccgccccccucuccuccuccgccccccccgagaccaccgccgucccccccacccccuccgccaccacccucgaccccuccuccgccuccgccccccccgagaccaccgccgccccccccacccccuccgccaccacccccgccccccccuccucccccgccccccaggagaccaccgccgcccccaucaccacccccaacuccucccccaccacccucgcccccgacaccuccgagaccuccgccgcccccacccaccagaccaccaccuccgucaccacccagaccaccaccaccaagcagcccaccuccgcccccggccagaacaagaucucccgcuuccuccucuacaugaagaaccuccucaaccgcaucaucgacgacauggucgagcaguga

SEQ ID NO: 46285 - RNA, 273 nt, Artificial Sequence
  derived and/or modified sequence opt2 from MUCL1__Homo_sapiens__XP_011536170
augaaguuccucgccguccucguccuccucggcgucuccaucuuccucgucuccgcccagaaccccaccaccgccgcccccgccgacaccuaccccgccaccggccccgccgacgacgaggcccccgacgccgagaccaccgccgccgccaccaccgccaccaccgccgcccccaccaccgccaccaccgccgccuccaccaccgcccgcaaggacauccccguccuccccaagugggucggcgaccuccccaacggccgcgucugccccuga

SEQ ID NO: 46286 - RNA, 2136 nt, Artificial Sequence
  derived and/or modified sequence opt2 from MUM1__Homo_sapiens__NP_116242
augauggccgacgccaaguacguccucugccgcugggagaagcgccucuggcccgccaagguccucgcccgcaccgccaccuccaccaagaacaagcgccgcaaggaguacuuccucgccguccagauccucucccucgaggagaagaucaaggucaaguccaccgaggucgagauccucgagaagucccagaucgaggccaucgccuccucccucgccucccagaacgagguccccgccgccccccucgaggagcucgccuaccgccgcucccuccgcgucgcccucgacguccucuccgagggcuccaucuggucccaggaguccuccgccggcaccggccgcgccgaccgcucccuccgcggcaagcccauggagcacgucuccucccccugcgacuccaacuccuccucccucccccgcggcgacguccucggcuccucccgcccccaccgccgccgccccugcguccagcagucccucuccuccuccuucaccugcgagaaggaccccgagugcaaggucgaccacaagaagggccuccgcaaguccgagaacccccgcggcccccucguccuccccgccggcggcggcgcccaggacgaguccggcucccgcauccaccacaagaacuggacccucgccuccaagcgcggcggcaacuccgcccagaaggccucccucugccucaacggcuccucccucuccgaggacgacaccgagcgcgacaugggcuccaagggcggcuccugggccgcccccucccuccccuccggcguccgcgaggacgaccccugcgccaacgccgagggccacgaccccggccucccccucggcucccucaccgccccccccgcccccgagcccuccgccugcuccgagcccggcgagugccccgccaagaagcgcccccgccucgacggcucccagcgcccccccgccguccagcucgagcccauggccgccggcgccgcccccucccccggccccggccccggcccccgcgaguccgucaccccccgcuccaccgcccgccucggccccccccccucccacgccuccgccgacgccacccgcugccuccccugccccgacucccagaagcucgagaaggagugccaguccuccgaggaguccaugggcuccaacuccaugcgcuccauccucgaggaggacgaggaggacgaggagcccccccgcguccuccucuaccacgagccccgcuccuucgaggucggcaugcucgucuggcacaagcacaagaaguaccccuucuggcccgccgucgucaaguccguccgccagcgcgacaagaaggccuccguccucuacaucgagggccacaugaaccccaagaugaagggcuucaccgucucccucaagucccucaagcacuucgacugcaaggagaagcagacccuccucaaccaggcccgcgaggacuucaaccaggacaucggcuggugcgucucccucaucaccgacuaccgcguccgccucggcugcggcuccuucgccggcuccuuccucgaguacuacgccgccgacaucuccuaccccguccgcaaguccauccagcaggacguccucggcaccaagcucccccagcucuccaagggcucccccgaggagcccgucgucggcugcccccucggccagcgccagcccugccgcaagaugcuccccgaccgcucccgcgccgcccgcgaccgcgccaaccagaagcucgucgaguacaucgucaaggccaagggcgccgagucccaccuccgcgccauccucaagucccgcaagcccucccgcuggcuccagaccuuccucuccuccucccaguacgucaccugcgucgagaccuaccucgaggacgagggccagcucgaccucgucgucaaguaccuccagggcgucuaccaggaggucggcgccaagguccuccagcgcaccaacggcgaccgcauccgcuucauccucgacguccuccuccccgaggccaucaucugcgccaucuccgccgucgacgaggucgacuacaagaccgccgaggagaaguacaucaagggccccucccucuccuaccgcgagaaggagaucuucgacaaccagcuccucgaggagcgcaaccgccgccgccgcuga

SEQ ID NO: 46287 - RNA, 1095 nt, Artificial Sequence
  derived and/or modified sequence opt2 from MURC__Homo_sapiens__NP_001018126
auggagcacaacggcuccgccuccaacgccgacaagauccaccagaaccgccucuccuccgucaccgaggacgaggaccaggacgccgcccucaccaucgucaccguccucgacaaggucgccuccaucgucgacuccguccaggccucccagaagcgcaucgaggagcgccaccgcgagauggagaacgccaucaaguccguccagaucgaccuccucaagcucucccagucccacuccaacaccggccacaucaucaacaagcucuucgagaagacccgcaaggucuccgcccacaucaaggacgucaaggcccgcgucgagaagcagcagauccacgucaagaaggucgaggucaagcaggaggagaucaugaagaagaacaaguuccgcgucgucaucuuccaggagaaguuccgcugccccaccucccucuccgucgucaaggaccgcaaccucaccgagaaccaggaggaggacgacgacgacaucuucgacccccccgucgaccucuccuccgacgaggaguacuacgucgaggagucccgcuccgcccgccuccgcaaguccggcaaggagcacaucgacaacaucaagaaggccuucuccaaggagaacaugcagaagacccgccagaaccucgacaagaaggucaaccgcauccgcacccgcaucgucacccccgagcgccgcgagcgccuccgccaguccggcgagcgccuccgccaguccggcgagcgccuccgccaguccggcgagcgcuucaagaaguccaucuccaacgccgcccccuccaaggaggccuucaagaugcgcucccuccgcaagggcaaggaccgcaccgucgccgagggcgaggagugcgcccgcgagaugggcgucgacaucaucgcccgcuccgagucccucggccccaucuccgagcucuacuccgacgagcucuccgagcccgagcacgaggccgcccgccccgucuaccccccccacgagggccgcgagauccccacccccgagccccucaaggucaccuucaagucccaggucaaggucgaggacgacgagucccuccuccucgaccucaagcacuccuccuga

SEQ ID NO: 46288 - RNA, 1656 nt, Artificial Sequence
  derived and/or modified sequence opt2 from MUS81__Homo_sapiens__XP_011543572
auggccgcccccguccgccucggccgcaagcgcccccuccccgccugccccaacccccucuucguccgcuggcucaccgaguggcgcgacgaggccacccgcucccgccgccgcacccgcuucgucuuccagaaggcccuccgcucccuccgccgcuacccccucccccuccgcuccggcaaggaggccaagauccuccagcacuucggcgacggccucugccgcaugcucgacgagcgccuccagcgccaccgcaccuccggcggcgaccacgcccccgacucccccuccggcgagaacucccccgccccccagggccgccucgccgagguccaggacuccuccaugcccguccccgcccagcccaaggccggcggcuccggcuccuacuggcccgcccgccacuccggcgcccgcgucauccuccucguccucuaccgcgagcaccucaaccccaacggccaccacuuccucaccaaggaggagcuccuccagcgcugcgcccagaaguccccccgcgucgcccccggcuccgcccgccccuggcccgcccuccgcucccuccuccaccgcaaccucguccuccgcacccaccagcccgcccgcuacucccucacccccgagggccucgagcucgcccagaagcucgccgaguccgagggccucucccuccucaacgucggcaucggccccaaggagccccccggcgaggagaccgccguccccggcgccgccuccgccgagcucgccuccgaggccggcguccagcagcagccccucgagcuccgccccggcgaguaccgcguccuccucugcgucgacaucggcgagacccgcggcggcggccaccgccccgagcuccuccgcgagcuccagcgccuccacgucacccacaccguccgcaagcuccacgucggcgacuucgucugggucgcccaggagaccaacccccgcgaccccgccaaccccggcgagcucguccucgaccacaucgucgagcgcaagcgccucgacgaccucugcuccuccaucaucgacggccgcuuccgcgagcagaaguuccgccucaagcgcugcggccucgagcgccgcgucuaccucgucgaggagcacggcuccguccacaaccucucccuccccgaguccacccuccuccaggccgucaccaacacccaggucaucgacggcuucuucgucaagcgcaccgccgacaucaaggaguccgccgccuaccucgcccuccucacccgcggccuccagcgccucuaccagggccacacccuccgcucccgccccuggggcacccccggcaaccccgaguccggcgccaugaccucccccaacccccucugcucccuccucaccuucuccgacuucaacgccggcgccaucaagaacaaggcccaguccguccgcgaggucuucgcccgccagcucaugcagguccgcggcgucuccggcgagaaggccgccgcccucgucgaccgcuacuccacccccgccucccuccucgccgccuacgacgccugcgccacccccaaggagcaggagacccuccucuccaccaucaagugcggccgccuccagcgcaaccucggccccgcccucucccgcacccucucccagcucuacugcuccuacggcccccucaccuga

SEQ ID NO: 46289 - RNA, 2352 nt, Artificial Sequence
  derived and/or modified sequence opt2 from MUSK__Homo_sapiens__NP_001159752
augcgcgagcucgucaacaucccccucguccacauccucacccucgucgccuucuccggcaccgagaagcuccccaaggcccccgucaucaccaccccccucgagaccgucgacgcccucgucgaggaggucgccaccuucaugugcgccgucgaguccuacccccagcccgagaucuccuggacccgcaacaagauccucaucaagcucuucgacacccgcuacuccauccgcgagaacggccagcuccucaccauccucuccgucgaggacuccgacgacggcaucuacugcugcaccgccaacaacggcgucggcggcgccgucgaguccugcggcgcccuccaggucaagaugaagcccaagaucacccgcccccccaucaacgucaagaucaucgagggccucaaggccguccuccccugcaccaccaugggcaaccccaagcccuccgucuccuggaucaagggcgacuccccccuccgcgagaacucccgcaucgccguccucgaguccggcucccuccgcauccacaacguccagaaggaggacgccggccaguaccgcugcgucgccaagaacucccucggcaccgccuacuccaaggucgucaagcucgaggucgaggaggaguccgagcccgagcaggacaccaaggucuucgcccgcauccuccgcgcccccgagucccacaacgucaccuucggcuccuucgucacccuccacugcaccgccaccggcauccccguccccaccaucaccuggaucgagaacggcaacgccgucuccuccggcuccauccaggaguccgucaaggaccgcgucaucgacucccgccuccagcucuucaucaccaagcccggccucuacaccugcaucgccaccaacaagcacggcgagaaguucuccaccgccaaggccgccgccaccaucuccaucgccgaguggcgcgaguacugccucgccgucaaggagcucuucugcgccaaggaguggcucgucauggaggagaagacccaccgcggccucuaccgcuccgagaugcaccuccucuccguccccgagugcuccaagcuccccuccaugcacugggaccccaccgccugcgcccgccucccccaccucgccuucccccccaugaccuccuccaagcccuccgucgacauccccaaccuccccuccuccuccuccuccuccuucuccgucucccccaccuacuccaugaccgucaucaucuccaucauguccuccuucgccaucuucguccuccucaccaucaccacccucuacugcugccgccgccgcaagcaguggaagaacaagaagcgcgaguccgccgccgucacccucaccacccuccccuccgagcuccuccucgaccgccuccaccccaaccccauguaccagcgcaugccccuccuccucaaccccaagcuccucucccucgaguacccccgcaacaacaucgaguacguccgcgacaucggcgagggcgccuucggccgcgucuuccaggcccgcgcccccggccuccuccccuacgagcccuucaccauggucgccgucaagaugcucaaggaggaggccuccgccgacaugcaggccgacuuccagcgcgaggccgcccucauggccgaguucgacaaccccaacaucgucaagcuccucggcgucugcgccgucggcaagcccaugugccuccucuucgaguacauggccuacggcgaccucaacgaguuccuccgcuccauguccccccacaccgucugcucccucucccacuccgaccucuccaugcgcgcccaggucuccucccccggcccccccccccucuccugcgccgagcagcucugcaucgcccgccaggucgccgccggcauggccuaccucuccgagcgcaaguucguccaccgcgaccucgccacccgcaacugccucgucggcgagaacauggucgucaagaucgccgacuucggccucucccgcaacaucuacuccgccgacuacuacaaggccaacgagaacgacgccauccccauccgcuggaugccccccgaguccaucuucuacaaccgcuacaccaccgaguccgacgucugggccuacggcgucguccucugggagaucuucuccuacggccuccagcccuacuacggcauggcccacgaggaggucaucuacuacguccgcgacggcaacauccucuccugccccgagaacugccccgucgagcucuacaaccucaugcgccucugcugguccaagcuccccgccgaccgccccuccuucaccuccauccaccgcauccucgagcgcaugugcgagcgcgccgagggcaccgucuccgucuga

SEQ ID NO: 46290 - RNA, 2253 nt, Artificial Sequence
  derived and/or modified sequence opt2 from MUT__Homo_sapiens__NP_000246
augcuccgcgccaagaaccagcucuuccuccucuccccccacuaccuccgccaggucaaggaguccuccggcucccgccucauccagcagcgccuccuccaccagcagcagccccuccaccccgagugggccgcccucgccaagaagcagcucaagggcaagaaccccgaggaccucaucuggcacacccccgagggcaucuccaucaagccccucuacuccaagcgcgacaccauggaccuccccgaggagcuccccggcgucaagcccuucacccgcggccccuaccccaccauguacaccuuccgccccuggaccauccgccaguacgccggcuucuccaccgucgaggaguccaacaaguucuacaaggacaacaucaaggccggccagcagggccucuccgucgccuucgaccucgccacccaccgcggcuacgacuccgacaacccccgcguccgcggcgacgucggcauggccggcgucgccaucgacaccgucgaggacaccaagauccucuucgacggcaucccccucgagaagauguccgucuccaugaccaugaacggcgccgucauccccguccucgccaacuucaucgucaccggcgaggagcagggcguccccaaggagaagcucaccggcaccauccagaacgacauccucaaggaguucaugguccgcaacaccuacaucuucccccccgagcccuccaugaagaucaucgccgacaucuucgaguacaccgccaagcacaugcccaaguucaacuccaucuccaucuccggcuaccacaugcaggaggccggcgccgacgccauccucgagcucgccuacacccucgccgacggccucgaguacucccgcaccggccuccaggccggccucaccaucgacgaguucgccccccgccucuccuucuucuggggcaucggcaugaacuucuacauggagaucgccaagaugcgcgccggccgccgccucugggcccaccucaucgagaagauguuccagcccaagaacuccaagucccuccuccuccgcgcccacugccagaccuccggcuggucccucaccgagcaggaccccuacaacaacaucguccgcaccgccaucgaggccauggccgccgucuucggcggcacccagucccuccacaccaacuccuucgacgaggcccucggccuccccaccgucaaguccgcccgcaucgcccgcaacacccagaucaucauccaggaggaguccggcauccccaaggucgccgaccccuggggcggcuccuacaugauggagugccucaccaacgacgucuacgacgccgcccucaagcucaucaacgagaucgaggagaugggcggcauggccaaggccgucgccgagggcauccccaagcuccgcaucgaggagugcgccgcccgccgccaggcccgcaucgacuccggcuccgaggucaucgucggcgucaacaaguaccagcucgagaaggaggacgccgucgagguccucgccaucgacaacaccuccguccgcaaccgccagaucgagaagcucaagaagaucaaguccucccgcgaccaggcccucgccgagcgcugccucgccgcccucaccgagugcgccgccuccggcgacggcaacauccucgcccucgccgucgacgccucccgcgcccgcugcaccgucggcgagaucaccgacgcccucaagaaggucuucggcgagcacaaggccaacgaccgcauggucuccggcgccuaccgccaggaguucggcgaguccaaggagaucaccuccgccaucaagcgcguccacaaguucauggagcgcgagggccgccgcccccgccuccucgucgccaagaugggccaggacggccacgaccgcggcgccaaggucaucgccaccggcuucgccgaccucggcuucgacgucgacaucggcccccucuuccagaccccccgcgaggucgcccagcaggccgucgacgccgacguccacgccgucggcaucuccacccucgccgccggccacaagacccucguccccgagcucaucaaggagcucaacucccucggccgccccgacauccucgucaugugcggcggcgucauccccccccaggacuacgaguuccucuucgaggucggcgucuccaacgucuucggccccggcacccgcauccccaaggccgccguccagguccucgacgacaucgagaagugccucgagaagaagcagcaguccgucuga

SEQ ID NO: 46291 - RNA, 1611 nt, Artificial Sequence
  derived and/or modified sequence opt2 from MUTYH__Homo_sapiens__NP_001280119
augaccccccucgucucccgccucucccgccucugggccaucaugcgcaagccccgcgccgccgucggcuccggccaccgcaagcaggccgccucccaggagggccgccagaagcacgccaagaacaacucccaggccaagcccuccgccugcgacgccggccucgcccgccagcccgaggaggucguccuccaggccuccgucuccuccuaccaccucuuccgcgacgucgccgaggucaccgccuuccgcggcucccuccucuccugguacgaccaggagaagcgcgaccuccccuggcgccgccgcgccgaggacgagauggaccucgaccgccgcgccuacgccgucugggucuccgaggucaugcuccagcagacccaggucgccaccgucaucaacuacuacaccggcuggaugcagaaguggcccacccuccaggaccucgccuccgccucccucgaggaggucaaccagcucugggccggccucggcuacuacucccgcggccgccgccuccaggagggcgcccgcaaggucgucgaggagcucggcggccacaugccccgcaccgccgagacccuccagcagcuccuccccggcgucggccgcuacaccgccggcgccaucgccuccaucgccuucggccaggccaccggcgucgucgacggcaacgucgcccgcguccucugccgcguccgcgccaucggcgccgaccccuccuccacccucgucucccagcagcucuggggccucgcccagcagcucgucgaccccgcccgccccggcgacuucaaccaggccgccauggagcucggcgccaccgucugcaccccccagcgcccccucugcucccagugccccgucgagucccucugccgcgcccgccagcgcgucgagcaggagcagcuccucgccuccggcucccucuccggcucccccgacgucgaggagugcgcccccaacaccggccagugccaccucugccucccccccuccgagcccugggaccagacccucggcgucgucaacuucccccgcaaggccucccgcaagcccccccgcgaggaguccuccgccaccugcguccucgagcagcccggcgcccucggcgcccagauccuccucguccagcgccccaacuccggccuccucgccggccucugggaguuccccuccgucaccugggagcccuccgagcagcuccagcgcaaggcccuccuccaggagcuccagcgcugggccggcccccuccccgccacccaccuccgccaccucggcgaggucguccacaccuucucccacaucaagcucaccuaccaggucuacggccucgcccucgagggccagacccccgucaccaccgucccccccggcgcccgcuggcucacccaggaggaguuccacaccgccgccgucuccaccgccaugaagaaggucuuccgcgucuaccagggccagcagcccggcaccugcaugggcuccaagcgcucccaggucuccucccccugcucccgcaagaagccccgcaugggccagcagguccucgacaacuucuuccgcucccacaucuccaccgacgcccacucccucaacuccgccgcccaguga

SEQ ID NO: 46292 - RNA, 666 nt, Artificial Sequence
  derived and/or modified sequence opt2 from MVB12B__Homo_sapiens__NP_001011703
augcgcuccugcuucugcguccgccgcucccgcgaccccccccccccccagcccccccccccccccccccagcgcggcaccgaccaguccaccaugcccgaggucaaggaccucuccgaggcccuccccgagaccuccauggaccccaucaccggcgucggcgucgucgccucccgcaaccgcgcccccaccggcuacgacgucgucgcccagaccgccgacggcgucgacgccgaccucuggaaggacggccucuucaaguccaaggucacccgcuaccucugcuucacccgcuccuucuccaaggagaacucccaccucggcaacguccucgucgacaugaagcucaucgacaucaaggacacccuccccgucggcuucauccccauccaggagaccgucgacacccaggaggucgccuuccgcaagaagcgccucugcaucaaguucaucccccgcgacuccaccgaggccgccaucugcgacauccgcaucaugggccgcaccaagcaggcccccccccaguacaccuucaucggcgagcucaacuccaugggcaucugguaccgcaugggccgcgucccccgcaaccacgacuccucccagcccaccacccccucccaguccuccgccgccuccacccccgcccccaaccucccccgcuga

SEQ ID NO: 46293 - RNA, 1203 nt, Artificial Sequence
  derived and/or modified sequence opt2 from MVD__Homo_sapiens__NP_002452
auggccuccgagaagccccucgccgccgucaccugcaccgcccccgucaacaucgccgucaucaaguacuggggcaagcgcgacgaggagcucguccuccccaucaacuccucccucuccgucacccuccaccaggaccagcucaagaccaccaccaccgccgucaucuccaaggacuucaccgaggaccgcaucuggcucaacggccgcgaggaggacgucggccagccccgccuccaggccugccuccgcgagauccgcugccucgcccgcaagcgccgcaacucccgcgacggcgacccccuccccuccucccucuccugcaagguccacgucgccuccgucaacaacuuccccaccgccgccggccucgccuccuccgccgccggcuacgccugccucgccuacacccucgcccgcgucuacggcgucgaguccgaccucuccgaggucgcccgccgcggcuccggcuccgccugccgcucccucuacggcggcuucgucgaguggcagaugggcgagcaggccgacggcaaggacuccaucgcccgccaggucgcccccgagucccacuggcccgagcuccgcguccucauccucgucgucuccgccgagaagaagcucaccggcuccaccgucggcaugcgcgccuccgucgagaccuccccccuccuccgcuuccgcgccgaguccgucguccccgcccgcauggccgagauggcccgcugcauccgcgagcgcgacuuccccuccuucgcccagcucaccaugaaggacuccaaccaguuccacgccaccugccucgacaccuucccccccaucuccuaccucaacgccaucuccuggcgcaucauccaccucguccaccgcuucaacgcccaccacggcgacaccaaggucgccuacaccuucgacgccggccccaacgccgucaucuucacccucgacgacaccgucgccgaguucgucgccgccgucuggcacggcuucccccccggcuccaacggcgacaccuuccucaagggccuccagguccgccccgccccccucuccgccgagcuccaggccgcccucgccauggagcccacccccggcggcgucaaguacaucaucgucacccaggucggccccggcccccagauccucgacgaccccugcgcccaccuccucggccccgacggccuccccaagcccgccgccuga

SEQ ID NO: 46294 - RNA, 1035 nt, Artificial Sequence
  derived and/or modified sequence opt2 from MVK__Homo_sapiens__NP_001288111
augcucuccgagguccuccucgucuccgcccccggcaaggucauccuccacggcgagcacgccgucguccacggcaaggucgcccucgccgucucccucaaccuccgcaccuuccuccgccuccagccccacuccaacggcaaggucgaccucucccuccccaacaucggcaucaagcgcgccugggacgucgcccgccuccagucccucgacaccuccuuccucgagcagggcgacgucaccacccccaccuccgagcaggucgagaagcucaaggaggucgccggccuccccgacgacugcgccgucaccgagcgccucgccguccucgccuuccucuaccucuaccucuccaucugccgcaagcagcgcuggaccaaggaggaccucgagcucaucaacaagugggccuuccagggcgagcgcaugauccacggcaaccccuccggcgucgacaacgccgucuccaccuggggcggcgcccuccgcuaccaccagggcaagaucuccucccucaagcgcucccccgcccuccagauccuccucaccaacaccaaggucccccgcaacacccgcgcccucgucgccggcguccgcaaccgccuccucaaguuccccgagaucgucgccccccuccucaccuccaucgacgccaucucccucgagugcgagcgcguccucggcgagaugggcgaggcccccgcccccgagcaguaccucguccucgaggagcucaucgacaugaaccagcaccaccucaacgcccucggcgucggccacgccucccucgaccagcucugccaggucacccgcgcccgcggccuccacuccaagcucaccggcgccggcggcggcggcugcggcaucacccuccucaagcccggccucgagcagcccgaggucgaggccaccaagcaggcccucaccuccugcggcuucgacugccucgagaccuccaucggcgcccccggcgucuccauccacuccgccaccucccucgacucccgcguccagcaggcccucgacggccucuga

SEQ ID NO: 46295 - RNA, 2502 nt, Artificial Sequence
  derived and/or modified sequence opt2 from MVP__Homo_sapiens__NP_001280133
auggccaccgaggaguucaucauccgcaucccccccuaccacuacauccacguccucgaccagaacuccaacgucucccgcgucgaggucggccccaagaccuacauccgccaggacaacgagcgcguccucuucgcccccaugcgcauggucaccguccccccccgccacuacugcaccgucgccaaccccgucucccgcgacgcccagggccucguccucuucgacgucaccggccagguccgccuccgccacgccgaccucgagauccgccucgcccaggaccccuucccccucuaccccggcgagguccucgagaaggacaucaccccccuccaggucguccuccccaacaccgcccuccaccucaaggcccuccucgacuucgaggacaaggacggcgacaaggucgucgccggcgacgaguggcucuucgagggccccggcaccuacaucccccgcaaggaggucgaggucgucgagaucauccaggccaccaucauccgccagaaccaggcccuccgccuccgcgcccgcaaggagugcugggaccgcgacggcaaggagcgcgucaccggcgaggaguggcucgucaccaccgucggcgccuaccuccccgccgucuucgaggagguccucgaccucgucgacgccgucauccucaccgagaagaccgcccuccaccuccgcgcccgccgcaacuuccgcgacuuccgcggcgucucccgccgcaccggcgaggaguggcucgucaccguccaggacaccgaggcccacguccccgacguccacgaggagguccucggcgucguccccaucaccacccucggcccccacaacuacugcgucauccucgaccccgucggccccgacggcaagaaccagcucggccagaagcgcgucgucaagggcgagaaguccuucuuccuccagcccggcgagcagcucgagcagggcauccaggacgucuacguccucuccgagcagcagggccuccuccuccgcgcccuccagccccucgaggagggcgaggacgaggagaaggucucccaccaggccggcgaccacuggcucauccgcggcccccucgaguacguccccuccgccaaggucgaggucgucgaggagcgccaggccaucccccucgacgagaacgagggcaucuacguccaggacgucaagaccggcaagguccgcgccgucaucggcuccaccuacaugcucacccaggacgagguccucugggagaaggagcucccccccggcgucgaggagcuccucaacaagggccaggacccccucgccgaccgcggcgagaaggacaccgccaagucccuccagccccucgccccccgcaacaagacccgcgucgucuccuaccgcgucccccacaacgccgccguccaggucuacgacuaccgcgagaagcgcgcccgcgucgucuucggccccgagcucgucucccucggccccgaggagcaguucaccguccucucccucuccgccggccgccccaagcgcccccacgcccgccgcgcccucugccuccuccucggccccgacuucuucaccgacgucaucaccaucgagaccgccgaccacgcccgccuccagcuccagcucgccuacaacuggcacuucgaggucaacgaccgcaaggacccccaggagaccgccaagcucuucuccguccccgacuucgucggcgacgccugcaaggccaucgccucccgcguccgcggcgccgucgccuccgucaccuucgacgacuuccacaagaacuccgcccgcaucauccgcaccgccgucuucggcuucgagaccuccgaggccaagggccccgacggcauggcccucccccgcccccgcgaccaggccgucuucccccagaacggccucgucgucuccuccgucgacguccaguccgucgagcccgucgaccagcgcacccgcgacgcccuccagcgcuccguccagcucgccaucgagaucaccaccaacucccaggaggccgccgccaagcacgaggcccagcgccucgagcaggaggcccgcggccgccucgagcgccagaagauccucgaccaguccgaggccgagaaggcccgcaaggagcuccucgagcucgaggcccucuccauggccgucgaguccaccggcaccgccaaggccgaggccgagucccgcgccgaggccgcccgcaucgagggcgagggcuccguccuccaggccaacaccauccgcgaccucgccgucgccggccccgagaugcaggucaagcuccuccagucccucggccucaaguccacccucaucaccgacggcuccacccccaucaaccucuucaacaccgccuucggccuccucggcaugggccccgagggccagccccucggccgccgcgucgccuccggccccucccccggcgagggcaucuccccccaguccgcccaggccccccaggcccccggcgacaaccacgucguccccguccuccgcuga

SEQ ID NO: 46296 - RNA, 1989 nt, Artificial Sequence
  derived and/or modified sequence opt2 from MX1__Homo_sapiens__XP_005261039
auggucgucuccgaggucgacaucgccaaggccgaccccgccgccgccucccacccccuccuccucaacggcgacgccaccgucgcccagaagaaccccggcuccgucgccgagaacaaccucugcucccaguacgaggagaagguccgccccugcaucgaccucaucgacucccuccgcgcccucggcgucgagcaggaccucgcccuccccgccaucgccgucaucggcgaccaguccuccggcaaguccuccguccucgaggcccucuccggcgucgcccucccccgcggcuccggcaucgucacccgcugcccccucguccucaagcucaagaagcucgucaacgaggacaaguggcgcggcaaggucuccuaccaggacuacgagaucgagaucuccgacgccuccgaggucgagaaggagaucaacaaggcccagaacgccaucgccggcgagggcaugggcaucucccacgagcucaucacccucgagaucuccucccgcgacguccccgaccucacccucaucgaccuccccggcaucacccgcgucgccgucggcaaccagcccgccgacaucggcuacaagaucaagacccucaucaagaaguacauccagcgccaggagaccaucucccucgucgucguccccuccaacgucgacaucgccaccaccgaggcccucuccauggcccaggaggucgaccccgagggcgaccgcaccaucggcauccucaccaagcccgaccucgucgacaagggcaccgaggacaaggucgucgacgucguccgcaaccucgucuuccaccucaagaagggcuacaugaucgucaagugccgcggccagcaggagauccaggaccagcucucccucuccgaggcccuccagcgcgagaagaucuucuucgagaaccaccccuacuuccgcgaccuccucgaggagggcaaggccaccguccccugccucgccgagaagcucaccuccgagcucaucacccacaucugcaagucccucccccuccucgagaaccagaucaaggagacccaccagcgcaucaccgaggagcuccagaaguacggcgucgacauccccgaggacgagaacgagaagauguucuuccucaucgacaaggucaacgccuucaaccaggacaucaccgcccucaugcagggcgaggagaccgucggcgaggaggacauccgccucuucacccgccuccgccacgaguuccacaagugguccaccaucaucgagaacaacuuccaggagggccacaagauccucucccgcaagauccagaaguucgagaaccaguaccgcggccgcgagcuccccggcuucgucaacuaccgcaccuucgagaccaucgucaagcagcagaucaaggcccucgaggagcccgccgucgacaugcuccacaccgucaccgacaugguccgccucgccuucaccgacgucuccaucaagaacuucgaggaguucuucaaccuccaccgcaccgccaaguccaagaucgaggacauccgcgccgagcaggagcgcgagggcgagaagcucauccgccuccacuuccagauggagcagaucgucuacugccaggaccaggucuaccgcggcgcccuccagaagguccgcgagaaggagcucgaggaggagaagaagaagaaguccugggacuucggcgccuuccaguccuccuccgccaccgacuccuccauggaggagaucuuccagcaccucauggccuaccaccaggaggccuccaagcgcaucuccucccacaucccccucaucauccaguucuucaugcuccagaccuacggccagcagcuccagaaggccaugcuccagcuccuccaggacaaggacaccuacuccuggcuccucaaggagcgcuccgacaccuccgacaagcgcaaguuccucaaggagcgccucgcccgccucacccaggcccgccgccgccucgcccaguuccccggcuga

SEQ ID NO: 46297 - RNA, 2148 nt, Artificial Sequence
  derived and/or modified sequence opt2 from MX2__Homo_sapiens__XP_011527874
auguccaaggcccacaagcccuggcccuaccgccgccgcucccaguucuccucccgcaaguaccucaagaaggagaugaacuccuuccagcagcagcccccccccuucggcaccguccccccccagaugauguucccccccaacuggcagggcgccgagaaggacgccgccuuccucgccaaggacuucaacuuccucacccucaacaaccagcccccccccggcaaccgcucccagccccgcgccaugggccccgagaacaaccucuacucccaguacgagcagaagguccgccccugcaucgaccucaucgacucccuccgcgcccucggcgucgagcaggaccucgcccuccccgccaucgccgucaucggcgaccaguccuccggcaaguccuccguccucgaggcccucuccggcgucgcccucccccgcggcuccggcaucgucacccgcugcccccucguccucaagcucaagaagcagcccugcgaggccugggccggccgcaucuccuaccgcaacaccgagcucgagcuccaggaccccggccaggucgagaaggagauccacaaggcccagaacgucauggccggcaacggccgcggcaucucccacgagcucaucucccucgagaucaccucccccgagguccccgaccucaccaucaucgaccuccccggcaucacccgcgucgccgucgacaaccagccccgcgacaucggccuccagaucaaggcccucaucaagaaguacauccagcgccagcagaccaucaaccucgucgucguccccugcaacgucgacaucgccaccaccgaggcccucuccauggcccacgaggucgaccccgagggcgaccgcaccaucggcauccucaccaagcccgaccucauggaccgcggcaccgagaaguccgucaugaacgucguccgcaaccucaccuacccccucaagaagggcuacaugaucgucaagugccgcggccagcaggagaucaccaaccgccucucccucgccgaggccaccaagaaggagaucaccuucuuccagacccaccccuacuuccgcguccuccucgaggagggcuccgccaccgucccccgccucgccgagcgccucaccaccgagcucaucaugcacauccagaagucccucccccuccucgagggccagauccgcgagucccaccagaaggccaccgaggagcuccgccgcugcggcgccgacauccccucccaggaggccgacaagauguucuuccucaucgagaagaucaagauguucaaccaggacaucgagaagcucgucgagggcgaggaggucguccgcgagaacgagacccgccucuacaacaagauccgcgaggacuucaagaacugggucggcauccucgccaccaacacccagaaggucaagaacaucauccacgaggaggucgagaaguacgagaagcaguaccgcggcaaggagcuccucggcuucgucaacuacaagaccuucgagaucaucguccaccaguacauccagcagcucgucgagcccgcccucuccaugcuccagaaggccauggagaucauccagcaggccuucaucaacgucgccaagaagcacuucggcgaguucuucaaccucaaccagaccguccaguccaccaucgaggacaucaaggucaagcacaccgccaaggccgagaacaugauccagcuccaguuccgcauggagcagauggucuucugccaggaccagaucuacuccgucguccucaagaagguccgcgaggagaucuucaacccccucggcacccccucccagaacaugaagcucaacucccacuuccccuccaacgaguccuccgucuccuccuucaccgagaucggcauccaccucaacgccuacuuccucgagaccuccaagcgccucgccaaccagauccccuucaucauccaguacuucaugcuccgcgagaacggcgacucccuccagaaggccaugaugcagauccuccaggagaagaaccgcuacuccuggcuccuccaggagcaguccgagaccgccaccaagcgccgcauccucaaggagcgcaucuaccgccucacccaggcccgccacgcccucugccaguucuccuccaaggagauccacuga

SEQ ID NO: 46298 - RNA, 636 nt, Artificial Sequence
  derived and/or modified sequence opt2 from MXD1__Homo_sapiens__NP_001189443
auggccgccgccguccgcaugaacauccagaugcuccucgaggccgccgacuaccucgagcgccgcgagcgcgaggccgagcacggcuacgccuccaugcuccccuacaacaacaaggaccgcgacgcccucaagcgccgcaacaaguccaagaagaacaacuccuccucccgccgcgcccaccuccgccucugccucgagaagcucaagggccucgucccccucggccccgaguccucccgccacaccacccucucccuccucaccaaggccaagcuccacaucaagaagcucgaggacugcgaccgcaaggccguccaccagaucgaccagcuccagcgcgagcagcgccaccucaagcgccagcucgagaagcucggcaucgagcgcauccgcauggacuccaucggcuccaccgucuccuccgagcgcuccgacuccgaccgcgaggagaucgacgucgacgucgaguccaccgacuaccucaccggcgaccucgacugguccuccuccuccgucuccgacuccgacgagcgcggcuccaugcagucccucggcuccgacgagggcuacuccuccaccuccaucaagcgcaucaagcuccaggacucccacaaggccugccucggccucuga

SEQ ID NO: 46299 - RNA, 582 nt, Artificial Sequence
  derived and/or modified sequence opt2 from MXD3__Homo_sapiens__NP_001136407
auggagccccucgccuccaacauccagguccuccuccaggccgccgaguuccucgagcgccgcgagcgcgaggccgagcacggcuacgccucccucugcccccaccgcucccccggccccauccaccgccgcaagaagcgccccccccaggcccccggcgcccaggacuccggccgcuccguccacaacgagcucgagaagcgccgccgcgcccagcucaagcgcugccucgagcgccucaagcagcagaugccccucggcgccgacugcgcccgcuacaccacccucucccuccuccgccgcgcccgcaugcacauccagaagcucgaggaccaggagcagcgcgcccgccagcucaaggagcgccuccgcuccaagcagcagucccuccagcgccagcucgagcagcuccgcggccucgccggcgccgccgagcgcgagcgccuccgcgccgacucccucgacuccuccggccucuccuccgagcgcuccgacuccgaccagguccuccccaacgagaacggcggcacccccaaccaccgccccaccggccgcggcaacaacaucuccucccaccacuga

SEQ ID NO: 46300 - RNA, 630 nt, Artificial Sequence
  derived and/or modified sequence opt2 from MXD4__Homo_sapiens__NP_006445
auggagcucaacucccuccucauccuccucgaggccgccgaguaccucgagcgccgcgaccgcgaggccgagcacggcuacgccuccguccuccccuucgacggcgacuucgcccgcgagaagaccaaggccgccggccucguccgcaaggcccccaacaaccgcuccucccacaacgagcucgagaagcaccgccgcgccaagcuccgccucuaccucgagcagcucaagcagcucgucccccucggccccgacuccacccgccacaccacccucucccuccucaagcgcgccaagguccacaucaagaagcucgaggagcaggaccgccgcgcccucuccaucaaggagcagcuccagcaggagcaccgcuuccucaagcgccgccucgagcagcucuccguccaguccgucgagcgcguccgcaccgacuccaccggcuccgccgucuccaccgacgacuccgagcaggaggucgacaucgagggcauggaguucggccccggcgagcucgacuccgucggcuccuccuccgacgccgacgaccacuacucccuccaguccggcaccggcggcgacuccggcuucggcccccacugccgccgccucggccgccccgcccucuccuga

SEQ ID NO: 46301 - RNA, 549 nt, Artificial Sequence
  derived and/or modified sequence opt2 from MXI1__Homo_sapiens__NP_001008541
augcccuccccccgccuccagcacuccaagcccccccgccgccucucccgcgcccagaagcacuccuccggcuccuccaacaccuccaccgccaaccgccgcgcccaccuccgccucugccucgagcgccucaagguccucaucccccucggccccgacugcacccgccacaccacccucggccuccucaacaaggccaaggcccacaucaagaagcucgaggaggccgagcgcaagucccagcaccagcucgagaaccucgagcgcgagcagcgcuuccucaaguggcgccucgagcagcuccagggcccccaggagauggagcgcauccgcauggacuccaucggcuccaccaucuccuccgaccgcuccgacuccgagcgcgaggagaucgaggucgacgucgaguccaccgaguucucccacggcgaggucgacaacaucuccaccaccuccaucuccgacaucgacgaccacuccucccuccccuccaucggcuccgacgagggcuacuccuccgccuccgucaagcucuccuucaccuccuga

SEQ ID NO: 46302 - RNA, 8487 nt, Artificial Sequence
  derived and/or modified sequence opt2 from MXRA5__Homo_sapiens__NP_056234
augcccaagcgcgcccacuggggcgcccucuccgucguccucauccuccucuggggccacccccgcgucgcccucgccugcccccaccccugcgccugcuacguccccuccgagguccacugcaccuuccgcucccucgccuccguccccgccggcaucgccaagcacgucgagcgcaucaaccucggcuucaacuccauccaggcccucuccgagaccuccuucgccggccucaccaagcucgagcuccucaugauccacggcaacgagauccccuccauccccgacggcgcccuccgcgaccucuccucccuccaggucuucaaguucuccuacaacaagcuccgcgucaucaccggccagacccuccagggccucuccaaccucaugcgccuccacaucgaccacaacaagaucgaguucauccacccccaggccuucaacggccucaccucccuccgccuccuccaccucgagggcaaccuccuccaccagcuccaccccuccaccuucuccaccuucaccuuccucgacuacuuccgccucuccaccauccgccaccucuaccucgccgagaacaugguccgcacccuccccgccuccaugcuccgcaacaugccccuccucgagaaccucuaccuccagggcaaccccuggaccugcgacugcgagaugcgcugguuccucgagugggacgccaagucccgcggcauccucaagugcaagaaggacaaggccuacgagggcggccagcucugcgccaugugcuucucccccaagaagcucuacaagcacgagauccacaagcucaaggacaugaccugccucaagcccuccaucgaguccccccuccgccagaaccgcucccgcuccaucgaggaggagcaggagcaggaggaggacggcggcucccagcucauccucgagaaguuccagcucccccagugguccaucucccucaacaugaccgacgagcacggcaacauggucaaccucgucugcgacaucaagaagcccauggacgucuacaagauccaccucaaccagaccgacccccccgacaucgacaucaacgccaccgucgcccucgacuucgagugccccaugacccgcgagaacuacgagaagcucuggaagcucaucgccuacuacuccgagguccccgucaagcuccaccgcgagcucaugcucuccaaggacccccgcgucuccuaccaguaccgccaggacgccgacgaggaggcccucuacuacaccggcguccgcgcccagauccucgccgagcccgagugggucaugcagcccuccaucgacauccagcucaaccgccgccaguccaccgccaagaagguccuccucuccuacuacacccaguacucccagaccaucuccaccaaggacacccgccaggcccgcggccgcuccugggucaugaucgagcccuccggcgccguccagcgcgaccagaccguccucgagggcggccccugccagcucuccugcaacgucaaggccuccgagucccccuccaucuucuggguccuccccgacggcuccauccucaaggcccccauggacgaccccgacuccaaguucuccauccucuccuccggcuggcuccgcaucaaguccauggagcccuccgacuccggccucuaccagugcaucgcccagguccgcgacgagauggaccgcauggucuaccgcguccucguccagucccccuccacccagcccgccgagaaggacaccgucaccaucggcaagaaccccggcgaguccgucacccuccccugcaacgcccucgccauccccgaggcccaccucuccuggauccuccccaaccgccgcaucaucaacgaccucgccaacaccucccacgucuacaugcuccccaacggcacccucuccauccccaagguccaggucuccgacuccggcuacuaccgcugcgucgccgucaaccagcagggcgccgaccacuucaccgucggcaucaccgucaccaagaagggcuccggccuccccuccaagcgcggccgccgccccggcgccaaggcccucucccgcguccgcgaggacaucgucgaggacgagggcggcuccggcaugggcgacgaggagaacaccucccgccgccuccuccaccccaaggaccaggaggucuuccucaagaccaaggacgacgccaucaacggcgacaagaaggccaagaagggccgccgcaagcucaagcucuggaagcacuccgagaaggagcccgagaccaacgucgccgagggccgccgcgucuucgagucccgccgccgcaucaacauggccaacaagcagaucaaccccgagcgcugggccgacauccucgccaagguccgcggcaagaaccuccccaagggcaccgagguccccccccucaucaagaccaccuccccccccucccucucccucgaggucaccccccccuuccccgccaucuccccccccuccgccucccccguccagaccgucaccuccgccgaggaguccuccgccgacgucccccuccucggcgaggaggagcacguccucggcaccaucuccuccgccuccaugggccucgagcacaaccacaacggcgucauccucgucgagcccgaggucaccuccaccccccucgaggaggucgucgacgaccucuccgagaagaccgaggagaucaccuccaccgagggcgaccucaagggcaccgccgcccccacccucaucuccgagcccuacgagcccucccccacccuccacacccucgacaccgucuacgagaagcccacccacgaggagaccgccaccgagggcugguccgccgccgacgucggcuccucccccgagcccaccuccuccgaguacgagcccccccucgacgccgucucccucgccgaguccgagcccaugcaguacuucgaccccgaccucgagaccaagucccagcccgacgaggacaagaugaaggaggacaccuucgcccaccucacccccacccccaccaucugggucaacgacuccuccaccucccagcucuucgaggacuccaccaucggcgagcccggcguccccggccagucccaccuccagggccucaccgacaacauccaccucgucaaguccucccucuccacccaggacacccuccucaucaagaagggcaugaaggagaugucccagacccuccagggcggcaacaugcucgagggcgaccccacccacucccgcuccuccgaguccgagggccaggaguccaaguccaucacccuccccgacuccacccucggcaucauguccuccaugucccccgucaagaagcccgccgagaccaccgucggcacccuccucgacaaggacaccaccaccgccaccaccaccccccgccagaaggucgcccccuccuccaccauguccacccaccccucccgccgccgccccaacggccgccgccgccuccgccccaacaaguuccgccaccgccacaagcagaccccccccaccaccuucgcccccuccgagaccuucuccacccagcccacccaggcccccgacaucaagaucuccucccaggucgaguccucccucguccccaccgccugggucgacaacaccgucaacacccccaagcagcucgagauggagaagaacgccgagcccaccuccaagggcaccccccgccgcaagcacggcaagcgccccaacaagcaccgcuacacccccuccaccgucuccucccgcgccuccggcuccaagcccucccccucccccgagaacaagcaccgcaacaucgucacccccuccuccgagaccauccuccucccccgcaccgucucccucaagaccgagggccccuacgacucccucgacuacaugaccaccacccgcaagaucuacuccuccuaccccaagguccaggagacccuccccgucaccuacaagcccaccuccgacggcaaggagaucaaggacgacgucgccaccaacgucgacaagcacaaguccgacauccucgucaccggcgaguccaucaccaacgccauccccaccucccgcucccucgucuccaccaugggcgaguucaaggaggaguccucccccgucggcuuccccggcacccccaccuggaaccccucccgcaccgcccagcccggccgccuccagaccggcauccccgucaccaccuccggcgagaaccucaccgaccccccccuccucaaggagcucgaggacgucgacuucaccuccgaguuccucuccucccucaccgucuccacccccuuccaccaggaggaggccggcuccuccaccacccucuccuccaucaaggucgaggucgccuccucccaggccgagaccaccacccucgaccaggaccaccucgagaccaccgucgccauccuccucuccgagacccgcccccagaaccacacccccaccgccgcccgcaugaaggagcccgccuccuccucccccuccaccauccucaugucccucggccagaccaccaccaccaagcccgcccuccccuccccccgcaucucccaggccucccgcgacuccaaggagaacgucuuccucaacuacgucggcaaccccgagaccgaggccacccccgucaacaacgagggcacccagcacauguccggccccaacgagcucuccacccccuccuccgaccaggacgccuucaaccucuccaccaagcucgagcucgagaagcaggucuucggcucccgcucccucccccgcggccccgacucccagcgccaggacggccgcguccacgccucccaccagcucacccgcguccccgccaagcccauccuccccaccgccaccguccgccuccccgagauguccacccaguccgccucccgcuacuucgucaccucccaguccccccgccacuggaccaacaagcccgagaucaccaccuaccccuccggcgcccuccccgagaacaagcaguucaccaccccccgccucuccuccaccaccaucccccucccccuccacauguccaagcccuccauccccuccaaguucaccgaccgccgcaccgaccaguucaacggcuacuccaaggucuucggcaacaacaacauccccgaggcccgcaaccccgucggcaagccccccuccccccgcaucccccacuacuccaacggccgccuccccuucuucaccaacaagacccucuccuucccccagcucggcgucacccgccgcccccagauccccaccucccccgcccccgucaugcgcgagcgcaaggucauccccggcuccuacaaccgcauccacucccacuccaccuuccaccucgacuucggcccccccgcccccccccuccuccacaccccccagaccaccggcucccccuccaccaaccuccagaacauccccauggucuccuccacccaguccuccaucuccuucaucaccuccuccguccaguccuccggcuccuuccaccaguccuccuccaaguucuucgccggcggcccccccgccuccaaguucuggucccucggcgagaagccccagauccucaccaaguccccccagaccgucuccgucaccgccgagaccgacaccgucuuccccugcgaggccaccggcaagcccaagcccuucgucaccuggaccaaggucuccaccggcgcccucaugacccccaacacccgcauccagcgcuucgagguccucaagaacggcacccucgucauccgcaagguccagguccaggaccgcggccaguacaugugcaccgccuccaaccuccacggccucgaccgcauggucguccuccucuccgucaccguccagcagccccagauccucgccucccacuaccaggacgucaccgucuaccucggcgacaccaucgccauggagugccucgccaagggcacccccgccccccagaucuccuggaucuuccccgaccgccgcgucuggcagaccgucucccccgucgagggccgcaucacccuccacgagaaccgcacccucuccaucaaggaggccuccuucuccgaccgcggcgucuacaagugcgucgccuccaacgccgccggcgccgacucccucgccauccgccuccacgucgccgcccucccccccgucauccaccaggagaagcucgagaacaucucccucccccccggccucuccauccacauccacugcaccgccaaggccgccccccuccccuccguccgcuggguccucggcgacggcacccagauccgccccucccaguuccuccacggcaaccucuucgucuuccccaacggcacccucuacauccgcaaccucgcccccaaggacuccggccgcuacgagugcgucgccgccaaccucgucggcuccgcccgccgcaccguccagcucaacguccagcgcgccgccgccaacgcccgcaucaccggcaccuccccccgccgcaccgacguccgcuacggcggcacccucaagcucgacugcuccgccuccggcgaccccuggccccgcauccucuggcgccuccccuccaagcgcaugaucgacgcccucuucuccuucgacucccgcaucaaggucuucgccaacggcacccucgucgucaaguccgucaccgacaaggacgccggcgacuaccucugcgucgcccgcaacaaggucggcgacgacuacgucguccucaaggucgacgucgucaugaagcccgccaagaucgagcacaaggaggagaacgaccacaaggucuucuacggcggcgaccucaaggucgacugcgucgccaccggccuccccaaccccgagaucuccuggucccuccccgacggcucccucgucaacuccuucaugcaguccgacgacuccggcggccgcaccaagcgcuacgucgucuucaacaacggcacccucuacuucaacgaggucggcaugcgcgaggagggcgacuacaccugcuucgccgagaaccaggucggcaaggacgagaugcgcguccgcgucaaggucgucaccgcccccgccaccauccgcaacaagaccuaccucgccguccagguccccuacggcgacgucgucaccgucgccugcgaggccaagggcgagcccaugcccaaggucaccuggcucucccccaccaacaaggucauccccaccuccuccgagaaguaccagaucuaccaggacggcacccuccucauccagaaggcccagcgcuccgacuccggcaacuacaccugccucguccgcaacuccgccggcgaggaccgcaagaccgucuggauccacgucaacguccagccccccaagaucaacggcaaccccaaccccaucaccaccguccgcgagaucgccgccggcggcucccgcaagcucaucgacugcaaggccgagggcauccccaccccccgcguccucugggccuuccccgagggcgucguccuccccgcccccuacuacggcaaccgcaucaccguccacggcaacggcucccucgacauccgcucccuccgcaaguccgacuccguccagcucgucugcauggcccgcaacgagggcggcgaggcccgccucauccuccagcucaccguccucgagcccauggagaagcccaucuuccacgaccccaucuccgagaagaucaccgccauggccggccacaccaucucccucaacugcuccgccgccggcacccccacccccucccucgucuggguccuccccaacggcaccgaccuccaguccggccagcagcuccagcgcuucuaccacaaggccgacggcaugcuccacaucuccggccucuccuccgucgacgccggcgccuaccgcugcgucgcccgcaacgccgccggccacaccgagcgccucgucucccucaaggucggccucaagcccgaggccaacaagcaguaccacaaccucgucuccaucaucaacggcgagacccucaagcuccccugcaccccccccggcgccggccagggccgcuucuccuggacccuccccaacggcaugcaccucgagggcccccagacccucggccgcgucucccuccucgacaacggcacccucaccguccgcgaggccuccgucuucgaccgcggcaccuacgucugccgcauggagaccgaguacggccccuccgucaccuccauccccgucaucgucaucgccuaccccccccgcaucaccuccgagcccacccccgucaucuacacccgccccggcaacaccgucaagcucaacugcauggccaugggcauccccaaggccgacaucaccugggagcuccccgacaagucccaccucaaggccggcguccaggcccgccucuacggcaaccgcuuccuccacccccagggcucccucaccauccagcacgccacccagcgcgacgccggcuucuacaagugcauggccaagaacauccucggcuccgacuccaagaccaccuacauccacgucuucuga

SEQ ID NO: 46303 - RNA, 969 nt, Artificial Sequence
  derived and/or modified sequence opt2 from MYADM__Homo_sapiens__NP_001277119
augcccgucaccgucacccgcaccaccaucaccaccaccaccaccuccuccuccggccucggcucccccaugaucgucggcuccccccgcgcccucacccagccccucggccuccuccgccuccuccagcucgucuccaccugcgucgccuucucccucgucgccuccgucggcgccuggaccggcuccaugggcaacugguccauguucaccuggugcuucugcuucuccgucacccucaucauccucaucgucgagcucugcggccuccaggcccgcuucccccucuccuggcgcaacuuccccaucaccuucgccugcuacgccgcccucuucugccucuccgccuccaucaucuaccccaccaccuacguccaguuccucucccacggccgcucccgcgaccacgccaucgccgccaccuucuucuccugcaucgccugcgucgccuacgccaccgaggucgccuggacccgcgcccgccccggcgagaucaccggcuacauggccaccguccccggccuccucaagguccucgagaccuucgucgccugcaucaucuucgccuucaucuccgaccccaaccucuaccagcaccagcccgcccucgaguggugcgucgccgucuacgccaucugcuucauccucgccgccaucgccauccuccucaaccucggcgagugcaccaacguccuccccauccccuuccccuccuuccucuccggccucgcccuccucuccguccuccucuacgccaccgcccucguccucuggccccucuaccaguucgacgagaaguacggcggccagccccgccgcucccgcgacgucuccugcucccgcucccacgccuacuacgucugcgccugggaccgccgccucgccgucgccauccucaccgccaucaaccuccucgccuacgucgccgaccucguccacuccgcccaccucgucuucgucaaggucuga

SEQ ID NO: 46304 - RNA, 3999 nt, Artificial Sequence
  derived and/or modified sequence opt2 from MYBBP1A__Homo_sapiens__NP_001099008
auggagucccgcgaccccgcccagcccaugucccccggcgaggccacccaguccggcgcccgccccgccgaccgcuacggccuccucaagcacucccgcgaguuccucgacuucuucugggacaucgccaagcccgagcaggagacccgccucgccgccaccgagaagcuccucgaguaccuccgcggccgccccaagggcuccgagaugaaguacgcccucaagcgccucaucaccggccucggcgucggccgcgagaccgcccgccccugcuacucccucgcccucgcccagcuccuccaguccuucgaggaccucccccucugcuccauccuccagcagauccaggagaaguacgaccuccaccaggucaagaaggccaugcuccgccccgcccucuucgccaaccucuucggcguccucgcccucuuccaguccggccgccucgucaaggaccaggaggcccucaugaaguccgucaagcuccuccaggcccucgcccaguaccagaaccaccuccaggagcagccccgcaaggcccucgucgacauccucuccgaggucuccaaggccacccuccaggagauccuccccgagguccucaaggccgaccucaacaucauccucuccucccccgagcagcucgagcucuuccuccucgcccagcagaagguccccuccaagcucaagaagcucgucggcuccgucaaccucuucuccgacgagaacgucccccgccucgucaacguccucaagauggccgccuccuccgucaagaaggaccgcaagcuccccgccaucgcccucgaccuccuccgccucgcccucaaggaggacaaguucccccgcuucuggaaggaggucgucgagcagggccuccucaagaugcaguucuggcccgccuccuaccucugcuuccgccuccucggcgccgcccucccccuccucaccaaggagcagcuccaccucgucaugcagggcgacgucauccgccacuacggcgagcacgucugcaccgccaagcuccccaagcaguucaaguucgcccccgagauggacgacuacgucggcaccuuccucgagggcugccaggacgaccccgagcgccagcucgccguccucgucgccuucuccuccgucaccaaccagggccuccccgucacccccaccuucuggcgcgucguccgcuuccucuccccccccgcccuccagggcuacgucgccuggcuccgcgccauguuccuccagcccgaccucgacucccucgucgacuucuccaccaacaaccagaagaaggcccaggacuccucccuccacaugcccgagcgcgccgucuuccgccuccgcaaguggaucaucuuccgccucgucuccaucgucgacucccuccaccucgagauggaggaggcccucaccgagcaggucgcccgcuucugccucuuccacuccuucuucgucaccaagaagcccaccucccagauccccgagaccaagcaccccuucuccuucccccucgagaaccaggcccgcgaggccgucuccuccgccuucuucucccuccuccagacccucuccacccaguucaagcaggcccccggccagacccagggcggccagcccuggaccuaccaccucguccaguucgccgaccuccuccucaaccacucccacaacgucaccaccgucacccccuucaccgcccagcagcgccaggccugggaccgcaugcuccagacccucaaggagcucgaggcccacuccgccgaggcccgcgccgccgccuuccagcaccuccuccuccucgucggcauccaccuccucaagucccccgccgaguccugcgaccuccucggcgacauccagaccugcauccgcaagucccucggcgagaagccccgccgcucccgcaccaagaccaucgacccccaggagccccccugggucgagguccucgucgagauccuccucgcccuccucgcccagcccucccaccucaugcgccaggucgcccgcuccgucuucggccacaucugcucccaccucaccccccgcgcccuccagcucauccucgacguccucaaccccgagaccuccgaggacgagaacgaccgcgucgucgucaccgacgacuccgacgagcgccgccucaagggcgccgaggacaaguccgaggagggcgaggacaaccgcuccuccgaguccgaggaggaguccgagggcgaggaguccgaggaggaggagcgcgacggcgacgucgaccagggcuuccgcgagcagcucaugaccguccuccaggccggcaaggcccucggcggcgaggacuccgagaacgaggaggagcucggcgacgaggccaugauggcccucgaccagucccucgccucccucuucgccgagcagaagcuccgcauccaggcccgccgcgacgagaagaacaagcuccagaaggagaaggcccuccgccgcgacuuccagauccgcguccucgaccucgucgagguccucgucaccaagcagcccgagaacgcccucguccucgagcuccucgagccccuccucuccaucauccgccgcucccuccgcuccuccuccuccaagcaggagcaggaccuccuccacaagaccgcccgcaucuucacccaccaccucugccgcgcccgccgcuacugccacgaccucggcgagcgcgccggcgcccuccacgcccaggucgagcgccucguccagcaggccggccgccagcccgacucccccaccgcccucuaccacuucaacgccucccucuaccuccuccgcguccucaagggcaacaccgccgagggcugcguccacgagacccaggagaagcagaaggccggcaccgaccccucccacaugcccaccggcccccaggccgccuccugccucgaccucaaccucgucacccgcgucuacuccaccgcccucuccuccuuccucaccaagcgcaacuccccccucaccguccccauguuccucucccucuucucccgccaccccguccucugccagucccuccuccccauccucguccagcacaucaccggccccguccgcccccgccaccaggccugccuccuccuccagaagacccucuccaugcgcgagguccgcuccugcuucgaggaccccgaguggaagcagcucaugggccagguccucgccaaggucaccgagaaccuccgcguccucggcgaggcccagaccaaggcccagcaccagcaggcccucuccucccucgagcuccucaacguccucuuccgcaccugcaagcacgagaagcucacccucgaccucaccguccuccucggcguccuccagggccagcagcagucccuccagcagggcgcccacuccaccggcuccucccgccuccacgaccucuacuggcaggccaugaagacccucggcguccagcgccccaagcucgagaagaaggacgccaaggagauccccuccgccacccagucccccaucuccaagaagcgcaagaagaagggcuuccuccccgagaccaagaagcgcaagaagcgcaaguccgaggacggcacccccgccgaggacggcacccccgccgccaccggcggcucccagccccccuccaugggccgcaagaagcgcaaccgcaccaaggccaagguccccgcccaggccaacggcacccccaccaccaagucccccgcccccggcgcccccacccgcucccccuccacccccgccaagucccccaagcuccagaagaagaaccagaagcccucccaggucaacggcgcccccggcucccccaccgagcccgccggccagaagcagcaccagaaggcccuccccaagaagggcguccucggcaaguccccccucuccgcccucgcccgcaagaaggcccgccucucccucgucauccgcucccccucccuccuccaguccggcgccaagaagaaggcccagacccuccgcuucaccaucuccuccuccaagaaguga

SEQ ID NO: 46305 - RNA, 1914 nt, Artificial Sequence
  derived and/or modified sequence opt2 from MYB__Homo_sapiens__NP_001123644
auggcccgccgcccccgccacuccaucuacuccuccgacgaggacgacgaggacuucgagaugugcgaccacgacuacgacggccuccuccccaaguccggcaagcgccaccucggcaagacccgcuggacccgcgaggaggacgagaagcucaagaagcucgucgagcagaacggcaccgacgacuggaaggucaucgccaacuaccuccccaaccgcaccgacguccagugccagcaccgcuggcagaagguccucaaccccgagcucaucaagggccccuggaccaaggaggaggaccagcgcgucaucgagcucguccagaaguacggccccaagcgcugguccgucaucgccaagcaccucaagggccgcaucggcaagcagugccgcgagcgcuggcacaaccaccucaaccccgaggucaagaagaccuccuggaccgaggaggaggaccgcaucaucuaccaggcccacaagcgccucggcaaccgcugggccgagaucgccaagcuccuccccggccgcaccgacaacgccaucaagaaccacuggaacuccaccaugcgccgcaaggucgagcaggagggcuaccuccaggaguccuccaaggccucccagcccgccgucgccaccuccuuccagaagaacucccaccucaugggcuucgcccaggccccccccaccgcccagcuccccgccaccggccagcccaccgucaacaacgacuacuccuacuaccacaucuccgaggcccagaacgucuccucccacguccccuaccccgucgcccuccacgucaacaucgucaacgucccccagcccgccgccgccgccauccagcgccacuacaacgacgaggaccccgagaaggagaagcgcaucaaggagcucgagcuccuccucauguccaccgagaacgagcucaagggccagcagacccagaaccacaccugcuccuaccccggcuggcacuccaccaccaucgccgaccacacccgcccccacggcgacuccgcccccgucuccugccucggcgagcaccacuccacccccucccuccccgccgaccccggcucccuccccgaggaguccgccucccccgcccgcugcaugaucguccaccagggcaccauccucgacaacgucaagaaccuccucgaguucgccgagacccuccaguucaucgacuccuuccucaacaccuccuccaaccacgagaacuccgaccucgagaugcccucccucaccuccaccccccucaucggccacaagcucaccgucaccacccccuuccaccgcgaccagaccgucaagacccagaaggagaacaccgucuuccgcacccccgccaucaagcgcuccauccucgaguccuccccccgcacccccacccccuucaagcacgcccucgccgcccaggagaucaaguacggcccccucaagaugcucccccagacccccucccaccucgucgaggaccuccaggacgucaucaagcaggaguccgacgaguccggcaucgucgccgaguuccaggagaacggccccccccuccucaagaagaucaagcaggaggucgagucccccaccgacaaguccggcaacuucuucugcucccaccacugggagggcgacucccucaacacccagcucuucacccagaccucccccgucgccgacgcccccaacauccucaccuccuccguccucauggcccccgccuccgaggacgaggacaacguccucaaggccuucaccguccccaagaaccgcucccucgccuccccccuccagcccugcuccuccaccugggagcccgccuccugcggcaagauggaggagcagaugaccuccuccucccaggcccgcaaguacgucaacgccuucuccgcccgcacccucgucauguga

SEQ ID NO: 46306 - RNA, 2259 nt, Artificial Sequence
  derived and/or modified sequence opt2 from MYBL1__Homo_sapiens__NP_001073885
auggccaagcgcucccgcuccgaggacgaggacgacgaccuccaguacgccgaccacgacuacgaggucccccagcagaagggccucaagaagcucuggaaccgcgucaaguggacccgcgacgaggacgacaagcucaagaagcucgucgagcagcacggcaccgacgacuggacccucaucgccucccaccuccagaaccgcuccgacuuccagugccagcaccgcuggcagaagguccucaaccccgagcucaucaagggccccuggaccaaggaggaggaccagcgcgucaucgagcucguccagaaguacggccccaagcgcuggucccucaucgccaagcaccucaagggccgcaucggcaagcagugccgcgagcgcuggcacaaccaccucaaccccgaggucaagaaguccuccuggaccgaggaggaggaccgcaucaucuacgaggcccacaagcgccucggcaaccgcugggccgagaucgccaagcuccuccccggccgcaccgacaacuccaucaagaaccacuggaacuccaccaugcgccgcaaggucgagcaggagggcuaccuccaggacggcaucaaguccgagcgcuccuccuccaagcuccagcacaagcccugcgccgccauggaccacaugcagacccagaaccaguucuacauccccguccagauccccggcuaccaguacgucucccccgagggcaacugcaucgagcacguccagcccaccuccgccuucauccagcagcccuucaucgacgaggaccccgacaaggagaagaagaucaaggagcucgagaugcuccucauguccgccgagaacgagguccgccgcaagcgcauccccucccagcccggcuccuucuccuccugguccggcuccuuccucauggacgacaacauguccaacacccucaacucccucgacgagcacaccuccgaguucuacuccauggacgagaaccagcccgucuccgcccagcagaacucccccaccaaguuccucgccgucgaggccaacgccguccucuccucccuccagaccauccccgaguucgccgagacccucgagcucaucgaguccgaccccgucgccugguccgacgucaccuccuucgacaucuccgacgccgccgccucccccaucaaguccacccccgucaagcucaugcgcauccagcacaacgagggcgccauggagugccaguucaacgucucccucguccucgagggcaagaagaacaccugcaacggcggcaacuccgaggccgucccccucaccucccccaacaucgccaaguucuccaccccccccgccauccuccgcaagaagcgcaagaugcgcgucggccacucccccggcuccgagcuccgcgacggcucccucaacgacggcggcaacauggcccucaagcacaccccccucaagacccuccccuucucccccucccaguucuucaacaccugccccggcaacgagcagcucaacaucgagaaccccuccuucaccuccacccccaucugcggccagaaggcccucaucaccaccccccuccacaaggagaccacccccaaggaccagaaggagaacgucggcuuccgcacccccaccauccgccgcuccauccucggcaccaccccccgcacccccacccccuucaagaacgcccucgccgcccaggagaagaaguacggcccccucaagaucgucucccagccccucgccuuccucgaggaggacauccgcgagguccucaaggaggagaccggcaccgaccucuuccucaaggaggaggacgagcccgccuacaaguccugcaagcaggagaacaccgccuccggcaagaagguccgcaagucccucguccucgacaacugggagaaggaggaguccggcacccagcuccucaccgaggacaucuccgacaugcaguccgagaaccgcuucaccaccucccuccucaugaucccccuccucgagauccacgacaaccgcugcaaccucauccccgagaagcaggacaucaacuccaccaacaagaccuacacccucaccaagaagaagcccaaccccaacaccuccaaggucgucaagcucgagaagaaccuccaguccaacugcgagugggagaccgucgucuacggcaagaccgaggaccagcucaucaugaccgagcaggcccgccgcuaccucuccaccuacaccgccaccuccuccaccucccgcgcccucauccucuga

SEQ ID NO: 46307 - RNA, 2031 nt, Artificial Sequence
  derived and/or modified sequence opt2 from MYBL2__Homo_sapiens__NP_001265539
augucccgccgcacccgcugcgaggaccucgacgagcuccacuaccaggacaccgacuccgacguccccgagcagcgcgacuccaagugcaaggucaaguggacccacgaggagaaccgcaccgaccagcagugccaguaccgcuggcuccgcguccucaaccccgaccucgucaagggccccuggaccaaggaggaggaccagaaggucaucgagcucgucaagaaguacggcaccaagcaguggacccucaucgccaagcaccucaagggccgccucggcaagcagugccgcgagcgcuggcacaaccaccucaaccccgaggucaagaaguccugcuggaccgaggaggaggaccgcaucaucugcgaggcccacaagguccucggcaaccgcugggccgagaucgccaagaugcuccccggccgcaccgacaacgccgucaagaaccacuggaacuccaccaucaagcgcaaggucgacaccggcggcuuccucuccgaguccaaggacugcaagccccccgucuaccuccuccucgagcucgaggacaaggacggccuccaguccgcccagcccaccgagggccagggcucccuccucaccaacuggcccuccgucccccccaccaucaaggaggaggagaacuccgaggaggagcucgccgccgccaccaccuccaaggagcaggagcccaucggcaccgaccucgacgccguccgcacccccgagccccucgaggaguuccccaagcgcgaggaccaggagggcuccccccccgagaccucccuccccuacaagugggucgucgaggccgccaaccuccucauccccgccgucggcuccucccucuccgaggcccucgaccucaucgaguccgaccccgacgccuggugcgaccucuccaaguucgaccuccccgaggagcccuccgccgaggacuccaucaacaacucccucguccagcuccaggccucccaccagcagcagguccuccccccccgccagcccuccgcccucguccccuccgucaccgaguaccgccucgacggccacaccaucuccgaccucucccgcuccucccgcggcgagcucauccccaucucccccuccaccgaggucggcggcuccggcaucggcaccccccccuccguccucaagcgccagcgcaagcgccgcgucgcccucucccccgucaccgagaacuccaccucccucuccuuccucgacuccugcaacucccucacccccaaguccacccccgucaagacccuccccuucucccccucccaguuccucaacuucuggaacaagcaggacacccucgagcucgagucccccucccucaccuccacccccgucugcucccagaaggucgucgucaccaccccccuccaccgcgacaagaccccccuccaccagaagcacgccgccuucgucacccccgaccagaaguacuccauggacaacaccccccacacccccacccccuucaagaacgcccucgagaaguacggcccccucaagccccucccccagaccccccaccucgaggaggaccucaaggagguccuccgcuccgaggccggcaucgagcucaucaucgaggacgacauccgccccgagaagcagaagcgcaagcccggccuccgccgcucccccaucaagaagguccgcaagucccucgcccucgacaucgucgacgaggacgucaagcucaugauguccacccuccccaagucccucucccuccccaccaccgcccccuccaacuccuccucccucacccucuccggcaucaaggaggacaacucccuccucaaccagggcuuccuccaggccaagcccgagaaggccgccgucgcccagaagccccgcucccacuucaccacccccgcccccauguccuccgccuggaagaccgucgccugcggcggcacccgcgaccagcucuucaugcaggagaaggcccgccagcuccucggccgccucaagcccucccacaccucccgcacccucauccucuccuga

SEQ ID NO: 46308 - RNA, 3522 nt, Artificial Sequence
  derived and/or modified sequence opt2 from MYBPC1__Homo_sapiens__NP_001241647
augcccgagcccaccaagaaggaggagaacgagguccccgcccccgcccccccccccgaggagcccuccaaggagaaggaggccggcaccacccccgccaaggacuggacccucgucgagaccccccccggcgaggagcaggccaagcagaacgccaacucccagcucuccauccucuucaucgagaagccccagggcggcaccgucaaggucggcgaggacaucaccuucaucgccaaggucaaggccgaggaccuccuccgcaagcccaccaucaagugguucaagggcaaguggauggaccucgccuccaaggccggcaagcaccuccagcucaaggagaccuucgagcgccacucccgcgucuacaccuucgagaugcagaucaucaaggccaaggacaacuucgccggcaacuaccgcugcgaggucaccuacaaggacaaguucgacuccugcuccuucgaccucgagguccacgaguccaccggcaccacccccaacaucgacauccgcuccgccuucaagcgcuccggcgagggccaggaggacgccggcgagcucgacuucuccggccuccucaagcgccgcgaggucaagcagcaggaggaggagccccaggucgacgucugggagcuccucaagaacgccaagcccuccgaguacgagaagaucgccuuccaguacggcaucaccgaccuccgcggcaugcucaagcgccucaagcgcaugcgccgcgaggagaagaaguccgccgccuucgccaagauccucgaccccgccuaccaggucgacaagggcggccgcguccgcuucgucgucgagcucgccgaccccaagcucgaggucaagugguacaagaacggccaggagauccgccccuccaccaaguacaucuucgagcacaagggcugccagcgcauccucuucaucaacaacugccagaugaccgacgacuccgaguacuacgucaccgccggcgacgagaagugcuccaccgagcucuucguccgcgagccccccaucauggucaccaagcagcucgaggacaccaccgccuacugcggcgagcgcgucgagcucgagugcgaggucuccgaggacgacgccaacgucaagugguucaagaacggcgaggagaucauccccggccccaagucccgcuaccgcauccgcgucgagggcaagaagcacauccucaucaucgagggcgccaccaaggccgacgccgccgaguacuccgucaugaccaccggcggccaguccuccgccaagcucuccgucgaccucaagccccucaagauccucaccccccucaccgaccagaccgucaaccucggcaaggagaucugccucaagugcgagaucuccgagaacauccccggcaaguggaccaagaacggccuccccguccaggaguccgaccgccucaaggucguccacaagggccgcauccacaagcucgucaucgccaacgcccucaccgaggacgagggcgacuacgucuucgcccccgacgccuacaacgucacccuccccgccaagguccacgucaucgacccccccaagaucauccucgacggccucgacgccgacaacaccgucaccgucaucgccggcaacaagcuccgccucgagauccccaucuccggcgagcccccccccaaggccauguggucccgcggcgacaaggccaucauggagggcuccggccgcauccgcaccgaguccuaccccgacuccuccacccucgucaucgacaucgccgagcgcgacgacuccggcgucuaccacaucaaccucaagaacgaggccggcgaggcccacgccuccaucaaggucaaggucgucgacuuccccgacccccccgucgcccccaccgucaccgaggucggcgacgacuggugcaucaugaacugggagccccccgccuacgacggcggcucccccauccucggcuacuucaucgagcgcaagaagaagcaguccucccgcuggaugcgccucaacuucgaccucugcaaggagaccaccuucgagcccaagaagaugaucgagggcgucgccuacgagguccgcaucuucgccgucaacgccaucggcaucuccaagcccuccaugcccucccgccccuucgucccccucgccgucaccuccccccccacccuccucaccgucgacuccgucaccgacaccaccgucaccaugcgcuggcgcccccccgaccacaucggcgccgccggccucgacggcuacguccucgaguacugcuucgagggcuccaccuccgccaagcaguccgacgagaacggcgaggccgccuacgaccuccccgccgaggacuggaucgucgccaacaaggaccucaucgacaagaccaaguucaccaucaccggccuccccaccgacgccaagaucuucguccgcgucaaggccgucaacgccgccggcgccuccgagcccaaguacuacucccagcccauccucgucaaggagaucaucgagccccccaagauccgcaucccccgccaccucaagcagaccuacauccgccgcgucggcgaggccgucaaccucgucauccccuuccagggcaagccccgccccgagcucaccuggaagaaggacggcgccgagaucgacaagaaccagaucaacauccgcaacuccgagaccgacaccaucaucuucauccgcaaggccgagcgcucccacuccggcaaguacgaccuccaggucaaggucgacaaguucgucgagaccgccuccaucgacauccagaucaucgaccgccccggccccccccagaucgucaagaucgaggacgucuggggcgagaacgucgcccucaccuggaccccccccaaggacgacggcaacgccgccaucaccggcuacaccauccagaaggccgacaagaaguccauggagugguucaccgucaucgagcacuaccaccgcaccuccgccaccaucaccgagcucgucaucggcaacgaguacuacuuccgcgucuucuccgagaacaugugcggccucuccgaggacgccaccaugaccaaggaguccgccgucaucgcccgcgacggcaagaucuacaagaaccccgucuacgaggacuucgacuucuccgaggcccccauguucacccagccccucgucaacaccuacgccaucgccggcuacaacgccacccucaacugcuccguccgcggcaaccccaagcccaagaucaccuggaugaagaacaaggucgccaucgucgacgacccccgcuaccgcauguucuccaaccagggcgucugcacccucgagauccgcaagcccucccccuacgacggcggcaccuacugcugcaaggccgucaacgaccucggcaccgucgagaucgagugcaagcucgaggucaaggucaucuaccagggcgucaacacccccggccagcccgucuuccucgagggccagcagcaggucggcucccccuccgccgacuccuccugcaaggccuaccuccagaccuga

SEQ ID NO: 46309 - RNA, 3426 nt, Artificial Sequence
  derived and/or modified sequence opt2 from MYBPC2__Homo_sapiens__NP_004524
augcccgaggccaagcccgccgccaagaaggcccccaagggcaaggacgcccccaagggcgcccccaaggaggccccccccaaggaggcccccgccgaggcccccaaggaggccccccccgaggaccagucccccaccgccgaggagcccaccggcgucuuccucaagaagcccgacuccgucuccgucgagaccggcaaggacgccgucgucgucgccaaggucaacggcaaggagcuccccgacaagcccaccaucaagugguucaagggcaaguggcucgagcucggcuccaaguccggcgcccgcuucuccuucaaggagucccacaacuccgccuccaacgucuacaccgucgagcuccacaucggcaaggucguccucggcgaccgcggcuacuaccgccucgaggucaaggccaaggacaccugcgacuccugcggcuucaacaucgacgucgaggccccccgccaggacgccuccggccagucccucgaguccuucaagcgcaccuccgagaagaaguccgacaccgccggcgagcucgacuucuccggccuccucaagaagcgcgaggucgucgaggaggagaagaagaagaagaagaaggacgacgacgaccucggcaucccccccgagaucugggagcuccucaagggcgccaagaaguccgaguacgagaagaucgccuuccaguacggcaucaccgaccuccgcggcaugcucaagcgccucaagaaggccaaggucgaggucaagaaguccgccgccuucaccaagaagcucgaccccgccuaccaggucgaccgcggcaacaagaucaagcucauggucgagaucuccgaccccgaccucacccucaagugguucaagaacggccaggagaucaagcccuccuccaaguacgucuucgagaacgucggcaagaagcgcauccucaccaucaacaagugcacccucgccgacgacgccgccuacgaggucgccgucaaggacgagaagugcuucaccgagcucuucgucaaggagccccccguccucaucgucaccccccucgaggaccagcaggucuucgucggcgaccgcgucgagauggccgucgaggucuccgaggagggcgcccaggucauguggaugaaggacggcgucgagcucacccgcgaggacuccuucaaggcccgcuaccgcuucaagaaggacggcaagcgccacauccucaucuucuccgacgucguccaggaggaccgcggccgcuaccaggucaucaccaacggcggccagugcgaggccgagcucaucgucgaggagaagcagcucgagguccuccaggacaucgccgaccucaccgucaaggccuccgagcaggccgucuucaagugcgaggucuccgacgagaaggucaccggcaagugguacaagaacggcgucgagguccgccccuccaagcgcaucaccaucucccacgucggccgcuuccacaagcucgucaucgacgacguccgccccgaggacgagggcgacuacaccuucguccccgacggcuacgcccucucccucuccgccaagcucaacuuccucgagaucaaggucgaguacguccccaagcaggagccccccaagauccaccucgacugcuccggcaagaccuccgagaacgccaucgucgucgucgccggcaacaagcuccgccucgacgucuccaucaccggcgagcccccccccgucgccaccuggcucaagggcgacgaggucuucaccaccaccgagggccgcacccgcaucgagaagcgcgucgacugcuccuccuucgucaucgaguccgcccagcgcgaggacgagggccgcuacaccaucaaggucaccaaccccgucggcgaggacgucgccuccaucuuccuccaggucgucgacguccccgacccccccgaggccguccgcaucaccuccgucggcgaggacugggccauccucgucugggagccccccauguacgacggcggcaagcccgucaccggcuaccucgucgagcgcaagaagaagggcucccagcgcuggaugaagcucaacuucgaggucuucaccgagaccaccuacgaguccaccaagaugaucgagggcauccucuacgagaugcgcgucuucgccgucaacgccaucggcgucucccagcccuccaugaacaccaagcccuucaugcccaucgcccccaccuccgagccccuccaccucaucgucgaggacgucaccgacaccaccaccacccucaaguggcgcccccccaaccgcaucggcgccggcggcaucgacggcuaccucgucgaguacugccucgagggcuccgaggaguggguccccgccaacaccgagcccgucgagcgcugcggcuucaccgucaagaaccuccccaccggcgcccgcauccucuuccgcgucgucggcgucaacaucgccggccgcuccgagcccgccacccucgcccagcccgucaccauccgcgagaucgccgagccccccaagauccgccucccccgccaccuccgccagaccuacauccgcaaggucggcgagcagcucaaccucgucguccccuuccagggcaagccccgcccccaggucgucuggaccaagggcggcgccccccucgacaccucccgcguccacguccgcaccuccgacuucgacaccgucuucuucguccgccaggccgcccgcuccgacuccggcgaguacgagcucuccguccagaucgagaacaugaaggacaccgccaccauccgcauccgcgucgucgagaaggccggcccccccaucaacgucauggucaaggaggucuggggcaccaacgcccucgucgaguggcaggcccccaaggacgacggcaacuccgagaucaugggcuacuucguccagaaggccgacaagaagaccauggagugguucaacgucuacgagcgcaaccgccacaccuccugcaccgucuccgaccucaucgucggcaacgaguacuacuuccgcgucuacaccgagaacaucugcggccucuccgacucccccggcgucuccaagaacaccgcccgcauccucaagaccggcaucaccuucaagcccuucgaguacaaggagcacgacuuccgcauggcccccaaguuccucaccccccucaucgaccgcgucgucgucgccggcuacuccgccgcccucaacugcgccguccgcggccaccccaagcccaaggucgucuggaugaagaacaagauggagauccgcgaggaccccaaguuccucaucaccaacuaccagggcguccucacccucaacauccgccgccccucccccuucgacgccggcaccuacaccugccgcgccgucaacgagcucggcgaggcccucgccgagugcaagcucgagguccgcgucccccaguga

SEQ ID NO: 46310 - RNA, 3825 nt, Artificial Sequence
  derived and/or modified sequence opt2 from MYBPC3__Homo_sapiens__NP_000247
augcccgagcccggcaagaagcccgucuccgccuucuccaagaagccccgcuccgucgaggucgccgccggcucccccgccgucuucgaggccgagaccgagcgcgccggcgucaagguccgcuggcagcgcggcggcuccgacaucuccgccuccaacaaguacggccucgccaccgagggcacccgccacacccucaccguccgcgaggucggccccgccgaccagggcuccuacgccgucaucgccggcuccuccaaggucaaguucgaccucaaggucaucgaggccgagaaggccgagcccaugcucgcccccgcccccgcccccgccgaggccaccggcgcccccggcgaggcccccgcccccgccgccgagcucggcgaguccgcccccucccccaagggcuccuccuccgccgcccucaacggccccacccccggcgcccccgacgaccccaucggccucuucgucaugcgcccccaggacggcgaggucaccgucggcggcuccaucaccuucuccgcccgcgucgccggcgccucccuccucaagccccccgucgucaagugguucaagggcaagugggucgaccucuccuccaaggucggccagcaccuccagcuccacgacuccuacgaccgcgccuccaaggucuaccucuucgagcuccacaucaccgacgcccagcccgccuucaccggcuccuaccgcugcgaggucuccaccaaggacaaguucgacugcuccaacuucaaccucaccguccacgaggccaugggcaccggcgaccucgaccuccucuccgccuuccgccgcaccucccucgccggcggcggccgccgcaucuccgacucccacgaggacaccggcauccucgacuucuccucccuccucaagaagcgcgacuccuuccgcaccccccgcgacuccaagcucgaggcccccgccgaggaggacgucugggagauccuccgccaggccccccccuccgaguacgagcgcaucgccuuccaguacggcgucaccgaccuccgcggcaugcucaagcgccucaagggcaugcgccgcgacgagaagaaguccaccgccuuccagaagaagcucgagcccgccuaccaggucuccaagggccacaagauccgccucaccgucgagcucgccgaccacgacgccgaggucaaguggcucaagaacggccaggagauccagauguccggcuccaaguacaucuucgaguccaucggcgccaagcgcacccucaccaucucccagugcucccucgccgacgacgccgccuaccagugcgucgucggcggcgagaagugcuccaccgagcucuucgucaaggagccccccguccucaucacccgcccccucgaggaccagcucgucauggucggccagcgcgucgaguucgagugcgaggucuccgaggagggcgcccaggucaaguggcucaaggacggcgucgagcucacccgcgaggagaccuucaaguaccgcuucaagaaggacggccagcgccaccaccucaucaucaacgaggccaugcucgaggacgccggccacuacgcccucugcaccuccggcggccaggcccucgccgagcucaucguccaggagaagaagcucgaggucuaccaguccaucgccgaccucauggucggcgccaaggaccaggccgucuucaagugcgaggucuccgacgagaacguccgcggcgucuggcucaagaacggcaaggagcucguccccgacucccgcaucaaggucucccacaucggccgcguccacaagcucaccaucgacgacgucacccccgccgacgaggccgacuacuccuucguccccgagggcuucgccugcaaccucuccgccaagcuccacuucauggaggucaagaucgacuucgucccccgccaggagccccccaagauccaccucgacugccccggccgcauccccgacaccaucgucgucgucgccggcaacaagcuccgccucgacguccccaucuccggcgaccccgcccccaccgucaucuggcagaaggccaucacccagggcaacaaggcccccgcccgccccgcccccgacgcccccgaggacaccggcgacuccgacgagugggucuucgacaagaagcuccucugcgagaccgagggccgcguccgcgucgagaccaccaaggaccgcuccaucuucaccgucgagggcgccgagaaggaggacgagggcgucuacaccgucaccgucaagaaccccgucggcgaggaccaggucaaccucaccgucaaggucaucgacguccccgacgcccccgccgcccccaagaucuccaacgucggcgaggacuccugcaccguccagugggagccccccgccuacgacggcggccagcccauccucggcuacauccucgagcgcaagaagaagaaguccuaccgcuggaugcgccucaacuucgaccucauccaggagcucucccacgaggcccgccgcaugaucgagggcgucgucuacgagaugcgcgucuacgccgucaacgccaucggcaugucccgccccucccccgccucccagcccuucaugcccaucggcccccccuccgagcccacccaccucgccgucgaggacgucuccgacaccaccgucucccucaaguggcgcccccccgagcgcgucggcgccggcggccucgacggcuacuccgucgaguacugccccgagggcugcuccgagugggucgccgcccuccagggccucaccgagcacaccuccauccucgucaaggaccuccccaccggcgcccgccuccucuuccgcguccgcgcccacaacauggccggccccggcgcccccgucaccaccaccgagcccgucaccguccaggagauccuccagcgcccccgccuccagcucccccgccaccuccgccagaccauccagaagaaggucggcgagcccgucaaccuccucauccccuuccagggcaagccccgcccccaggucaccuggaccaaggagggccagccccucgccggcgaggaggucuccauccgcaacucccccaccgacaccauccucuucauccgcgccgcccgccgcguccacuccggcaccuaccaggucaccguccgcaucgagaacauggaggacaaggccacccucguccuccaggucgucgacaagcccucccccccccaggaccuccgcgucaccgacgccuggggccucaacgucgcccucgaguggaagcccccccaggacgucggcaacaccgagcucuggggcuacaccguccagaaggccgacaagaagaccauggagugguucaccguccucgagcacuaccgccgcacccacugcgucguccccgagcucaucaucggcaacggcuacuacuuccgcgucuucucccagaacauggucggcuucuccgaccgcgccgccaccaccaaggagcccgucuucaucccccgccccggcaucaccuacgagccccccaacuacaaggcccucgacuucuccgaggcccccuccuucacccagccccucgucaaccgcuccgucaucgccggcuacaccgccaugcucugcugcgccguccgcggcucccccaagcccaagaucuccugguucaagaacggccucgaccucggcgaggacgcccgcuuccgcauguucuccaagcagggcguccucacccucgagauccgcaagcccugccccuucgacggcggcaucuacgucugccgcgccaccaaccuccagggcgaggcccgcugcgagugccgccucgagguccgcgucccccaguga

SEQ ID NO: 46311 - RNA, 1434 nt, Artificial Sequence
  derived and/or modified sequence opt2 from MYBPH__Homo_sapiens__NP_004988
augauggagaagaacaccuccgagggccccgccugcucccccgaggagaccgccuccgaguccgccaagguccccaccgccgagccccccggcgaggucgccgucuccgaguccacccgcgaggagcagguccccaagccccaggcccccgccccccaggcccccaccgccuccaccgccaccaagcccgccccccccuccgaggacguccccuccgccccccuccuccucacccucgacgacgucuccuccuccuccgucaccgucuccugggagccccccgagcgccucggccgccucggccuccagggcuacguccucgagcucugccgcgagggcgccuccgaguggguccccgucuccgcccgccccaugauggucacccagcagaccguccgcaaccucgcccucggcgacaaguuccuccuccgcgucuccgccgucuccuccgccggcgccggcccccccgccaugcucgaccagcccauccacauccgcgagaacaucgaggcccccaagauccgcgucccccgccaccuccgccagaccuacauccgccaggucggcgagaccgucaaccuccagauccccuuccagggcaagcccaagccccaggccaccuggacccacaacggccacgcccucgacucccagcgcgucuccaugcgcaccggcgaccaggacuccauccucuucauccgcuccgcccagcgcuccgacuccggccgcuacgagcucaccguccgcgucgaggaccucgaggccaaggccgucaucgacauccucgucaucgagaagcccggcccccccuccuccauccgccuccucgacgucuggggcugcaacgccgcccuccaguggacccccccccaggacaccggcaacaccgagcuccucggcuacaugguccagaaggccgacaagaagaccggccagugguucaccguccucgagcgcuaccaccccaccaccugcaccaucuccgaccucaucaucggcaacuccuacuccuuccgcgucuucuccgagaaccucugcggccucuccaccuccgccaccgucaccaaggagcucgcccacauccagaaggccgacaucgccgccaagcccaagggcuucaucgagcgcgacuucuccgaggcccccuccuucacccagccccucgccgaccacaccuccacccccggcuacuccacccagcucuucugcuccguccgcgccucccccaagcccaagaucaucuggaugaagaacaagauggagauccagggcaaccccaaguaccgcgcccucuccgagcagggcgucugcacccucgagauccgcaagcccucccccuucgacuccggcgucuacaccugcaaggccaucaacguccucggcgaggccuccgucgacugccgccucgaggucaaggccuccgccgcccacuga

SEQ ID NO: 46312 - RNA, 14037 nt, Artificial Sequence
  derived and/or modified sequence opt2 from MYCBP2__Homo_sapiens__NP_055872
augaugaugugcgccgccaccgccucccccgccgccgccuccuccggccucggcggcgacggcuucuaccccgccgccaccuucuccuccucccccgcccccggcgcccucuucaugcccguccccgacggcuccgucgccgccgccggccucggccucggccuccccgccgccgacucccgcggccacuaccagcuccuccucuccggccgcgcccucgccgaccgcuaccgccgcaucuacaccgccgcccucaacgaccgcgaccagggcggcggcuccgccggccaccccgccucccgcaacaagaagauccucaacaagaagaagcucaagcgcaagcagaaguccaaguccaaggucaagacccgcuccaaguccgagaaccucgagaacaccgucaucauccccgacaucaagcuccacuccaaccccuccgccuucaacaucuacugcaacguccgccacugcguccucgaguggcagaagaaggagaucucccucgccgccgccuccaagaacuccguccaguccggcgaguccgacuccgacgaggaggaggaguccaaggagccccccaucaagcuccccaagaucaucgaggucggccucugcgaggucuucgagcucaucaaggagacccgcuucucccaccccucccucugccuccgcucccuccaggcccuccucaacguccuccagggccagcagcccgagggccuccaguccgagccccccgagguccucgagucccucuuccagcuccuccucgagaucaccguccgcuccaccggcaugaacgacuccaccggccagucccucaccgcccucuccugcgccugccucuucucccucgucgccuccuggggcgagaccggccgcacccuccaggccaucuccgccauccucaccaacaacggcucccacgccugccagaccauccagguccccaccauccucaacucccuccagcgcuccguccaggccguccucgucggcaagauccagauccaggacugguucuccaacggcaucaagaaggccgcccucaugcacaaguggccccucaaggagaucuccgucgacgaggacgaccagugccuccuccagaacgacggcuucuuccucuaccuccucugcaaggacggccucuacaagaucggcuccggcuacuccggcaccguccgcggccacaucuacaacuccaccucccgcauccgcaaccgcaaggagaagaaguccuggcucggcuacgcccagggcuaccuccucuaccgcgacgucaacaaccacuccaugaccgccauccgcaucucccccgagacccucgagcaggacggcaccgucaugcuccccgacugccacaccgagggccagaacauccucuucaccgacggcgaguacaucaaccagaucgccgccucccgcgacgacggcuucgucguccgcaucuucgccaccuccaccgagcccguccuccagcaggagcuccagcucaagcucgcccgcaagugccuccacgccugcggcaucucccucuucgaccucgagaaggaccuccacaucaucuccaccggcuucgacgaggaguccgccauccucggcgccggccgcgaguucgcccucaugaagaccgccaacggcaagaucuacuacaccggcaaguaccagucccucggcaucaagcagggcggccccuccgccggcaagugggucgagcuccccaucaccaagucccccaagaucguccacuucuccgucggccacgacggcucccacgcccuccucgucgccgaggacggcuccaucuucuucaccggcuccgccuccaagggcgaggacggcgaguccaccaagucccgccgccaguccaagcccuacaagcccaagaagaucaucaagauggagggcaagaucgucgucuacaccgccugcaacaacggcuccuccuccgucaucuccaaggacggcgagcucuacauguucggcaaggacgccaucuacuccgacuccuccucccucgucaccgaccucaagggccacuucgucacccaggucgccaugggcaaggcccacaccugcguccucaugaagaacggcgaggucuggaccuucggcgucaacaacaagggccagugcggccgcgacaccggcgccaugaaccagggcggcaagggcuucggcgucgagaacauggccaccgccauggacgaggaccucgaggaggagcucgacgagaaggacgagaaguccaugaugugcccccccggcaugcacaaguggaagcucgagcagugcauggucugcaccgucugcggcgacugcaccggcuacggcgccuccugcgucuccuccggccgccccgaccgcguccccggcggcaucugcggcugcggcuccggcgaguccggcugcgccgucugcggcugcugcaaggccugcgcccgcgagcucgacggccaggaggcccgccagcgcggcauccucgacgccgucaaggagaugaucccccucgaccuccuccucgccguccccguccccggcgucaacaucgaggagcaccuccagcuccgccaggaggagaagcgccagcgcgucauccgccgccaccgccucgaggagggccgcggcccccucgucuucgccggccccaucuucaugaaccaccgcgagcaggcccucgcccgccuccgcucccaccccgcccagcucaagcacaagcgcgacaagcacaaggacggcuccggcgagcgcggcgagaaggacgccuccaagaucaccaccuacccccccggcuccguccgcuucgacugcgagcuccgcgccguccaggucuccugcggcuuccaccacuccgucguccucauggagaacggcgacgucuacaccuucggcuacggccagcacggccagcucggccacggcgacgucaacucccgcggcugccccacccucguccaggcccuccccggccccuccacccaggucaccgccggcuccaaccacaccgccguccuccucauggacggccaggucuucaccuucggcuccuucuccaagggccagcucggccgccccauccucgacguccccuacuggaacgccaagcccgcccccaugcccaacaucggcuccaaguacggccgcaaggccaccuggaucggcgccuccggcgaccagaccuuccuccgcaucgacgaggcccucaucaacucccacguccucgccaccuccgagaucuucgccuccaagcacaucaucggccucguccccgccuccaucuccgagcccccccccuucaagugccuccucaucaacaaggucgacggcuccugcaagaccuucaacgacuccgagcaggaggaccuccagggcuucggcgucugccucgaccccgucuacgacgucaucuggcgcuuccgccccaacacccgcgagcucuggugcuacaacgccgucgucgccgacgcccgccuccccuccgccgccgacaugcagucccgcugcuccauccucucccccgagcucgcccuccccaccggcucccgcgcccucaccacccgcucccacgccgcccuccacauccucggcugccucgacacccucgccgccaugcaggaccucaagaugggcgucgccuccaccgaggaggagacccaggccgucaugaaggucuacuccaaggaggacuacuccgucgucaaccgcuucgagucccacggcggcggcuggggcuacuccgcccacuccgucgaggccauccgcuucuccgccgacaccgacauccuccucggcggccucggccucuucggcggccgcggcgaguacaccgccaagaucaagcucuucgagcucggccccgacggcggcgaccacgagaccgacggcgaccuccucgccgagaccgacguccucgccuacgacugcgccgcccgcgagaaguacgccaugauguucgacgagcccguccuccuccaggccggcuggugguacgucgccugggcccgcgucuccggccccuccuccgacugcggcucccacggccaggccuccaucaccaccgacgacggcgucgucuuccaguucaaguccuccaagaaguccaacaacggcaccgacgucaacgccggccagaucccccagcuccucuaccgccuccccaccuccgacggcuccgccuccaagggcaagcagcagaccuccgagcccguccacauccucaagcgcuccuucgcccgcaccgucuccgucgagugcuucgagucccuccucuccauccuccacugguccuggaccacccucguccucggcgucgaggagcuccgcggccucaagggcuuccaguucaccgccacccuccucgaccucgagcgccuccgcuucgucggcaccugcugccuccgccuccuccgcgucuacaccugcgagaucuaccccgucuccgccaccggcaaggccgucgucgaggagaccuccaagcucgccgagugcaucggcaagacccgcacccuccuccgcaagauccucuccgagggcgucgaccacugcauggucaagcucgacaacgacccccagggcuaccucucccagccccucucccuccucgaggccguccuccaggagugccacaacaccuucaccgccugcuuccacuccuucuaccccacccccgcccuccagugggccugccucugcgaccuccucaacugccucgaccaggacauccaggaggccaacuucaagaccuccuccucccgccuccucgccgccgucauguccgcccucugccacaccuccgucaagcucaccuccaucuuccccaucgccuacgacggcgagguccuccuccgcuccaucgucaagcaggucuccaccgagaacgacuccacccucguccaccgcuucccccuccucgucgcccacauggagaagcucucccaguccgaggagaacaucuccggcaugaccuccuuccgcgagguccucgagaagaugcucgucaucgucguccuccccguccgcaacucccuccgccgcgagaacgagcucuucuccucccaccucgucuccaacaccugcggccuccucgccuccaucgucuccgagcucaccgccuccgcccucggcuccgaggucgacggccucaacucccuccacuccgucaaggccuccgccaaccgcuucaccaagaccucccagggccgcuccuggaacaccggcaacggcucccccgacgccaucugcuucuccgucgacaagcccggcaucgucgucgucggcuucuccgucuacggcggcggcggcauccacgaguacgagcucgagguccucgucgacgacuccgagcacgccggcgacuccacccacucccaccgcuggaccucccucgagcucgucaagggcaccuacaccaccgacgacucccccuccgacaucgccgagauccgccucgacaaggucgucccccucaaggagaacgucaaguacgccguccgccuccgcaacuacggcucccgcaccgccaacggcgacggcggcaugaccaccguccagugccccgacggcgucaccuucaccuucuccaccugcucccucuccuccaacggcaccaaccagacccgcggccagaucccccagauccucuacuaccgcuccgaguucgacggcgaccuccagucccagcuccucuccaaggccaacgaggaggacaagaacugcucccgcgcccucuccgucgucuccaccgucguccgcgccuccaaggaccuccuccaccgcgcccucgccgucgacgccgacgacauccccgagcuccucuccuccuccucccucuucuccaugcuccucccccucaucaucgccuacaucggccccgucgccgccgccauccccaaggucgccgucgaggucuucggccucguccagcagcuccuccccuccgucgccauccucaaccagaaguacgccccccccgccuucaaccccaaccaguccaccgacuccaccaccggcaaccagcccgagcagggccucuccgccugcaccaccuccucccacuacgccgucaucgaguccgagcaccccuacaagcccgccugcgucaugcacuacaaggucaccuuccccgagugcguccgcuggaugaccaucgaguucgacccccagugcggcaccgcccaguccgaggacguccuccgccuccucauccccguccgcaccguccagaacuccggcuacggccccaagcucaccuccguccacgagaaccucaacuccuggaucgagcucaagaaguucuccggcuccuccggcuggcccaccaugguccucguccuccccggcaacgaggcccucuucucccucgagaccgccuccgacuacgucaaggacgacaaggccuccuucuacggcuucaagugcuucgccaucggcuacgaguucucccccggccccgacgagggcgucauccagcucgagaaggagcucgccaaccucggcggcgucugcgccgccgcccucaugaagaaggaccucgcccuccccaucggcaacgagcucgaggaggaccucgagauccucgaggaggccgcccuccaggucugcaagacccacuccggcauccucggcaagggccucgcccucucccacucccccaccauccucgaggcccucgagggcaaccucccccuccagauccaguccaacgagcaguccuuccucgacgacuucaucgccugcguccccggcuccuccggcggccgccucgcccgcuggcuccagcccgacuccuacgccgacccccagaagaccucccucauccucaacaaggacgacauccgcugcggcuggcccaccaccaucaccguccagaccaaggaccaguacggcgacgucguccacguccccaacaugaaggucgaggucaaggccguccccgucucccagaagaagaugucccuccagcaggaccaggccaagaagccccagcgcauccccggcucccccgccgucaccgccgccuccuccaacaccgacaugaccuacggcggccucgccucccccaagcucgacgucuccuacgagcccaugaucgucaaggaggcccgcuacaucgccaucaccaugaugaaggucuacgagaacuacuccuucgaggagcuccgcuucgccucccccacccccaagcgccccuccgagaacaugcucauccgcgucaacaacgacggcaccuacugcgccaacuggacccccggcgccaucggccucuacacccuccacgucaccaucgacggcaucgagaucgacgccggccucgaggucaaggucaaggacccccccaagggcaugaucccccccggcacccagcucgucaagcccaaguccgagccccagcccaacaagguccgcaaguucgucgccaaggacuccgccggccuccgcauccgcucccaccccucccuccaguccgagcagaucggcaucgucaaggucaacggcaccaucaccuucaucgacgagauccacaacgacgacggcgucuggcuccgccucaacgacgagaccaucaagaaguacguccccaacaugaacggcuacaccgaggccuggugccucuccuucaaccagcaccucggcaagucccuccucguccccgucgacgaguccaagaccaacaccgacgacuucuucaaggacaucaacuccugcugcccccaggaggccaccaugcaggagcaggacaugcccuuccuccgcggcggccccggcauguacaaggucgucaagaccggccccuccggccacaacauccgcuccugccccaaccuccgcggcauccccaucggcaugcucguccucggcaacaaggucaaggccgucggcgaggucaccaacuccgagggcaccuggguccagcucgaccagaacuccauggucgaguucugcgaguccgacgagggcgaggccuggucccucgcccgcgaccgcggcggcaaccaguaccuccgccacgaggacgagcaggcccuccucgaccagaacucccagacccccccccccucccccuucuccguccaggccuucaacaagggcgccuccugcuccgcccagggcuucgacuacggccucggcaacuccaagggcgaccgcggcaacaucuccaccuccuccaagcccgccuccaccuccggcaaguccgagcucuccuccaagcacucccgcucccucaagcccgacggccgcaugucccgcaccaccgccgaccagaagaagccccgcggcaccgagucccucuccgccuccgagucccucauccucaaguccgacgccgccaagcuccgcuccgacucccacucccgcucccucucccccaaccacaacacccuccagacccucaaguccgacggccgcaugcccuccuccucccgcgccgagucccccggccccggcucccgccucuccucccccaagcccaagacccuccccgccaaccgcuccucccccuccggcgccuccuccccccgcuccuccuccccccacgacaagaaccucccccagaaguccaccgcccccgucaagaccaagcucgaccccccccgcgagcgcuccaaguccgacuccuacacccucgaccccgacacccuccgcaagaagaagaugccccucaccgagccccuccgcggccgcuccaccucccccaagcccaaguccguccccaaggacuccaccgacucccccggcuccgagaaccgcgcccccuccccccacgucguccaggagaaccuccacuccgaggucgucgaggucugcaccuccuccacccucaagaccaacucccucaccgacuccaccugcgacgacuccuccgaguucaaguccgucgacgagggcuccaacaagguccacuucuccaucggcaaggccccccucaaggacgagcaggagaugcgcgccucccccaagaucucccgcaagugcgccaaccgccacacccgccccaagaaggagaaguccuccuuccucuucaagggcgacggcuccaagccccucgagcccgccaagcaggccaugucccccuccgucgccgagugcgcccgcgccgucuucgccuccuuccucuggcacgagggcaucguccacgacgccauggccugcuccuccuuccucaaguuccaccccgagcucuccaaggagcacgcccccauccgcuccucccucaacucccagcagcccaccgaggagaaggagaccaagcucaagaaccgccacucccucgagaucuccuccgcccucaacauguucaacaucgccccccacggccccgacaucuccaagaugggcuccaucaacaagaacaagguccucuccaugcucaaggagcccccccuccacgagaagugcgaggacggcaagaccgagaccaccuucgagauguccaugcacaacaccaugaaguccaaguccccccucccccucacccuccagcaccucgucgccuucugggaggacaucucccucgccaccaucaaggccgccucccagaacaugaucuuccccucccccggcuccugcgccguccucaagaagaaggagugcgagaaggagaacaagaaguccaagaaggagaagaagaagaaggagaaggccgagguccgcccccgcggcaaccucuucggcgagauggcccagcucgccgucggcggccccgagaaggacaccaucugcgagcucugcggcgagucccaccccuaccccgucaccuaccacaugcgccaggcccaccccggcugcggccgcuacgccggcggccagggcuacaacuccaucggccacuucugcggcggcugggccggcaacugcggcgacggcggcaucggcggcuccaccugguaccucgucugcgaccgcugccgcgagaaguaccuccgcgagaagcaggccgccgcccgcgagaaggucaagcagucccgccgcaagcccaugcaggucaagaccccccgcgcccuccccaccauggaggcccaccaggucaucaaggccaacgcccucuuccuccucucccucuccuccgccgccgagcccuccauccucugcuaccaccccgccaagcccuuccagucccagcuccccuccgucaaggagggcaucuccgaggaccuccccgucaagaugcccugccucuaccuccagacccucgcccgccaccaccacgagaacuucgucggcuaccaggacgacaaccucuuccaggacgagaugcgcuaccuccgcuccaccuccguccccgcccccuacaucuccgucacccccgacgccucccccaacgucuucgaggagcccgaguccaacaugaaguccaugccccccucccucgagaccucccccaucaccgacaccgaccucgccaagcgcaccgucuuccagcgcuccuacuccgucgucgccuccgaguacgacaagcagcacuccauccuccccgcccgcgucaaggccaucccccgccgccgcgucaacuccggcgacaccgaggucggcuccucccuccuccgccaccccucccccgagcucucccgccucaucuccgcccacuccucccucuccaagggcgagcgcaacuuccaguggcccguccucgccuucgucauccagcaccacgaccucgagggccucgagaucgccaugaagcaggcccuccgcaaguccgccugccgcgucuucgccauggaggccuucaacuggcuccucugcaacgucauccagaccaccucccuccacgacauccucuggcacuucgucgccucccucacccccgcccccgucgagcccgaggaggaggaggacgaggagaacaagaccuccaaggagaacuccgagcaggagaaggacacccgcgucugcgagcacccccucuccgacaucgucaucgccggcgaggccgcccacccccucccccacaccuuccaccgccuccuccagaccaucuccgaccucaugaugucccuccccuccggcuccucccuccagcagauggcccuccgcugcuggucccucaaguucaagcaguccgaccaccaguuccuccaccaguccaacgucuuccaccacaucaacaacauccucuccaaguccgacgacggcgacuccgaggaguccuucuccaucuccauccaguccggcuucgaggccaugucccaggagcucugcaucgucaugugccucaaggaccucaccuccaucgucgacaucaagaccuccucccgccccgccaugaucggcucccucaccgacggcuccaccgagaccuucugggaguccggcgacgaggacaagaacaagaccaagaacaucaccaucaacugcgucaagggcaucaacgcccgcuacgucuccguccacgucgacaacucccgcgaccucggcaacaaggucaccuccaugaccuuccucaccggcaaggccgucgaggaccucugccgcaucaagcaggucgaccucgacucccgccacaucggcugggucaccuccgagcuccccggcggcgacaaccacaucaucaagaucgagcucaagggccccgagaacacccuccgcguccgccaggucaagguccucggcuggaaggacggcgaguccaccaagaucgccggccagaucuccgccuccgucgcccagcagcgcaacugcgaggccgagacccuccgcgucuuccgccucaucaccucccaggucuucggcaagcucaucuccggcgacgccgagcccacccccgagcaggaggagaaggcccuccucuccucccccgagggcgaggagaaggucuacaacgccaccuccgacgccgaccucaaggagcacauggucggcaucaucuucucccgcuccaagcucaccaaccuccagaagcaggucugcgcccacaucguccaggccauccgcauggaggccacccgcguccgcgaggagugggagcacgccaucuccuccaaggagaacgccaacucccagcccaacgacgaggacgccuccuccgacgccuacugcuucgagcuccucuccaugguccucgcccucuccggcuccaacgucggccgccaguaccucgcccagcagcucacccuccuccaggaccucuucucccuccuccacaccgccuccccccgcguccagcgccaggucaccucccuccuccgccgcguccuccccgaggucacccccucccgccucgccuccaucaucggcgucaagucccucccccccgccgacaucuccgacaucauccacuccaccgagaagggcgacuggaacaagcucggcauccucgacauguuccucggcugcaucgccaaggcccucaccguccagcucaaggccaagggcaccaccaucaccggcaccgccggcaccaccgucggcaagggcgucaccaccgucacccuccccaugaucuucaacuccuccuaccuccgccgcggcgagucccacugguggaugaagggcuccacccccacccagaucuccgagaucaucaucaagcucaucaaggacauggccgccggccaccucuccgaggccuggucccgcgucaccaagaacgccaucgccgagaccaucaucgcccucaccaagauggaggaggaguuccgcucccccguccgcugcaucgccaccacccgccucuggcucgcccucgccucccucugcguccucgaccaggaccacgucgaccgccucuccuccggccgcuggaugggcaaggacggccagcagaagcagaugcccaugugcgacaaccacgacgacggcgagaccgccgccaucauccucugcaacgucugcggcaaccucugcaccgacugcgaccgcuuccuccaccuccaccgccgcaccaagacccaccagcgccaggucuucaaggaggaggaggaggccaucaaggucgaccuccacgagggcugcggccgcaccaagcucuucuggcucauggcccucgccgacuccaagaccaugaaggccauggucgaguuccgcgagcacaccggcaagcccaccaccuccuccuccgaggccugccgcuucugcggcucccgcuccggcaccgagcucuccgccgucggcuccgucugcuccgacgccgacugccaggaguacgccaagaucgccugcuccaagacccaccccugcggccaccccugcggcggcgucaagaacgaggagcacugccuccccugccuccacggcugcgacaaguccgccaccucccucaagcaggacgccgacgacaugugcaugaucugcuucaccgaggcccucuccgccgcccccgccauccagcucgacugcucccacaucuuccaccuccagugcugccgccgcguccucgagaaccgcuggcucggcccccgcaucaccuucggcuucaucuccugccccaucugcaagaacaagaucaaccacaucguccucaaggaccuccucgaccccaucaaggagcucuacgaggacguccgccgcaaggcccucaugcgccucgaguacgagggccuccacaaguccgaggccaucaccacccccggcguccgcuucuacaacgaccccgccggcuacgccaugaaccgcuacgccuacuacgucugcuacaagugccgcaaggccuacuucggcggcgaggcccgcugcgacgccgaggccggccgcggcgacgacuacgacccccgcgagcucaucugcggcgccugcuccgacgucucccgcgcccagaugugccccaagcacggcaccgacuuccucgaguacaagugccgcuacugcugcuccgucgccgucuucuucugcuucggcaccacccacuucugcaacgccugccacgacgacuuccagcgcaugaccuccauccccaaggaggagcucccccacugccccgccggccccaagggcaagcagcucgagggcaccgagugcccccuccacgucguccacccccccaccggcgaggaguucgcccucggcugcggcgucugccgcaacgcccacaccuucuga

SEQ ID NO: 46313 - RNA, 2955 nt, Artificial Sequence
  derived and/or modified sequence opt2 from MYCBPAP__Homo_sapiens__NP_115509
augcgcgcccccgcccgcggcaccggcugcugcggccgcuccggcggccgcuggcucgccggcgccgcccagccccgcugccucugggccggcggcgccggccagcgcuucaugguccccggcggcaccaugaagucccucaagaaggacucccgccuccgcaucacccccacccgccuccucgaggccuccgagaacgucaaggagaagaagcgcgccaagggccccgagcagcccacccccaccauccaggaggagcccgagcccgucuccaacguccuccagggcgacgacauccucgcccucgccaucaagaaggaggaccucaaggagcagcacaucccccgccucaccgagaaggaggacaagcgcgucaucacccagaaguucaucauccgcaagcucaagcccauggacccccgccgcaaggucugccaccucgucgcccgccccgccaaccccgacgaggccaccaagccccucgacuacuccggccccggcgacuccuucgacggcuccgaccagauccucccccaccacauccucggcucccuccaggacuucaagcgcaucgcccucgcccgcggcaacacccagcucgccgagcgcauccccaccucccccugccucaugacccucaucuccgccgagggcgaguccaagcagaaggcccccaaggaggagaagcgcccccccugggccccccccccccagcacaacuuccucaagaacuggcagcgcaacaccgcccuccgcaagaagcagcaggaggcccucuccgagcaccucaagaagcccgucuccgagcuccucaugcacaccggcgagaccuaccgccgcauccaggaggagcgcgagcucaucgacugcacccuccccacccgccgcgaccgcaaguccugggagaacuccggcuucuggucccgccucgaguaccucggcgacgagaugaccggccucgucaugaccaagaccaagacccagcgcggccucauggagcccaucacccacauccgcaagccccacuccauccgcgucgagaccggccuccccgcccagcgcgacgccuccuaccgcuacaccugggaccgcucccucuuccucaucuaccgccgcaaggagcuccagcgcaucauggaggagcucgacuucucccagcaggacaucgacggccucgaggucgucggcaagggcuggcccuucuccgccgucaccgucgaggacuacaccgucuucgagcgcucccagggcuccuccuccgaggacaccgccuaccucggcacccucgccuccuccuccgacgucuccaugcccauccucggccccucccuccucuucugcggcaagcccgccugcuggauccgcggcuccaacccccaggacaagcgccaggucggcaucgccgcccaccucaccuucgagacccucgagggcgagaagaccuccuccgagcucaccgucgucaacaacggcaccgucgccaucugguacgacuggcgccgccagcaccagcccgacaccuuccaggaccucaagaagaaccgcaugcagcgcuucuacuucgacaaccgcgagggcgucauccuccccggcgagaucaagaccuucaccuucuucuucaagucccucaccgccggcgucuuccgcgaguucugggaguuccgcacccaccccacccuccucggcggcgccauccuccaggucaaccuccacgccgucucccucacccaggacgucuucgaggacgagcgcaagguccucgaguccaagcucaccgcccacgaggccgucaccgucguccgcgagguccuccaggagcuccucaugggcguccucacccccgagcgcacccccucccccgucgacgccuaccucaccgaggaggaccucuuccgccaccgcaaccccccccuccacuacgagcaccaggucguccagucccuccaccagcucuggcgccaguacaugacccuccccgccaaggccgaggaggcccgccccggcgacaaggagcacgucucccccaucgccaccgagaaggccuccgucaacgccgagcuccucccccgcuuccgcucccccaucuccgagacccaggucccccgccccgagaacgaggcccuccgcgaguccggcucccagaaggcccgcgucggcaccaaguccccccagcgcaaguccaucauggaggagauccucgucgaggagucccccgacgucgacuccaccaagucccccugggagcccgacggccucccccuccucgaguggaaccucugccucgaggacuuccgcaaggccgucaugguccuccccgacgagaaccaccgcgaggacgcccucaugcgccucaacaaggccgcccucgagcucugccagaagccccgcccccuccaguccaaccuccuccaccagaugugccuccagcucuggcgcgacgucaucgacucccucgucggccacuccauguggcuccgcuccguccucggccuccccgagaaggagaccaucuaccucaacguccccgaggagcaggaccagaaguccccccccaucauggaggucaagguccccgucggcaaggccggcaaggaggagcgcaagggcgccgcccaggagaagaagcagcucggcaucaaggacaaggaggacaagaagggcgccaagcuccucggcaaggaggaccgccccaacuccaagaagcacaaggccaaggacgacaagaaggucaucaaguccgccucccaggaccgcuucucccucgaggaccccacccccgacaucauccucuccucccaggagcccaucgacccccucgucaugggcaaguacacccagucccuccacuccgagguccgcggccuccucgacacccucgucaccgaccucaugguccucgccgacgagcucucccccaucaagaacgucgaggaggcccuccgccucugccgcuga

SEQ ID NO: 46314 - RNA, 1365 nt, Artificial Sequence
  derived and/or modified sequence opt2 from MYC__Homo_sapiens__NP_002458
auggacuucuuccgcgucgucgagaaccagcagccccccgccaccaugccccucaacgucuccuucaccaaccgcaacuacgaccucgacuacgacuccguccagcccuacuucuacugcgacgaggaggagaacuucuaccagcagcagcagcaguccgagcuccagccccccgcccccuccgaggacaucuggaagaaguucgagcuccuccccacccccccccucucccccucccgccgcuccggccucugcucccccuccuacgucgccgucacccccuucucccuccgcggcgacaacgacggcggcggcggcuccuucuccaccgccgaccagcucgagauggucaccgagcuccucggcggcgacauggucaaccaguccuucaucugcgaccccgacgacgagaccuucaucaagaacaucaucauccaggacugcaugugguccggcuucuccgccgccgccaagcucgucuccgagaagcucgccuccuaccaggccgcccgcaaggacuccggcucccccaaccccgcccgcggccacuccgucugcuccaccuccucccucuaccuccaggaccucuccgccgccgccuccgagugcaucgaccccuccgucgucuuccccuacccccucaacgacuccuccucccccaaguccugcgccucccaggacuccuccgccuucucccccuccuccgacucccuccucuccuccaccgaguccuccccccagggcucccccgagccccucguccuccacgaggagaccccccccaccaccuccuccgacuccgaggaggagcaggaggacgaggaggagaucgacgucgucuccgucgagaagcgccaggcccccggcaagcgcuccgaguccggcucccccuccgccggcggccacuccaagcccccccacuccccccucguccucaagcgcugccacgucuccacccaccagcacaacuacgccgccccccccuccacccgcaaggacuaccccgccgccaagcgcgucaagcucgacuccguccgcguccuccgccagaucuccaacaaccgcaagugcaccuccccccgcuccuccgacaccgaggagaacgucaagcgccgcacccacaacguccucgagcgccagcgccgcaacgagcucaagcgcuccuucuucgcccuccgcgaccagauccccgagcucgagaacaacgagaaggcccccaaggucgucauccucaagaaggccaccgccuacauccucuccguccaggccgaggagcagaagcucaucuccgaggaggaccuccuccgcaagcgccgcgagcagcucaagcacaagcucgagcagcuccgcaacuccugcgccuga

SEQ ID NO: 46315 - RNA, 1395 nt, Artificial Sequence
  derived and/or modified sequence opt2 from MYCN__Homo_sapiens__NP_005369
augcccuccugcuccaccuccaccaugcccggcaugaucugcaagaaccccgaccucgaguucgacucccuccagcccugcuucuaccccgacgaggacgacuucuacuucggcggccccgacuccaccccccccggcgaggacaucuggaagaaguucgagcuccuccccacccccccccucucccccucccgcggcuucgccgagcacuccuccgagccccccuccugggucaccgagaugcuccucgagaacgagcucuggggcucccccgccgaggaggacgccuucggccucggcggccucggcggccucacccccaaccccgucauccuccaggacugcaugugguccggcuucuccgcccgcgagaagcucgagcgcgccgucuccgagaagcuccagcacggccgcggcccccccaccgccggcuccaccgcccagucccccggcgccggcgccgccucccccgccggccgcggccacggcggcgccgccggcgccggccgcgccggcgccgcccuccccgccgagcucgcccaccccgccgccgagugcgucgaccccgccgucgucuuccccuuccccgucaacaagcgcgagcccgcccccguccccgccgcccccgccuccgcccccgccgccggccccgccgucgccuccggcgccggcaucgccgcccccgccggcgcccccggcgucgcccccccccgccccggcggccgccagaccuccggcggcgaccacaaggcccucuccaccuccggcgaggacacccucuccgacuccgacgacgaggacgacgaggaggaggacgaggaggaggagaucgacgucgucaccgucgagaagcgccgcuccuccuccaacaccaaggccgucaccaccuucaccaucaccguccgccccaagaacgccgcccucggccccggccgcgcccaguccuccgagcucauccucaagcgcugccuccccauccaccagcagcacaacuacgccgcccccucccccuacgucgaguccgaggacgcccccccccagaagaagaucaaguccgaggccuccccccgcccccucaaguccgucaucccccccaaggccaagucccucuccccccgcaacuccgacuccgaggacuccgagcgccgccgcaaccacaacauccucgagcgccagcgccgcaacgaccuccgcuccuccuuccucacccuccgcgaccacguccccgagcucgucaagaacgagaaggccgccaaggucgucauccucaagaaggccaccgaguacguccacucccuccaggccgaggagcaccagcuccuccucgagaaggagaagcuccaggcccgccagcagcagcuccucaagaagaucgagcacgcccgcaccugcuga

SEQ ID NO: 46316 - RNA, 708 nt, Artificial Sequence
  derived and/or modified sequence opt2 from MYCT1__Homo_sapiens__NP_079383
augcgcacccaggucuacgagggccucugcaagaacuacuucucccucgccguccuccagcgcgaccgcaucaagcuccucuucuucgacauccucgucuuccucuccgucuuccuccucuuccuccucuuccucgucgacaucauggccaacaacaccaccucccucggcucccccuggcccgagaacuucugggaggaccucaucauguccuucaccgucuccauggccaucggccucguccucggcggcuucaucugggccgucuucaucugccucucccgccgccgccgcgccuccgcccccaucucccagugguccuccucccgccgcucccgcuccuccuacacccacggccucaaccgcaccggcuucuaccgccacuccggcugcgagcgccgcuccaaccucucccucgccucccucaccuuccagcgccaggccucccucgagcaggccaacuccuucccccgcaaguccuccuuccgcgccuccaccuuccaccccuuccuccagugccccccccuccccgucgagaccgagucccagcucgucacccuccccuccuccaacaucucccccaccaucuccaccucccacucccucucccgccccgacuacugguccuccaacucccuccgcgucggccucuccaccccccccccccccgccuacgaguccaucaucaaggccuuccccgacuccuga

SEQ ID NO: 46317 - RNA, 480 nt, Artificial Sequence
  derived and/or modified sequence opt2 from MYD88__Homo_sapiens__NP_001166037
augcgccccgaccgcgccgaggcccccggcccccccgccauggccgccggcggccccggcgccggcuccgccgcccccgucuccuccaccuccucccucccccucgccgcccucaacaugcgcguccgccgccgccucucccucuuccucaacguccgcacccaggucgccgccgacuggaccgcccucgccgaggagauggacuucgaguaccucgagauccgccagcucgagacccaggccgaccccaccggccgccuccucgacgccuggcagggccgccccggcgccuccgucggccgccuccucgagcuccucaccaagcucggccgcgacgacguccuccucgagcucggccccuccaucggcgccgccggcuggugguggcucucccucaugaucaccugccgcgcccgcaacgucaccucccgccccaaccuccacuccgccucccuccagguccccauccgcuccgacuga

SEQ ID NO: 46318 - RNA, 522 nt, Artificial Sequence
  derived and/or modified sequence opt2 from MYDGF__Homo_sapiens__NP_061980
auggccgcccccuccggcggcuggaacggcgucggcgccucccucugggccgcccuccuccucggcgccgucgcccuccgccccgccgaggccgucuccgagcccaccaccgucgccuucgacguccgccccggcggcgucguccacuccuucucccacaacgucggccccggcgacaaguacaccugcauguucaccuacgccucccagggcggcaccaacgagcaguggcagaugucccucggcaccuccgaggaccaccagcacuucaccugcaccaucuggcgcccccagggcaaguccuaccucuacuucacccaguucaaggccgagguccgcggcgccgagaucgaguacgccauggccuacuccaaggccgccuucgagcgcgaguccgacgucccccucaagaccgaggaguucgaggucaccaagaccgccgucgcccaccgccccggcgccuucaaggccgagcucuccaagcucgucaucgucgccaaggccucccgcaccgagcucuga

SEQ ID NO: 46319 - RNA, 1731 nt, Artificial Sequence
  derived and/or modified sequence opt2 from MYEF2__Homo_sapiens__NP_001288139
auggccgacgccaacaaggccgagguccccggcgccaccggcggcgacuccccccaccuccagcccgccgagccccccggcgagccccgccgcgagccccaccccgccgaggccgagaagcagcagccccagcacuccuccuccuccaacggcgucaagauggagaacgacgaguccgccaaggaggagaaguccgaccucaaggagaaguccaccggcuccaagaaggccaaccgcuuccaccccuacuccaaggacaagaacuccggcaccggcgagaagaagggccccaaccgcaaccgcgucuucaucuccaacauccccuacgacaugaaguggcaggccaucaaggaccucaugcgcgagaaggucggcgaggucaccuacgucgagcucuucaaggacgccgagggcaagucccgcggcugcggcgucgucgaguucaaggacgaggaguucgucaagaaggcccucgagaccaugaacaaguacgaccucuccggccgcccccucaacaucaaggaggaccccgacggcgagaacgcccgccgcgcccuccagcgcaccggcggcuccuuccccggcggccacguccccgacaugggcuccggccucaugaaccucccccccuccauccucaacaaccccaacaucccccccgaggucaucuccaaccuccaggccggccgccucggcuccaccaucuucgucgccaaccucgacuucaaggucggcuggaagaagcucaaggaggucuucuccaucgccggcaccgucaagcgcgccgacaucaaggaggacaaggacggcaagucccgcggcaugggcaccgucaccuucgagcaggccaucgaggccguccaggccaucuccauguucaacggccaguuccucuucgaccgccccaugcacgucaagauggacgacaaguccgucccccacgaggaguaccgcucccacgacggcaagaccccccagcucccccgcggccucggcggcaucggcaugggccucggccccggcggccagcccaucuccgccucccagcucaacaucggcggcgucaugggcaaccucggccccggcggcaugggcauggacggccccggcuucggcggcaugaaccgcaucggcggcggcaucggcuucggcggccucgaggccaugaacuccaugggcggcuucggcggcgucggccgcaugggcgagcucuaccgcggcgccaugaccuccuccauggagcgcgacuucggccgcggcgacaucggcaucaaccgcggcuucggcgacuccuucggccgccucggcggcggcaugggcuccaugaacuccgucaccggcggcaugggcaugggccucgaccgcauguccuccuccuucgaccgcaugggccccggcaucggcgccauccucgagcgcuccaucgacauggaccgcggcuuccucuccggccccaugggcuccggcaugcgcgagcgcaucggcuccaagggcaaccagaucuucguccgcaaccuccccuucgaccucaccuggcagaagcucaaggagaaguucucccagugcggccacgucauguucgccgagaucaagauggagaacggcaaguccaagggcugcggcaccguccgcuucgacucccccgaguccgccgagaaggccugccgcaucaugaacggcaucaagaucuccggccgcgagaucgacguccgccucgaccgcaacgccuga

SEQ ID NO: 46320 - RNA, 942 nt, Artificial Sequence
  derived and/or modified sequence opt2 from MYEOV__Homo_sapiens__NP_001280220
auggcccuccgcaucugcgucaccuacacccccgcccuccccaucggccucugcacccgcugcugccucugccucgagcagucccccuccuggugccacugccuccgcggcgucuccuuccucaccuuccaccuccaccaguccgucccccucggcgaccgcgacucccuccucauguucacccgccaggccggccacuucgucgagggcuccaaggccggccgcucccgcggccgccucugccucucccaggcccuccgcgucgccguccgcggcgccuucgucucccucugguucgccgccggcgccggcgaccgcgagcgcaacaagggcgacaagggcgcccagaccggcgccggccucucccaggaggccgaggacgucgacgucucccgcgcccgccgcgucaccgacgccccccagggcacccucugcggcaccggcaaccgcaacuccggcucccaguccgcccgcgucgucggcgucgcccaccucggcgaggccuuccgcgucggcgucgagcaggccaucuccuccugccccgaggagguccacggccgccacggccucuccauggagaucaugugggcccgcauggacgucgcccuccgcucccccggccgcggccuccucgccggcgccggcgcccucugcaugacccucgccgaguccuccugccccgacuacgagcgcggccgccgcgccugccucacccuccaccgccaccccaccccccacugcuccaccuggggccucccccuccgcgucgccggcuccuggcucaccgucgucaccgucgaggcccucggcggcuggcgcaugggcguccgccgcaccggccaggucggccccaccaugcaccccccccccgucuccggcgccuccccccuccuccuccaccaccuccuccuccuccuccucaucaucauccucaccugcuga

SEQ ID NO: 46321 - RNA, 768 nt, Artificial Sequence
  derived and/or modified sequence opt2 from MYF5__Homo_sapiens__NP_005584
auggacgucauggacggcugccaguucucccccuccgaguacuucuacgacggcuccugcauccccucccccgagggcgaguucggcgacgaguucgucccccgcgucgccgccuucggcgcccacaaggccgagcuccagggcuccgacgaggacgagcacguccgcgcccccaccggccaccaccaggccggccacugccucaugugggccugcaaggccugcaagcgcaaguccaccaccauggaccgccgcaaggccgccaccaugcgcgagcgccgccgccucaagaaggucaaccaggccuucgagacccucaagcgcugcaccaccaccaaccccaaccagcgccuccccaaggucgagauccuccgcaacgccauccgcuacaucgagucccuccaggagcuccuccgcgagcaggucgagaacuacuacucccuccccggccaguccugcuccgagcccaccucccccaccuccaacugcuccgacggcaugcccgagugcaacucccccgucuggucccgcaaguccuccaccuucgacuccaucuacugccccgacgucuccaacgucuacgccaccgacaagaacucccucuccucccucgacugccucuccaacaucgucgaccgcaucaccuccuccgagcagcccggccucccccuccaggaccucgccucccucucccccgucgccuccaccgacucccagcccgccacccccggcgccuccuccucccgccucaucuaccacguccucuga

SEQ ID NO: 46322 - RNA, 729 nt, Artificial Sequence
  derived and/or modified sequence opt2 from MYF6__Homo_sapiens__NP_002460
augaugauggaccucuucgagaccggcuccuacuucuucuaccucgacggcgagaacgucacccuccagccccucgaggucgccgagggcuccccccucuaccccggcuccgacggcacccucucccccugccaggaccagaugccccccgaggccggcuccgacuccuccggcgaggagcacguccucgccccccccggccuccagcccccccacugccccggccagugccucaucugggccugcaagaccugcaagcgcaaguccgcccccaccgaccgccgcaaggccgccacccuccgcgagcgccgccgccucaagaagaucaacgaggccuucgaggcccucaagcgccgcaccgucgccaaccccaaccagcgccuccccaaggucgagauccuccgcuccgccaucuccuacaucgagcgccuccaggaccuccuccaccgccucgaccagcaggagaagaugcaggagcucggcgucgaccccuucuccuaccgccccaagcaggagaaccucgagggcgccgacuuccuccgcaccugcuccucccaguggcccuccgucuccgaccacucccgcggccucgucaucaccgccaaggagggcggcgccuccaucgacuccuccgccuccuccucccuccgcugccucuccuccaucgucgacuccaucuccuccgaggagcgcaagcuccccugcgucgaggaggucgucgagaaguga

SEQ ID NO: 46323 - RNA, 6024 nt, Artificial Sequence
  derived and/or modified sequence opt2 from MYH10__Homo_sapiens__NP_001242941
auggcccagcgcaccggccucgaggaccccgagcgcuaccucuucgucgaccgcgccgucaucuacaaccccgccacccaggccgacuggaccgccaagaagcucgucuggauccccuccgagcgccacggcuucgaggccgccuccaucaaggaggagcgcggcgacgaggucauggucgagcucgccgagaacggcaagaaggccauggucaacaaggacgacauccagaagaugaacccccccaaguucuccaaggucgaggacauggccgagcucaccugccucaacgaggccuccguccuccacaaccucaaggaccgcuacuacuccggccucaucuacaccuacuccggccucuucugcgucgucaucaaccccuacaagaaccuccccaucuacuccgagaacaucaucgagauguaccgcggcaagaagcgccacgagaugcccccccacaucuacgccaucuccgaguccgccuaccgcugcaugcuccaggaccgcgaggaccaguccauccucugcaccggcgaguccggcgccggcaagaccgagaacaccaagaaggucauccaguaccucgcccacgucgccuccucccacaagggccgcaaggaccacaacaucccccaggagucccccaagcccgucaagcaccagggcgagcucgagcgccagcuccuccaggccaaccccauccucgaguccuucggcaacgccaagaccgucaagaacgacaacuccucccgcuucggcaaguucauccgcaucaacuucgacgucaccggcuacaucgucggcgccaacaucgagaccuaccuccucgagaagucccgcgccguccgccaggccaaggacgagcgcaccuuccacaucuucuaccagcuccucuccggcgccggcgagcaccucaaguccgaccuccuccucgagggcuucaacaacuaccgcuuccucuccaacggcuacauccccauccccggccagcaggacaaggacaacuuccaggagaccauggaggccaugcacaucaugggcuucucccacgaggagauccucuccaugcucaaggucgucuccuccguccuccaguucggcaacaucuccuucaagaaggagcgcaacaccgaccaggccuccaugcccgagaacaccgucgcccagaagcucugccaccuccucggcaugaacgucauggaguucacccgcgccauccucaccccccgcaucaaggucggccgcgacuacguccagaaggcccagaccaaggagcaggccgacuucgccgucgaggcccucgccaaggccaccuacgagcgccucuuccgcuggcucguccaccgcaucaacaaggcccucgaccgcaccaagcgccagggcgccuccuucaucggcauccucgacaucgccggcuucgagaucuucgagcucaacuccuucgagcagcucugcaucaacuacaccaacgagaagcuccagcagcucuucaaccacaccauguucauccucgagcaggaggaguaccagcgcgagggcaucgaguggaacuucaucgacuucggccucgaccuccagcccugcaucgaccucaucgagcgccccgccaacccccccggcguccucgcccuccucgacgaggagugcugguuccccaaggccaccgacaagaccuucgucgagaagcucguccaggagcagggcucccacuccaaguuccagaagccccgccagcucaaggacaaggccgacuucugcaucauccacuacgccggcaaggucgacuacaaggccgacgaguggcucaugaagaacauggacccccucaacgacaacgucgccacccuccuccaccaguccuccgaccgcuucgucgccgagcucuggaaggacgagauccagaacauccagcgcgccuccuucuacgacuccgucuccggccuccacgagccccccgucgaccgcaucgucggccucgaccaggucaccggcaugaccgagaccgccuucggcuccgccuacaagaccaagaagggcauguuccgcaccgucggccagcucuacaaggagucccucaccaagcucauggccacccuccgcaacaccaaccccaacuucguccgcugcaucauccccaaccacgagaagcgcgccggcaagcucgacccccaccucguccucgaccagcuccgcugcaacggcguccucgagggcauccgcaucugccgccagggcuuccccaaccgcaucgucuuccaggaguuccgccagcgcuacgagauccucacccccaacgccauccccaagggcuucauggacggcaagcaggccugcgagcgcaugauccgcgcccucgagcucgaccccaaccucuaccgcaucggccaguccaagaucuucuuccgcgccggcguccucgcccaccucgaggaggagcgcgaccucaagaucaccgacaucaucaucuucuuccaggccgucugccgcggcuaccucgcccgcaaggccuucgccaagaagcagcagcagcucuccgcccucaagguccuccagcgcaacugcgccgccuaccucaagcuccgccacuggcagugguggcgcgucuucaccaaggucaagccccuccuccaggucacccgccaggaggaggagcuccaggccaaggacgaggagcuccucaaggucaaggagaagcagaccaaggucgagggcgagcucgaggagauggagcgcaagcaccagcagcuccucgaggagaagaacauccucgccgagcagcuccaggccgagaccgagcucuucgccgaggccgaggagaugcgcgcccgccucgccgccaagaagcaggagcucgaggagauccuccacgaccucgagucccgcgucgaggaggaggaggagcgcaaccagauccuccagaacgagaagaagaagaugcaggcccacauccaggaccucgaggagcagcucgacgaggaggagggcgcccgccagaagcuccagcucgagaaggucaccgccgaggccaagaucaagaagauggaggaggagauccuccuccucgaggaccagaacuccaaguucaucaaggagaagaagcucauggaggaccgcaucgccgagugcuccucccagcucgccgaggaggaggagaaggccaagaaccucgccaagauccgcaacaagcaggaggucaugaucuccgaccucgaggagcgccucaagaaggaggagaagacccgccaggagcucgagaaggccaagcgcaagcucgacggcgagaccaccgaccuccaggaccagaucgccgagcuccaggcccagaucgacgagcucaagcuccagcucgccaagaaggaggaggagcuccagggcgcccucgcccgcggcgacgacgagacccuccacaagaacaacgcccucaaggucguccgcgagcuccaggcccagaucgccgagcuccaggaggacuucgaguccgagaaggccucccgcaacaaggccgagaagcagaagcgcgaccucuccgaggagcucgaggcccucaagaccgagcucgaggacacccucgacaccaccgccgcccagcaggagcuccgcaccaagcgcgagcaggaggucgccgagcucaagaaggcccucgaggaggagaccaagaaccacgaggcccagauccaggacaugcgccagcgccacgccaccgcccucgaggagcucuccgagcagcucgagcaggccaagcgcuucaaggccaaccucgagaagaacaagcagggccucgagaccgacaacaaggagcucgccugcgaggucaagguccuccagcaggucaaggccgaguccgagcacaagcgcaagaagcucgacgcccagguccaggagcuccacgccaaggucuccgagggcgaccgccuccgcgucgagcucgccgagaaggccuccaagcuccagaacgagcucgacaacgucuccacccuccucgaggaggccgagaagaagggcaucaaguucgccaaggacgccgccucccucgagucccagcuccaggacacccaggagcuccuccaggaggagacccgccagaagcucaaccucuccucccgcauccgccagcucgaggaggagaagaacucccuccaggagcagcaggaggaggaggaggaggcccgcaagaaccucgagaagcagguccucgcccuccagucccagcucgccgacaccaagaagaaggucgacgacgaccucggcaccaucgagucccucgaggaggccaagaagaagcuccucaaggacgccgaggcccucucccagcgccucgaggagaaggcccucgccuacgacaagcucgagaagaccaagaaccgccuccagcaggagcucgacgaccucaccgucgaccucgaccaccagcgccaggucgccuccaaccucgagaagaagcagaagaaguucgaccagcuccucgccgaggagaaguccaucuccgcccgcuacgccgaggagcgcgaccgcgccgaggccgaggcccgcgagaaggagaccaaggcccucucccucgcccgcgcccucgaggaggcccucgaggccaaggaggaguucgagcgccagaacaagcagcuccgcgccgacauggaggaccucauguccuccaaggacgacgucggcaagaacguccacgagcucgagaaguccaagcgcgcccucgagcagcaggucgaggagaugcgcacccagcucgaggagcucgaggacgagcuccaggccaccgaggacgccaagcuccgccucgaggucaacaugcaggccaugaaggcccaguucgagcgcgaccuccagacccgcgacgagcagaacgaggagaagaagcgccuccucaucaagcagguccgcgagcucgaggccgagcucgaggacgagcgcaagcagcgcgcccucgccgucgccuccaagaagaagauggagaucgaccucaaggaccucgaggcccagaucgaggccgccaacaaggcccgcgacgaggucaucaagcagcuccgcaagcuccaggcccagaugaaggacuaccagcgcgagcucgaggaggcccgcgccucccgcgacgagaucuucgcccaguccaaggaguccgagaagaagcucaagucccucgaggccgagauccuccagcuccaggaggagcucgccuccuccgagcgcgcccgccgccacgccgagcaggagcgcgacgagcucgccgacgagaucaccaacuccgccuccggcaaguccgcccuccucgacgagaagcgccgccucgaggcccgcaucgcccagcucgaggaggagcucgaggaggagcaguccaacauggagcuccucaacgaccgcuuccgcaagaccacccuccaggucgacacccucaacgccgagcucgccgccgagcgcuccgccgcccagaaguccgacaacgcccgccagcagcucgagcgccagaacaaggagcucaaggccaagcuccaggagcucgagggcgccgucaaguccaaguucaaggccaccaucuccgcccucgaggccaagaucggccagcucgaggagcagcucgagcaggaggccaaggagcgcgccgccgccaacaagcucguccgccgcaccgagaagaagcucaaggagaucuucaugcaggucgaggacgagcgccgccacgccgaccaguacaaggagcagauggagaaggccaacgcccgcaugaagcagcucaagcgccagcucgaggaggccgaggaggaggccacccgcgccaacgccucccgccgcaagcuccagcgcgagcucgacgacgccaccgaggccaacgagggccucucccgcgaggucuccacccucaagaaccgccuccgccgcggcggccccaucuccuucuccuccucccgcuccggccgccgccagcuccaccucgagggcgccucccucgagcucuccgacgacgacaccgaguccaagaccuccgacgucaacgagacccagcccccccaguccgaguga

SEQ ID NO: 46324 - RNA, 5838 nt, Artificial Sequence
  derived and/or modified sequence opt2 from MYH11__Homo_sapiens__NP_001035202
auggcccagaagggccagcucuccgacgacgagaaguuccucuucgucgacaagaacuucaucaacucccccgucgcccaggccgacugggccgccaagcgccucgucuggguccccuccgagaagcagggcuucgaggccgccuccaucaaggaggagaagggcgacgaggucgucgucgagcucgucgagaacggcaagaaggucaccgucggcaaggacgacauccagaagaugaacccccccaaguucuccaaggucgaggacauggccgagcucaccugccucaacgaggccuccguccuccacaaccuccgcgagcgcuacuucuccggccucaucuacaccuacuccggccucuucugcgucgucgucaaccccuacaagcaccuccccaucuacuccgagaagaucgucgacauguacaagggcaagaagcgccacgagaugcccccccacaucuacgccaucgccgacaccgccuaccgcuccaugcuccaggaccgcgaggaccaguccauccucugcaccggcgaguccggcgccggcaagaccgagaacaccaagaaggucauccaguaccucgccgucgucgccuccucccacaagggcaagaaggacaccuccaucacccagggccccuccuucgccuacggcgagcucgagaagcagcuccuccaggccaaccccauccucgaggccuucggcaacgccaagaccgucaagaacgacaacuccucccgcuucggcaaguucauccgcaucaacuucgacgucaccggcuacaucgucggcgccaacaucgagaccuaccuccucgagaagucccgcgccauccgccaggcccgcgacgagcgcaccuuccacaucuucuacuacaugaucgccggcgccaaggagaagaugcgcuccgaccuccuccucgagggcuucaacaacuacaccuuccucuccaacggcuucguccccauccccgccgcccaggacgacgagauguuccaggagaccgucgaggccauggccaucaugggcuucuccgaggaggagcagcucuccauccucaaggucgucuccuccguccuccagcucggcaacaucgucuucaagaaggagcgcaacaccgaccaggccuccaugcccgacaacaccgccgcccagaaggucugccaccucaugggcaucaacgucaccgacuucacccgcuccauccucaccccccgcaucaaggucggccgcgacgucguccagaaggcccagaccaaggagcaggccgacuucgccgucgaggcccucgccaaggccaccuacgagcgccucuuccgcuggauccucacccgcgucaacaaggcccucgacaagacccaccgccagggcgccuccuuccucggcauccucgacaucgccggcuucgagaucuucgaggucaacuccuucgagcagcucugcaucaacuacaccaacgagaagcuccagcagcucuucaaccacaccauguucauccucgagcaggaggaguaccagcgcgagggcaucgaguggaacuucaucgacuucggccucgaccuccagcccugcaucgagcucaucgagcgccccaacaacccccccggcguccucgcccuccucgacgaggagugcugguuccccaaggccaccgacaaguccuucgucgagaagcucugcaccgagcagggcucccaccccaaguuccagaagcccaagcagcucaaggacaagaccgaguucuccaucauccacuacgccggcaaggucgacuacaacgccuccgccuggcucaccaagaacauggacccccucaacgacaacgucaccucccuccucaacgccuccuccgacaaguucgucgccgaccucuggaaggacgucgaccgcaucgucggccucgaccagauggccaagaugaccgaguccucccuccccuccgccuccaagaccaagaagggcauguuccgcaccgucggccagcucuacaaggagcagcucggcaagcucaugaccacccuccgcaacaccacccccaacuucguccgcugcaucauccccaaccacgagaagcgcuccggcaagcucgacgccuuccucguccucgagcagcuccgcugcaacggcguccucgagggcauccgcaucugccgccagggcuuccccaaccgcaucgucuuccaggaguuccgccagcgcuacgagauccucgccgccaacgccauccccaagggcuucauggacggcaagcaggccugcauccucaugaucaaggcccucgagcucgaccccaaccucuaccgcaucggccaguccaagaucuucuuccgcaccggcguccucgcccaccucgaggaggagcgcgaccucaagaucaccgacgucaucauggccuuccaggccaugugccgcggcuaccucgcccgcaaggccuucgccaagcgccagcagcagcucaccgccaugaaggucauccagcgcaacugcgccgccuaccucaagcuccgcaacuggcagugguggcgccucuucaccaaggucaagccccuccuccaggucacccgccaggaggaggagaugcaggccaaggaggacgagcuccagaagaccaaggagcgccagcagaaggccgagaacgagcucaaggagcucgagcagaagcacucccagcucaccgaggagaagaaccuccuccaggagcagcuccaggccgagaccgagcucuacgccgaggccgaggagaugcgcguccgccucgccgccaagaagcaggagcucgaggagauccuccacgagauggaggcccgccucgaggaggaggaggaccgcggccagcagcuccaggccgagcgcaagaagauggcccagcagaugcucgaccucgaggagcagcucgaggaggaggaggccgcccgccagaagcuccagcucgagaaggucaccgccgaggccaagaucaagaagcucgaggacgagauccucgucauggacgaccagaacaacaagcucuccaaggagcgcaagcuccucgaggagcgcaucuccgaccucaccaccaaccucgccgaggaggaggagaaggccaagaaccucaccaagcucaagaacaagcacgaguccaugaucuccgagcucgagguccgccucaagaaggaggagaagucccgccaggagcucgagaagcucaagcgcaagcucgagggcgacgccuccgacuuccacgagcagaucgccgaccuccaggcccagaucgccgagcucaagaugcagcucgccaagaaggaggaggagcuccaggccgcccucgcccgccucgacgacgagaucgcccagaagaacaacgcccucaagaagauccgcgagcucgagggccacaucuccgaccuccaggaggaccucgacuccgagcgcgccgcccgcaacaaggccgagaagcagaagcgcgaccucggcgaggagcucgaggcccucaagaccgagcucgaggacacccucgacuccaccgccacccagcaggagcuccgcgccaagcgcgagcaggaggucaccguccucaagaaggcccucgacgaggagacccgcucccacgaggcccagguccaggagaugcgccagaagcacgcccaggccgucgaggagcucaccgagcagcucgagcaguucaagcgcgccaaggccaaccucgacaagaacaagcagacccucgagaaggagaacgccgaccucgccggcgagcuccgcguccucggccaggccaagcaggaggucgagcacaagaagaagaagcucgaggcccagguccaggagcuccaguccaagugcuccgacggcgagcgcgcccgcgccgagcucaacgacaagguccacaagcuccagaacgaggucgaguccgucaccggcaugcucaacgaggccgagggcaaggccaucaagcucgccaaggacgucgccucccucuccucccagcuccaggacacccaggagcuccuccaggaggagacccgccagaagcucaacgucuccaccaagcuccgccagcucgaggaggagcgcaacucccuccaggaccagcucgacgaggagauggaggccaagcagaaccucgagcgccacaucuccacccucaacauccagcucuccgacuccaagaagaagcuccaggacuucgccuccaccgucgaggcccucgaggagggcaagaagcgcuuccagaaggagaucgagaaccucacccagcaguacgaggagaaggccgccgccuacgacaagcucgagaagaccaagaaccgccuccagcaggagcucgacgaccucgucgucgaccucgacaaccagcgccagcucgucuccaaccucgagaagaagcagcgcaaguucgaccagcuccucgccgaggagaagaacaucuccuccaaguacgccgacgagcgcgaccgcgccgaggccgaggcccgcgagaaggagaccaaggcccucucccucgcccgcgcccucgaggaggcccucgaggccaaggaggagcucgagcgcaccaacaagaugcucaaggccgagauggaggaccucgucuccuccaaggacgacgucggcaagaacguccacgagcucgagaaguccaagcgcgcccucgagacccagauggaggagaugaagacccagcucgaggagcucgaggacgagcuccaggccaccgaggacgccaagcuccgccucgaggucaacaugcaggcccucaagggccaguucgagcgcgaccuccaggcccgcgacgagcagaacgaggagaagcgccgccagcuccagcgccagcuccacgaguacgagaccgagcucgaggacgagcgcaagcagcgcgcccucgccgccgccgccaagaagaagcucgagggcgaccucaaggaccucgagcuccaggccgacuccgccaucaagggccgcgaggaggccaucaagcagcuccgcaagcuccaggcccagaugaaggacuuccagcgcgagcucgaggacgcccgcgccucccgcgacgagaucuucgccaccgccaaggagaacgagaagaaggccaagucccucgaggccgaccucaugcagcuccaggaggaccucgccgccgccgagcgcgcccgcaagcaggccgaccucgagaaggaggagcucgccgaggagcucgccuccucccucuccggccgcaacgcccuccaggacgagaagcgccgccucgaggcccgcaucgcccagcucgaggaggagcucgaggaggagcagggcaacauggaggccauguccgaccgcguccgcaaggccacccagcaggccgagcagcucuccaacgagcucgccaccgagcgcuccaccgcccagaagaacgaguccgcccgccagcagcucgagcgccagaacaaggagcuccgcuccaagcuccacgagauggagggcgccgucaaguccaaguucaaguccaccaucgccgcccucgaggccaagaucgcccagcucgaggagcaggucgagcaggaggcccgcgagaagcaggccgccaccaagucccucaagcagaaggacaagaagcucaaggagauccuccuccaggucgaggacgagcgcaagauggccgagcaguacaaggagcaggccgagaagggcaacgcccgcgucaagcagcucaagcgccagcucgaggaggccgaggaggagucccagcgcaucaacgccaaccgccgcaagcuccagcgcgagcucgacgaggccaccgaguccaacgaggccaugggccgcgaggucaacgcccucaaguccaagcuccgcggcccccccccccaggagaccucccaguga

SEQ ID NO: 46325 - RNA, 5817 nt, Artificial Sequence
  derived and/or modified sequence opt2 from MYH13__Homo_sapiens__NP_003793
auguccuccgacgccgagauggccaucuucggcgaggccgcccccuaccuccgcaagcccgagaaggagcgcaucgaggcccagaaccgccccuucgacuccaagaaggccugcuucgucgccgacaacaaggagauguacgucaagggcaugauccagacccgcgagaacgacaaggucaucgucaagacccucgacgaccgcaugcucacccucaacaacgaccaggucuuccccaugaacccccccaaguucgacaagaucgaggacauggccaugaugacccaccuccacgagcccgccguccucuacaaccucaaggagcgcuacgccgccuggaugaucuacaccuacuccggccucuucugcgucaccgucaaccccuacaaguggcuccccgucuacaagcccgaggucgucgccgccuaccgcggcaagaagcgccaggaggcccccccccacaucuucuccaucuccgacaacgccuaccaguucaugcucaccgaccgcgacaaccaguccauccucaucaccggcgaguccggcgccggcaagaccgucaacaccaagcgcgucauccaguacuucgccaccaucgccgucaccggcgacaagaagaaggagacccagcccggcaagaugcagggcacccucgaggaccagaucauccaggccaacccccuccucgaggccuucggcaacgccaagaccguccgcaacgacaacuccucccgcuucggcaaguucauccgcauccacuucggcgccaccggcaagcucgccuccgccgacaucgagaccuaccuccucgagaagucccgcgucaccuuccagcucuccuccgagcgcuccuaccacaucuucuaccagaucauguccaacaagaagcccgagcucaucgaccuccuccucaucuccaccaaccccuucgacuuccccuucgucucccagggcgaggucaccgucgccuccaucgacgacuccgaggagcuccucgccaccgacaacgccaucgacauccucggcuucuccuccgaggagaaggucggcaucuacaagcucaccggcgccgucaugcacuacggcaacaugaaguucaagcagaagcagcgcgaggagcaggccgagcccgacggcaccgaggucgccgacaaggccggcuaccucaugggccucaacuccgccgagaugcucaagggccucugcugcccccgcgucaaggucggcaacgaguacgucaccaagggccagaacguccagcaggucaccaacuccgucggcgcccucgccaaggccgucuacgagaagauguuccucuggauggucacccgcaucaaccagcagcucgacaccaagcagccccgccaguacuucaucggcguccucgacaucgccggcuucgagaucuucgacuucaacucccucgagcagcucugcaucaacuucaccaacgagaagcuccagcaguucuucaaccaccacauguucguccucgagcaggaggaguacaagaaggagggcaucgagugggaguucaucgacuucggcauggaccucgccgccugcaucgagcucaucgagaagcccaugggcaucuucuccauccucgaggaggagugcauguuccccaaggccaccgacaccuccuucaagaacaagcucuacgaccagcaccucggcaaguccaacaacuuccagaagcccaagcccgccaagggcaaggccgaggcccacuucucccucguccacuacgccggcaccgucgacuacaacaucgccggcuggcucgacaagaacaaggacccccucaacgagaccgucgucggccucuaccagaaguccucccucaagcuccucuccuuccucuucuccaacuacgccggcgccgagaccggcgacuccggcggcuccaagaagggcggcaagaagaagggcuccuccuuccagaccgucuccgccgucuuccgcgagaaccucaacaagcucaugaccaaccuccgcuccacccacccccacuucguccgcugccucauccccaacgagaccaagacccccggcgucauggaccacuaccucgucaugcaccagcuccgcugcaacggcguccucgagggcauccgcaucugccgcaagggcuuccccucccgcauccucuacgccgacuucaagcagcgcuaccgcauccucaacgccuccgccauccccgagggccaguucaucgacuccaagaacgccuccgagaagcuccucaacuccaucgacgucgaccgcgagcaguuccgcuucggcaacaccaaggucuucuucaaggccggccuccucggccuccucgaggagaugcgcgacgagaagcucgucacccucaugaccuccacccaggccgucugccgcggcuaccucaugcgcgucgaguucaagaagaugauggagcgccgcgacuccaucuucugcauccaguacaacauccgcuccuucaugaacgucaagcacuggcccuggaugaaccucuucuucaagaucaagccccuccucaaguccgccgaggccgagaaggagauggccaccaugaaggaggacuucgagcgcaccaaggaggagcucgcccgcuccgaggcccgccgcaaggagcucgaggagaagauggucucccuccuccaggagaagaacgaccuccagcuccagguccaguccgagaccgagaaccucauggacgccgaggagcgcugcgagggccucaucaaguccaagauccuccucgaggccaaggucaaggagcucaccgagcgccucgaggaggaggaggagaugaacuccgagcucgucgccaagaagcgcaaccucgaggacaagugcuccucccucaagcgcgacaucgacgaccucgagcucacccucaccaaggucgagaaggagaagcacgccaccgagaacaaggucaagaaccucuccgaggagaugaccgcccucgaggagaacaucuccaagcucaccaaggagaagaagucccuccaggaggcccaccagcagacccucgacgaccuccaggucgaggaggacaaggucaacggccucaucaagaucaacgccaagcucgagcagcagaccgacgaccucgagggcucccucgagcaggagaagaagcuccgcgccgaccucgagcgcgccaagcgcaagcucgagggcgaccucaagaugucccaggaguccaucauggaccucgagaacgacaagcagcagaucgaggagaagcucaagaagaaggaguucgagcucucccagcuccaggccaagaucgacgacgagcagguccacucccuccaguuccagaagaagaucaaggagcuccaggcccgcaucgaggagcucgaggaggagaucgaggccgagcacacccuccgcgccaagaucgagaagcagcgcuccgaccucgcccgcgagcucgaggagaucuccgagcgccucgaggaggccuccggcgccaccuccgcccagaucgagaugaacaagaagcgcgaggccgaguuccagaagaugcgccgcgaccucgaggaggccacccuccagcacgaggccaccgccgccacccuccgcaagaagcaggccgacuccgucgccgagcucggcgagcagaucgacaaccuccagcgcgucaagcagaagcucgagaaggagaaguccgagcucaagauggagaucgacgacauggccuccaacaucgaggcccucuccaaguccaaguccaacaucgagcgcaccugccgcaccgucgaggaccaguucuccgagaucaaggccaaggacgagcagcagacccagcucauccacgaccucaacaugcagaaggcccgccuccagacccagaacggcgagcucucccaccgcgucgaggagaaggagucccucaucucccagcucaccaaguccaagcaggcccucacccagcagcucgaggagcucaagcgccagauggaggaggagaccaaggccaagaacgccauggcccacgcccuccaguccucccgccacgacugcgaccuccuccgcgagcaguacgaggaggagcaggaggccaaggccgagcuccagcgcgcccucuccaaggccaacuccgaggucgcccaguggcgcaccaaguacgagaccgacgccauccagcgcaccgaggagcucgaggaggccaagaagaagcucgcccagcgccuccaggaggccgaggagaacaccgagaccgccaacuccaagugcgccucccucgagaagaccaagcagcgccuccagggcgaggucgaggaccucaugcgcgaccucgagcgcucccacaccgccugcgccacccucgacaagaagcagcgcaacuucgacaagguccucgccgaguggaagcagaagcucgacgagucccaggccgagcucgaggccgcccagaaggagucccgcucccucuccaccgagcucuucaagaugcgcaacgccuacgaggaggucgucgaccagcucgagacccuccgccgcgagaacaagaaccuccaggaggagaucuccgaccucaccgagcagaucgccgagaccggcaagaaccuccaggaggccgagaagaccaagaagcucgucgagcaggagaaguccgaccuccaggucgcccucgaggaggucgagggcucccucgagcacgaggaguccaagauccuccgcguccagcucgagcucucccaggucaaguccgagcucgaccgcaaggucaucgagaaggacgaggagaucgagcagcucaagcgcaacucccagcgcgccgccgaggcccuccaguccguccucgacgccgagauccgcucccgcaacgacgcccuccgccucaagaagaagauggagggcgaccucaacgagauggagauccagcucggccacuccaaccgccagauggccgagacccagaagcaccuccgcaccguccagggccagcucaaggacucccagcuccaccucgacgacgcccuccgcuccaacgaggaccucaaggagcagcucgccaucgucgagcgccgcaacggccuccuccucgaggagcucgaggagaugaaggucgcccucgagcagaccgagcgcacccgccgccucuccgagcaggagcuccucgacgccuccgaccgcguccagcuccuccacucccagaacaccucccucaucaacaccaagaagaagcucgaggccgacaucgcccagugccaggccgaggucgagaacuccauccaggagucccgcaacgccgaggagaaggccaagaaggccaucaccgacgccgccaugauggccgaggagcucaagaaggagcaggacaccuccgcccaccucgagcgcaugaagaagaaccucgagcagaccgucaaggaccuccagcaccgccucgacgaggccgagcagcucgcccucaagggcggcaagaagcagauccagaagcucgagaaccgcguccgcgagcucgagaacgagcucgacgucgagcagaagcgcggcgccgaggcccucaagggcgcccacaaguacgagcgcaaggucaaggagaugaccuaccaggccgaggaggaccacaagaacauccuccgccuccaggaccucgucgacaagcuccaggccaaggucaaguccuacaagcgccaggccgaggaggccgaggagcaggccaacacccagcucucccgcugccgccgcguccagcacgagcucgaggaggccgccgagcgcgccgacaucgccgagucccaggucaacaagcuccgcgccaagucccgcgacgucggcucccagaagauggaggaguga

SEQ ID NO: 46326 - RNA, 6111 nt, Artificial Sequence
  derived and/or modified sequence opt2 from MYH14__Homo_sapiens__NP_001139281
auggccgccgucaccauguccguccccggccgcaaggcccccccccgccccggccccguccccgaggccgcccagcccuuccucuucaccccccgcggccccuccgccggcggcggccccggcuccggcaccuccccccaggucgaguggaccgcccgccgccucgucuggguccccuccgagcuccacggcuucgaggccgccgcccuccgcgacgagggcgaggaggaggccgaggucgagcucgccgaguccggccgccgccuccgccucccccgcgaccagauccagcgcaugaacccccccaaguucuccaaggccgaggacauggccgagcucaccugccucaacgaggccuccguccuccacaaccuccgcgagcgcuacuacuccggccucaucuacaccuacuccggccucuucugcgucgucaucaaccccuacaagcagcuccccaucuacaccgaggccaucgucgagauguaccgcggcaagaagcgccacgagguccccccccacgucuacgccgucaccgagggcgccuaccgcuccaugcuccaggaccgcgaggaccaguccauccucugcaccggcgaguccggcgccggcaagaccgagaacaccaagaaggucauccaguaccucgcccacgucgccuccucccccaagggccgcaaggagcccggcguccccgccuccgucuccaccgucuccuacggcgagcucgagcgccagcuccuccaggccaaccccauccucgaggccuucggcaacgccaagaccgucaagaacgacaacuccucccgcuucggcaaguucauccgcaucaacuucgacgucgccggcuacaucgucggcgccaacaucgagaccuaccuccucgagaagucccgcgccauccgccaggccaaggacgagugcuccuuccacaucuucuaccagcuccucggcggcgccggcgagcagcucaaggccgaccuccuccucgagcccugcucccacuaccgcuuccucaccaacggccccuccuccucccccggccaggagcgcgagcucuuccaggagacccucgagucccuccgcguccucggcuucucccacgaggagaucaucuccaugcuccgcauggucuccgccguccuccaguucggcaacaucgcccucaagcgcgagcgcaacaccgaccaggccaccaugcccgacaacaccgccgcccagaagcucugccgccuccucggccucggcgucaccgacuucucccgcgcccuccucaccccccgcaucaaggucggccgcgacuacguccagaaggcccagaccaaggagcaggccgacuucgcccucgaggcccucgccaaggccaccuacgagcgccucuuccgcuggcucguccuccgccucaaccgcgcccucgaccgcuccccccgccagggcgccuccuuccucggcauccucgacaucgccggcuucgagaucuuccagcucaacuccuucgagcagcucugcaucaacuacaccaacgagaagcuccagcagcucuucaaccacaccauguucguccucgagcaggaggaguaccagcgcgagggcauccccuggaccuuccucgacuucggccucgaccuccagcccugcaucgaccucaucgagcgccccgccaacccccccggccuccucgcccuccucgacgaggagugcugguuccccaaggccaccgacaaguccuucgucgagaaggucgcccaggagcagggcggccaccccaaguuccagcgcccccgccaccuccgcgaccaggccgacuucuccguccuccacuacgccggcaaggucgacuacaaggccaacgaguggcucaugaagaacauggacccccucaacgacaacgucgccgcccuccuccaccaguccaccgaccgccucaccgccgagaucuggaaggacgagcacggcggcuuccagcaguucuccuuccucggcuccuucccccccuccccccccggcuccgccgagcgcugcuccuccgccaucuccccccccggcgucgagggcaucgucggccucgagcaggucuccucccucggcgacggcccccccggcggccgcccccgccgcggcauguuccgcaccgucggccagcucuacaaggagucccucucccgccucauggccacccucuccaacaccaaccccuccuucguccgcugcaucguccccaaccacgagaagcgcgccggcaagcucgagccccgccucguccucgaccagcuccgcugcaacggcguccucgagggcauccgcaucugccgccagggcuuccccaaccgcauccucuuccaggaguuccgccagcgcuacgagauccucacccccaacgccauccccaagggcuucauggacggcaagcaggccugcgagaagaugauccaggcccucgagcucgaccccaaccucuaccgcgucggccaguccaagaucuucuuccgcgccggcguccucgcccagcucgaggaggagcgcgaccucaaggucaccgacaucaucgucuccuuccaggccgccgcccgcggcuaccucgcccgccgcgccuuccagaagcgccagcagcagcaguccgcccuccgcgucaugcagcgcaacugcgccgccuaccucaagcuccgccacuggcagugguggcgccucuucaccaaggucaagccccuccuccaggucacccgccaggacgagguccuccaggcccgcgcccaggagcuccagaagguccaggagcuccagcagcaguccgcccgcgaggucggcgagcuccagggccgcgucgcccagcucgaggaggagcgcgcccgccucgccgagcagcuccgcgccgaggccgagcucugcgccgaggccgaggagacccgcggccgccucgccgcccgcaagcaggagcucgagcucgucgucuccgagcucgaggcccgcgucggcgaggaggaggagugcucccgccagaugcagaccgagaagaagcgccuccagcagcacauccaggagcucgaggcccaccucgaggccgaggagggcgcccgccagaagcuccagcucgagaaggucaccaccgaggccaagaugaagaaguucgaggaggaccuccuccuccucgaggaccagaacuccaagcucuccaaggagcgcaagcuccucgaggaccgccucgccgaguucuccucccaggccgccgaggaggaggagaaggucaagucccucaacaagcuccgccucaaguacgaggccaccaucgccgacauggaggaccgccuccgcaaggaggagaagggccgccaggagcucgagaagcucaagcgccgccucgacggcgaguccuccgagcuccaggagcagauggucgagcagcagcagcgcgccgaggagcuccgcgcccagcucggccgcaaggaggaggagcuccaggccgcccucgcccgcgccgaggacgagggcggcgcccgcgcccagcuccucaagucccuccgcgaggcccaggccgcccucgccgaggcccaggaggaccucgaguccgagcgcgucgcccgcaccaaggccgagaagcagcgccgcgaccucggcgaggagcucgaggcccuccgcggcgagcucgaggacacccucgacuccaccaacgcccagcaggagcuccgcuccaagcgcgagcaggaggucaccgagcucaagaagacccucgaggaggagacccgcauccacgaggccgccguccaggagcuccgccagcgccacggccaggcccucggcgagcucgccgagcagcucgagcaggcccgccgcggcaagggcgccugggagaagacccgccucgcccucgaggccgaggucuccgagcuccgcgccgagcucuccucccuccagaccgcccgccaggagggcgagcagcgccgccgccgccucgagcuccagcuccaggagguccagggccgcgccggcgacggcgagcgcgcccgcgccgaggccgccgagaagcuccagcgcgcccaggccgagcucgagaacgucuccggcgcccucaacgaggccgaguccaagaccauccgccucuccaaggagcucuccuccaccgaggcccagcuccacgacgcccaggagcuccuccaggaggagacccgcgccaagcucgcccucggcucccgcguccgcgccauggaggccgaggccgccggccuccgcgagcagcucgaggaggaggccgccgcccgcgagcgcgccggccgcgagcuccagaccgcccaggcccagcucuccgaguggcgccgccgccaggaggaggaggccggcgcccucgaggccggcgaggaggcccgccgccgcgccgcccgcgaggccgaggcccucacccagcgccucgccgagaagaccgagaccgucgaccgccucgagcgcggccgccgccgccuccagcaggagcucgacgacgccaccauggaccucgagcagcagcgccagcucgucuccacccucgagaagaagcagcgcaaguucgaccagcuccucgccgaggagaaggccgccguccuccgcgccgucgaggagcgcgagcgcgccgaggccgagggccgcgagcgcgaggcccgcgcccucucccucacccgcgcccucgaggaggagcaggaggcccgcgaggagcucgagcgccagaaccgcgcccuccgcgccgagcucgaggcccuccucuccuccaaggacgacgucggcaaguccguccacgagcucgagcgcgccugccgcgucgccgagcaggccgccaacgaccuccgcgcccaggucaccgagcucgaggacgagcucaccgccgccgaggacgccaagcuccgccucgaggucaccguccaggcccucaagacccagcacgagcgcgaccuccagggccgcgacgaggccggcgaggagcgccgccgccagcucgccaagcagcuccgcgacgccgaggucgagcgcgacgaggagcgcaagcagcgcacccucgccgucgccgcccgcaagaagcucgagggcgagcucgaggagcucaaggcccagauggccuccgccggccagggcaaggaggaggccgucaagcagcuccgcaagaugcaggcccagaugaaggagcucuggcgcgaggucgaggagacccgcaccucccgcgaggagaucuucucccagaaccgcgaguccgagaagcgccucaagggccucgaggccgagguccuccgccuccaggaggagcucgccgccuccgaccgcgcccgccgccaggcccagcaggaccgcgacgagauggccgacgaggucgccaacggcaaccucuccaaggccgccauccucgaggagaagcgccagcucgagggccgccucggccagcucgaggaggagcucgaggaggagcaguccaacuccgagcuccucaacgaccgcuaccgcaagcuccuccuccaggucgagucccucaccaccgagcucuccgccgagcgcuccuucuccgccaaggccgaguccggccgccagcagcucgagcgccagauccaggagcuccgcggccgccucggcgaggaggacgccggcgcccgcgcccgccacaagaugaccaucgccgcccucgaguccaagcucgcccaggccgaggagcagcucgagcaggagacccgcgagcgcauccucuccggcaagcucguccgccgcgccgagaagcgccucaaggaggucguccuccaggucgaggaggagcgccgcgucgccgaccagcuccgcgaccagcucgagaagggcaaccuccgcgucaagcagcucaagcgccagcucgaggaggccgaggaggaggccucccgcgcccaggccggccgccgccgccuccagcgcgagcucgaggacgucaccgaguccgccgaguccaugaaccgcgaggucaccacccuccgcaaccgccuccgccgcggcccccucaccuucaccacccgcaccguccgccaggucuuccgccucgaggagggcgucgccuccgacgaggaggccgaggaggcccagcccggcuccggccccucccccgagcccgagggcuccccccccgcccacccccaguga

SEQ ID NO: 46327 - RNA, 5841 nt, Artificial Sequence
  derived and/or modified sequence opt2 from MYH15__Homo_sapiens__NP_055796
auggucgaguccugccuccucaccuuccgcgccuucuucugguggaucgcccucaucaagauggaccucuccgaccucggcgaggccgccgccuuccuccgccgcuccgaggccgagcuccuccuccuccaggccaccgcccucgacggcaagaagaagugcuggauccccgacggcgagaacgccuacaucgaggccgaggucaagggcuccgaggacgacggcaccgucaucgucgagaccgccgacggcgagucccucuccaucaaggaggacaagauccagcagaugaacccccccgaguucgagaugaucgaggacauggccaugcucacccaccucaacgaggccuccguccuccacacccucaagcgccgcuacggccaguggaugaucuacaccuacuccggccucuucugcgucaccaucaaccccuacaaguggcuccccgucuaccagaaggaggucauggccgccuacaagggcaagcgccgcuccgaggcccccccccacaucuucgccgucgccaacaacgccuuccaggacaugcuccacaaccgcgagaaccaguccauccucuucaccggcgaguccggcgccggcaagaccgucaacuccaagcacaucauccaguacuucgccaccaucgccgccaugaucgagucccgcaagaagcagggcgcccucgaggaccagaucaugcaggccaacaccauccucgaggccuucggcaacgccaagacccuccgcaacgacaacuccucccgcuucggcaaguucauccgcaugcacuucggcgcccgcggcaugcucuccuccgucgacaucgacaucuaccuccucgagaagucccgcgucaucuuccagcaggccggcgagcgcaacuaccacaucuucuaccagauccucuccggccagaaggagcuccacgaccuccuccucgucuccgccaaccccuccgacuuccacuucugcuccugcggcgccgucaccgucgagucccucgacgacgccgaggagcuccucgccaccgagcaggccauggacauccucggcuuccuccccgacgagaaguacggcugcuacaagcucaccggcgccaucaugcacuucggcaacaugaaguucaagcagaagccccgcgaggagcagcucgaggccgacggcaccgagaacgccgacaaggccgccuuccucaugggcaucaacuccuccgagcucgucaagugccucauccacccccgcaucaaggucggcaacgaguacgucacccgcggccagaccaucgagcaggucaccugcgccgucggcgcccucuccaaguccauguacgagcgcauguucaaguggcucgucgcccgcaucaaccgcgcccucgacgccaagcucucccgccaguucuucaucggcauccucgacaucaccggcuucgagauccucgaguacaacucccucgagcagcucugcaucaacuucaccaacgagaagcuccagcaguucuucaacuggcacauguucguccucgagcaggaggaguacaagaaggaguccaucgagugggucuccaucggcuucggccucgaccuccaggccugcaucgaccucaucgagaagcccaugggcauccucuccauccucgaggaggagugcauguuccccaaggccaccgaccucaccuucaagaccaagcucuucgacaaccacuucggcaaguccguccaccuccagaagcccaagcccgacaagaagaaguucgaggcccacuucgagcucguccacuacgccggcgucguccccuacaacaucuccggcuggcucgagaagaacaaggaccuccucaacgagaccgucgucgccgucuuccagaaguccuccaaccgccuccucgccucccucuucgagaacuacauguccaccgacuccgccauccccuucggcgagaagaagcgcaagaagggcgccuccuuccagaccgucgccucccuccacaaggagaaccucaacaagcucaugaccaaccucaaguccaccgccccccacuucguccgcugcaucaaccccaacgucaacaagauccccggcauccucgaccccuaccucguccuccagcagcuccgcugcaacggcguccucgagggcacccgcaucugccgcgagggcuuccccaaccgccuccaguacgccgacuucaagcagcgcuacugcauccucaacccccgcaccuuccccaaguccaaguucgucuccucccgcaaggccgccgaggagcuccucggcucccucgagaucgaccacacccaguaccgcuucggcaucaccaaggucuucuucaaggccggcuuccucggccagcucgaggccauccgcgacgagcgccucuccaaggucuucacccucuuccaggcccgcgcccagggcaagcucaugcgcaucaaguuccagaagauccucgaggagcgcgacgcccucauccucauccaguggaacauccgcgccuucauggccgucaagaacuggcccuggaugcgccucuucuucaagaucaagccccucgucaaguccuccgaggucggcgaggaggucgccggccucaaggaggagugcgcccagcuccagaaggcccucgagaaguccgaguuccagcgcgaggagcucaaggccaagcaggucucccucacccaggagaagaacgaccucauccuccagcuccaggccgagcaggagacccucgccaacgucgaggagcagugcgaguggcucaucaaguccaagauccagcucgaggcccgcgucaaggagcucuccgagcgcgucgaggaggaggaggagaucaacuccgagcucaccgcccgcggccgcaagcucgaggacgagugcuucgagcucaagaaggagaucgacgaccucgagaccaugcucgucaaguccgagaaggagaagcgcaccaccgagcacaaggucaagaaccucaccgaggaggucgaguuccucaacgaggacaucuccaagcucaaccgcgccgccaaggucguccaggaggcccaccagcagacccucgacgaccuccacauggaggaggagaagcucuccucccucuccaaggccaaccucaagcucgagcagcaggucgacgagcucgagggcgcccucgagcaggagcgcaaggcccgcaugaacugcgagcgcgagcuccacaagcucgagggcaaccucaagcucaaccgcgaguccauggagaaccucgaguccucccagcgccaccucgccgaggagcuccgcaagaaggagcucgagcucucccagaugaacuccaaggucgagaacgagaagggccucgucgcccagcuccagaagaccgucaaggagcuccagacccagaucaaggaccucaaggagaagcucgaggccgagcgcaccacccgcgccaagauggagcgcgagcgcgccgaccucacccaggaccucgccgaccucaacgagcgccucgaggaggucggcggcuccucccucgcccagcucgagaucaccaagaagcaggagaccaaguuccagaagcuccaccgcgacauggaggaggccacccuccacuucgagaccaccuccgccucccucaagaagcgccacgccgacucccucgccgagcucgagggccaggucgagaaccuccagcaggucaagcagaagcucgagaaggacaaguccgaccuccagcucgaggucgacgaccuccucacccgcgucgagcagaugacccgcgccaaggccaacgccgagaagcucugcacccucuacgaggagcgccuccacgaggccaccgccaagcucgacaaggucacccagcucgccaacgaccucgccgcccagaagaccaagcucugguccgaguccggcgaguuccuccgccgccucgaggagaaggaggcccucaucaaccagcucucccgcgagaaguccaacuucacccgccagaucgaggaccuccgcggccagcucgagaaggagaccaagucccaguccgcccucgcccacgcccuccagaaggcccagcgcgacugcgaccuccuccgcgagcaguacgaggaggagcaggaggucaaggccgagcuccaccgcacccucuccaaggucaacgccgagaugguccaguggcgcaugaaguacgagaacaacgucauccagcgcaccgaggaccucgaggacgccaagaaggagcucgccauccgccuccaggaggccgccgaggccaugggcgucgccaacgcccgcaacgccucccucgagcgcgcccgccaccagcuccagcucgagcucggcgacgcccucuccgaccucggcaagguccgcuccgccgccgcccgccucgaccagaagcagcuccaguccggcaaggcccucgccgacuggaagcagaagcacgaggagucccaggcccuccucgacgccucccagaaggagguccaggcccucuccaccgagcuccucaagcucaagaacaccuacgaggaguccaucgucggccaggagacccuccgccgcgagaacaagaaccuccaggaggagaucuccaaccucaccaaccagguccgcgagggcaccaagaaccucaccgagauggagaaggucaagaagcucaucgaggaggagaagaccgagguccaggucacccucgaggagaccgagggcgcccucgagcgcaacgaguccaagauccuccacuuccagcucgagcuccucgaggccaaggccgagcucgagcgcaagcucuccgagaaggacgaggagaucgagaacuuccgccgcaagcagcagugcaccaucgacucccuccaguccucccucgacuccgaggccaagucccgcaucgaggucacccgccucaagaagaagauggaggaggaccucaacgagauggagcuccagcucuccugcgccaaccgccaggucuccgaggccaccaagucccucggccagcuccagauccagaucaaggaccuccagaugcagcucgacgacuccacccagcucaacuccgaccucaaggagcaggucgccgucgccgagcgccgcaacucccuccuccaguccgagcucgaggaccuccgcucccuccaggagcagaccgagcgcggccgccgccucuccgaggaggagcuccucgaggccaccgagcgcaucaaccucuucuacacccagaacaccucccuccucucccagaagaagaagcucgaggccgacgucgcccgcaugcagaaggaggccgaggaggucguccaggagugccagaacgccgaggagaaggccaagaaggccgccaucgaggccgccaaccucuccgaggagcucaagaagaagcaggacaccaucgcccaccucgagcgcacccgcgagaacauggagcagaccaucaccgaccuccagaagcgccucgccgaggccgagcagauggcccucaugggcucccgcaagcagauccagaagcucgagucccgcguccgcgagcucgagggcgagcucgagggcgagauccgccgcuccgccgaggcccagcgcggcgcccgccgccucgagcgcugcaucaaggagcucaccuaccaggccgaggaggacaagaagaaccucucccgcaugcagacccagauggacaagcuccagcucaagguccagaacuacaagcagcaggucgaggucgccgagacccaggccaaccaguaccucuccaaguacaagaagcagcagcacgagcucaacgaggucaaggagcgcgccgaggucgccgagucccaggucaacaagcucaagaucaaggcccgcgaguucggcaagaagguccaggaggaguga

SEQ ID NO: 46328 - RNA, 5820 nt, Artificial Sequence
  derived and/or modified sequence opt2 from MYH1__Homo_sapiens__NP_005954
auguccuccgacuccgagauggccaucuucggcgaggccgcccccuuccuccgcaaguccgagcgcgagcgcaucgaggcccagaacaagcccuucgacgccaagaccuccgucuucgucgucgaccccaaggaguccuucgucaaggccaccguccagucccgcgagggcggcaaggucaccgccaagaccgaggccggcgccaccgucaccgucaaggacgaccaggucuuccccaugaacccccccaaguacgacaagaucgaggacauggccaugaugacccaccuccacgagcccgccguccucuacaaccucaaggagcgcuacgccgccuggaugaucuacaccuacuccggccucuucugcgucaccgucaaccccuacaaguggcuccccgucuacaacgccgaggucgucaccgccuaccgcggcaagaagcgccaggaggcccccccccacaucuucuccaucuccgacaacgccuaccaguucaugcucaccgaccgcgagaaccaguccauccucaucaccggcgaguccggcgccggcaagaccgucaacaccaagcgcgucauccaguacuucgccaccaucgccgucaccggcgagaagaagaaggaggaggucaccuccggcaagaugcagggcacccucgaggaccagaucaucuccgccaacccccuccucgaggccuucggcaacgccaagaccguccgcaacgacaacuccucccgcuucggcaaguucauccgcauccacuucggcaccaccggcaagcucgccuccgccgacaucgagaccuaccuccucgagaagucccgcgucaccuuccagcucaaggccgagcgcuccuaccacaucuucuaccagaucauguccaacaagaagcccgaccucaucgagaugcuccucaucaccaccaaccccuacgacuacgccuucgucucccagggcgagaucaccguccccuccaucgacgaccaggaggagcucauggccaccgacuccgccaucgagauccucggcuucaccuccgacgagcgcgucuccaucuacaagcucaccggcgccgucaugcacuacggcaacaugaaguucaagcagaagcagcgcgaggagcaggccgagcccgacggcaccgaggucgccgacaaggccgccuaccuccagaaccucaacuccgccgaccuccucaaggcccucugcuacccccgcgucaaggucggcaacgaguacgucaccaagggccagaccguccagcaggucuacaacgccgucggcgcccucgccaaggccgucuacgacaagauguuccucuggauggucacccgcaucaaccagcagcucgacaccaagcagccccgccaguacuucaucggcguccucgacaucgccggcuucgagaucuucgacuucaacucccucgagcagcucugcaucaacuucaccaacgagaagcuccagcaguucuucaaccaccacauguucguccucgagcaggaggaguacaagaaggagggcaucgaguggaccuucaucgacuucggcauggaccucgccgccugcaucgagcucaucgagaagcccaugggcaucuucuccauccucgaggaggagugcauguuccccaaggccaccgacaccuccuucaagaacaagcucuacgagcagcaccucggcaaguccaacaacuuccagaagcccaagcccgccaagggcaagcccgaggcccacuucucccucauccacuacgccggcaccgucgacuacaacaucgccggcuggcucgacaagaacaaggacccccucaacgagaccgucgucggccucuaccagaaguccgccaugaagacccucgcccuccucuucgucggcgccaccggcgccgaggccgaggccggcggcggcaagaagggcggcaagaagaagggcuccuccuuccagaccgucuccgcccucuuccgcgagaaccucaacaagcucaugaccaaccuccgcuccacccacccccacuucguccgcugcaucauccccaacgagaccaagacccccggcgccauggagcacgagcucguccuccaccagcuccgcugcaacggcguccucgagggcauccgcaucugccgcaagggcuuccccucccgcauccucuacgccgacuucaagcagcgcuacaagguccucaacgccuccgccauccccgagggccaguucaucgacuccaagaaggccuccgagaagcuccucggcuccaucgacaucgaccacacccaguacaaguucggccacaccaaggucuucuucaaggccggccuccucggccuccucgaggagaugcgcgacgagaagcucgcccagcucaucacccgcacccaggccaugugccgcggcuuccucgcccgcgucgaguaccagaagauggucgagcgccgcgaguccaucuucugcauccaguacaacguccgcgccuucaugaacgucaagcacuggcccuggaugaagcucuacuucaagaucaagccccuccucaaguccgccgagaccgagaaggagauggccaacaugaaggaggaguucgagaagaccaaggaggagcucgccaagaccgaggccaagcgcaaggagcucgaggagaagauggucacccucaugcaggagaagaacgaccuccagcuccagguccaggccgaggccgacucccucgccgacgccgaggagcgcugcgaccagcucaucaagaccaagauccagcucgaggccaagaucaaggaggucaccgagcgcgccgaggacgaggaggagaucaacgccgagcucaccgccaagaagcgcaagcucgaggacgagugcuccgagcucaagaaggacaucgacgaccucgagcucacccucgccaaggucgagaaggagaagcacgccaccgagaacaaggucaagaaccucaccgaggagauggccggccucgacgagaccaucgccaagcucaccaaggagaagaaggcccuccaggaggcccaccagcagacccucgacgaccuccaggccgaggaggacaaggucaacacccucaccaaggccaagaucaagcucgagcagcaggucgacgaccucgagggcucccucgagcaggagaagaagauccgcauggaccucgagcgcgccaagcgcaagcucgagggcgaccucaagcucgcccaggaguccaccauggacaucgagaacgacaagcagcagcucgacgagaagcucaagaagaaggaguucgagauguccggccuccaguccaagaucgaggacgagcaggcccucggcaugcagcuccagaagaagaucaaggagcuccaggcccgcaucgaggagcucgaggaggagaucgaggccgagcgcgccucccgcgccaaggccgagaagcagcgcuccgaccucucccgcgagcucgaggagaucuccgagcgccucgaggaggccggcggcgccaccuccgcccagaucgagaugaacaagaagcgcgaggccgaguuccagaagaugcgccgcgaccucgaggaggccacccuccagcacgaggccaccgccgccacccuccgcaagaagcacgccgacuccgucgccgagcucggcgagcagaucgacaaccuccagcgcgucaagcagaagcucgagaaggagaaguccgagaugaagauggagaucgacgaccucgccuccaacauggagaccgucuccaaggccaagggcaaccucgagaagaugugccgcgcccucgaggaccagcucuccgagaucaagaccaaggaggaggagcagcagcgccucaucaacgaccucaccgcccagcgcgcccgccuccagaccgaguccggcgaguacucccgccagcucgacgagaaggacacccucgucucccagcucucccgcggcaagcaggccuucacccagcagaucgaggagcucaagcgccagcucgaggaggagaucaaggccaaguccgcccucgcccacgcccuccaguccucccgccacgacugcgaccuccuccgcgagcaguacgaggaggagcaggaggccaaggccgagcuccagcgcgccauguccaaggccaacuccgaggucgcccaguggcgcaccaaguacgagaccgacgccauccagcgcaccgaggagcucgaggaggccaagaagaagcucgcccagcgccuccaggacgccgaggagcacgucgaggccgucaacgccaagugcgccucccucgagaagaccaagcagcgccuccagaacgaggucgaggaccucaugaucgacgucgagcgcaccaacgccgccugcgccgcccucgacaagaagcagcgcaacuucgacaagauccucgccgaguggaagcagaagugcgaggagacccacgccgagcucgaggccucccagaaggagucccgcucccucuccaccgagcucuucaagaucaagaacgccuacgaggagucccucgaccagcucgagacccucaagcgcgagaacaagaaccuccagcaggagaucuccgaccucaccgagcagaucgccgagggcggcaagcgcauccacgagcucgagaagaucaagaagcaggucgagcaggagaaguccgagcuccaggccgcccucgaggaggccgaggccucccucgagcacgaggagggcaagauccuccgcauccagcucgagcucaaccaggucaaguccgaggucgaccgcaagaucgccgagaaggacgaggagaucgaccagaugaagcgcaaccacauccgcaucgucgaguccaugcaguccacccucgacgccgagauccgcucccgcaacgacgccauccgccucaagaagaagauggagggcgaccucaacgagauggagauccagcucaaccacgccaaccgcauggccgccgaggcccuccgcaacuaccgcaacacccaggccauccucaaggacacccagcuccaccucgacgacgcccuccgcucccaggaggaccucaaggagcagcucgccauggucgagcgccgcgccaaccuccuccaggccgagaucgaggagcuccgcgccacccucgagcagaccgagcgcucccgcaagaucgccgagcaggagcuccucgacgccuccgagcgcguccagcuccuccacacccagaacaccucccucaucaacaccaagaagaagcucgagaccgacaucucccagauccagggcgagauggaggacaucauccaggaggcccgcaacgccgaggagaaggccaagaaggccaucaccgacgccgccaugauggccgaggagcucaagaaggagcaggacaccuccgcccaccucgagcgcaugaagaagaaccucgagcagaccgucaaggaccuccagcaccgccucgacgaggccgagcagcucgcccucaagggcggcaagaagcagauccagaagcucgaggcccgcguccgcgagcucgagggcgaggucgaguccgagcagaagcgcaacgucgaggccgucaagggccuccgcaagcacgagcgcaaggucaaggagcucaccuaccagaccgaggaggaccgcaagaacauccuccgccuccaggaccucgucgacaagcuccaggccaaggucaaguccuacaagcgccaggccgaggaggccgaggagcaguccaacgucaaccucuccaaguuccgccgcauccagcacgagcucgaggaggccgaggagcgcgccgacaucgccgagucccaggucaacaagcuccgcgucaagucccgcgagguccacaccaagaucaucuccgaggaguga

SEQ ID NO: 46329 - RNA, 5826 nt, Artificial Sequence
  derived and/or modified sequence opt2 from MYH2__Homo_sapiens__NP_001093582
auguccuccgacuccgagcucgccgucuucggcgaggccgcccccuuccuccgcaaguccgagcgcgagcgcaucgaggcccagaaccgccccuucgacgccaagaccuccgucuucgucgccgagcccaaggaguccuucgucaagggcaccauccagucccgcgagggcggcaaggucaccgucaagaccgagggcggcgccacccucaccgucaaggacgaccaggucuuccccaugaacccccccaaguacgacaagaucgaggacauggccaugaugacccaccuccacgagcccgccguccucuacaaccucaaggagcgcuacgccgccuggaugaucuacaccuacuccggccucuucugcgucaccgucaaccccuacaaguggcuccccgucuacaagcccgaggucgucaccgccuaccgcggcaagaagcgccaggaggcccccccccacaucuucuccaucuccgacaacgccuaccaguucaugcucaccgaccgcgagaaccaguccauccucaucaccggcgaguccggcgccggcaagaccgucaacaccaagcgcgucauccaguacuucgccaccaucgccgucaccggcgagaagaagaaggaggagaucaccuccggcaagauccagggcacccucgaggaccagaucaucuccgccaacccccuccucgaggccuucggcaacgccaagaccguccgcaacgacaacuccucccgcuucggcaaguucauccgcauccacuucggcaccaccggcaagcucgccuccgccgacaucgagaccuaccuccucgagaagucccgcgucgucuuccagcucaaggccgagcgcuccuaccacaucuucuaccagaucaccuccaacaagaagcccgagcucaucgagaugcuccucaucaccaccaaccccuacgacuaccccuucgucucccagggcgagaucuccgucgccuccaucgacgaccaggaggagcucauggccaccgacuccgccaucgacauccucggcuucaccaacgaggagaaggucuccaucuacaagcucaccggcgccgucaugcacuacggcaaccucaaguucaagcagaagcagcgcgaggagcaggccgagcccgacggcaccgaggucgccgacaaggccgccuaccuccagucccucaacuccgccgaccuccucaaggcccucugcuacccccgcgucaaggucggcaacgaguacgucaccaagggccagaccgucgagcaggucuccaacgccgucggcgcccucgccaaggccgucuacgagaagauguuccucuggauggucgcccgcaucaaccagcagcucgacaccaagcagccccgccaguacuucaucggcguccucgacaucgccggcuucgagaucuucgacuucaacucccucgagcagcucugcaucaacuucaccaacgagaagcuccagcaguucuucaaccaccacauguucguccucgagcaggaggaguacaagaaggagggcaucgaguggaccuucaucgacuucggcauggaccucgccgccugcaucgagcucaucgagaagcccaugggcaucuucuccauccucgaggaggagugcauguuccccaaggccaccgacaccuccuucaagaacaagcucuacgaccagcaccucggcaaguccgccaacuuccagaagcccaaggucgucaagggcaaggccgaggcccacuucgcccucauccacuacgccggcgucgucgacuacaacaucaccggcuggcucgagaagaacaaggacccccucaacgagaccgucgucggccucuaccagaaguccgccaugaagacccucgcccagcucuucuccggcgcccagaccgccgagggcgagggcgccggcggcggcgccaagaagggcggcaagaagaagggcuccuccuuccagaccgucuccgcccucuuccgcgagaaccucaacaagcucaugaccaaccuccgcuccacccacccccacuucguccgcugcaucauccccaacgagaccaagacccccggcgccauggagcacgagcucguccuccaccagcuccgcugcaacggcguccucgagggcauccgcaucugccgcaagggcuuccccucccgcauccucuacgccgacuucaagcagcgcuacaagguccucaacgccuccgccauccccgagggccaguucaucgacuccaagaaggccuccgagaagcuccucgccuccaucgacaucgaccacacccaguacaaguucggccacaccaaggucuucuucaaggccggccuccucggccuccucgaggagaugcgcgacgacaagcucgcccagcucaucacccgcacccaggcccgcugccgcggcuuccucgcccgcgucgaguaccagcgcauggucgagcgccgcgaggccaucuucugcauccaguacaacauccgcuccuucaugaacgucaagcacuggcccuggaugaagcucuucuucaagaucaagccccuccucaaguccgccgagaccgagaaggagauggccaccaugaaggaggaguuccagaagaucaaggacgagcucgccaaguccgaggccaagcgcaaggagcucgaggagaagauggucacccuccucaaggagaagaacgaccuccagcuccagguccaggccgaggccgagggccucgccgacgccgaggagcgcugcgaccagcucaucaagaccaagauccagcucgaggccaagaucaaggaggucaccgagcgcgccgaggacgaggaggagaucaacgccgagcucaccgccaagaagcgcaagcucgaggacgagugcuccgagcucaagaaggacaucgacgaccucgagcucacccucgccaaggucgagaaggagaagcacgccaccgagaacaaggucaagaaccucaccgaggagauggccggccucgacgagaccaucgccaagcucaccaaggagaagaaggcccuccaggaggcccaccagcagacccucgacgaccuccaggccgaggaggacaaggucaacacccucaccaaggccaagaucaagcucgagcagcaggucgacgaccucgagggcucccucgagcaggagaagaagcuccgcauggaccucgagcgcgccaagcgcaagcucgagggcgaccucaagcucgcccaggaguccaucauggacaucgagaacgagaagcagcagcucgacgagaagcucaagaagaaggaguucgagaucuccaaccuccaguccaagaucgaggacgagcaggcccucggcauccagcuccagaagaagaucaaggagcuccaggcccgcaucgaggagcucgaggaggagaucgaggccgagcgcgccucccgcgccaaggccgagaagcagcgcuccgaccucucccgcgagcucgaggagaucuccgagcgccucgaggaggccggcggcgccaccuccgcccagaucgagaugaacaagaagcgcgaggccgaguuccagaagaugcgccgcgaccucgaggaggccacccuccagcacgaggccaccgccgccacccuccgcaagaagcacgccgacuccgucgccgagcucggcgagcagaucgacaaccuccagcgcgucaagcagaagcucgagaaggagaaguccgagaugaagauggagaucgacgaccucgccuccaacgucgagaccgucuccaaggccaagggcaaccucgagaagaugugccgcacccucgaggaccagcucuccgagcucaaguccaaggaggaggagcagcagcgccucaucaacgaccucaccgcccagcgcggccgccuccagaccgaguccggcgaguucucccgccagcucgacgagaaggaggcccucgucucccagcucucccgcggcaagcaggccuucacccagcagaucgaggagcucaagcgccagcucgaggaggagaucaaggccaagaacgcccucgcccacgcccuccaguccucccgccacgacugcgaccuccuccgcgagcaguacgaggaggagcaggaguccaaggccgagcuccagcgcgcccucuccaaggccaacaccgaggucgcccaguggcgcaccaaguacgagaccgacgccauccagcgcaccgaggagcucgaggaggccaagaagaagcucgcccagcgccuccaggccgccgaggagcacgucgaggccgucaacgccaagugcgccucccucgagaagaccaagcagcgccuccagaacgaggucgaggaccucaugcucgacgucgagcgcaccaacgccgccugcgccgcccucgacaagaagcagcgcaacuucgacaagauccucgccgaguggaagcagaagugcgaggagacccacgccgagcucgaggccucccagaaggaggcccgcucccucggcaccgagcucuucaagaucaagaacgccuacgaggagucccucgaccagcucgagacccucaagcgcgagaacaagaaccuccagcaggagaucuccgaccucaccgagcagaucgccgagggcggcaagcgcauccacgagcucgagaagaucaagaagcaggucgagcaggagaagugcgagcuccaggccgcccucgaggaggccgaggccucccucgagcacgaggagggcaagauccuccgcauccagcucgagcucaaccaggucaaguccgaggucgaccgcaagaucgccgagaaggacgaggagaucgaccagcucaagcgcaaccacauccgcaucgucgaguccaugcaguccacccucgacgccgagauccgcucccgcaacgacgccauccgccucaagaagaagauggagggcgaccucaacgagauggagauccagcucaaccacgccaaccgcauggccgccgaggcccuccgcaacuaccgcaacacccagggcauccucaaggacacccagauccaccucgacgacgcccuccgcucccaggaggaccucaaggagcagcucgccauggucgagcgccgcgccaaccuccuccaggccgagaucgaggagcuccgcgccacccucgagcagaccgagcgcucccgcaagaucgccgagcaggagcuccucgacgccuccgagcgcguccagcuccuccacacccagaacaccucccucaucaacaccaagaagaagcucgagaccgacaucucccagaugcagggcgagauggaggacauccuccaggaggcccgcaacgccgaggagaaggccaagaaggccaucaccgacgccgccaugauggccgaggagcucaagaaggagcaggacaccuccgcccaccucgagcgcaugaagaagaacauggagcagaccgucaaggaccuccagcuccgccucgacgaggccgagcagcucgcccucaagggcggcaagaagcagauccagaagcucgaggcccgcguccgcgagcucgagggcgaggucgaguccgagcagaagcgcaacgccgaggccgucaagggccuccgcaagcacgagcgccgcgucaaggagcucaccuaccagaccgaggaggaccgcaagaacauccuccgccuccaggaccucgucgacaagcuccaggccaaggucaaguccuacaagcgccaggccgaggaggccgaggagcaguccaacaccaaccucgccaaguuccgcaagcuccagcacgagcucgaggaggccgaggagcgcgccgacaucgccgagucccaggucaacaagcuccgcgucaagucccgcgagguccacaccaaggucaucuccgaggaguga

SEQ ID NO: 46330 - RNA, 5823 nt, Artificial Sequence
  derived and/or modified sequence opt2 from MYH3__Homo_sapiens__XP_011522173
auguccuccgacaccgagauggaggucuucggcaucgccgcccccuuccuccgcaaguccgagaaggagcgcaucgaggcccagaaccagcccuucgacgccaagaccuacugcuucgucgucgacuccaaggaggaguacgccaagggcaagaucaaguccucccaggacggcaaggucaccgucgagaccgaggacaaccgcacccucgucgucaagcccgaggacgucuacgccaugaacccccccaaguucgaccgcaucgaggacauggccaugcucacccaccucaacgagcccgccguccucuacaaccucaaggaccgcuacaccuccuggaugaucuacaccuacuccggccucuucugcgucaccgucaaccccuacaaguggcuccccgucuacaaccccgaggucgucgagggcuaccgcggcaagaagcgccaggaggcccccccccacaucuucuccaucuccgacaacgccuaccaguucaugcucaccgaccgcgagaaccaguccauccucaucaccggcgaguccggcgccggcaagaccgucaacaccaagcgcgucauccaguacuucgccaccaucgccgccaccggcgaccucgccaagaagaaggacuccaagaugaagggcacccucgaggaccagaucaucuccgccaacccccuccucgaggccuucggcaacgccaagaccguccgcaacgacaacuccucccgcuucggcaaguucauccgcauccacuucggcaccaccggcaagcucgccuccgccgacaucgagaccuaccuccucgagaagucccgcgucaccuuccagcucaaggccgagcgcuccuaccacaucuucuaccagauccucuccaacaagaagcccgagcucaucgagcuccuccucaucaccaccaaccccuacgacuaccccuucaucucccagggcgagauccucgucgccuccaucgacgacgccgaggagcuccucgccaccgacuccgccaucgacauccucggcuucacccccgaggagaaguccggccucuacaagcucaccggcgccgucaugcacuacggcaacaugaaguucaagcagaagcagcgcgaggagcaggccgagcccgacggcaccgaggucgccgacaagaccgccuaccucaugggccucaacuccuccgaccuccucaaggcccucugcuucccccgcgucaaggucggcaacgaguacgucaccaagggccagaccgucgaccagguccaccacgccgucaacgcccucuccaaguccgucuacgagaagcucuuccucuggauggucacccgcaucaaccagcagcucgacaccaagcucccccgccagcacuucaucggcguccucgacaucgccggcuucgagaucuucgaguacaacucccucgagcagcucugcaucaacuucaccaacgagaagcuccagcaguucuucaaccaccacauguucguccucgagcaggaggaguacaagaaggagggcaucgaguggaccuucaucgacuucggcauggaccucgccgccugcaucgagcucaucgagaagcccaugggcaucuucuccauccucgaggaggagugcauguuccccaaggccaccgacaccuccuucaagaacaagcucuacgaccagcaccucggcaaguccaacaacuuccagaagcccaaggucgucaagggccgcgccgaggcccacuucucccucauccacuacgccggcaccgucgacuacuccgucuccggcuggcucgagaagaacaaggacccccucaacgagaccgucgucggccucuaccagaaguccuccaaccgccuccucgcccaccucuacgccaccuucgccaccgccgacgccgacuccggcaagaagaaggucgccaagaagaagggcuccuccuuccagaccgucuccgcccucuuccgcgagaaccucaacaagcucauguccaaccuccgcaccacccacccccacuucguccgcugcaucauccccaacgagaccaagacccccggcgccauggagcacucccucguccuccaccagcuccgcugcaacggcguccucgagggcauccgcaucugccgcaagggcuuccccaaccgcauccucuacggcgacuucaagcagcgcuaccgcguccucaacgccuccgccauccccgagggccaguucaucgacuccaagaaggccugcgagaagcuccucgccuccaucgacaucgaccacacccaguacaaguucggccacaccaaggucuucuucaaggccggccuccucggcacccucgaggagaugcgcgacgaccgccucgccaagcucaucacccgcacccaggccgucugccgcggcuuccucaugcgcgucgaguuccagaagaugguccagcgccgcgaguccaucuucugcauccaguacaacauccgcuccuucaugaacgucaagcacuggcccuggaugaagcucuucuucaagaucaagccccuccucaaguccgccgagaccgagaaggagauggccaccaugaaggaggaguuccagaagaccaaggacgagcucgccaaguccgaggccaagcgcaaggagcucgaggagaagcucgucacccucguccaggagaagaacgaccuccagcuccagguccaggccgaguccgagaaccuccucgacgccgaggagcgcugcgaccagcucaucaaggccaaguuccagcucgaggccaagaucaaggaggucaccgagcgcgccgaggacgaggaggagaucaacgccgagcucaccgccaagaagcgcaagcucgaggacgagugcuccgagcucaagaaggacaucgacgaccucgagcucacccucgccaaggucgagaaggagaagcacgccaccgagaacaaggucaagaaccucaccgaggagcucuccggccucgacgagaccaucgccaagcucacccgcgagaagaaggcccuccaggaggcccaccagcaggcccucgacgaccuccaggccgaggaggacaaggucaacucccucaacaagaccaaguccaagcucgagcagcaggucgaggaccucgaguccucccucgagcaggagaagaagcuccgcgucgaccucgagcgcaacaagcgcaagcucgagggcgaccucaagcucgcccaggaguccauccucgaccucgagaacgacaagcagcagcucgacgagcgccucaagaagaaggacuucgaguacugccagcuccaguccaaggucgaggacgagcagacccucggccuccaguuccagaagaagaucaaggagcuccaggcccgcaucgaggagcucgaggaggagaucgaggccgagcgcgccacccgcgccaagaccgagaagcagcgcuccgacuacgcccgcgagcucgaggagcucuccgagcgccucgaggaggccggcggcgucaccuccacccagaucgagcucaacaagaagcgcgaggccgaguuccucaagcuccgccgcgaccucgaggaggccacccuccagcacgaggccauggucgccgcccuccgcaagaagcacgccgacuccgucgccgagcucggcgagcagaucgacaaccuccagcgcgucaagcagaagcucgagaaggagaaguccgaguucaagcucgagaucgacgaccucuccuccuccauggaguccgucuccaaguccaaggccaaccucgagaagaucugccgcacccucgaggaccagcucuccgaggcccgcggcaagaacgaggagauccagcgcucccucuccgagcucaccacccagaagucccgccuccagaccgaggccggcgagcucucccgccagcucgaggagaaggaguccaucgucucccagcucucccgcuccaagcaggccuucacccagcagaccgaggagcucaagcgccagcucgaggaggagaacaaggccaagaacgcccucgcccacgcccuccaguccucccgccacgacugcgaccuccuccgcgagcaguacgaggaggagcaggagggcaaggccgagcuccagcgcgcccucuccaaggccaacuccgaggucgcccaguggcgcaccaaguacgagaccgacgccauccagcgcaccgaggagcucgaggaggccaagaagaagcucgcccagcgccuccaggacuccgaggagcaggucgaggccgucaacgccaagugcgccucccucgagaagaccaagcagcgccuccagggcgaggucgaggaccucauggucgacgucgagcgcgccaacucccucgccgccgcccucgacaagaagcagcgcaacuucgacaagguccucgccgaguggaagaccaagugcgaggagucccaggccgagcucgaggccucccucaaggagucccgcucccucuccaccgagcucuucaagcucaagaacgccuacgaggaggcccucgaccagcucgagaccgucaagcgcgagaacaagaaccucgagcaggagaucgccgaccucaccgagcagaucgccgagaacggcaagaccauccacgagcucgagaagucccgcaagcagaucgagcucgagaaggccgacauccagcucgcccucgaggaggccgaggccgcccucgagcacgaggaggccaagauccuccgcauccagcucgagcucacccaggucaaguccgagaucgaccgcaagaucgccgagaaggacgaggagaucgagcagcucaagcgcaacuaccagcgcaccgucgagaccaugcaguccgcccucgacgccgagguccgcucccgcaacgaggccauccgccucaagaagaagauggagggcgaccucaacgagaucgagauccagcucucccacgccaaccgccaggccgccgagacccucaagcaccuccgcuccguccagggccagcucaaggacacccagcuccaccucgacgacgcccuccgcggccaggaggaccucaaggagcagcucgccaucgucgagcgccgcgccaaccuccuccaggccgaggucgaggagcuccgcgccacccucgagcagaccgagcgcgcccgcaagcucgccgagcaggagcuccucgacuccaacgagcgcguccagcuccuccacacccagaacaccucccucauccacaccaagaagaagcucgagaccgaccucaugcagcuccaguccgaggucgaggacgccucccgcgacgcccgcaacgccgaggagaaggccaagaaggccaucaccgacgccgccaugauggccgaggagcucaagaaggagcaggacaccuccgcccaccucgagcgcaugaagaagaaccucgagcagaccgucaaggaccuccagcaccgccucgacgaggccgagcagcucgcccucaagggcggcaagaagcagauccagaagcucgagacccgcauccgcgagcucgaguucgagcucgagggcgagcagaagaagaacaccgaguccgucaagggccuccgcaaguacgagcgccgcgucaaggagcucaccuaccaguccgaggaggaccgcaagaacguccuccgccuccaggaccucgucgacaagcuccaggucaaggucaaguccuacaagcgccaggccgaggaggccgacgagcaggccaacgcccaccucaccaaguuccgcaaggcccagcacgagcucgaggaggccgaggagcgcgccgacaucgccgagucccaggucaacaagcuccgcgccaagacccgcgacuucaccuccucccgcauggucguccacgaguccgaggaguga

SEQ ID NO: 46331 - RNA, 5820 nt, Artificial Sequence
  derived and/or modified sequence opt2 from MYH4__Homo_sapiens__NP_060003
auguccuccgacuccgagauggccaucuucggcgaggccgcccccuuccuccgcaaguccgagaaggagcgcaucgaggcccagaacaagcccuucgacgccaagaccuccgucuucgucgucgaccccaaggaguccuacgucaaggccaucguccagucccgcgagggcggcaaggucaccgccaagaccgaggccggcgccaccgucaccgucaaggaggaccaggucuucuccaugaacccccccaaguacgacaagaucgaggacauggccaugaugacccaccuccacgagcccgccguccucuacaaccucaaggagcgcuacgccgccuggaugaucuacaccuacuccggccucuucugcgucaccgucaaccccuacaaguggcuccccgucuacaaccccgaggucgucaccgccuaccgcggcaagaagcgccaggaggcccccccccacaucuucuccaucuccgacaacgccuaccaguucaugcucaccgaccgcgagaaccaguccauccucaucaccggcgaguccggcgccggcaagaccgucaacaccaagcgcgucauccaguacuucgccaccaucgccgucaccggcgagaagaagaaggaggagcccgccuccggcaagaugcagggcacccucgaggaccagaucaucuccgccaacccccuccucgaggccuucggcaacgccaagaccguccgcaacgacaacuccucccgcuucggcaaguucauccgcauccacuucggcgccaccggcaagcucgccuccgccgacaucgagaccuaccuccucgagaagucccgcgucaccuuccagcucaaggccgagcgcuccuaccacaucuucuaccagauccucuccaacaagaagcccgagcucaucgagaugcuccucaucaccaccaaccccuacgacuucgccuucgucucccagggcgagaucaccguccccuccaucgacgaccaggaggagcucauggccaccgacuccgccgucgacauccucggcuucaccgccgacgagaaggucgccaucuacaagcucaccggcgccgucaugcacuacggcaacaugaaguucaagcagaagcagcgcgaggagcaggccgagcccgacggcaccgaggucgccgacaaggccgccuaccucaccucccucaacuccgccgaccuccucaagucccucugcuacccccgcgucaaggucggcaacgaguucgucaccaagggccagaccguccagcaggucuacaacgccgucggcgcccucgccaaggccaucuacgagaagauguuccucuggauggucacccgcaucaaccagcagcucgacaccaagcagccccgccaguacuucaucggcguccucgacaucgccggcuucgagaucuucgacuucaacucccucgagcagcucugcaucaacuucaccaacgagaagcuccagcaguucuucaaccaccacauguucguccucgagcaggaggaguacaagaaggagggcaucgagugggaguucaucgacuucggcauggaccucgccgccugcaucgagcucaucgagaagcccaugggcaucuucuccauccucgaggaggagugcauguuccccaaggccaccgacaccuccuucaagaacaagcucuacgagcagcaccucggcaaguccaacaacuuccagaagcccaagcccgccaagggcaagcccgaggcccacuucucccucguccacuacgccggcaccgucgacuacaacaucgccggcuggcucgacaagaacaaggacccccucaacgagaccgucgucggccucuaccagaaguccgccaugaagacccucgccuuccucuucuccggcgcccagaccgccgaggccgagggcggcggcggcaagaagggcggcaagaagaagggcuccuccuuccagaccgucuccgcccucuuccgcgagaaccucaacaagcucaugaccaaccuccgcuccacccacccccacuucguccgcugcaucauccccaacgagaccaagacccccggcgccauggagcacgagcucguccuccaccagcuccgcugcaacggcguccucgagggcauccgcaucugccgcaagggcuuccccucccgcauccucuacgccgacuucaagcagcgcuacaagguccucaacgccuccgccauccccgagggccaguucaucgacuccaagaaggccuccgagaagcuccucggcuccaucgagaucgaccacacccaguacaaguucggccacaccaaggucuucuucaaggccggccuccucggcacccucgaggagaugcgcgacgagaagcucgcccagcucaucacccgcacccaggccaucugccgcggcuuccucaugcgcgucgaguuccgcaagaugauggagcgccgcgaguccaucuucugcauccaguacaacauccgcgccuucaugaacgucaagcacuggcccuggaugaagcucuacuucaagaucaagccccuccucaaguccgccgagaccgagaaggagauggccaacaugaaggaggaguucgagaagaccaaggaggagcucgccaagaccgaggccaagcgcaaggagcucgaggagaagauggucacccucaugcaggagaagaacgaccuccagcuccagguccaggccgaggccgacgcccucgccgacgccgaggagcgcugcgaccagcucaucaagaccaagauccagcucgaggccaagaucaaggaggucaccgagcgcgccgaggacgaggaggagaucaacgccgagcucaccgccaagaagcgcaagcucgaggacgagugcuccgagcucaagaaggacaucgacgaccucgagcucacccucgccaaggucgagaaggagaagcacgccaccgagaacaaggucaagaaccucaccgaggagauggccggccucgacgagaccaucgccaagcucaccaaggagaagaaggcccuccaggaggcccaccagcagacccucgacgaccuccagauggaggaggacaaggucaacacccucaccaaggccaagaccaagcucgagcagcaggucgacgaccucgagggcucccucgagcaggagaagaagcucugcauggaccucgagcgcgccaagcgcaagcucgagggcgaccucaagcucgcccaggaguccaccauggacaccgagaacgacaagcagcagcucaacgagaagcucaagaagaaggaguucgagauguccaaccuccagggcaagaucgaggacgagcaggcccucgccauccagcuccagaagaagaucaaggagcuccaggcccgcaucgaggagcucgaggaggagaucgaggccgagcgcgccucccgcgccaaggccgagaagcagcgcuccgaccucucccgcgagcucgaggagaucuccgagcgccucgaggaggccggcggcgccaccuccgcccagaucgagaugaacaagaagcgcgaggccgaguuccagaagaugcgccgcgaccucgaggaguccacccuccagcacgaggccaccgccgccgcccuccgcaagaagcacgccgacuccgucgccgagcucggcgagcagaucgacucccuccagcgcgucaagcagaagcucgagaaggagaaguccgagcucaagauggagaucaacgaccucgccuccaacauggagaccgucuccaaggccaaggccaacuucgagaagaugugccgcacccucgaggaccagcucuccgagaucaagaccaaggaggaggagcagcagcgccucaucaacgagcucuccgcccagaaggcccgccuccacaccgaguccggcgaguucucccgccagcucgacgagaaggacgccauggucucccagcucucccgcggcaagcaggccuucacccagcagaucgaggagcucaagcgccagcucgaggaggagaccaaggccaaguccacccucgcccacgcccuccaguccgcccgccacgacugcgaccuccuccgcgagcaguacgaggaggagcaggaggccaaggccgagcuccagcgcggcauguccaaggccaacuccgaggucgcccaguggcgcaccaaguacgagaccgacgccauccagcgcaccgaggagcucgaggaggccaagaagaagcucgcccagcgccuccaggacgccgaggagcacgucgaggccgucaacuccaagugcgccucccucgagaagaccaagcagcgccuccagaacgaggucgaggaccucaugaucgacgucgagcgcuccaacgccgccugcaucgcccucgacaagaagcagcgcaacuucgacaagguccucgccgaguggaagcagaaguacgaggagacccaggccgagcucgaggccucccagaaggagucccgcucccucuccaccgagcucuucaaggucaagaacgccuacgaggagucccucgaccaccucgagacccucaagcgcgagaacaagaaccuccagcaggagaucuccgaccucaccgagcagaucgccgagggcggcaagcacauccacgagcucgagaaggucaagaagcagcucgaccacgagaaguccgagcuccagaccucccucgaggaggccgaggccucccucgagcacgaggagggcaagauccuccgcauccagcucgagcucaaccaggucaaguccgagaucgaccgcaagaucgccgagaaggacgaggagcucgaccagcucaagcgcaaccaccuccgcgucgucgaguccaugcaguccacccucgacgccgagauccgcucccgcaacgacgcccuccgcaucaagaagaagauggagggcgaccucaacgagauggagauccagcucaaccacgccaaccgccaggccgccgaggcccuccgcaaccuccgcaacacccagggcauccucaaggacacccagcuccaccucgacgacgccauccgcggccaggacgaccucaaggagcagcucgccauggucgagcgccgcgccaaccucaugcaggccgaggucgaggagcuccgcgccucccucgagcgcaccgagcgcggccgcaagauggccgagcaggagcuccucgacgccuccgagcgcguccagcuccuccacacccagaacaccucccucaucaacaccaagaagaagcucgagaccgacaucucccagauccagggcgagauggaggacaucguccaggaggcccgcaacgccgaggagaaggccaagaaggccaucaccgacgccgccaugauggccgaggagcucaagaaggagcaggacaccuccgcccaccucgagcgcaugaagaagaacauggagcagaccgucaaggaccuccagcuccgccucgacgaggccgagcagcucgcccucaagggcggcaagaagcagauccagaagcucgaggcccgcguccgcgagcucgaguccgaggucgaguccgagcagaagcacaacgucgaggccgucaagggccuccgcaagcacgagcgccgcgucaaggagcucaccuaccagaccgaggaggaccgcaagaacauccuccgccuccaggaccucgucgacaagcuccagaccaaggucaaggccuacaagcgccaggccgaggaggccgaggagcaguccaacgucaaccucgccaaguuccgcaagcuccagcacgagcucgaggaggccaaggagcgcgccgacaucgccgagucccaggucaacaagcuccgcgucaagucccgcgagguccacaccaaggucaucuccgaggaguga

SEQ ID NO: 46332 - RNA, 5820 nt, Artificial Sequence
  derived and/or modified sequence opt2 from MYH6__Homo_sapiens__NP_002462
augaccgacgcccagauggccgacuucggcgccgccgcccaguaccuccgcaaguccgagaaggagcgccucgaggcccagacccgccccuucgacauccgcaccgagugcuucguccccgacgacaaggaggaguucgucaaggccaagauccucucccgcgagggcggcaaggucaucgccgagaccgagaacggcaagaccgucaccgucaaggaggaccagguccuccagcagaacccccccaaguucgacaagaucgaggacauggccaugcucaccuuccuccacgagcccgccguccucuucaaccucaaggagcgcuacgccgccuggaugaucuacaccuacuccggccucuucugcgucaccgucaaccccuacaaguggcuccccgucuacaacgccgaggucgucgccgccuaccgcggcaagaagcgcuccgaggcccccccccacaucuucuccaucuccgacaacgccuaccaguacaugcucaccgaccgcgagaaccaguccauccucaucaccggcgaguccggcgccggcaagaccgucaacaccaagcgcgucauccaguacuucgccuccaucgccgccaucggcgaccgcggcaagaaggacaacgccaacgccaacaagggcacccucgaggaccagaucauccaggccaaccccgcccucgaggccuucggcaacgccaagaccguccgcaacgacaacuccucccgcuucggcaaguucauccgcauccacuucggcgccaccggcaagcucgccuccgccgacaucgagaccuaccuccucgagaagucccgcgucaucuuccagcucaaggccgagcgcaacuaccacaucuucuaccagauccucuccaacaagaagcccgagcuccucgacaugcuccucgucaccaacaaccccuacgacuacgccuucgucucccagggcgaggucuccgucgccuccaucgacgacuccgaggagcucauggccaccgacuccgccuucgacguccucggcuucaccuccgaggagaaggccggcgucuacaagcucaccggcgccaucaugcacuacggcaacaugaaguucaagcagaagcagcgcgaggagcaggccgagcccgacggcaccgaggacgccgacaaguccgccuaccucaugggccucaacuccgccgaccuccucaagggccucugccacccccgcgucaaggucggcaacgaguacgucaccaagggccaguccguccagcaggucuacuacuccaucggcgcccucgccaaggccgucuacgagaagauguucaacuggauggucacccgcaucaacgccacccucgagaccaagcagccccgccaguacuucaucggcguccucgacaucgccggcuucgagaucuucgacuucaacuccuucgagcagcucugcaucaacuucaccaacgagaagcuccagcaguucuucaaccaccacauguucguccucgagcaggaggaguacaagaaggagggcaucgaguggaccuucaucgacuucggcauggaccuccaggccugcaucgaccucaucgagaagcccaugggcaucauguccauccucgaggaggagugcauguuccccaaggccaccgacaugaccuucaaggccaagcucuacgacaaccaccucggcaaguccaacaacuuccagaagccccgcaacaucaagggcaagcaggaggcccacuucucccucauccacuacgccggcaccgucgacuacaacauccucggcuggcucgagaagaacaaggacccccucaacgagaccgucgucgcccucuaccagaaguccucccucaagcucauggccacccucuucuccuccuacgccaccgccgacaccggcgacuccggcaaguccaagggcggcaagaagaagggcuccuccuuccagaccgucuccgcccuccaccgcgagaaccucaacaagcucaugaccaaccuccgcaccacccacccccacuucguccgcugcaucauccccaacgagcgcaaggcccccggcgucauggacaacccccucgucaugcaccagcuccgcugcaacggcguccucgagggcauccgcaucugccgcaagggcuuccccaaccgcauccucuacggcgacuuccgccagcgcuaccgcauccucaaccccgucgccauccccgagggccaguucaucgacucccgcaagggcaccgagaagcuccucuccucccucgacaucgaccacaaccaguacaaguucggccacaccaaggucuucuucaaggccggccuccucggccuccucgaggagaugcgcgacgagcgccucucccgcaucaucacccgcaugcaggcccaggcccgcggccagcucaugcgcaucgaguucaagaagaucgucgagcgccgcgacgcccuccucgucauccaguggaacauccgcgccuucaugggcgucaagaacuggcccuggaugaagcucuacuucaagaucaagccccuccucaaguccgccgagaccgagaaggagauggccaccaugaaggaggaguucggccgcaucaaggagacccucgagaaguccgaggcccgccgcaaggagcucgaggagaagauggucucccuccuccaggagaagaacgaccuccagcuccagguccaggccgagcaggacaaccucaacgacgccgaggagcgcugcgaccagcucaucaagaacaagauccagcucgaggccaaggucaaggagaugaacgagcgccucgaggacgaggaggagaugaacgccgagcucaccgccaagaagcgcaagcucgaggacgagugcuccgagcucaagaaggacaucgacgaccucgagcucacccucgccaaggucgagaaggagaagcacgccaccgagaacaaggucaagaaccucaccgaggagauggccggccucgacgagaucaucgccaagcucaccaaggagaagaaggcccuccaggaggcccaccagcaggcccucgacgaccuccaggucgaggaggacaaggucaacucccucuccaaguccaaggucaagcucgagcagcaggucgacgaccucgagggcucccucgagcaggagaagaagguccgcauggaccucgagcgcgccaagcgcaagcucgagggcgaccucaagcucacccaggaguccaucauggaccucgagaacgacaagcuccagcucgaggagaagcucaagaagaaggaguucgacaucaaccagcagaacuccaagaucgaggacgagcagguccucgcccuccagcuccagaagaagcucaaggagaaccaggcccgcaucgaggagcucgaggaggagcucgaggccgagcgcaccgcccgcgccaaggucgagaagcuccgcuccgaccucucccgcgagcucgaggagaucuccgagcgccucgaggaggccggcggcgccaccuccguccagaucgagaugaacaagaagcgcgaggccgaguuccagaagaugcgccgcgaccucgaggaggccacccuccagcacgaggccaccgccgccgcccuccgcaagaagcacgccgacuccgucgccgagcucggcgagcagaucgacaaccuccagcgcgucaagcagaagcucgagaaggagaaguccgaguucaagcucgagcucgacgacgucaccuccaacauggagcagaucaucaaggccaaggccaaccucgagaaggucucccgcacccucgaggaccaggccaacgaguaccgcgucaagcucgaggaggcccagcgcucccucaacgacuucaccacccagcgcgccaagcuccagaccgagaacggcgagcucgcccgccagcucgaggagaaggaggcccucaucucccagcucacccgcggcaagcucuccuacacccagcagauggaggaccucaagcgccagcucgaggaggagggcaaggccaagaacgcccucgcccacgcccuccaguccgcccgccacgacugcgaccuccuccgcgagcaguacgaggaggagaccgaggccaaggccgagcuccagcgcguccucuccaaggccaacuccgaggucgcccaguggcgcaccaaguacgagaccgacgccauccagcgcaccgaggagcucgaggaggccaagaagaagcucgcccagcgccuccaggacgccgaggaggccgucgaggccgucaacgccaagugcuccucccucgagaagaccaagcaccgccuccagaacgagaucgaggaccucauggucgacgucgagcgcuccaacgccgccgccgccgcccucgacaagaagcagcgcaacuucgacaagauccucgccgaguggaagcagaaguacgaggagucccaguccgagcucgaguccucccagaaggaggcccgcucccucuccaccgagcucuucaagcucaagaacgccuacgaggagucccucgagcaccucgagaccuucaagcgcgagaacaagaaccuccaggaggagaucuccgaccucaccgagcagcucggcgagggcggcaagaacguccacgagcucgagaagguccgcaagcagcucgaggucgagaagcucgagcuccaguccgcccucgaggaggccgaggccucccucgagcacgaggagggcaagauccuccgcgcccagcucgaguucaaccagaucaaggccgagaucgagcgcaagcucgccgagaaggacgaggagauggagcaggccaagcgcaaccaccagcgcgucgucgacucccuccagaccucccucgacgccgagacccgcucccgcaacgagguccuccgcgucaagaagaagauggagggcgaccucaacgagauggagauccagcucucccacgccaaccgcauggccgccgaggcccagaagcaggucaagucccuccagucccuccucaaggacacccagauccagcucgacgacgccguccgcgccaacgacgaccucaaggagaacaucgccaucgucgagcgccgcaacaaccuccuccaggccgagcucgaggagcuccgcgccgucgucgagcagaccgagcgcucccgcaagcucgccgagcaggagcucaucgagaccuccgagcgcguccagcuccuccacucccagaacaccucccucaucaaccagaagaagaagauggaguccgaccucacccagcuccaguccgaggucgaggaggccguccaggagugccgcaacgccgaggagaaggccaagaaggccaucaccgacgccgccaugauggccgaggagcucaagaaggagcaggacaccuccgcccaccucgagcgcaugaagaagaacauggagcagaccaucaaggaccuccagcaccgccucgacgaggccgagcagaucgcccucaagggcggcaagaagcagcuccagaagcucgaggcccgcguccgcgagcucgagggcgagcucgaggccgagcagaagcgcaacgccgaguccgucaagggcaugcgcaaguccgagcgccgcaucaaggagcucaccuaccagaccgaggaggacaagaagaaccuccuccgccuccaggaccucgucgacaagcuccagcucaaggucaaggccuacaagcgccaggccgaggaggccgaggagcaggccaacaccaaccucuccaaguuccgcaagguccagcacgagcucgacgaggccgaggagcgcgccgacaucgccgagucccaggucaacaagcuccgcgccaagucccgcgacaucggcgccaagcagaagaugcacgacgaggaguga

SEQ ID NO: 46333 - RNA, 5952 nt, Artificial Sequence
  derived and/or modified sequence opt2 from MYH7B__Homo_sapiens__NP_065935
auguccggcaacaagcgcggcucccgcgccuccugcccccaccgcggcgccgagugccuccuccccugggccgcccucaaccuccagggcuuccagcuccuccuccuccaccccuccgccaccgccaugauggacgucuccgagcucggcgaguccgcccgcuaccuccgccagggcuaccaggagaugaccaagguccacaccauccccugggacggcaagaagcgcgucuggguccccgacgagcaggacgccuacgucgaggccgaggucaaguccgaggccaccggcggccgcgucaccgucgagaccaaggaccagaagguccucaugguccgcgaggccgagcuccagcccaugaaccccccccgcuucgaccuccucgaggacauggccaugaugacccaccucaacgaggccuccguccuccacaaccuccgccagcgcuacgcccgcuggaugaucuacaccuacuccggccucuucugcgucaccaucaaccccuacaaguggcuccccgucuacaccgccuccgucgucgccgccuacaagggcaagcgccgcuccgacucccccccccacaucuacgccgucgccgacaacgccuacaacgacaugcuccgcaaccgcgacaaccaguccaugcucaucaccggcgaguccggcgccggcaagaccgucaacaccaagcgcgucauccaguacuucgccaucgucgccgcccucggcgacggccccggcaagaaggcccaguuccucgccaccaagaccggcggcacccucgaggaccagaucaucgaggccaaccccgccauggaggccuucggcaacgccaagacccuccgcaacgacaacuccucccgcuucggcaaguucauccgcauccacuucggccccuccggcaagcucgccuccgccgacaucgacuccuaccuccucgagaagucccgcgucaucuuccagcuccccggcgagcgcuccuaccacgucuacuaccagauccucuccggccgcaagcccgagcuccaggacaugcuccuccucuccaugaaccccuacgacuaccacuucugcucccagggcgucaucaccgucgacaacaugaacgacggcgaggagcucaucgccaccgaccacgccauggacauccucggcuucuccgucgacgagaagugcgccugcuacaagaucgucggcgcccuccuccacuucggcaacaugaaguucaagcagaagcagcgcgaggagcaggccgaggccgacggcaccgaguccgccgacaaggccgccuaccucaugggcgucuccuccggcgaccuccucaagggccuccuccacccccgcguccgcgucggcaacgaguacgucaccaagggccaguccgucgagcaggucgucuucgccgucggcgcccucgccaaggccaccuacgaccgccucuuccgcuggcucgucucccgcaucaaccagacccucgacaccaagcucccccgccaguucuucaucggcguccucgacaucgccggcuucgagaucuucgaguucaacuccuucgagcagcucugcaucaacuucaccaacgagaagcuccagcaguucuucaaccagcacauguucguccucgagcaggaggaguacaagcgcgagggcaucgacugggucuucaucgacuucggccucgaccuccagcccugcaucgaccucaucgagaagccccucggcauccucuccauccucgaggaggagugcauguuccccaaggccuccgacgccuccuuccgcgccaagcucuacgacaaccacgccggcaagucccccaacuuccagcagccccgccccgacaagaagcgcaaguaccaggcccacuucgaggucguccacuacgccggcgucguccccuacuccaucgucggcuggcucgagaagaacaaggacccccucaacgagaccgucguccccaucuuccagaagucccagaaccgccuccucgccacccucuacgagaacuacgccggcuccugcuccaccgagccccccaaguccggcgucaaggagaagcgcaagaaggccgccuccuuccagaccgucucccagcuccacaaggagaaccucaacaagcucaugaccaaccuccgcgccacccagccccacuucguccgcugcaucguccccaacgagaacaagacccccggcgucauggacgccuuccucguccuccaccagcuccgcugcaacggcguccucgagggcauccgcaucugccgccagggcuuccccaaccgccuccucuacaccgacuuccgccagcgcuaccgcauccucaaccccuccgccauccccgacgacaccuucauggacucccgcaaggccaccgagaagcuccucggcucccucgaccucgaccacacccaguaccaguucggccacaccaaggucuucuucaaggccggccuccucggcguccucgaggagcuccgcgaccagcgccucgccaagguccucacccuccuccaggcccgcucccgcggccgccucaugcgccucgaguaccagcgccuccucggcggccgcgacgcccucuucaccauccaguggaacauccgcgccuucaacgccgucaagaacugguccuggaugaagcucuucuucaagaugaagccccuccuccgcuccgcccaggccgaggaggagcucgccgcccuccgcgccgagcuccgcggccuccgcggcgcccucgccgccgccgaggccaagcgccaggagcucgaggagacccacgucuccaucacccaggagaagaacgaccucgcccuccagcuccaggccgagcaggacaaccucgccgacgccgaggagcgcugccaccuccucaucaaguccaagguccagcucgagggcaaggucaaggagcucuccgagcgccucgaggacgaggaggaggucaacgccgaccucgccgcccgccgccgcaagcucgaggacgagugcaccgagcucaagaaggacaucgacgaccucgagcucacccucgccaaggccgagaaggagaagcaggccaccgagaacaaggucaagaaccucaccgaggagauggccgcccucgacgaguccgucgcccgccucaccaaggagaagaaggcccuccaggaggcccaccagcaggcccucggcgaccuccaggccgaggaggaccgcgucuccgcccucaccaaggccaagcuccgccucgagcagcaggucgaggaccucgagugcucccucgagcaggagaagaagcuccgcauggacaccgagcgcgccaagcgcaagcucgagggcgaccucaagcucacccaggaguccgucgccgacgccgcccaggacaagcagcagcucgaggagaagcucaagaagaaggacuccgagcucucccagcucucccuccgcgucgaggacgagcagcuccucggcgcccagaugcagaagaagaucaaggagcuccaggcccgcgccgaggagcucgaggaggagcucgaggccgagcgcgccgcccgcgcccgcgucgagaagcagcgcgccgaggccgcccgcgagcucgaggagcucuccgagcgccucgaggaggccggcggcgccuccgccggccagcgcgagggcugccgcaagcgcgaggccgagcucggccgccuccgccgcgagcucgaggaggccgcccuccgccacgaggccaccgucgccgcccuccgccgcaagcaggccgagggcgccgccgagcucggcgagcaggucgacucccuccagcgcguccgccagaagcucgagaaggagaaguccgagcuccgcauggaggucgacgaccucgccgccaacgucgagacccucacccgcgccaaggccuccgccgagaagcucugccgcaccuacgaggaccagcucuccgaggccaagaucaaggucgaggagcuccagcgccagcucgccgacgccuccacccagcgcggccgccuccagaccgaguccggcgagcucucccgccuccucgaggagaaggagugccucaucucccagcucucccgcggcaaggcccucgccgcccagucccucgaggagcuccgccgccagcucgaggaggaguccaaggccaaguccgcccucgcccacgccguccaggcccuccgccacgacugcgaccuccuccgcgagcagcacgaggaggaggccgaggcccaggccgagcuccagcgccuccucuccaaggccaacgccgaggucgcccaguggcgcuccaaguacgaggccgacgccauccagcgcaccgaggagcucgaggaggccaagaagaagcucgcccuccgccuccaggaggccgaggagggcgucgaggccgccaacgccaagugcuccucccucgagaaggccaagcuccgccuccagaccgaguccgaggacgucacccucgagcucgagcgcgccaccuccgccgccgccgcccucgacaagaagcagcgccaccucgagcgcgcccucgaggagcgccgccgccaggaggaggagaugcagcgcgagcucgaggccgcccagcgcgagucccgcggccucggcaccgagcucuuccgccuccgccacggccacgaggaggcccucgaggcccucgagacccucaagcgcgagaacaagaaccuccaggaggagaucuccgaccucaccgaccaggucucccucuccggcaaguccauccaggagcucgagaagaccaagaaggcccucgagggcgagaaguccgagauccaggccgcccucgaggaggccgagggcgcccucgagcucgaggagaccaagacccuccgcauccagcucgagcucucccaggucaaggccgaggucgaccgcaagcucgccgagaaggacgaggagugcgccaaccuccgccgcaaccaccagcgcgccgucgagucccuccaggccucccucgacgccgagacccgcgcccgcaacgaggcccuccgccucaagaagaagauggagggcgaccucaacgaccucgagcuccagcucggccacgccacccgccaggccaccgaggcccaggccgccacccgccucaugcaggcccagcucaaggaggagcaggccggccgcgacgaggagcagcgccucgccgccgagcuccacgagcaggcccaggcccucgagcgccgcgccucccuccucgccgccgagcucgaggagcuccgcgccgcccucgagcagggcgagcgcucccgccgccucgccgagcaggagcuccucgaggccaccgagcgccucaaccuccuccacucccagaacaccggccuccucaaccagaagaagaagcucgaggccgaccucgcccagcucuccggcgaggucgaggaggccgcccaggagcgccgcgaggccgaggagaaggccaagaaggccaucaccgacgccgccaugauggccgaggagcucaagaaggagcaggacaccuccgcccaccucgagcgcaugaagaagacccucgagcagaccguccgcgagcuccaggcccgccucgaggaggccgagcaggccgcccuccgcggcggcaagaagcagguccagaagcucgaggccaagguccgcgagcucgaggccgagcucgacgccgagcagaagaagcacgccgaggcccucaagggcguccgcaagcacgagcgccgcgucaaggagcucgccuaccaggccgaggaggaccgcaagaaccucgcccgcaugcaggaccucgucgacaagcuccaguccaaggucaaguccuacaagcgccaguucgaggaggccgagcagcaggccaacaccaaccucgccaaguaccgcaaggcccagcacgagcucgacgacgccgaggagcgcgccgacauggccgagacccaggccaacaagcuccgcgcccgcacccgcgacgcccucggccccaagcacaaggaguga

SEQ ID NO: 46334 - RNA, 5808 nt, Artificial Sequence
  derived and/or modified sequence opt2 from MYH7__Homo_sapiens__NP_000248
augggcgacuccgagauggccgucuucggcgccgccgcccccuaccuccgcaaguccgagaaggagcgccucgaggcccagacccgccccuucgaccucaagaaggacgucuucguccccgacgacaagcaggaguucgucaaggccaagaucgucucccgcgagggcggcaaggucaccgccgagaccgaguacggcaagaccgucaccgucaaggaggaccaggucaugcagcagaacccccccaaguucgacaagaucgaggacauggccaugcucaccuuccuccacgagcccgccguccucuacaaccucaaggaccgcuacggcuccuggaugaucuacaccuacuccggccucuucugcgucaccgucaaccccuacaaguggcuccccgucuacacccccgaggucgucgccgccuaccgcggcaagaagcgcuccgaggcccccccccacaucuucuccaucuccgacaacgccuaccaguacaugcucaccgaccgcgagaaccaguccauccucaucaccggcgaguccggcgccggcaagaccgucaacaccaagcgcgucauccaguacuucgccgucaucgccgccaucggcgaccgcuccaagaaggaccagucccccggcaagggcacccucgaggaccagaucauccaggccaaccccgcccucgaggccuucggcaacgccaagaccguccgcaacgacaacuccucccgcuucggcaaguucauccgcauccacuucggcgccaccggcaagcucgccuccgccgacaucgagaccuaccuccucgagaagucccgcgucaucuuccagcucaaggccgagcgcgacuaccacaucuucuaccagauccucuccaacaagaagcccgagcuccucgacaugcuccucaucaccaacaaccccuacgacuacgccuucaucucccagggcgagaccaccgucgccuccaucgacgacgccgaggagcucauggccaccgacaacgccuucgacguccucggcuucaccuccgaggagaagaacuccauguacaagcucaccggcgccaucaugcacuucggcaacaugaaguucaagcucaagcagcgcgaggagcaggccgagcccgacggcaccgaggaggccgacaaguccgccuaccucaugggccucaacuccgccgaccuccucaagggccucugccacccccgcgucaaggucggcaacgaguacgucaccaagggccagaacguccagcaggucaucuacgccaccggcgcccucgccaaggccgucuacgagcgcauguucaacuggauggucacccgcaucaacgccacccucgagaccaagcagccccgccaguacuucaucggcguccucgacaucgccggcuucgagaucuucgacuucaacuccuucgagcagcucugcaucaacuucaccaacgagaagcuccagcaguucuucaaccaccacauguucguccucgagcaggaggaguacaagaaggagggcaucgaguggaccuucaucgacuucggcauggaccuccaggccugcaucgaccucaucgagaagcccaugggcaucauguccauccucgaggaggagugcauguuccccaaggccaccgacaugaccuucaaggccaagcucuucgacaaccaccucggcaaguccgccaacuuccagaagccccgcaacaucaagggcaagcccgaggcccacuucucccucauccacuacgccggcaucgucgacuacaacaucaucggcuggcuccagaagaacaaggacccccucaacgagaccgucgucggccucuaccagaaguccucccucaagcuccucuccacccucuucgccaacuacgccggcgccgacgcccccaucgagaagggcaagggcaaggccaagaagggcuccuccuuccagaccgucuccgcccuccaccgcgagaaccucaacaagcucaugaccaaccuccgcuccacccacccccacuucguccgcugcaucauccccaacgagaccaagucccccggcgucauggacaacccccucgucaugcaccagcuccgcugcaacggcguccucgagggcauccgcaucugccgcaagggcuuccccaaccgcauccucuacggcgacuuccgccagcgcuaccgcauccucaaccccgccgccauccccgagggccaguucaucgacucccgcaagggcgccgagaagcuccucuccucccucgacaucgaccacaaccaguacaaguucggccacaccaaggucuucuucaaggccggccuccucggccuccucgaggagaugcgcgacgagcgccucucccgcaucaucacccgcauccaggcccagucccgcggcguccucgcccgcauggaguacaagaagcuccucgagcgccgcgacucccuccucgucauccaguggaacauccgcgccuucaugggcgucaagaacuggcccuggaugaagcucuacuucaagaucaagccccuccucaaguccgccgagcgcgagaaggagauggccuccaugaaggaggaguucacccgccucaaggaggcccucgagaaguccgaggcccgccgcaaggagcucgaggagaagauggucucccuccuccaggagaagaacgaccuccagcuccagguccaggccgagcaggacaaccucgccgacgccgaggagcgcugcgaccagcucaucaagaacaagauccagcucgaggccaaggucaaggagaugaacgagcgccucgaggacgaggaggagaugaacgccgagcucaccgccaagaagcgcaagcucgaggacgagugcuccgagcucaagcgcgacaucgacgaccucgagcucacccucgccaaggucgagaaggagaagcacgccaccgagaacaaggucaagaaccucaccgaggagauggccggccucgacgagaucaucgccaagcucaccaaggagaagaaggcccuccaggaggcccaccagcaggcccucgacgaccuccaggccgaggaggacaaggucaacacccucaccaaggccaaggucaagcucgagcagcaggucgacgaccucgagggcucccucgagcaggagaagaagguccgcauggaccucgagcgcgccaagcgcaagcucgagggcgaccucaagcucacccaggaguccaucauggaccucgagaacgacaagcagcagcucgacgagcgccucaagaagaaggacuucgagcucaacgcccucaacgcccgcaucgaggacgagcaggcccucggcucccagcuccagaagaagcucaaggagcuccaggcccgcaucgaggagcucgaggaggagcucgaggccgagcgcaccgcccgcgccaaggucgagaagcuccgcuccgaccucucccgcgagcucgaggagaucuccgagcgccucgaggaggccggcggcgccaccuccguccagaucgagaugaacaagaagcgcgaggccgaguuccagaagaugcgccgcgaccucgaggaggccacccuccagcacgaggccaccgccgccgcccuccgcaagaagcacgccgacuccgucgccgagcucggcgagcagaucgacaaccuccagcgcgucaagcagaagcucgagaaggagaaguccgaguucaagcucgagcucgacgacgucaccuccaacauggagcagaucaucaaggccaaggccaaccucgagaagaugugccgcacccucgaggaccagaugaacgagcaccgcuccaaggccgaggagacccagcgcuccgucaacgaccucaccucccagcgcgccaagcuccagaccgagaacggcgagcucucccgccagcucgacgagaaggaggcccucaucucccagcucacccgcggcaagcucaccuacacccagcagcucgaggaccucaagcgccagcucgaggaggaggucaaggccaagaacgcccucgcccacgcccuccaguccgcccgccacgacugcgaccuccuccgcgagcaguacgaggaggagaccgaggccaaggccgagcuccagcgcguccucuccaaggccaacuccgaggucgcccaguggcgcaccaaguacgagaccgacgccauccagcgcaccgaggagcucgaggaggccaagaagaagcucgcccagcgccuccaggaggccgaggaggccgucgaggccgucaacgccaagugcuccucccucgagaagaccaagcaccgccuccagaacgagaucgaggaccucauggucgacgucgagcgcuccaacgccgccgccgccgcccucgacaagaagcagcgcaacuucgacaagauccucgccgaguggaagcagaaguacgaggagucccaguccgagcucgaguccucccagaaggaggcccgcucccucuccaccgagcucuucaagcucaagaacgccuacgaggagucccucgagcaccucgagaccuucaagcgcgagaacaagaaccuccaggaggagaucuccgaccucaccgagcagcucggcuccuccggcaagaccauccacgagcucgagaagguccgcaagcagcucgaggccgagaagauggagcuccaguccgcccucgaggaggccgaggccucccucgagcacgaggagggcaagauccuccgcgcccagcucgaguucaaccagaucaaggccgagaucgagcgcaagcucgccgagaaggacgaggagauggagcaggccaagcgcaaccaccuccgcgucgucgacucccuccagaccucccucgacgccgagacccgcucccgcaacgaggcccuccgcgucaagaagaagauggagggcgaccucaacgagauggagauccagcucucccacgccaaccgcauggccgccgaggcccagaagcaggucaagucccuccagucccuccucaaggacacccagauccagcucgacgacgccguccgcgccaacgacgaccucaaggagaacaucgccaucgucgagcgccgcaacaaccuccuccaggccgagcucgaggagcuccgcgccgucgucgagcagaccgagcgcucccgcaagcucgccgagcaggagcucaucgagaccuccgagcgcguccagcuccuccacucccagaacaccucccucaucaaccagaagaagaagauggacgccgaccucucccagcuccagaccgaggucgaggaggccguccaggagugccgcaacgccgaggagaaggccaagaaggccaucaccgacgccgccaugauggccgaggagcucaagaaggagcaggacaccuccgcccaccucgagcgcaugaagaagaacauggagcagaccaucaaggaccuccagcaccgccucgacgaggccgagcagaucgcccucaagggcggcaagaagcagcuccagaagcucgaggcccgcguccgcgagcucgagaacgagcucgaggccgagcagaagcgcaacgccgaguccgucaagggcaugcgcaaguccgagcgccgcaucaaggagcucaccuaccagaccgaggaggaccgcaagaaccuccuccgccuccaggaccucgucgacaagcuccagcucaaggucaaggccuacaagcgccaggccgaggaggccgaggagcaggccaacaccaaccucuccaaguuccgcaagguccagcacgagcucgacgaggccgaggagcgcgccgacaucgccgagucccaggucaacaagcuccgcgccaagucccgcgacaucggcaccaagggccucaacgaggaguga

SEQ ID NO: 46335 - RNA, 5814 nt, Artificial Sequence
  derived and/or modified sequence opt2 from MYH8__Homo_sapiens__NP_002463
auguccgccuccuccgacgccgagauggccgucuucggcgaggccgcccccuaccuccgcaaguccgagaaggagcgcaucgaggcccagaacaagcccuucgacgccaagaccuccgucuucgucgccgagcccaaggaguccuacgucaaguccaccauccaguccaaggagggcggcaaggucaccgucaagaccgagggcggcgccacccucaccguccgcgaggaccaggucuuccccaugaacccccccaaguacgacaagaucgaggacauggccaugaugacccaccuccacgagcccggcguccucuacaaccucaaggagcgcuacgccgccuggaugaucuacaccuacuccggccucuucugcgucaccgucaaccccuacaaguggcuccccgucuacaagcccgaggucgucgccgccuaccgcggcaagaagcgccaggaggcccccccccacaucuucuccaucuccgacaacgccuaccaguucaugcucaccgaccgcgagaaccaguccauccucaucaccggcgaguccggcgccggcaagaccgucaacaccaagcgcgucauccaguacuucgccaccaucgccgucaccggcgagaagaagaaggacgaguccggcaagaugcagggcacccucgaggaccagaucaucuccgccaacccccuccucgaggccuucggcaacgccaagaccguccgcaacgacaacuccucccgcuucggcaaguucauccgcauccacuucggcaccaccggcaagcucgccuccgccgacaucgagaccuaccuccucgagaagucccgcgucaccuuccagcucaaggccgagcgcuccuaccacaucuucuaccagaucaccuccaacaagaagcccgaccucaucgagaugcuccucaucaccaccaaccccuacgacuacgccuucgucucccagggcgagaucaccguccccuccaucgacgaccaggaggagcucauggccaccgacuccgccaucgacauccucggcuucacccccgaggagaaggucuccaucuacaagcucaccggcgccgucaugcacuacggcaacaugaaguucaagcagaagcagcgcgaggagcaggccgagcccgacggcaccgaggucgccgacaaggccgccuaccuccagucccucaacuccgccgaccuccucaaggcccucugcuacccccgcgucaaggucggcaacgaguacgucaccaagggccagaccguccagcaggucuacaacgccgucggcgcccucgccaaggccgucuacgagaagauguuccucuggauggucacccgcaucaaccagcagcucgacaccaagcagccccgccaguacuucaucggcguccucgacaucgccggcuucgagaucuucgacuucaacucccucgagcagcucugcaucaacuucaccaacgagaagcuccagcaguucuucaaccaccacauguucguccucgagcaggaggaguacaagaaggagggcaucgaguggaccuucaucgacuucggcauggaccucgccgccugcaucgagcucaucgagaagccccucggcaucuucuccauccucgaggaggagugcauguuccccaaggccaccgacaccuccuucaagaacaagcucuacgaccagcaccucggcaaguccgccaacuuccagaagcccaaggucgucaagggcaaggccgaggcccacuucucccucauccacuacgccggcaccgucgacuacaacaucaccggcuggcucgacaagaacaaggacccccucaacgacaccgucgucggccucuaccagaaguccgccaugaagacccucgccucccucuucuccaccuacgccuccgccgaggccgacuccuccgccaagaagggcgccaagaagaagggcuccuccuuccagaccgucuccgcccucuuccgcgagaaccucaacaagcucaugaccaaccuccgcuccacccacccccacuucguccgcugcaucauccccaacgagaccaagacccccggcgccauggagcacgagcucguccuccaccagcuccgcugcaacggcguccucgagggcauccgcaucugccgcaagggcuuccccucccgcauccucuacggcgacuucaagcagcgcuacaagguccucaacgccuccgccauccccgagggccaguucaucgacuccaagaaggccuccgagaagcuccucgccuccaucgacaucgaccacacccaguacaaguucggccacaccaaggucuucuucaaggccggccuccucggccuccucgaggagaugcgcgacgagaagcucgcccagaucaucacccgcacccaggccgucugccgcggcuuccucaugcgcgucgaguaccagaagaugcuccagcgccgcgaggcccucuucugcauccaguacaacguccgcgccuucaugaacgucaagcacuggcccuggaugaagcucuucuucaagaucaagccccuccucaaguccgccgagaccgagaaggagauggccaccaugaaggaggaguuccagaagaccaaggacgagcucgccaaguccgaggccaagcgcaaggagcucgaggagaagauggucacccuccucaaggagaagaacgaccuccagcuccagguccaguccgaggccgacucccucgccgacgccgaggagcgcugcgagcagcucaucaagaacaagauccagcucgaggccaagaucaaggaggucaccgagcgcgccgaggaggaggaggagaucaacgccgagcucaccgccaagaagcgcaagcucgaggacgagugcuccgagcucaagaaggacaucgacgaccucgagcucacccucgccaaggucgagaaggagaagcacgccaccgagaacaaggucaagaaccucaccgaggagauggccggccucgacgagaccaucgccaagcucuccaaggagaagaaggcccuccaggagacccaccagcagacccucgacgaccuccaggccgaggaggacaaggucaacauccucaccaaggccaagaccaagcucgagcagcaggucgacgaccucgagggcucccucgagcaggagaagaagcuccgcauggaccucgagcgcgccaagcgcaagcucgagggcgaccucaagcucgcccaggaguccaccauggacauggagaacgacaagcagcagcucgacgagaagcucgagaagaaggaguucgagaucuccaaccucaucuccaagaucgaggacgagcaggccgucgagauccagcuccagaagaagaucaaggagcuccaggcccgcaucgaggagcucggcgaggagaucgaggccgagcgcgccucccgcgccaaggccgagaagcagcgcuccgaccucucccgcgagcucgaggagaucuccgagcgccucgaggaggccggcggcgccaccuccgcccaggucgagcucaacaagaagcgcgaggccgaguuccagaagcuccgccgcgaccucgaggaggccacccuccagcacgaggccauggucgccgcccuccgcaagaagcacgccgacuccauggccgagcucggcgagcagaucgacaaccuccagcgcgucaagcagaagcucgagaaggagaaguccgagcucaagauggagaccgacgaccucuccuccaacgccgaggccaucuccaaggccaagggcaaccucgagaagaugugccgcucccucgaggaccaggucuccgagcucaagaccaaggaggaggagcagcagcgccucaucaacgaccucaccgcccagcgcgcccgccuccagaccgaggccggcgaguacucccgccagcucgacgagaaggacgcccucgucucccagcucucccgcuccaagcaggccuccacccagcagaucgaggagcucaagcaccagcucgaggaggagaccaaggccaagaacgcccucgcccacgcccuccaguccucccgccacgacugcgaccuccuccgcgagcaguacgaggaggagcaggagggcaaggccgagcuccagcgcgcccucuccaaggccaacuccgaggucgcccaguggcgcaccaaguacgagaccgacgccauccagcgcaccgaggagcucgaggaggccaagaagaagcucgcccagcgccuccaggaggccgaggagcacgucgaggccgucaacgccaagugcgccucccucgagaagaccaagcagcgccuccagaacgaggucgaggaccucaugcucgacgucgagcgcuccaacgccgccugcgccgcccucgacaagaagcagcgcaacuucgacaagguccucuccgaguggaagcagaaguacgaggagacccaggccgagcucgaggccucccagaaggagucccgcucccucuccaccgagcucuucaaggucaagaacgucuacgaggagucccucgaccagcucgagacccuccgccgcgagaacaagaaccuccagcaggagaucuccgaccucaccgagcagaucgccgagggcggcaagcagauccacgagcucgagaagaucaagaagcaggucgagcaggagaagugcgagauccaggccgcccucgaggaggccgaggccucccucgagcacgaggagggcaagauccuccgcauccagcucgagcucaaccaggucaaguccgaggucgaccgcaagaucgccgagaaggacgaggagaucgaccagcucaagcgcaaccacacccgcgucgucgagaccaugcaguccacccucgacgccgagauccgcucccgcaacgacgcccuccgcgucaagaagaagauggagggcgaccucaacgagauggagauccagcucaaccacgccaaccgccucgccgccgagucccuccgcaacuaccgcaacacccagggcauccucaaggagacccagcuccaccucgacgacgcccuccgcggccaggaggaccucaaggagcagcucgccaucgucgagcgccgcgccaaccuccuccaggccgagaucgaggagcucugggccacccucgagcagaccgagcgcucccgcaagaucgccgagcaggagcuccucgacgccuccgagcgcguccagcuccuccacacccagaacaccucccucaucaacaccaagaagaagcucgagaacgacgucucccagcuccaguccgaggucgaggaggucauccaggagucccgcaacgccgaggagaaggccaagaaggccaucaccgacgccgccaugauggccgaggagcucaagaaggagcaggacaccuccgcccaccucgagcgcaugaagaagaaccucgagcagaccgucaaggaccuccagcaccgccucgacgaggccgagcagcucgcccucaagggcggcaagaagcagauccagaagcucgaggcccgcguccgcgagcucgagggcgaggucgagaacgagcagaagcgcaacgccgaggccgucaagggccuccgcaagcacgagcgccgcgucaaggagcucaccuaccagaccgaggaggaccgcaagaacguccuccgccuccaggaccucgucgacaagcuccaggccaaggucaaguccuacaagcgccaggccgaggaggccgaggagcaguccaacgccaaccucuccaaguuccgcaagcuccagcacgagcucgaggaggccgaggagcgcgccgacaucgccgagucccaggucaacaagcuccgcgucaagucccgcgagguccacaccaagaucuccgccgaguga

SEQ ID NO: 46336 - RNA, 5883 nt, Artificial Sequence
  derived and/or modified sequence opt2 from MYH9__Homo_sapiens__NP_002464
auggcccagcaggccgccgacaaguaccucuacgucgacaagaacuucaucaacaacccccucgcccaggccgacugggccgccaagaagcucgucuggguccccuccgacaaguccggcuucgagcccgccucccucaaggaggaggucggcgaggaggccaucgucgagcucgucgagaacggcaagaaggucaaggucaacaaggacgacauccagaagaugaacccccccaaguucuccaaggucgaggacauggccgagcucaccugccucaacgaggccuccguccuccacaaccucaaggagcgcuacuacuccggccucaucuacaccuacuccggccucuucugcgucgucaucaaccccuacaagaaccuccccaucuacuccgaggagaucgucgagauguacaagggcaagaagcgccacgagaugcccccccacaucuacgccaucaccgacaccgccuaccgcuccaugaugcaggaccgcgaggaccaguccauccucugcaccggcgaguccggcgccggcaagaccgagaacaccaagaaggucauccaguaccucgccuacgucgccuccucccacaaguccaagaaggaccagggcgagcucgagcgccagcuccuccaggccaaccccauccucgaggccuucggcaacgccaagaccgucaagaacgacaacuccucccgcuucggcaaguucauccgcaucaacuucgacgucaacggcuacaucgucggcgccaacaucgagaccuaccuccucgagaagucccgcgccauccgccaggccaaggaggagcgcaccuuccacaucuucuacuaccuccucuccggcgccggcgagcaccucaagaccgaccuccuccucgagcccuacaacaaguaccgcuuccucuccaacggccacgucaccauccccggccagcaggacaaggacauguuccaggagaccauggaggccaugcgcaucaugggcauccccgaggaggagcagaugggccuccuccgcgucaucuccggcguccuccagcucggcaacaucgucuucaagaaggagcgcaacaccgaccaggccuccaugcccgacaacaccgccgcccagaaggucucccaccuccucggcaucaacgucaccgacuucacccgcggcauccucaccccccgcaucaaggucggccgcgacuacguccagaaggcccagaccaaggagcaggccgacuucgccaucgaggcccucgccaaggccaccuacgagcgcauguuccgcuggcucguccuccgcaucaacaaggcccucgacaagaccaagcgccagggcgccuccuucaucggcauccucgacaucgccggcuucgagaucuucgaccucaacuccuucgagcagcucugcaucaacuacaccaacgagaagcuccagcagcucuucaaccacaccauguucauccucgagcaggaggaguaccagcgcgagggcaucgaguggaacuucaucgacuucggccucgaccuccagcccugcaucgaccucaucgagaagcccgccggcccccccggcauccucgcccuccucgacgaggagugcugguuccccaaggccaccgacaaguccuucgucgagaaggucaugcaggagcagggcacccaccccaaguuccagaagcccaagcagcucaaggacaaggccgacuucugcaucauccacuacgccggcaaggucgacuacaaggccgacgaguggcucaugaagaacauggacccccucaacgacaacaucgccacccuccuccaccaguccuccgacaaguucgucuccgagcucuggaaggacgucgaccgcaucaucggccucgaccaggucgccggcauguccgagaccgcccuccccggcgccuucaagacccgcaagggcauguuccgcaccgucggccagcucuacaaggagcagcucgccaagcucauggccacccuccgcaacaccaaccccaacuucguccgcugcaucauccccaaccacgagaagaaggccggcaagcucgacccccaccucguccucgaccagcuccgcugcaacggcguccucgagggcauccgcaucugccgccagggcuuccccaaccgcgucgucuuccaggaguuccgccagcgcuacgagauccucacccccaacuccauccccaagggcuucauggacggcaagcaggccugcguccucaugaucaaggcccucgagcucgacuccaaccucuaccgcaucggccaguccaaggucuucuuccgcgccggcguccucgcccaccucgaggaggagcgcgaccucaagaucaccgacgucaucaucggcuuccaggccugcugccgcggcuaccucgcccgcaaggccuucgccaagcgccagcagcagcucaccgccaugaagguccuccagcgcaacugcgccgccuaccucaagcuccgcaacuggcagugguggcgccucuucaccaaggucaagccccuccuccaggucucccgccaggaggaggagaugauggccaaggaggaggagcucgucaagguccgcgagaagcagcucgccgccgagaaccgccucaccgagauggagacccuccagucccagcucauggccgagaagcuccagcuccaggagcagcuccaggccgagaccgagcucugcgccgaggccgaggagcuccgcgcccgccucaccgccaagaagcaggagcucgaggagaucugccacgaccucgaggcccgcgucgaggaggaggaggagcgcugccagcaccuccaggccgagaagaagaagaugcagcagaacauccaggagcucgaggagcagcucgaggaggaggaguccgcccgccagaagcuccagcucgagaaggucaccaccgaggccaagcucaagaagcucgaggaggagcagaucauccucgaggaccagaacugcaagcucgccaaggagaagaagcuccucgaggaccgcaucgccgaguucaccaccaaccucaccgaggaggaggagaaguccaagucccucgccaagcucaagaacaagcacgaggccaugaucaccgaccucgaggagcgccuccgccgcgaggagaagcagcgccaggagcucgagaagacccgccgcaagcucgagggcgacuccaccgaccucuccgaccagaucgccgagcuccaggcccagaucgccgagcucaagaugcagcucgccaagaaggaggaggagcuccaggccgcccucgcccgcgucgaggaggaggccgcccagaagaacauggcccucaagaagauccgcgagcucgagucccagaucuccgagcuccaggaggaccucgaguccgagcgcgccucccgcaacaaggccgagaagcagaagcgcgaccucggcgaggagcucgaggcccucaagaccgagcucgaggacacccucgacuccaccgccgcccagcaggagcuccgcuccaagcgcgagcaggaggucaacauccucaagaagacccucgaggaggaggccaagacccacgaggcccagauccaggagaugcgccagaagcacucccaggccgucgaggagcucgccgagcagcucgagcagaccaagcgcgucaaggccaaccucgagaaggccaagcagacccucgagaacgagcgcggcgagcucgccaacgaggucaagguccuccuccagggcaagggcgacuccgagcacaagcgcaagaaggucgaggcccagcuccaggagcuccaggucaaguucaacgagggcgagcgcguccgcaccgagcucgccgacaaggucaccaagcuccaggucgagcucgacaacgucaccggccuccucucccaguccgacuccaaguccuccaagcucaccaaggacuucuccgcccucgagucccagcuccaggacacccaggagcuccuccaggaggagaaccgccagaagcucucccucuccaccaagcucaagcaggucgaggacgagaagaacuccuuccgcgagcagcucgaggaggaggaggaggccaagcacaaccucgagaagcagaucgccacccuccacgcccaggucgccgacaugaagaagaagauggaggacuccgucggcugccucgagaccgccgaggaggucaagcgcaagcuccagaaggaccucgagggccucucccagcgccacgaggagaaggucgccgccuacgacaagcucgagaagaccaagacccgccuccagcaggagcucgacgaccuccucgucgaccucgaccaccagcgccaguccgccugcaaccucgagaagaagcagaagaaguucgaccagcuccucgccgaggagaagaccaucuccgccaaguacgccgaggagcgcgaccgcgccgaggccgaggcccgcgagaaggagaccaaggcccucucccucgcccgcgcccucgaggaggccauggagcagaaggccgagcucgagcgccucaacaagcaguuccgcaccgagauggaggaccucauguccuccaaggacgacgucggcaaguccguccacgagcucgagaaguccaagcgcgcccucgagcagcaggucgaggagaugaagacccagcucgaggagcucgaggacgagcuccaggccaccgaggacgccaagcuccgccucgaggucaaccuccaggccaugaaggcccaguucgagcgcgaccuccagggccgcgacgagcaguccgaggagaagaagaagcagcucguccgccagguccgcgagauggaggccgagcucgaggacgagcgcaagcagcgcuccauggccgucgccgcccgcaagaagcucgagauggaccucaaggaccucgaggcccacaucgacuccgccaacaagaaccgcgacgaggccaucaagcagcuccgcaagcuccaggcccagaugaaggacugcaugcgcgagcucgacgacacccgcgccucccgcgaggagauccucgcccaggccaaggagaacgagaagaagcucaaguccauggaggccgagaugauccagcuccaggaggagcucgccgccgccgagcgcgccaagcgccaggcccagcaggagcgcgacgagcucgccgacgagaucgccaacuccuccggcaagggcgcccucgcccucgaggagaagcgccgccucgaggcccgcaucgcccagcucgaggaggagcucgaggaggagcagggcaacaccgagcucaucaacgaccgccucaagaaggccaaccuccagaucgaccagaucaacaccgaccucaaccucgagcgcucccacgcccagaagaacgagaacgcccgccagcagcucgagcgccagaacaaggagcucaaggucaagcuccaggagauggagggcaccgucaaguccaaguacaaggccuccaucaccgcccucgaggccaagaucgcccagcucgaggagcagcucgacaacgagaccaaggagcgccaggccgccugcaagcagguccgccgcaccgagaagaagcucaaggacguccuccuccaggucgacgacgagcgccgcaacgccgagcaguacaaggaccaggccgacaaggccuccacccgccucaagcagcucaagcgccagcucgaggaggccgaggaggaggcccagcgcgccaacgccucccgccgcaagcuccagcgcgagcucgaggacgccaccgagaccgccgacgccaugaaccgcgaggucuccucccucaagaacaagcuccgccgcggcgaccuccccuucgucgucccccgccgcauggcccgcaagggcgccggcgacggcuccgacgaggaggucgacggcaaggccgacggcgccgaggccaagcccgccgaguga

SEQ ID NO: 46337 - RNA, 516 nt, Artificial Sequence
  derived and/or modified sequence opt2 from MYL12A__Homo_sapiens__NP_001289977
auguccuccaagcgcaccaagaccaagaccaagaagcgcccccagcgcgccaccuccaacgucuucgccauguucgaccagucccagauccaggaguucaaggaggccuucaacaugaucgaccagaaccgcgacggcuucaucgacaaggaggaccuccacgacaugcucgccucccucggcaagaaccccaccgacgaguaccucgacgccaugaugaacgaggcccccggccccaucaacuucaccauguuccucaccauguucggcgagaagcucaacggcaccgaccccgaggacgucauccgcaacgccuucgccugcuucgacgaggaggccaccggcaccauccaggaggacuaccuccgcgagcuccucaccaccaugggcgaccgcuucaccgacgaggaggucgacgagcucuaccgcgaggcccccaucgacaagaagggcaacuucaacuacaucgaguucacccgcauccucaagcacggcgccaaggacaaggacgacuga

SEQ ID NO: 46338 - RNA, 519 nt, Artificial Sequence
  derived and/or modified sequence opt2 from MYL12B__Homo_sapiens__NP_001138416
auguccuccaagaaggccaagaccaagaccaccaagaagcgcccccagcgcgccaccuccaacgucuucgccauguucgaccagucccagauccaggaguucaaggaggccuucaacaugaucgaccagaaccgcgacggcuucaucgacaaggaggaccuccacgacaugcucgccucccucggcaagaaccccaccgacgccuaccucgacgccaugaugaacgaggcccccggccccaucaacuucaccauguuccucaccauguucggcgagaagcucaacggcaccgaccccgaggacgucauccgcaacgccuucgccugcuucgacgaggaggccaccggcaccauccaggaggacuaccuccgcgagcuccucaccaccaugggcgaccgcuucaccgacgaggaggucgacgagcucuaccgcgaggcccccaucgacaagaagggcaacuucaacuacaucgaguucacccgcauccucaagcacggcgccaaggacaaggacgacuga

SEQ ID NO: 46339 - RNA, 585 nt, Artificial Sequence
  derived and/or modified sequence opt2 from MYL1__Homo_sapiens__NP_524144
auggcccccaagaaggacgucaagaagcccgucgccgccgccgccgccgcccccgcccccgcccccgcccccgcccccgcccccgcccccgccaagcccaaggaggagaagaucgaccucuccgccaucaagaucgaguucuccaaggagcagcaggacgaguucaaggaggccuuccuccucuucgaccgcaccggcgacuccaagaucacccucucccaggucggcgacguccuccgcgcccucggcaccaaccccaccaacgccgagguccgcaagguccucggcaaccccuccaacgaggagcucaacgccaagaagaucgaguucgagcaguuccuccccaugaugcaggccaucuccaacaacaaggaccaggccaccuacgaggacuucgucgagggccuccgcgucuucgacaaggagggcaacggcaccgucaugggcgccgagcuccgccacguccucgccacccucggcgagaagaugaaggaggaggaggucgaggcccucauggccggccaggaggacuccaacggcugcaucaacuacgaggccuucgucaagcacaucauguccaucuga

SEQ ID NO: 46340 - RNA, 501 nt, Artificial Sequence
  derived and/or modified sequence opt2 from MYL2__Homo_sapiens__NP_000423
auggcccccaagaaggccaagaagcgcgccggcggcgccaacuccaacgucuucuccauguucgagcagacccagauccaggaguucaaggaggccuucaccaucauggaccagaaccgcgacggcuucaucgacaagaacgaccuccgcgacaccuucgccgcccucggccgcgucaacgucaagaacgaggagaucgacgagaugaucaaggaggcccccggccccaucaacuucaccgucuuccucaccauguucggcgagaagcucaagggcgccgaccccgaggagaccauccucaacgccuucaaggucuucgaccccgagggcaagggcguccucaaggccgacuacguccgcgagaugcucaccacccaggccgagcgcuucuccaaggaggaggucgaccagauguucgccgccuucccccccgacgucaccggcaaccucgacuacaagaaccucguccacaucaucacccacggcgaggagaaggacuga

SEQ ID NO: 46341 - RNA, 588 nt, Artificial Sequence
  derived and/or modified sequence opt2 from MYL3__Homo_sapiens__NP_000249
auggcccccaagaagcccgagcccaagaaggacgacgccaaggccgcccccaaggccgcccccgcccccgcccccccccccgagcccgagcgccccaaggaggucgaguucgacgccuccaagaucaagaucgaguucacccccgagcagaucgaggaguucaaggaggccuucaugcucuucgaccgcacccccaagugcgagaugaagaucaccuacggccagugcggcgacguccuccgcgcccucggccagaaccccacccaggccgagguccuccgcguccucggcaagccccgccaggaggagcucaacaccaagaugauggacuucgagaccuuccuccccaugcuccagcacaucuccaagaacaaggacaccggcaccuacgaggacuucgucgagggccuccgcgucuucgacaaggagggcaacggcaccgucaugggcgccgagcuccgccacguccucgccacccucggcgagcgccucaccgaggacgaggucgagaagcucauggccggccaggaggacuccaacggcugcaucaacuacgaggccuucgucaagcacaucauguccuccuga

SEQ ID NO: 46342 - RNA, 594 nt, Artificial Sequence
  derived and/or modified sequence opt2 from MYL4__Homo_sapiens__NP_001002841
auggcccccaagaagcccgagcccaagaaggaggccgccaagcccgcccccgcccccgcccccgcccccgcccccgcccccgcccccgcccccgaggcccccaaggagcccgccuucgaccccaaguccgucaagaucgacuucaccgccgaccagaucgaggaguucaaggaggccuucucccucuucgaccgcacccccaccggcgagaugaagaucaccuacggccagugcggcgacguccuccgcgcccucggccagaaccccaccaacgccgagguccuccgcguccucggcaagcccaagcccgaggagaugaacgucaagaugcucgacuucgagaccuuccuccccauccuccagcacaucucccgcaacaaggagcagggcaccuacgaggacuucgucgagggccuccgcgucuucgacaaggaguccaacggcaccgucaugggcgccgagcuccgccacguccucgccacccucggcgagaagaugaccgaggccgaggucgagcagcuccucgccggccaggaggacgccaacggcugcaucaacuacgaggccuucgucaagcacaucauguccggcuga

SEQ ID NO: 46343 - RNA, 456 nt, Artificial Sequence
  derived and/or modified sequence opt2 from MYL6__Homo_sapiens__NP_066299
augugcgacuucaccgaggaccagaccgccgaguucaaggaggccuuccagcucuucgaccgcaccggcgacggcaagauccucuacucccagugcggcgacgucaugcgcgcccucggccagaaccccaccaacgccgagguccucaagguccucggcaaccccaaguccgacgagaugaacgucaagguccucgacuucgagcacuuccuccccaugcuccagaccgucgccaagaacaaggaccagggcaccuacgaggacuacgucgagggccuccgcgucuucgacaaggagggcaacggcaccgucaugggcgccgagauccgccacguccucgucacccucggcgagaagaugaccgaggaggaggucgagaugcucgucgccggccacgaggacuccaacggcugcaucaacuacgaggccuucguccgccacauccucuccggcuga

SEQ ID NO: 46344 - RNA, 528 nt, Artificial Sequence
  derived and/or modified sequence opt2 from MYL7__Homo_sapiens__NP_067046
auggccucccgcaaggccggcacccgcggcaaggucgccgccaccaagcaggcccagcgcggcuccuccaacgucuucuccauguucgagcaggcccagauccaggaguucaaggaggccuucuccugcaucgaccagaaccgcgacggcaucaucugcaaggccgaccuccgcgagaccuacucccagcucggcaaggucuccguccccgaggaggagcucgacgccaugcuccaggagggcaagggccccaucaacuucaccgucuuccucacccucuucggcgagaagcucaacggcaccgaccccgaggaggccauccucuccgccuuccgcauguucgaccccuccggcaagggcgucgucaacaaggacgaguucaagcagcuccuccucacccaggccgacaaguucucccccgccgaggucgagcagauguucgcccucacccccauggaccucgccggcaacaucgacuacaagucccucugcuacaucaucacccacggcgacgagaaggaggaguga

SEQ ID NO: 46345 - RNA, 519 nt, Artificial Sequence
  derived and/or modified sequence opt2 from MYL9__Homo_sapiens__NP_006088
auguccuccaagcgcgccaaggccaagaccaccaagaagcgcccccagcgcgccaccuccaacgucuucgccauguucgaccagucccagauccaggaguucaaggaggccuucaacaugaucgaccagaaccgcgacggcuucaucgacaaggaggaccuccacgacaugcucgccucccucggcaagaaccccaccgacgaguaccucgagggcaugauguccgaggcccccggccccaucaacuucaccauguuccucaccauguucggcgagaagcucaacggcaccgaccccgaggacgucauccgcaacgccuucgccugcuucgacgaggaggccuccggcuucauccacgaggaccaccuccgcgagcuccucaccaccaugggcgaccgcuucaccgacgaggaggucgacgagauguaccgcgaggcccccaucgacaagaagggcaacuucaacuacgucgaguucacccgcauccucaagcacggcgccaaggacaaggacgacuga

SEQ ID NO: 46346 - RNA, 1338 nt, Artificial Sequence
  derived and/or modified sequence opt2 from MYLIP__Homo_sapiens__NP_037394
augcucugcuacgucacccgccccgacgccguccucauggaggucgaggucgaggccaaggccaacggcgaggacugccucaaccaggucugccgccgccucggcaucaucgaggucgacuacuucggccuccaguucaccggcuccaagggcgagucccucuggcucaaccuccgcaaccgcaucucccagcagauggacggccucgcccccuaccgccucaagcuccgcgucaaguucuucgucgagccccaccucauccuccaggagcagacccgccacaucuucuuccuccacaucaaggaggcccuccucgccggccaccuccucugcucccccgagcaggccgucgagcucuccgcccuccucgcccagaccaaguucggcgacuacaaccagaacaccgccaaguacaacuacgaggagcucugcgccaaggagcucuccuccgccacccucaacuccaucgucgccaagcacaaggagcucgagggcaccucccaggccuccgccgaguaccagguccuccagaucgucuccgccauggagaacuacggcaucgaguggcacuccguccgcgacuccgagggccagaagcuccucaucggcgucggccccgagggcaucuccaucugcaaggacgacuucucccccaucaaccgcaucgccuaccccgucguccagauggccacccaguccggcaagaacgucuaccucaccgucaccaaggaguccggcaacuccaucguccuccucuucaagaugaucuccacccgcgccgccuccggccucuaccgcgccaucaccgagacccacgccuucuaccgcugcgacaccgucaccuccgccgucaugaugcaguacucccgcgaccucaagggccaccucgccucccucuuccucaacgagaacaucaaccucggcaagaaguacgucuucgacaucaagcgcaccuccaaggaggucuacgaccacgcccgccgcgcccucuacaacgccggcgucgucgaccucgucucccgcaacaaccagucccccucccacuccccccucaaguccuccgaguccuccaugaacugcuccuccugcgagggccucuccugccagcagacccgcguccuccaggagaagcuccgcaagcucaaggaggccaugcucugcauggucugcugcgaggaggagaucaacuccaccuucugccccugcggccacaccgucugcugcgaguccugcgccgcccagcuccaguccugccccgucugccgcucccgcgucgagcacguccagcacgucuaccuccccacccacaccucccuccucaaccucaccgucaucuga

SEQ ID NO: 46347 - RNA, 1791 nt, Artificial Sequence
  derived and/or modified sequence opt2 from MYLK2__Homo_sapiens__NP_149109
auggccaccgagaacggcgccgucgagcucggcauccagaaccccuccaccgacaaggcccccaagggccccaccggcgagcgcccccucgccgccggcaaggaccccggcccccccgaccccaagaaggcccccgacccccccacccucaagaaggacgccaaggcccccgccuccgagaagggcgacggcacccucgcccagcccuccaccuccucccagggccccaagggcgagggcgaccgcggcggcggccccgccgagggcuccgccggcccccccgccgcccucccccagcagaccgccacccccgagaccuccgucaagaagcccaaggccgagcagggcgccuccggcucccaggaccccggcaagccccgcgucggcaagaaggccgccgagggccaggccgccgcccgccgcggcucccccgccuuccuccacucccccuccugccccgccaucaucuccuccuccgagaagcuccucgccaagaagccccccuccgaggccuccgagcucaccuucgagggcguccccaugacccacucccccaccgacccccgccccgccaaggccgaggagggcaagaacauccucgccgagucccagaaggaggucggcgagaagacccccggccaggccggccaggccaagaugcagggcgacaccucccgcggcaucgaguuccaggccguccccuccgagaaguccgaggucggccaggcccucugccucaccgcccgcgaggaggacugcuuccagauccucgacgacugcccccccccccccgcccccuucccccaccgcauggucgagcuccgcaccggcaacgucuccuccgaguucuccaugaacuccaaggaggcccucggcggcggcaaguucggcgccgucugcaccugcauggagaaggccaccggccucaagcucgccgccaaggucaucaagaagcagacccccaaggacaaggagaugguccuccucgagaucgaggucaugaaccagcucaaccaccgcaaccucauccagcucuacgccgccaucgagaccccccacgagaucguccucuucauggaguacaucgagggcggcgagcucuucgagcgcaucgucgacgaggacuaccaccucaccgaggucgacaccauggucuucguccgccagaucugcgacggcauccucuucaugcacaagaugcgcguccuccaccucgaccucaagcccgagaacauccucugcgucaacaccaccggccaccucgucaagaucaucgacuucggccucgcccgccgcuacaaccccaacgagaagcucaaggucaacuucggcacccccgaguuccucucccccgaggucgucaacuacgaccagaucuccgacaagaccgacaugugguccaugggcgucaucaccuacaugcuccucuccggccucucccccuuccucggcgacgacgacaccgagacccucaacaacguccucuccggcaacugguacuucgacgaggagaccuucgaggccgucuccgacgaggccaaggacuucgucuccaaccucaucgucaaggaccagcgcgcccgcaugaacgccgcccagugccucgcccaccccuggcucaacaaccucgccgagaaggccaagcgcugcaaccgccgccucaagucccagauccuccucaagaaguaccucaugaagcgccgcuggaagaagaacuucaucgccgucuccgccgccaaccgcuucaagaagaucuccuccuccggcgcccucauggcccucggcgucuga

SEQ ID NO: 46348 - RNA, 2460 nt, Artificial Sequence
  derived and/or modified sequence opt2 from MYLK3__Homo_sapiens__NP_872299
auguccggcaccuccaaggagucccucggccacggcggccuccccggccucggcaagaccugccucaccaccauggacaccaagcucaacaugcucaacgagaaggucgaccagcuccuccacuuccaggaggacgucaccgagaagcuccaguccaugugccgcgacaugggccaccucgagcgcggccuccaccgccucgaggccucccgcgcccccggccccggcggcgccgacggcgucccccacaucgacacccaggccggcuggcccgagguccucgagcucguccgcgccaugcagcaggacgccgcccagcacggcgcccgccucgaggcccucuuccgcauggucgccgccgucgaccgcgccaucgcccucgucggcgccaccuuccagaaguccaaggucgccgacuuccucaugcagggccgcguccccuggcgccgcggcucccccggcgacucccccgaggagaacaaggagcgcgucgaggaggagggcggcaagcccaagcacguccucuccaccuccggcguccaguccgacgcccgcgagcccggcgaggagucccagaaggccgacguccucgagggcaccgccgagcgccucccccccauccgcgccuccggccucggcgccgaccccgcccaggccgucgucucccccggccagggcgacggcguccccggccccgcccaggccuuccccggccaccucccccuccccaccaaggucgaggccaaggcccccgagacccccuccgagaaccuccgcaccggccucgagcucgcccccgcccccggccgcgucaacgucgucucccccucccucgaggucgcccccggcgccggccagggcgccuccuccucccgccccgaccccgagccccucgaggagggcacccgccucacccccggccccggcccccagugccccggcccccccggccuccccgcccaggcccgcgccacccacuccggcggcgagacccccccccgcaucuccauccacauccaggagauggacacccccggcgagaugcucaugaccggccgcggcucccucggccccacccucaccaccgaggcccccgccgccgcccagcccggcaagcagggcccccccggcaccggccgcugccuccaggcccccggcaccgagcccggcgagcagacccccgagggcgcccgcgagcucuccccccuccaggaguccuccucccccggcggcgucaaggccgaggaggagcagcgcgccggcgccgagcccggcacccgccccucccucgcccgcuccgacgacaacgaccacgaggucggcgcccucggccuccagcagggcaagucccccggcgccggcaaccccgagcccgagcaggacugcgccgcccgcgcccccguccgcgccgaggccguccgccgcaugccccccggcgccgaggccggcuccgucguccucgacgacucccccgccccccccgcccccuucgagcaccgcgucgucuccgucaaggagaccuccaucuccgccggcuacgaggucugccagcacgagguccucggcggcggccgcuucggccagguccaccgcugcaccgagaaguccaccggccucccccucgccgccaagaucaucaaggucaaguccgccaaggaccgcgaggacgucaagaacgagaucaacaucaugaaccagcucucccacgucaaccucauccagcucuacgacgccuucgaguccaagcacuccugcacccucgucauggaguacgucgacggcggcgagcucuucgaccgcaucaccgacgagaaguaccaccucaccgagcucgacgucguccucuucacccgccagaucugcgagggcguccacuaccuccaccagcacuacauccuccaccucgaccucaagcccgagaacauccucugcgucaaccagaccggccaccagaucaagaucaucgacuucggccucgcccgccgcuacaagccccgcgagaagcucaaggucaacuucggcacccccgaguuccucgcccccgaggucgucaacuacgaguucgucuccuuccccaccgacaugugguccgucggcgucaucaccuacaugcuccucuccggccucucccccuuccucggcgagaccgacgccgagaccaugaacuucaucgucaacugcuccugggacuucgacgccgacaccuucgagggccucuccgaggaggccaaggacuucgucucccgccuccucgucaaggagaaguccugccgcauguccgccacccagugccucaagcacgaguggcucaacaaccuccccgccaaggccucccgcuccaagacccgccucaagucccagcuccuccuccagaaguacaucgcccagcgcaaguggaagaagcacuucuacgucgucaccgccgccaaccgccuccgcaaguuccccaccucccccuga

SEQ ID NO: 46349 - RNA, 5745 nt, Artificial Sequence
  derived and/or modified sequence opt2 from MYLK__Homo_sapiens__NP_444253
augggcgacgucaagcucgucgccuccucccacaucuccaagaccucccucuccgucgaccccucccgcgucgacuccaugccccucaccgaggcccccgccuucauccuccccccccgcaaccucugcaucaaggagggcgccaccgccaaguucgagggccgcguccgcggcuaccccgagccccaggucaccuggcaccgcaacggccagcccaucaccuccggcggccgcuuccuccucgacugcggcauccgcggcaccuucucccucgucauccacgccguccacgaggaggaccgcggcaaguacaccugcgaggccaccaacggcuccggcgcccgccaggucaccgucgagcucaccgucgagggcuccuucgccaagcagcucggccagcccgucgucuccaagacccucggcgaccgcuucuccgcccccgccgucgagacccgccccuccaucuggggcgagugcccccccaaguucgccaccaagcucggccgcgucgucgucaaggagggccagaugggccgcuucuccugcaagaucaccggccgcccccagccccaggucaccuggcucaagggcaacgucccccuccagcccuccgcccgcgucuccgucuccgagaagaacggcaugcagguccucgagauccacggcgucaaccaggacgacgucggcgucuacaccugccucgucgucaacggcuccggcaaggccuccauguccgccgagcucuccauccagggccucgacuccgccaaccgcuccuucguccgcgagaccaaggccaccaacuccgacguccgcaaggaggucaccaacgucaucuccaaggaguccaagcucgacucccucgaggccgccgccaaguccaagaacugcuccuccccccagcgcggcggcuccccccccugggccgccaacucccagccccagcccccccgcgaguccaagcucgaguccugcaaggacuccccccgcaccgccccccagacccccguccuccagaagaccuccuccuccaucacccuccaggccgcccgcguccagcccgagccccgcgcccccggccucggcguccucucccccuccggcgaggagcgcaagcgccccgcccccccccgccccgccaccuuccccacccgccagcccggccucggcucccaggacgucgucuccaaggccgccaaccgccgcauccccauggagggccagcgcgacuccgccuuccccaaguucgaguccaagccccagucccaggaggucaaggagaaccagaccgucaaguuccgcugcgaggucuccggcauccccaagcccgaggucgccugguuccucgagggcacccccguccgccgccaggagggcuccaucgaggucuacgaggacgccggcucccacuaccucugccuccucaaggcccgcacccgcgacuccggcaccuacuccugcaccgccuccaacgcccagggccagcucuccugcuccuggacccuccaggucgagcgccucgccgucauggaggucgcccccuccuucuccuccguccucaaggacugcgccgucaucgagggccaggacuucguccuccagugcuccguccgcggcacccccgucccccgcaucaccuggcuccucaacggccagcccauccaguacgcccgcuccaccugcgaggccggcgucgccgagcuccacauccaggacgcccuccccgaggaccacggcaccuacaccugccucgccgagaacgcccucggccaggucuccugcuccgccugggucaccguccacgagaagaaguccucccgcaaguccgaguaccuccuccccgucgcccccuccaagcccaccgcccccaucuuccuccagggccucuccgaccucaaggucauggacggcucccaggucaccaugaccguccaggucuccggcaaccccccccccgaggucaucuggcuccacaacggcaacgagauccaggaguccgaggacuuccacuucgagcagcgcggcacccagcacucccucugcauccaggaggucuuccccgaggacaccggcaccuacaccugcgaggccuggaacuccgccggcgagguccgcacccaggccguccucaccguccaggagccccacgacggcacccagcccugguucaucuccaagccccgcuccgucaccgccucccucggccaguccguccucaucuccugcgccaucgccggcgaccccuuccccaccguccacuggcuccgcgacggcaaggcccucugcaaggacaccggccacuucgagguccuccagaacgaggacgucuucacccucguccucaagaagguccagcccuggcacgccggccaguacgagauccuccucaagaaccgcgucggcgagugcuccugccaggucucccucaugcuccagaacuccuccgcccgcgcccucccccgcggccgcgagcccgccuccugcgaggaccucugcggcggcggcgucggcgccgacggcggcggcuccgaccgcuacggcucccuccgccccggcuggcccgcccgcggccagggcuggcucgaggaggaggacggcgaggacguccgcggcguccucaagcgccgcgucgagacccgccagcacaccgaggaggccauccgccagcaggaggucgagcagcucgacuuccgcgaccuccucggcaagaaggucuccaccaagacccucuccgaggacgaccucaaggagauccccgccgagcagauggacuuccgcgccaaccuccagcgccaggucaagcccaagaccgucuccgaggaggagcgcaagguccacuccccccagcaggucgacuuccgcuccguccucgccaagaagggcaccuccaagacccccguccccgagaagguccccccccccaagcccgccacccccgacuuccgcuccguccucggcggcaagaagaagcuccccgccgagaacggcuccuccuccgccgagacccucaacgccaaggccgucgaguccuccaagccccucuccaacgcccagcccuccggcccccucaagcccgucggcaacgccaagcccgccgagacccucaagcccaugggcaacgccaagcccgccgagacccucaagcccaugggcaacgccaagcccgacgagaaccucaaguccgccuccaaggaggagcucaagaaggacgucaagaacgacgucaacugcaagcgcggccacgccggcaccaccgacaacgagaagcgcuccgagucccagggcaccgcccccgccuucaagcagaagcuccaggacguccacgucgccgagggcaagaagcuccuccuccagugccaggucuccuccgacccccccgccaccaucaucuggacccucaacggcaagacccucaagaccaccaaguucaucauccucucccaggagggcucccucugcuccgucuccaucgagaaggcccuccccgaggaccgcggccucuacaagugcgucgccaagaacgacgccggccaggccgagugcuccugccaggucaccgucgacgacgcccccgccuccgagaacaccaaggcccccgagaugaagucccgccgccccaaguccucccucccccccguccucggcaccgaguccgacgccaccgucaagaagaagcccgcccccaagaccccccccaaggccgccaugcccccccagaucauccaguuccccgaggaccagaagguccgcgccggcgaguccgucgagcucuucggcaaggucaccggcacccagcccaucaccugcaccuggaugaaguuccgcaagcagauccaggaguccgagcacaugaaggucgagaacuccgagaacggcuccaagcucaccauccucgccgcccgccaggagcacugcggcugcuacacccuccucgucgagaacaagcucggcucccgccaggcccaggucaaccucaccgucgucgacaagcccgacccccccgccggcacccccugcgccuccgacauccgcuccuccucccucacccucuccugguacggcuccuccuacgacggcggcuccgccguccaguccuacuccaucgagaucugggacuccgccaacaagaccuggaaggagcucgccaccugccgcuccaccuccuucaacguccaggaccuccuccccgaccacgaguacaaguuccgcguccgcgccaucaacgucuacggcaccuccgagcccucccaggaguccgagcucaccaccgucggcgagaagcccgaggagcccaaggacgaggucgaggucuccgacgacgacgagaaggagcccgaggucgacuaccgcaccgucaccaucaacaccgagcagaaggucuccgacuucuacgacaucgaggagcgccucggcuccggcaaguucggccaggucuuccgccucgucgagaagaagacccgcaaggucugggccggcaaguucuucaaggccuacuccgccaaggagaaggagaacauccgccaggagaucuccaucaugaacugccuccaccaccccaagcucguccagugcgucgacgccuucgaggagaaggccaacaucgucaugguccucgagaucgucuccggcggcgagcucuucgagcgcaucaucgacgaggacuucgagcucaccgagcgcgagugcaucaaguacaugcgccagaucuccgagggcgucgaguacauccacaagcagggcaucguccaccucgaccucaagcccgagaacaucaugugcgucaacaagaccggcacccgcaucaagcucaucgacuucggccucgcccgccgccucgagaacgccggcucccucaagguccucuucggcacccccgaguucgucgcccccgaggucaucaacuacgagcccaucggcuacgccaccgacaugugguccaucggcgucaucugcuacauccucgucuccggccucucccccuucaugggcgacaacgacaacgagacccucgccaacgucaccuccgccaccugggacuucgacgacgaggccuucgacgagaucuccgacgacgccaaggacuucaucuccaaccuccucaagaaggacaugaagaaccgccucgacugcacccagugccuccagcaccccuggcucaugaaggacaccaagaacauggaggccaagaagcucuccaaggaccgcaugaagaaguacauggcccgccgcaaguggcagaagaccggcaacgccguccgcgccaucggccgccucuccuccauggccaugaucuccggccucuccggccgcaaguccuccaccggcucccccaccuccccccucaacgccgagaagcucgaguccgaggaggacgucucccaggccuuccucgaggccgucgccgaggagaagccccacgucaagcccuacuucuccaagaccauccgcgaccucgaggucgucgagggcuccgccgcccgcuucgacugcaagaucgagggcuaccccgaccccgaggucgucugguucaaggacgaccaguccauccgcgagucccgccacuuccagaucgacuacgacgaggacggcaacugcucccucaucaucuccgacgucugcggcgacgacgacgccaaguacaccugcaaggccgucaacucccucggcgaggccaccugcaccgccgagcucaucgucgagaccauggaggagggcgagggcgagggcgaggaggaggaggaguga

SEQ ID NO: 46350 - RNA, 510 nt, Artificial Sequence
  derived and/or modified sequence opt2 from MYLPF__Homo_sapiens__NP_037424
auggcccccaagcgcgccaagcgccgcaccgucgagggcggcuccuccuccgucuucuccauguucgaccagacccagauccaggaguucaaggaggccuucaccgucaucgaccagaaccgcgacggcaucaucgacaaggaggaccuccgcgacaccuucgccgccaugggccgccucaacgucaagaacgaggagcucgacgccaugaugaaggaggccuccggccccaucaacuucaccgucuuccucaccauguucggcgagaagcucaagggcgccgaccccgaggacgucaucaccggcgccuucaagguccucgaccccgagggcaagggcaccaucaagaagaaguuccucgaggagcuccucaccacccagugcgaccgcuucucccaggaggagaucaagaacaugugggccgccuucccccccgacgucggcggcaacgucgacuacaagaacaucugcuacgucaucacccacggcgacgccaaggaccaggaguga

SEQ ID NO: 46351 - RNA, 1746 nt, Artificial Sequence
  derived and/or modified sequence opt2 from MYNN__Homo_sapiens__NP_001172048
augcaguacucccaccacugcgagcaccuccucgagcgccucaacaagcagcgcgaggccggcuuccucugcgacugcaccaucgucaucggcgaguuccaguucaaggcccaccgcaacguccucgccuccuucuccgaguacuucggcgccaucuaccgcuccaccuccgagaacaacgucuuccucgaccagucccaggucaaggccgacggcuuccagaagcuccucgaguucaucuacaccggcacccucaaccucgacuccuggaacgucaaggagauccaccaggccgccgacuaccucaaggucgaggaggucgucaccaagugcaagaucaagauggaggacuucgccuucaucgccaaccccuccuccaccgagaucuccuccaucaccggcaacaucgagcucaaccagcagaccugccuccucacccuccgcgacuacaacaaccgcgagaaguccgaggucuccaccgaccucauccaggccaaccccaagcagggcgcccucgccaagaaguccucccagaccaagaagaagaagaaggccuucaacucccccaagaccggccagaacaagaccguccaguaccccuccgacauccucgagaacgccuccgucgagcucuuccucgacgccaacaagcuccccacccccgucgucgagcaggucgcccagaucaacgacaacuccgagcucgagcucaccuccgucgucgagaacaccuuccccgcccaggacaucguccacaccgucaccgucaagcgcaagcgcggcaagucccagcccaacugcgcccucaaggagcacuccauguccaacaucgccuccgucaagucccccuacgaggccgagaacuccggcgaggagcucgaccagcgcuacuccaaggccaagcccaugugcaacaccugcggcaaggucuucuccgaggccuccucccuccgccgccacaugcgcauccacaagggcgucaagcccuacgucugccaccucugcggcaaggccuucacccagugcaaccagcucaagacccacguccgcacccacaccggcgagaagcccuacaagugcgagcucugcgacaagggcuucgcccagaagugccagcucgucuuccacucccgcaugcaccacggcgaggagaagcccuacaagugcgacgucugcaaccuccaguucgccaccuccuccaaccucaagauccacgcccgcaagcacuccggcgagaagcccuacgucugcgaccgcugcggccagcgcuucgcccaggccuccacccucaccuaccacguccgccgccacaccggcgagaagcccuacgucugcgacaccugcggcaaggccuucgccgucuccuccucccucaucacccacucccgcaagcacaccggcgagaagcccuacaucugcggcaucugcggcaaguccuucaucuccuccggcgagcucaacaagcacuuccgcucccacaccggcgccgacaagacccucgacuccuccgccgaggaccacacccucuccgagcaggacuccauccagaaguccccccucuccgagaccauggacgucaagcccuccgacaugacccucccccucgcccucccccucggcaccgaggaccaccacaugcuccuccccgucaccgacacccagucccccaccuccgacacccuccuccgcuccaccgucaacggcuacuccgagccccagcucaucuuccuccagcagcucuacuga

SEQ ID NO: 46352 - RNA, 6177 nt, Artificial Sequence
  derived and/or modified sequence opt2 from MYO10__Homo_sapiens__NP_036466
auggacaacuucuucaccgagggcacccgcgucuggcuccgcgagaacggccagcacuuccccuccaccgucaacuccugcgccgagggcaucgucgucuuccgcaccgacuacggccaggucuucaccuacaagcaguccaccaucacccaccagaaggucaccgccaugcaccccaccaacgaggagggcgucgacgacauggccucccucaccgagcuccacggcggcuccaucauguacaaccucuuccagcgcuacaagcgcaaccagaucuacaccuacaucggcuccauccucgccuccgucaaccccuaccagcccaucgccggccucuacgagcccgccaccauggagcaguacucccgccgccaccucggcgagcuccccccccacaucuucgccaucgccaacgagugcuaccgcugccucuggaagcgccacgacaaccagugcauccucaucuccggcgaguccggcgccggcaagaccgaguccaccaagcucauccucaaguuccucuccgucaucucccagcagucccucgagcucucccucaaggagaagaccuccugcgucgagcgcgccauccucgaguccucccccaucauggaggccuucggcaacgccaagaccgucuacaacaacaacuccucccgcuucggcaaguucguccagcucaacaucugccagaagggcaacauccagggcggccgcaucgucgacuaccuccucgagaagaaccgcgucguccgccagaaccccggcgagcgcaacuaccacaucuucuacgcccuccucgccggccucgagcacgaggagcgcgaggaguucuaccucuccacccccgagaacuaccacuaccucaaccaguccggcugcgucgaggacaagaccaucuccgaccaggaguccuuccgcgaggucaucaccgccauggacgucaugcaguucuccaaggaggagguccgcgaggucucccgccuccucgccggcauccuccaccucggcaacaucgaguucaucaccgccggcggcgcccaggucuccuucaagaccgcccucggccgcuccgccgagcuccucggccucgaccccacccagcucaccgacgcccucacccagcgcuccauguuccuccgcggcgaggagauccucaccccccucaacguccagcaggccgucgacucccgcgacucccucgccauggcccucuacgccugcugcuucgagugggucaucaagaagaucaacucccgcaucaagggcaacgaggacuucaaguccaucggcauccucgacaucuucggcuucgagaacuucgaggucaaccacuucgagcaguucaacaucaacuacgccaacgagaagcuccaggaguacuucaacaagcacaucuucucccucgagcagcucgaguacucccgcgagggccucgucugggaggacaucgacuggaucgacaacggcgagugccucgaccucaucgagaagaagcucggccuccucgcccucaucaacgaggagucccacuucccccaggccaccgacuccacccuccucgagaagcuccacucccagcacgccaacaaccacuucuacgucaagccccgcgucgccgucaacaacuucggcgucaagcacuacgccggcgagguccaguacgacguccgcggcauccucgagaagaaccgcgacaccuuccgcgacgaccuccucaaccuccuccgcgagucccgcuucgacuucaucuacgaccucuucgagcacgucuccucccgcaacaaccaggacacccucaagugcggcuccaagcaccgccgccccaccgucuccucccaguucaaggacucccuccacucccucauggccacccucuccuccuccaaccccuucuucguccgcugcaucaagcccaacaugcagaagaugcccgaccaguucgaccaggccgucguccucaaccagcuccgcuacuccggcaugcucgagaccguccgcauccgcaaggccggcuacgccguccgccgccccuuccaggacuucuacaagcgcuacaagguccucaugcgcaaccucgcccuccccgaggacguccgcggcaagugcaccucccuccuccagcucuacgacgccuccaacuccgaguggcagcucggcaagaccaaggucuuccuccgcgagucccucgagcagaagcucgagaagcgccgcgaggaggaggucucccacgccgccauggucauccgcgcccacguccucggcuuccucgcccgcaagcaguaccgcaagguccucuacugcgucgucaucauccagaagaacuaccgcgccuuccuccuccgccgccgcuuccuccaccucaagaaggccgccaucgucuuccagaagcagcuccgcggccagaucgcccgccgcgucuaccgccagcuccucgccgagaagcgcgagcaggaggagaagaagaagcaggaggaggaggagaagaagaagcgcgaggaggaggagcgcgagcgcgagcgcgagcgccgcgaggccgagcuccgcgcccagcaggaggaggagacccgcaagcagcaggagcucgaggcccuccagaagucccagaaggaggccgagcucacccgcgagcucgagaagcagaaggagaacaagcaggucgaggagauccuccgccucgagaaggagaucgaggaccuccagcgcaugaaggagcagcaggagcucucccucaccgaggccucccuccagaagcuccaggagcgccgcgaccaggagcuccgccgccucgaggaggaggccugccgcgccgcccaggaguuccucgagucccucaacuucgacgagaucgacgagugcguccgcaacaucgagcgcucccucuccgucggcuccgaguucuccuccgagcucgccgaguccgccugcgaggagaagcccaacuucaacuucucccagcccuaccccgaggaggaggucgacgagggcuucgaggccgacgacgacgccuucaaggacucccccaaccccuccgagcacggccacuccgaccagcgcaccuccggcauccgcaccuccgacgacuccuccgaggaggaccccuacaugaacgacaccgucguccccaccucccccuccgccgacuccaccguccuccucgcccccuccguccaggacuccggcucccuccacaacuccuccuccggcgaguccaccuacugcaugccccagaacgccggcgaccuccccucccccgacggcgacuacgacuacgaccaggacgacuacgaggacggcgccaucaccuccggcuccuccgucaccuucuccaacuccuacggcucccaguggucccccgacuaccgcugcuccgucggcaccuacaacuccuccggcgccuaccgcuucuccuccgagggcgcccaguccuccuucgaggacuccgaggaggacuucgacucccgcuucgacaccgacgacgagcucuccuaccgccgcgacuccgucuacuccugcgucacccuccccuacuuccacuccuuccucuacaugaagggcggccucaugaacuccuggaagcgccgcuggugcguccucaaggacgagaccuuccucugguuccgcuccaagcaggaggcccucaagcagggcuggcuccacaagaagggcggcggcuccuccacccucucccgccgcaacuggaagaagcgcugguucguccuccgccaguccaagcucauguacuucgagaacgacuccgaggagaagcucaagggcaccgucgagguccgcaccgccaaggagaucaucgacaacaccaccaaggagaacggcaucgacaucaucauggccgaccgcaccuuccaccucaucgccgagucccccgaggacgccucccagugguucuccguccucucccagguccacgccuccaccgaccaggagauccaggagaugcacgacgagcaggccaacccccagaacgccgucggcacccucgacgucggccucaucgacuccgucugcgccuccgacucccccgaccgccccaacuccuucgucaucaucaccgccaaccgcguccuccacugcaacgccgacacccccgaggagaugcaccacuggaucacccuccuccagcgcuccaagggcgacacccgcgucgagggccaggaguucaucguccgcggcuggcuccacaaggaggucaagaacucccccaagauguccucccucaagcucaagaagcgcugguucguccucacccacaacucccucgacuacuacaaguccuccgagaagaacgcccucaagcucggcacccucguccucaacucccucugcuccgucgucccccccgacgagaagaucuucaaggagaccggcuacuggaacgucaccgucuacggccgcaagcacugcuaccgccucuacaccaagcuccucaacgaggccacccgcugguccuccgccauccagaacgucaccgacaccaaggcccccaucgacacccccacccagcagcucauccaggacaucaaggagaacugccucaacuccgacgucgucgagcagaucuacaagcgcaaccccauccuccgcuacacccaccacccccuccacuccccccuccucccccuccccuacggcgacaucaaccucaaccuccucaaggacaagggcuacaccacccuccaggacgaggccaucaagaucuucaacucccuccagcagcucgaguccauguccgaccccauccccaucauccagggcauccuccagaccggccacgaccuccgcccccuccgcgacgagcucuacugccagcucaucaagcagaccaacaaggucccccaccccggcuccgucggcaaccucuacuccuggcagauccucaccugccucuccugcaccuuccuccccucccgcggcauccucaaguaccucaaguuccaccucaagcgcauccgcgagcaguuccccggcuccgagauggagaaguacgcccucuucaccuacgagucccucaagaagaccaagugccgcgaguucguccccucccgcgacgagaucgaggcccucauccaccgccaggagaugaccuccaccgucuacugccacggcggcggcuccugcaagaucaccaucaacucccacaccaccgccggcgaggucgucgagaagcucauccgcggccucgccauggaggacucccgcaacauguucgcccucuucgaguacaacggccacgucgacaaggccaucgagucccgcaccgucgucgccgacguccucgccaaguucgagaagcucgccgccaccuccgaggucggcgaccuccccuggaaguucuacuucaagcucuacugcuuccucgacaccgacaacguccccaaggacuccgucgaguucgccuucauguucgagcaggcccacgaggccgucauccacggccaccaccccgcccccgaggagaaccuccagguccucgccgcccuccgccuccaguaccuccagggcgacuacacccuccacgccgccauccccccccucgaggaggucuacucccuccagcgccucaaggcccgcaucucccaguccaccaagaccuucacccccugcgagcgccucgagaagcgccgcaccuccuuccucgagggcacccuccgccgcuccuuccgcaccggcuccgucguccgccagaaggucgaggaggagcagaugcucgacauguggaucaaggaggaggucuccuccgcccgcgccuccaucaucgacaaguggcgcaaguuccagggcaugaaccaggagcaggccauggccaaguacauggcccucaucaaggaguggcccggcuacggcuccacccucuucgacgucgagugcaaggagggcggcuucccccaggagcucuggcucggcgucuccgccgacgccgucuccgucuacaagcgcggcgagggccgcccccucgaggucuuccaguacgagcacauccucuccuucggcgccccccucgccaacaccuacaagaucgucgucgacgagcgcgagcuccucuucgagaccuccgaggucgucgacgucgccaagcucaugaaggccuacaucuccaugaucgucaagaagcgcuacuccaccacccgcuccgccuccucccagggcuccucccgcuga

SEQ ID NO: 46353 - RNA, 10593 nt, Artificial Sequence
  derived and/or modified sequence opt2 from MYO15A__Homo_sapiens__NP_057323
auggccaaggaggaggacgaggagaagaaggccaagaagggcaagaagggcaagaaggcccccgagcccgagaagcccaagcgcucccucaagggcaccucccgccucuucaugggcuuccgcgaccgcacccccaagaucuccaagaagggccaguuccgcuccgccuccgccuucuucuggggccuccacaccggcccccagaagaccaagcgcaagcgcaaggcccgcaccguccucaaguccaccuccaagcucaugacccagaugcgcaugggcaagaagaagcgcgccaugaagggcaagaagcccuccuucauggucauccgcuuccccggccgccgcggcuacggccgccuccgcccccgcgcccgcucccucuccaaggccuccaccgccaucaacuggcucaccaagaaguuccuccucaagaaggccgaggaguccggcuccgagcaggccaccgucgacgccuggcuccagcgcuccuccucccgcaugggcucccgcaagcuccccuuccccuccggcgccgagauccuccgccccggcggccgccuccgccgcuucccccgcucccgcuccaucuacgccuccggcgagccccucggcuuccuccccuucgaggacgaggcccccuuccaccacuccggcucccgcaagucccucuacggccucgagggcuuccaggaccucggcgaguacuacgacuaccaccgcgacggcgacgacuacuacgaccgccagucccuccaccgcuacgaggagcaggagcccuaccucgccggccucggccccuacucccccgccuggccccccuacggcgaccacuacuacggcuacccccccgaggaccccuacgacuacuaccaccccgacuacuacggcggccccuucgaccccggcuacaccuacggcuacggcuacgacgacuacgagccccccuacgccccccccuccggcuacuccucccccuacuccuaccacgacggcuacgagggcgaggcccaccccuacggcuacuaccucgaccccuacgcccccuacgacgcccccuacccccccuacgaccuccccuaccacacccccuacgacguccccuacuucgaccccuacggcguccacuacaccguccccuacgccgagggcgucuacggcggcggcgacgaggccaucuacccccccgagguccccuacuucuaccccgaggaguccgccuccgccuucgucuaccccuggguccccccccccauccccuccccccacaaccccuacgcccacgccauggacgacaucgccgagcucgaggagcccgaggacgccggcgucgagcgccagggcaccuccuuccgccuccccuccgccgccuucuucgagcagcagggcauggacaagcccgcccgcuccaagcucucccucauccgcaaguuccgccucuucccccgcccccaggucaagcucuucggcaaggagaagcucgaggucccccucccccccucccucgacaucccccucccccucggcgacgccgacgaggaggaggacgaggaggagcucccccccgucuccgccguccccuacggccaccccuucuggggcuuccucaccccccgccagcgcaaccuccagcgcgcccucuccgccuucggcgcccaccgcggccucggcuucggccccgaguucggccgccccgucccccgccccgccaccucccucgcccgcuuccucaagaagacccucuccgagaagaagcccaucgcccgccuccgcggcucccagaaggcccgcgccggcggccccgccguccgcgaggccgccuacaagcgcuucggcuacaagcucgccggcauggaccccgagaagcccggcacccccaucguccuccgccgcgcccagccccgcgcccgcuccuccaacgacgcccgccgcccccccgccccccagcccgccccccgcacccucucccacugguccgcccuccucuccccccccguccccccccgcccccccuccuccggccccccccccgcccccccccucucccccgcccucuccggccucccccgccccgccucccccuacggcucccuccgccgccaccccccccccugggccgcccccgcccacgucccccccgccccccaggccuccuggugggccuucgucgagccccccgccgucucccccgaggucccccccgaccuccucgccuuccccggcccccgccccuccuuccgcggcucccgccgccgcggcgccgccuucggcuuccccggcgccuccccccgcgccucccgccgccgcgccugguccccccucgccuccccccagcccucccuccgcuccucccccggccucggcuacugcuccccccucgccccccccuccccccagcucucccuccgcaccggccccuuccagccccccuuccucccccccgcccgccgcccccgcucccuccaggagucccccgccccccgccgcgccgccggccgccucggcccccccggcuccccccuccccggcuccccccgcccccccucccccccccucggccucugccacuccccccgccgcuccucccucaaccuccccucccgccucccccacaccuggcgccgccucuccgagccccccacccgcgccgucaagccccagguccgccuccccuuccaccgccccccccgcgccggcgccuggcgcgccccccucgagcaccgcgaguccccccgcgagcccgaggacuccgagacccccuggaccguccccccccucgcccccuccugggacgucgacaugccccccacccagcgcccccccucccccuggcccggcggcgccggcucccgccgcggcuucucccgccccccccccguccccgagaaccccuuccuccagcuccucggccccguccccucccccacccuccagcccgaggaccccgccgccgacaugacccgcgucuuccucggccgccaccacgagcccggccccggccagcucaccaaguccgccggccccacccccgagaagcccgaggaggaggccacccucggcgacccccagcuccccgccgagaccaagccccccacccccgccccccccaaggacgucaccccccccaaggacaucaccccccccaaggacguccuccccgagcagaagacccuccgccccucccucuccuacccccucgccgccugcgaccagacccgcgccaccuggccccccuggcaccgcuggggcacccucccccaggccgccgccccccucgcccccauccgcgcccccgagccccuccccaagggcggcgagcgccgccaggccgcccccggccgcuucgccgucgucaugccccgcguccagaagcucuccuccuuccagcgcgucggccccgccacccucaagccccagguccagcccauccaggaccccaagccccgcgccugcucccuccgcugguccugccucuggcuccgcgccgacgccuacggccccuggccccgcguccacacccacccccaguccugccaccucggccccggcgccgccugccucucccuccgcggcuccugggaggaggucggcccccccuccuggcgcaacaagaugcacuccauccgcaaccuccccuccaugcgcuuccgcgagcagcacggcgaggacggcgucgaggacaugacccagcucgaggaccuccaggagaccaccguccucuccaaccucaagauccgcuucgagcgcaaccucaucuacaccuacaucggcuccauccucgucuccgucaaccccuaccagauguucggcaucuacggccccgagcagguccagcaguacaacggccgcgcccucggcgagaaccccccccaccucuucgccgucgccaaccucgccuucgccaagaugcucgacgccaagcagaaccagugcaucaucaucuccggcgaguccggcuccggcaagaccgaggccaccaagcucauccuccgcuaccucgccgccaugaaccagaagcgcgaggucaugcagcagaucaagauccucgaggccaccccccuccucgaguccuucggcaacgccaagaccguccgcaacgacaacuccucccgcuucggcaaguucgucgagaucuuccucgagggcggcgucaucuccggcgccaucaccucccaguaccuccucgagaagucccgcaucgucuuccaggccaagaacgagcgcaacuaccacaucuucuacgagcuccucgccggccuccccgcccagcuccgccaggccuucucccuccaggaggccgagaccuacuacuaccucaaccagggcggcaacugcgagaucgccggcaaguccgacgccgacgacuuccgccgccuccucgccgccauggagguccucggcuucuccuccgaggaccaggacuccaucuuccgcauccucgccuccauccuccaccucggcaacgucuacuucgagaaguacgagaccgacgcccaggaggucgccuccgucgucuccgcccgcgagauccaggccgucgccgagcuccuccagaucucccccgagggccuccagaaggccaucaccuucaaggucaccgagaccaugcgcgagaagaucuucaccccccucaccgucgaguccgccgucgacgcccgcgacgccaucgccaagguccucuacgcccuccucuucuccuggcucaucacccgcgucaacgcccucgucuccccccgccaggacacccucuccaucgccauccucgacaucuacggcuucgaggaccucuccuucaacuccuucgagcagcucugcaucaacuacgccaacgagaaccuccaguaccucuucaacaagaucgucuuccaggaggagcaggaggaguacauccgcgagcagaucgacuggcaggagaucaccuucgccgacaaccagcccugcaucaaccucaucucccucaagcccuacggcauccuccgcauccucgacgaccagugcugcuucccccaggccaccgaccacaccuuccuccagaagugccacuaccaccacggcgccaacccccucuacuccaagcccaagaugccccuccccgaguucaccaucaagcacuacgccggcaaggucaccuaccagguccacaaguuccucgacaagaaccacgaccagguccgccaggacguccucgaccucuucguccgcucccgcacccgcgucgucgcccaccucuucuccucccacgccccccaggccgccccccagcgccucggcaaguccuccuccgucacccgccucuacaaggcccacaccgucgccgccaaguuccagcagucccuccucgaccucgucgagaagauggagcgcugcaacccccucuucaugcgcugccucaagcccaaccacaagaaggagcccggccucuucgagcccgacgucgucauggcccagcuccgcuacuccggcguccucgagaccguccgcauccgcaaggagggcuuccccguccgccuccccuuccagggcuucaucgaccgcuacugcugccucgucgcccucaagcacgaccuccccgccaacggcgacaugugcgucuccguccucucccgccucugcaaggucaugcccaacauguaccgcgucggcgucuccaagcucuuccucaaggagcaccucuaccagcuccucgaguccaugcgcgagcacguccucaaccucgccgcccucacccuccagcgcugccuccgcggcuucuucaucaagcgccgcuuccgcucccuccgccacaagaucauccuccuccagucccgcgcccgcggcuaccucgcccgccagcgcuaccagcagaugcgccgcucccucgucaaguuccgcucccucguccacgccuacgucucccgccgccgcuaccucaagcuccgcgccgaguggcgcugccaggucgagggcgcccuccucugggagcaggaggagcucuccaagcgcgaggucgucgccgucggccaccucgagguccccgccgagcucgccggccuccuccaggccgucgccggccucggccucgcccaggucccccaggucgcccccguccgcaccccccgccuccaggccgagccccgcgucacccucccccucgacaucaacaacuaccccauggccaaguucguccagugccacuucaaggagcccgccuucggcaugcucaccgucccccuccgcaccccccucacccagcuccccgccgagcaccacgccgaggccgucuccaucuucaagcucauccuccgcuucaugggcgacccccaccuccacggcgcccgcgagaacaucuucggcaacuacaucguccagaagggccucgccguccccgagcuccgcgacgagauccucgcccagcucgccaaccaggucuggcacaaccacaacgcccacaacgccgagcgcggcuggcuccuccucgccgccugccucuccggcuucgcccccucccccugcuucaacaaguaccuccucaaguucgucuccgacuacggccgcaacggcuuccaggccgucugccagcaccgccucaugcaggccaugggccgcgcccagcagcagggcuccggcgccgcccgcacccucccccccacccagcucgaguggaccgccaccuacgagaaggccuccauggcccucgacgucggcugcuucaacggcgaccaguucuccugccccguccacuccugguccaccggcgaggaggucgccggcgacauccuccgccaccgcggccucgccgacggcuggcgcggcuggaccgucgccaugaagaacggcguccagugggccgagcucgccggccacgacuacguccucgaccucgucuccgaccucgagcuccuccgcgacuucccccgccagaaguccuacuucaucgucggcaccgagggccccgccgccucccgcggcggccccaaggucgucuucggcaacuccugggacuccgacgaggacauguccacccgcccccagccccaggagcacaugcccaagguccucgacuccgacggcuacuccucccacaaccaggacggcaccaacggcgagaccgaggcccagcgcggcaccgccacccaccaggaguccgacucccucggcgagcccgccgucccccacaagggccucgacugcuaccucgacucccucuucgaccccguccucuccuacggcgacgccgaccucgagaagcccaccgccaucgccuaccgcaugaagggcggcggccagcccggcggcggcuccuccuccggcaccgaggacaccccccgccgcccccccgagcccaagcccauccccggccucgacgccuccacccucgcccuccagcaggccuucauccacaagcaggccguccuccucgcccgcgagaugacccuccaggccaccgcccuccagcagcagccccucuccgccgcccuccgcucccuccccgccgagaagccccccgcccccgaggcccagcccaccuccgucggcaccggcccccccgccaagcccguccuccuccgcgccacccccaagccccucgcccccgccccccucgccaaggccccccgccuccccaucaagcccgucgccgcccccguccucgcccaggaccaggccucccccgagaccaccucccccucccccgagcucguccgcuacuccacccucaacuccgagcacuucccccagcccacccagcagaucaagaacaucguccgccaguaccagcagcccuuccgcggcggccgccccgaggcccuccgcaaggacggcggcaaggucuucaugaagcgccccgacccccacgaggaggcccucaugauccucaagggccagaugacccaccucgccgccgcccccggcacccaggucucccgcgaggccgucgcccucgucaagcccgucaccuccgccccccgccccuccauggcccccaccuccgcccuccccucccgcucccucgagccccccgaggagcucacccagacccgccuccaccgccucaucaaccccaacuucuacggcuaccaggacgcccccuggaagaucuuccuccgcaaggaggucuucuaccccaaggacuccuacucccaccccguccagcucgaccuccucuuccgccagauccuccacgacacccucuccgaggccugccuccgcaucuccgaggacgagcgccuccgcaugaaggcccucuucgcccagaaccagcucgacacccagaagccccucgucaccgaguccgucaagcgcgccgucgucuccaccgcccgcgacaccugggaggucuacuucucccgcaucuuccccgccaccggcuccgucggcaccggcguccagcuccucgccgucucccacgucggcaucaagcuccuccgcauggucaagggcggccaggaggccggcggccagcuccgcguccuccgcgccuacuccuucgccgacauccucuucgucaccaugcccucccagaacaugcucgaguucaaccucgccuccgagaaggucauccucuucuccgcccgcgcccaccaggucaagacccucgucgacgacuucauccucgagcucaagaaggacuccgacuacgucgucgccguccgcaacuuccuccccgaggaccccgcccuccucgccuuccacaagggcgacaucauccaccuccagccccucgagcccccccgcgucggcuacuccgccggcugcgucguccgccgcaaggucgucuaccucgaggagcuccgccgccgcggccccgacuucggcuggcgcuucggcaccauccacggccgcgucggccgcuuccccuccgagcucguccagcccgccgccgcccccgacuuccuccagcuccccaccgagcccggccgcggccgcgccgccgccgucgccgccgccgucgccuccgccgccgccgcccaggaggucggccgccgccgcgagggcccccccguccgcgcccgcuccgccgaccacggcgaggacgcccucgcccucccccccuacaccaugcucgaguucgcccagaaguacuuccgcgacccccagcgccgcccccaggacggccuccgccucaaguccaaggagccccgcgagucccgcacccucgaggacaugcucugcuucaccaagaccccccuccaggagucccucaucgagcucuccgacuccucccucuccaagauggccaccgacauguuccucgccgucaugcgcuucaugggcgacgccccccucaagggccaguccgaccucgacguccucugcaaccuccucaagcucugcggcgaccacgaggucaugcgcgacgagugcuacugccaggucgucaagcagaucaccgacaacaccuccuccaagcaggacuccugccagcgcggcuggcgccuccucuacaucgucaccgccuaccacuccugcuccgagguccuccacccccaccucacccgcuuccuccaggacgucucccgcacccccggccuccccuuccagggcaucgccaaggccugcgagcagaaccuccagaagacccuccgcuucggcggccgccucgagcuccccuccuccaucgagcuccgcgccaugcucgccggccgcuccuccaagcgccagcucuuccuccuccccggcggccucgagcgccaccucaagaucaagaccugcaccgucgcccucgacgucgucgaggagaucugcgccgagauggcccucacccgccccgaggccuucaacgaguacgucaucuucgucgucaccaaccgcggccagcacgucugcccccucucccgccgcgccuacauccucgacgucgccuccgagauggagcaggucgacggcggcuacaugcucugguuccgccgcguccucugggaccagccccucaaguucgagaacgagcucuacgucaccaugcacuacaaccagguccuccccgacuaccucaagggccucuucuccuccguccccgccucccgccccuccgagcagcuccuccagcaggucuccaagcucgccucccuccagcaccgcgccaaggaccacuucuaccuccccuccguccgcgagguccaggaguacauccccgcccagcucuaccgcaccaccgccggcuccaccuggcucaaccucgucucccagcaccgccagcagacccaggcccucuccccccaccaggcccgcgcccaguuccucggccuccucuccgcccuccccauguucggcuccuccuucuucuucauccaguccugcuccaacaucgccguccccgcccccugcauccucgccaucaaccacaacggccucaacuuccucuccaccgagacccacgagcucauggucaaguucccccucaaggagauccaguccacccgcacccagcgccccaccgccaacuccuccuaccccuacgucgagaucgcccucggcgacgucgccgcccagcgcacccuccagcuccagcucgagcagggccucgagcucugccgcgucgucgccguccacgucgagaaccuccucuccgcccacgagaagcgccucacccucccccccuccgagaucacccuccucuga

SEQ ID NO: 46354 - RNA, 5643 nt, Artificial Sequence
  derived and/or modified sequence opt2 from MYO16__Homo_sapiens__NP_001185879
augucccacuaccacuucaucaagugcugcugcuuccagcucugcaacgucuuccgcucccacgagauggagaucgaccagugccuccucgagucccucccccucggccagcgccagcgccucgucaagcgcaugcgcugcgagcagaucaaggccuacuacgagcgcgagaaggccuuccagaagcaggagggcuuccucaagcgccucaagcacgccaagaaccccaagguccacuucaaccucaccgacaugcuccaggacgccaucauccaccacaacgacaaggagguccuccgccuccucaaggagggcgccgacccccacacccucgucuccuccggcggcucccuccuccaccucugcgcccgcuacgacaacgccuucaucgccgagauccucaucgaccgcggcgucaacgucaaccaccaggacgaggacuucuggacccccaugcacaucgccugcgccugcgacaaccccgacaucguccuccuccucguccucgccggcgccaacguccuccuccaggacgucaacggcaacaucccccucgacuacgccgucgagggcaccgaguccuccuccauccuccucaccuaccucgacgagaacggcgucgaccucaccucccuccgccagaugaagcuccagcgccccauguccaugcucaccgacgucaagcacuuccucuccuccggcggcaacgucaacgagaagaacgacgagggcgucacccuccuccacauggccugcgccuccggcuacaaggaggucgucucccucauccucgagcacggcggcgaccucaacaucgucgacgaccaguacuggaccccccuccaccucgccgccaaguacggccagaccaaccucgucaagcuccuccucaugcaccaggccaacccccaccucgucaacugcaacgaggagaaggccuccgacaucgccgccuccgaguucaucgaggagaugcuccucaaggccgagaucgccugggaggagaagaugaaggagccccucuccgccuccacccucgcccaggaggagcccuacgaggagaucauccacgaccuccccguccucuccuccaagcucuccccccucguccuccccaucgccaagcaggacucccuccucgagaaggacaucauguucaaggacgccaccaagggccucugcaagcagcagucccaggacuccauccccgagaaccccaugauguccggcuccaccaagcccgagcaggucaagcucaugccccccgcccccaacgacgaccucgccacccucuccgagcucaacgacggcucccuccucuacgagauccagaagcgcuucggcaacaaccagaucuacaccuucaucggcgacauccuccuccucgucaaccccuacaaggagcuccccaucuacuccuccauggucucccagcucuacuucuccuccuccggcaagcucugcuccucccuccccccccaccucuucuccugcgucgagcgcgccuuccaccagcucuuccgcgagcagcgcccccagugcuucauccucuccggcgagcgcggcuccggcaaguccgaggccuccaagcagaucauccgccaccucaccugccgcgccggcgccucccgcgccacccucgacucccgcuucaagcacgucgucugcauccucgaggccuucggccacgccaagaccacccucaacgaccucuccuccugcuucaucaaguacuucgagcuccaguucugcgagcgcaagcagcagcucaccggcgcccgcaucuacaccuaccuccucgagaagucccgccucgucucccagccccucggccaguccaacuuccucaucuucuaccuccucauggacggccucuccgccgaggagaaguacggccuccaccucaacaaccucugcgcccaccgcuaccucaaccagaccauccaggacgacgccuccaccggcgagcgcucccucaaccgcgagaagcucgccguccucaagcgcgcccucaacgucgucggcuucuccucccucgaggucgagaaccucuucgucauccucgccgccauccuccaccucggcgacauccgcuucaccgcccucaacgagggcaacuccgccuucgucuccgaccuccagcuccucgagcaggucgccggcaugcuccaggucuccaccgacgagcucgccuccgcccucaccaccgacauccaguacuucaagggcgacaugaucauccgccgccacaccauccagaucgccgaguucuuccgcgaccuccucgccaagucccucuacucccgccucuucuccuuccucgucaacaccaugaacuccugccuccacucccaggacgagcagaaguccaugcagacccucgacaucggcauccucgacaucuucggcuucgaggaguuccagaagaacgaguucgagcagcucugcgucaacaugaccaacgagaagaugcaccacuacaucaacgagguccucuuccuccacgagcaggucgagugcguccaggagggcgucaccauggagaccgccuacucccccggcaaccagaacggcguccucgacuucuucuuccagaagcccuccggcuuccucacccuccucgacgaggagucccagaugaucugguccgucgaguccaacuuccccaagaagcuccagucccuccucgaguccuccaacaccaacgccgucuacucccccaugaaggacggcaacggcaacgucgcccucaaggaccacggcaccgccuucaccaucaugcacuacgccggccgcgucauguacgacgucgucggcgccaucgagaagaacaaggacucccucucccagaaccuccucuucgucaugaagaccuccgagaacgucgucaucaaccaccucuuccaguccaagcucucccagaccggcucccucgucuccgccuaccccuccuucaaguuccgcggccacaaguccgcccuccucuccaagaagaugaccgccuccuccaucaucggcgagaacaagaacuaccucgagcucuccaagcuccucaagaagaagggcaccuccaccuuccuccagcgccucgagcgcggcgaccccgucaccaucgccucccagcuccgcaagucccucauggacaucaucggcaagcuccagaagugcaccccccacuucauccacugcauccgccccaacaacuccaagcuccccgacaccuucgacaacuucuacgucuccgcccagcuccaguacaucggcguccucgagauggucaagaucuuccgcuacggcuaccccguccgccucuccuucuccgacuuccucucccgcuacaagccccucgccgacaccuuccuccgcgagaagaaggagcaguccgccgccgagcgcugccgccucguccuccagcagugcaagcuccagggcuggcagaugggcguccgcaaggucuuccucaaguacuggcacgccgaccagcucaacgaccucugccuccagcuccagcgcaagaucaucaccugccagaaggucauccgcggcuuccucgcccgccagcaccuccuccagcgcaucuccauccgccagcaggaggucaccuccaucaacuccuuccuccagaacaccgaggacaugggccucaagaccuacgacgcccucgucauccagaacgccuccgacaucgcccgcgagaacgaccgccuccgcuccgagaugaacgcccccuaccacaaggagaagcucgagguccgcaacaugcaggaggagggcuccaagcgcaccgacgacaaguccggcccccgccacuuccaccccuccuccauguccgucugcgccgccgucgacggccucggccagugccucgucggccccuccaucuggucccccucccuccacuccgucuucuccauggacgacuccuccucccuccccuccccccgcaagcagcccccccccaagcccaagcgcgaccccaacacccgccucuccgccuccuacgaggccgucuccgccugccucuccgccgcccgcgaggccgccaacgaggcccucgcccgcccccgcccccacuccgacgacuacuccaccaugaagaagauccccccccgcaagcccaagcgcucccccaacaccaagcucuccggcuccuacgaggagaucuccggcucccgccccggcgacgcccgccccgccggcgcccccggcgccgccgcccgcguccucacccccggcaccccccagugcgcccucccccccgccgccccccccggcgacgaggacgacuccgagcccgucuacaucgagaugcucggccacgccgcccgccccgacucccccgaccccggcgaguccgucuacgaggagaugaagugcugccuccccgacgacggcggccccggcgccggcuccuuccuccuccacggcgccucccccccccuccuccaccgcgcccccgaggacgaggccgccggcccccccggcgacgccugcgacauccccccccccuuccccaaccuccucccccaccgccccccccuccucgucuucccccccacccccgucaccugcucccccgccuccgacgaguccccccucaccccccucgaggucaagaagcuccccguccucgagaccaaccucaaguaccccguccagcccgagggcuccuccccccucuccccccaguacuccaagucccagaagggcgacggcgaccgccccgccucccccggccucgcccucuucaacggcuccggccgcgccuccccccccuccaccccccccccccccccccccccccccggccccccccccgcccccuaccgccccugcgcccaccucgccuucccccccgagcccgcccccgucaacgccggcaaggccggccccuccgccgaggcccccaagguccaccccaagcccaacuccgcccccgucgccggccccugcuccuccuuccccaagauccccuacucccccgucaaggccacccgcgccgacgcccgcaaggccggcuccuccgccuccccccccgcccccuacuccccccccuccucccgcccccucuccuccccccucgacgagcucgccucccucuucaacuccggccgcuccguccuccgcaaguccgccgccggccgcaagauccgcgaggccgagggcuucgagaccaacaugaacaucuccucccgcgacgaccccuccaccuccgagaucaccuccgagacccaggaccgcaacgccaacaaccacggcauccagcucuccaacucccucuccuccgccaucaccgccgagaacggcaacuccaucuccaacggccuccccgaggaggacggcuacucccgccucuccaucuccggcaccggcaccuccaccuuccagcgccaccgcgacucccacaccacccaggucauccaccagcuccgccucuccgagaacgaguccgucgcccuccaggagcuccucgacuggcgccgcaagcucugcgaggagggccaggacuggcagcagauccuccaccacgccgagccccgcguccccccccccccccccugcaagaagcccucccuccucaagaagcccgagggcgccuccugcaaccgccuccccuccgagcucugggacaccaccaucuga

SEQ ID NO: 46355 - RNA, 7704 nt, Artificial Sequence
  derived and/or modified sequence opt2 from MYO18B__Homo_sapiens__NP_115997
auggccaucuccucccgccucgcccucugggagcagaagauccgcgaggaggacaagucccccccccccuccuccccccccccccucuucuccgucauccccggcggcuucaucaagcagcucguccgcggcaccgagaaggaggccaaggaggcccgccagcgcaagcagcucgccgucgccucccccgagcgcgagauccccgagaucuccaucucccagcccaacuccaaguccuccuccggcacccgcuccggcucccagcagaucucccaggacgaccaguccuccucccccggcuccuccgacauccucggcaaggaguccgagggcucccgcucccccgaccccgagcagaugaccuccaucaacggcgagaaggcccaggagcucggcuccuccgccacccccaccaagaagaccguccccuucaagcgcggcguccgccgcggcgacguccuccucauggucgccaagcucgaccccgacuccgccaagcccgagaagacccacccccacgacgccccccccugcaagaccuccccccccgccaccgacaccggcaaggagaagaagggcgagaccucccgcacccccugcggcucccaggccuccaccgagauccucgcccccaaggccgagaagacccgcaccggcggccucggcgaccccggccagggcaccgucgcccucaagaagggcgaggagggccaguccaucgucggcaagggccucggcacccccaagaccaccgagcucaaggaggccgagccccagggcaaggaccgccagggcacccgcccccaggcccagggccccggcgagggcguccgccccggcaaggccgagaaggagggcgccgagcccaccaacaccgucgagaagggcaacgucuccaaggacgucggcuccgagggcaagcacguccgcccccagauccccggccgcaaguggggcggcuuccucggccgccgcuccaagugggacggcccccagaacaagaaggacaaggagggcguccuccucuccaaggccgagaagaccggcgagccccagacccagauggagaagaccucccagguccagggcgagcucggcgacgaccuccgcaugggcgagaaggccggcgagcuccgcuccaccaccggcaaggccggcgaguccugggacaagaaggagaagaugggccagccccagggcaaguccggcaacgccggcgaggcccgcucccagaccgagaagggcugcgaggcccccaaggaggucuccaccauggucgagucccccgccgcccccggcaagggcggcuggcccggcucccgcggccaggaggccgaggagcccugcucccgcgccggcgacggcgccggcgcccucgagaccgagcucgagggccccucccagcccgcccucgagaaggacgccgagcgcccccgcauccgcaaggagaaccaggacggccccgccccccaggaggagggcaagggcggccagucccgcgacuccgaccaggcccccgaggaccgcugguacgaggccgagaaggucuggcucgcccagaaggacggcuucacccucgccaccguccucaagcccgacgagggcaccgccgaccuccccgccggccgcguccgccucuggaucgacgccgacaagaccaucaccgaggucgacgaggagcacguccaccgcgccaacccccccgagcucgaccaggucgaggaccucgccucccucaucuccgucaacgaguccuccguccucaacacccuccuccagcgcuacaaggcccagcuccuccacaccugcaccggccccgaccucaucguccuccagccccgcggccccuccguccccuccgccggcaagguccccaagggccgccgcgacggccuccccgcccacaucggcuccauggcccagcgcgccuacugggcccuccucaaccagcgccgcgaccaguccaucgucgcccucggcugguccggcgccggcaagaccaccugcugcgagcagguccucgagcaccucgucggcauggccggcuccgucgacggccgcgucuccgucgagaagauccgcgccaccuucaccguccuccgcgccuucggcuccgucuccauggcccacucccgcuccgccacccgcuucuccauggucaugucccucgacuucaacgccaccggccgcaucaccgccgcccagcuccagaccaugcuccucgagaagucccgcgucgcccgccagcccgagggcgaguccaacuuccucgucuucucccagaugcucgccggccucgaccucgaccuccgcaccgagcucaaccuccaccagauggccgacuccuccuccuucggcaugggcgucugguccaagcccgaggacaagcagaaggccgccgccgccuucgcccagcuccagggcgccauggagaugcucggcaucuccgaguccgagcagcgcgccgucuggcgcguccucgccgccaucuaccaccucggcgccgccggcgccugcaaggucggccgcaagcaguucaugcgcuucgagugggccaacuacgccgccgaggcccucggcugcgaguacgaggagcucaacaccgccaccuucaagcaccaccuccgccagaucauccagcagaugaccuucggccccucccgcuggggccucgaggacgaggagaccuccuccggccucaagaugaccggcgucgacugcgucgagggcauggccuccggccucuaccaggagcucuucgccgccgucgucucccucaucaaccgcuccuucuccucccaccaccucuccauggccuccaucauggucgucgacucccccggcuuccagaacccccgccaccagggcaaggaccgcgccgccaccuucgaggagcucugccacaacuacgcccacgagcgccuccagcuccucuucuaccagcgcaccuucgucuccacccuccagcgcuaccaggaggagggcguccccguccaguucgaccuccccgaccccucccccggcaccaccgucgccgucgucgaccagaaccccucccagguccgccuccccgccggcggcggcgcccaggacgcccgcggccucuucuggguccucgacgaggagguccacgucgagggcuccuccgacuccgucguccucgagcgccucugcgccgccuucgagaagaagggcgccggcaccgagggcuccuccgcccuccgcaccugcgagcagccccuccagugcgagaucuuccaccagcucggcugggaccccguccgcuacgaccucaccggcuggcuccaccgcgccaagcccaaccucuccgcccucgacgccccccagguccuccaccaguccaagcgcgaggagcuccgcucccucuuccaggcccgcgccaagcucccccccgucugccgcgccgucgccggccucgagggcaccucccagcaggcccuccagcgcucccgcaugguccgccgcaccuucgccuccucccucgccgccguccgccgcaaggcccccugcucccagaucaagcuccagauggacgcccucaccuccaugaucaagcgcucccgccuccacuucauccacugccucguccccaaccccgucgucgagucccgcuccggccaggagucccccccccccccccagcccggccgcgacaagcccggcgccggcggcccccucgcccucgacauccccgcccuccgcguccagcucgccggcuuccacauccucgaggcccuccgccuccaccgcaccggcuacgccgaccacaugggccucacccgcuuccgccgccaguuccagguccucgacgccccccuccucaagaagcucauguccaccuccgagggcaucgacgagcgcaaggccgucgaggagcuccucgagacccucgaccucgagaagaaggccgucgccgucggccacucccaggucuuccucaaggccggcgucaucucccgccucgagaagcagcgcgagaagcucgucucccaguccaucguccucuuccaggccgccugcaagggcuuccucucccgccaggaguucaagaagcucaagauccgccgccucgccgcccagugcauccagaagaacgucgccgucuuccucgccgucaaggacuggcccugguggcagcuccucggcucccuccagccccuccucuccgccaccaucggcaccgagcagcuccgcgccaaggaggaggagcucaccacccuccgccgcaagcucgagaaguccgagaagcuccgcaacgagcuccgccagaacaccgaccuccucgaguccaagaucgccgaccucaccuccgaccucgccgacgagcgcuucaagggcgacgucgccugccagguccucgaguccgagcgcgccgagcgccuccaggccuuccgcgagguccaggagcucaaguccaagcacgagcagguccagaagaagcucggcgacgucaacaagcagcucgaggaggcccagcagaagauccagcucaacgaccucgagcgcaaccccaccggcggcgccgacgaguggcagaugcgcuucgacugcgcccagauggagaacgaguuccuccgcaagcgccuccagcagugcgaggagcgccucgacuccgagcucaccgcccgcaaggagcucgagcagaagcucggcgagcuccaguccgccuacgacggcgccaagaagauggcccaccagcucaagcgcaagugccaccaccucaccugcgaccucgaggacaccugcguccuccucgagaaccagcagucccgcaaccacgagcucgagaagaagcagaagaaguucgaccuccagcucgcccaggcccucggcgaguccgucuucgagaagggccuccgcgagaaggucacccaggagaacaccuccguccgcugggagcucggccagcuccagcagcagcucaagcagaaggagcaggaggccucccagcucaagcagcaggucgagaugcuccaggaccacaagcgcgagcuccucggcucccccucccucggcgagaacugcgucgccggccucaaggagcgccucuggaagcucgaguccuccgcccucgagcagcagaagauccagucccagcaggagaacaccaucaagcagcucgagcagcuccgccagcgcuucgagcucgagaucgagcgcaugaagcagaugcaccagaaggaccgcgaggaccaggaggaggagcucgaggacguccgccaguccugccagaagcgccuccaccagcucgagaugcagcucgagcaggaguacgaggagaagcagaugguccuccacgagaagcaggaccucgagggccucaucggcacccucugcgaccagaucggccaccgcgacuucgacgucgagaagcgccuccgccgcgaccuccgccgcacccacgcccuccucuccgacguccagcuccuccucggcaccauggaggacggcaagaccuccgucuccaaggaggagcucgagaagguccacucccagcucgagcaguccgaggccaagugcgaggaggcccucaagacccagaagguccucaccgccgaccucgaguccaugcacuccgagcucgagaacaugacccgcaacaagucccucgucgacgagcagcucuaccgccuccaguucgagaaggccgaccuccucaagcgcaucgacgaggaccaggacgaccucaacgagcucaugcagaagcacaaggaccucaucgcccaguccgccgccgacaucggccagauccaggagcuccagcuccagcucgaggaggccaagaaggagaagcacaagcuccaggagcagcuccaggucgcccagaugcgcaucgaguaccucgagcaguccaccgucgaccgcgccaucgucucccgccaggaggccgucaucugcgaccucgagaacaagaccgaguuccagaagguccagaucaagcgcuucgagguccucgucauccgccuccgcgacucccucaucaagaugggcgaggagcucucccaggccgccaccuccgagucccagcagcgcgaguccucccaguacuaccagcgccgccucgaggagcucaaggccgacauggaggagcucguccagcgcgaggccgaggccucccgccgcugcauggagcucgagaaguacgucgaggagcucgccgccguccgccagacccuccagaccgaccucgagaccuccauccgccgcaucgccgaccuccaggccgcccucgaggaggucgccuccuccgacuccgacaccgaguccguccagaccgccgucgacugcggcuccuccggccgcaaggagauggacaacgucuccauccucuccucccagcccgagggcucccuccaguccuggcucuccugcacccucucccucgccaccgacaccaugcgcacccccucccgccaguccgccaccuccucccgcauccucuccccccgcaucaacgaggaggccggcgacaccgagcgcacccaguccgcccucgcccucucccgcgcccgcuccaccaacguccacuccaagaccuccggcgacaagcccgucuccccccacuucguccgccgccagaaguacugccacuucggcgacggcgagguccucgccguccagcgcaaguccaccgagcgccucgagcccgccuccuccccccucgccucccgcuccaccaacaccuccccccucucccgcgagaagcuccccucccccuccgccgcccucuccgaguucgucgagggccuccgccgcaagcgcgcccagcgcggccagggcuccacccucggccucgaggacuggcccacccuccccaucuaccagaccaccggcgccuccacccuccgccgcggccgcgccggcuccgacgagggcaaccucucccuccgcgucggcgccaaguccccccucgagaucgagggcgccgccggcggccuccuccgcuccaccucccucaagugcaucuccuccgacggcgucggcggcaccacccuccuccccgagaaguccaagacccaguucuccuccugcgagucccuccucgagucccgccccuccaugggccgcaagcucuccucccccaccaccccccgcgacaugcuccucucccccacccuccgcccccgccgccgcugccucgaguccuccgucgacgacgccggcugccccgaccucggcaaggagccccucgucuuccagaaccgccaguucgcccaccucauggaggagccccucggcuccgaccccuucuccuggaagcuccccucccucgacuacgagcgcaagaccaaggucgacuucgacgacuuccuccccgccauccgcaagccccagacccccaccucccucgccggcuccgccaagggcggccaggacggcucccagcgcuccuccauccacuucgagaccgaggaggccaaccgcuccuuccucuccggcaucaagaccauccucaagaagucccccgagcccaaggaggaccccgcccaccucuccgacuccuccuccuccuccggcuccaucgucuccuucaaguccgccgacuccaucaagucccgccccggcaucccccgccucgccggcgacggcggcgagcgcaccucccccgagcgccgcgagcccggcaccggccgcaaggacgacgacgucgccuccaucaugaagaaguaccuccagaaguga

SEQ ID NO: 46356 - RNA, 3132 nt, Artificial Sequence
  derived and/or modified sequence opt2 from MYO1A__Homo_sapiens__NP_005370
augccccuccucgagggcuccgucggcgucgaggaccucguccuccucgagccccucgucgaggagucccuccucaagaaccuccagcuccgcuacgagaacaaggagaucuacaccuacaucggcaacgucgucaucuccgucaaccccuaccagcagcuccccaucuacggccccgaguucaucgccaaguaccaggacuacaccuucuacgagcucaagccccacaucuacgcccucgccaacgucgccuaccagucccuccgcgaccgcgaccgcgaccagugcauccucaucaccggcgaguccggcuccggcaagaccgaggccuccaagcucgucauguccuacgucgccgccgucugcggcaagggcgagcaggucaacuccgucaaggagcagcuccuccaguccaaccccguccucgaggccuucggcaacgccaagaccauccgcaacaacaacuccucccgcuucggcaaguacauggacaucgaguucgacuucaagggcuccccccucggcggcgucaucaccaacuaccuccucgagaagucccgccucgucaagcagcucaagggcgagcgcaacuuccacaucuucuaccagcuccucgccggcgccgacgagcagcuccucaaggcccucaagcucgagcgcgacaccaccggcuacgccuaccucaaccacgaggucucccgcgucgacggcauggacgacgccuccuccuuccgcgccguccaguccgccauggccgucaucggcuucuccgaggaggagauccgccagguccucgaggucaccuccaugguccucaagcucggcaacguccucgucgccgacgaguuccaggccuccggcauccccgccuccggcauccgcgacggccgcggcguccgcgagaucggcgagauggucggccucaacuccgaggaggucgagcgcgcccucugcucccgcaccauggagaccgccaaggagaaggucgucaccgcccucaacgucaugcaggcccaguacgcccgcgacgcccucgccaagaacaucuacucccgccucuucgacuggaucgucaaccgcaucaacgaguccaucaaggucggcaucggcgagaagaagaaggucaugggcguccucgacaucuacggcuucgagauccucgaggacaacuccuucgagcaguucgucaucaacuacugcaacgagaagcuccagcaggucuucaucgagaugacccucaaggaggagcaggaggaguacaagcgcgagggcauccccuggaccaaggucgacuacuucgacaacggcaucaucugcaagcucaucgagcacaaccagcgcggcauccucgccaugcucgacgaggagugccuccgccccggcgucgucuccgacuccaccuuccucgccaagcucaaccagcucuucuccaagcacggccacuacgaguccaaggucacccagaacgcccagcgccaguacgaccacaccaugggccucuccugcuuccgcaucugccacuacgccggcaaggucaccuacaacgucaccuccuucaucgacaagaacaacgaccuccucuuccgcgaccuccuccaggccauguggaaggcccagcacccccuccuccgcucccucuuccccgagggcaaccccaagcaggccucccucaagcgcccccccaccgccggcgcccaguucaaguccuccgucgccauccucaugaagaaccucuacuccaagucccccaacuacauccgcugcaucaagcccaacgagcaccagcagcgcggccaguucuccuccgaccucgucgccacccaggcccgcuaccucggccuccucgagaacguccgcguccgccgcgccggcuacgcccaccgccagggcuacggccccuuccucgagcgcuaccgccuccucucccgcuccaccuggccccacuggaacggcggcgaccgcgagggcgucgagaagguccucggcgagcucuccauguccuccggcgagcucgccuucggcaagaccaagaucuucauccgcucccccaagacccucuucuaccucgaggagcagcgccgccuccgccuccagcagcucgccacccucauccagaagaucuaccgcggcuggcgcugccgcacccacuaccagcucaugcgcaagucccagauccucaucuccuccugguuccgcggcaacaugcagaagaagugcuacggcaagaucaaggccuccguccuccucauccaggccuucguccgcggcuggaaggcccgcaagaacuaccgcaaguacuuccgcuccgaggccgcccucacccucgccgacuucaucuacaaguccaugguccagaaguuccuccucggccucaagaacaaccuccccuccaccaacguccucgacaagaccuggcccgccgcccccuacaagugccucuccaccgccaaccaggagcuccagcagcucuucuaccaguggaagugcaagcgcuuccgcgaccagcucucccccaagcaggucgagauccuccgcgagaagcucugcgccuccgagcucuucaagggcaagaaggccuccuacccccaguccguccccauccccuucugcggcgacuacaucggccuccagggcaaccccaagcuccagaagcucaagggcggcgaggagggccccguccucauggccgaggccgucaagaaggucaaccgcggcaacggcaagaccuccucccgcauccuccuccucaccaagggccacgucauccucaccgacaccaagaagucccaggccaagaucgucaucggccucgacaacgucgccggcgucuccgucaccucccucaaggacggccucuucucccuccaccucuccgagauguccuccgucggcuccaagggcgacuuccuccucgucuccgagcacgucaucgagcuccucaccaagauguaccgcgccguccucgacgccacccagcgccagcucaccgucaccgucaccgagaaguucuccguccgcuucaaggagaacuccgucgccgucaaggucguccagggccccgccggcggcgacaacuccaagcuccgcuacaagaagaagggcucccacugccucgaggucaccguccaguga

SEQ ID NO: 46357 - RNA, 3237 nt, Artificial Sequence
  derived and/or modified sequence opt2 from MYO1B__Homo_sapiens__NP_036355
auggccaagauggaggucaagaccucccuccucgacaacaugaucggcgucggcgacaugguccuccucgagccccucaacgaggagaccuucaucaacaaccucaagaagcgcuucgaccacuccgagaucuacaccuacaucggcuccgucgucaucuccgucaaccccuaccgcucccuccccaucuacucccccgagaaggucgaggaguaccgcaaccgcaacuucuacgagcucuccccccacaucuucgcccucuccgacgaggccuaccgcucccuccgcgaccaggacaaggaccagugcauccucaucaccggcgaguccggcgccggcaagaccgaggccuccaagcucgucauguccuacgucgccgccgucugcggcaagggcgccgaggucaaccaggucaaggagcagcuccuccaguccaaccccguccucgaggccuucggcaacgccaagaccguccgcaacgacaacuccucccgcuucggcaaguacauggacaucgaguucgacuucaagggcgacccccucggcggcgucaucuccaacuaccuccucgagaagucccgcgucgucaagcagccccgcggcgagcgcaacuuccacgucuucuaccagcuccucuccggcgccuccgaggagcuccucaacaagcucaagcucgagcgcgacuucucccgcuacaacuaccucucccucgacuccgccaaggucaacggcgucgacgacgccgccaacuuccgcaccguccgcaacgccaugcagaucgucggcuucauggaccacgaggccgaguccguccucgccgucgucgccgccguccucaagcucggcaacaucgaguucaagcccgagucccgcgucaacggccucgacgaguccaagaucaaggacaagaacgagcucaaggagaucugcgagcucaccggcaucgaccaguccguccucgagcgcgccuucuccuuccgcaccgucgaggccaagcaggagaaggucuccaccacccucaacgucgcccaggccuacuacgcccgcgacgcccucgccaagaaccucuacucccgccucuucuccuggcucgucaaccgcaucaacgaguccaucaaggcccagaccaagguccgcaagaaggucaugggcguccucgacaucuacggcuucgagaucuucgaggacaacuccuucgagcaguucaucaucaacuacugcaacgagaagcuccagcagaucuucaucgagcucacccucaaggaggagcaggaggaguacauccgcgaggacaucgaguggacccacaucgacuacuucaacaacgccaucaucugcgaccucaucgagaacaacaccaacggcauccucgccaugcucgacgaggagugccuccgccccggcaccgucaccgacgagaccuuccucgagaagcucaaccaggucugcgccacccaccagcacuucgagucccgcauguccaagugcucccgcuuccucaacgacaccucccucccccacuccugcuuccgcauccagcacuacgccggcaagguccucuaccaggucgagggcuucgucgacaagaacaacgaccuccucuaccgcgaccucucccaggccauguggaaggccucccacgcccucaucaagucccucuuccccgagggcaaccccgccaagaucaaccucaagcgcccccccaccgccggcucccaguucaaggccuccgucgccacccucaugaagaaccuccagaccaagaaccccaacuacauccgcugcaucaagcccaacgacaagaaggccgcccacaucuucaacgaggcccucgucugccaccagauccgcuaccucggccuccucgagaacguccgcguccgccgcgccggcuacgccuuccgccaggccuacgagcccugccucgagcgcuacaagaugcucugcaagcagaccuggccccacuggaagggccccgcccgcuccggcgucgagguccucuucaacgagcucgagauccccgucgaggaguacuccuucggccgcuccaagaucuucauccgcaacccccgcacccucuucaagcucgaggaccuccgcaagcagcgccucgaggaccucgccacccucauccagaagaucuaccgcggcuggaagugccgcacccacuuccuccucaugaagaagucccagaucgucaucgccgccugguaccgccgcuacgcccagcagaagcgcuaccagcagaccaaguccuccgcccucgucauccaguccuacauccgcggcuggaaggcccgcaagauccuccgcgagcucaagcaccagaagcgcugcaaggaggccgucaccaccaucgccgccuacuggcacggcacccagguccgccgcgaguaccgcaaguucuuccgcgccaacgccggcaagaagaucuacgaguucacccuccagcgcaucguccagaaguacuuccucgagaugaagaacaagaugcccucccucucccccaucgacaagaacuggcccucccgccccuaccucuuccucgacuccacccacaaggagcucaagcgcaucuuccaccucuggcgcugcaagaaguaccgcgaccaguucaccgaccagcagaagcucaucuacgaggagaagcucgaggccuccgagcucuucaaggacaagaaggcccucuaccccuccuccgucggccagcccuuccagggcgccuaccucgagaucaacaagaaccccaaguacaagaagcucaaggacgccaucgaggagaagaucaucaucgccgaggucgucaacaagaucaaccgcgccaacggcaaguccaccucccgcaucuuccuccucaccaacaacaaccuccuccucgccgaccagaaguccggccagaucaaguccgaggucccccucgucgacgucaccaaggucuccauguccucccagaacgacggcuucuucgccguccaccucaaggagggcuccgaggccgccuccaagggcgacuuccucuucuccuccgaccaccucaucgagauggccaccaagcucuaccgcaccacccucucccagaccaagcagaagcucaacaucgagaucuccgacgaguuccucguccaguuccgccaggacaaggucugcgucaaguucauccagggcaaccagaagaacggcuccguccccaccugcaagcgcaagaacaaccgccuccucgaggucgccguccccuga

SEQ ID NO: 46358 - RNA, 3192 nt, Artificial Sequence
  derived and/or modified sequence opt2 from MYO1C__Homo_sapiens__NP_001074248
auggcccuccaggucgagcucguccccaccggcgagaucauccgcgucguccacccccaccgccccugcaagcucgcccucggcuccgacggcguccgcgucaccauggaguccgcccucaccgcccgcgaccgcgucggcguccaggacuucguccuccucgagaacuucaccuccgaggccgccuucaucgagaaccuccgccgccgcuuccgcgagaaccucaucuacaccuacaucggccccguccucgucuccgucaaccccuaccgcgaccuccagaucuacucccgccagcacauggagcgcuaccgcggcgucuccuucuacgagguccccccccaccucuucgccgucgccgacaccgucuaccgcgcccuccgcaccgagcgccgcgaccaggccgucaugaucuccggcgaguccggcgccggcaagaccgaggccaccaagcgccuccuccaguucuacgccgagaccugccccgcccccgagcgcggcggcgccguccgcgaccgccuccuccaguccaaccccguccucgaggccuucggcaacgccaagacccuccgcaacgacaacuccucccgcuucggcaaguacauggacguccaguucgacuucaagggcgcccccgucggcggccacauccucuccuaccuccucgagaagucccgcgucguccaccagaaccacggcgagcgcaacuuccacaucuucuaccagcuccucgagggcggcgaggaggagacccuccgccgccucggccucgagcgcaacccccaguccuaccucuaccucgucaagggccagugcgccaaggucuccuccaucaacgacaaguccgacuggaaggucguccgcaaggcccucaccgucaucgacuucaccgaggacgaggucgaggaccuccucuccaucgucgccuccguccuccaccucggcaacauccacuucgccgccaacgaggaguccaacgcccaggucaccaccgagaaccagcucaaguaccucacccgccuccucuccgucgagggcuccacccuccgcgaggcccucacccaccgcaagaucaucgccaagggcgaggagcuccucuccccccucaaccucgagcaggccgccuacgcccgcgacgcccucgccaaggccgucuacucccgcaccuucaccuggcucgucggcaagaucaaccgcucccucgccuccaaggacgucgagucccccuccuggcgcuccaccaccguccucggccuccucgacaucuacggcuucgaggucuuccagcacaacuccuucgagcaguucugcaucaacuacugcaacgagaagcuccagcagcucuucaucgagcucacccucaaguccgagcaggaggaguacgaggccgagggcaucgccugggagcccguccaguacuucaacaacaagaucaucugcgaccucgucgaggagaaguucaagggcaucaucuccauccucgacgaggagugccuccgccccggcgaggccaccgaccucaccuuccucgagaagcucgaggacaccgucaagcaccacccccacuuccucacccacaagcucgccgaccagcgcacccgcaagucccucggccgcggcgaguuccgccuccuccacuacgccggcgaggucaccuacuccgucaccggcuuccucgacaagaacaacgaccuccucuuccgcaaccucaaggagaccaugugcuccuccaagaaccccaucaugucccagugcuucgaccgcuccgagcucuccgacaagaagcgccccgagaccgucgccacccaguucaagaugucccuccuccagcucgucgagauccuccaguccaaggagcccgccuacguccgcugcaucaagcccaacgacgccaagcagcccggccgcuucgacgagguccucauccgccaccaggucaaguaccucggccuccucgagaaccuccgcguccgccgcgccggcuucgccuaccgccgcaaguacgaggccuuccuccagcgcuacaagucccucugccccgagaccuggcccaccugggccggccgcccccaggacggcgucgccguccucguccgccaccucggcuacaagcccgaggaguacaagaugggccgcaccaagaucuucauccgcuuccccaagacccucuucgccaccgaggacgcccucgagguccgccgccagucccucgccaccaagauccaggccgccuggcgcggcuuccacuggcgccagaaguuccuccgcgucaagcgcuccgccaucugcauccaguccugguggcgcggcacccucggccgccgcaaggccgccaagcgcaagugggccgcccagaccauccgccgccucauccgcggcuucguccuccgccacgccccccgcugccccgagaacgccuucuuccucgaccacguccgcaccuccuuccuccucaaccuccgccgccagcucccccagaacguccucgacaccuccuggcccacccccccccccgcccuccgcgaggccuccgagcuccuccgcgagcucugcaucaagaacauggucuggaaguacugccgcuccaucucccccgaguggaagcagcagcuccagcagaaggccgucgccuccgagaucuucaagggcaagaaggacaacuacccccaguccgucccccgccucuucaucuccacccgccucggcaccgacgagaucuccccccgcguccuccaggcccucggcuccgagcccauccaguacgccguccccgucgucaaguacgaccgcaagggcuacaagccccgcucccgccagcuccuccucacccccaacgccgucgucaucgucgaggacgccaaggucaagcagcgcaucgacuacgccaaccucaccggcaucuccgucuccucccucuccgacucccucuucguccuccacguccagcgcgccgacaacaagcagaagggcgacgucguccuccaguccgaccacgucaucgagacccucaccaagaccgcccucuccgccaaccgcgucaacuccaucaacaucaaccagggcuccaucaccuucgccggcggccccggccgcgacggcaccaucgacuucacccccggcuccgagcuccucaucaccaaggccaagaacggccaccucgccgucgucgccccccgccucaacucccgcuga

SEQ ID NO: 46359 - RNA, 3021 nt, Artificial Sequence
  derived and/or modified sequence opt2 from MYO1D__Homo_sapiens__NP_056009
auggccgagcaggagucccucgaguucggcaaggccgacuucguccucauggacaccgucuccaugcccgaguucauggccaaccuccgccuccgcuucgagaagggccgcaucuacaccuucaucggcgaggucgucgucuccgucaaccccuacaagcuccucaacaucuacggccgcgacaccaucgagcaguacaagggccgcgagcucuacgagcgccccccccaccucuucgccaucgccgacgccgccuacaaggccaugaagcgccgcuccaaggacaccugcaucgucaucuccggcgaguccggcgccggcaagaccgaggccuccaaguacaucaugcaguacaucgccgccaucaccaaccccucccagcgcgccgaggucgagcgcgucaagaacaugcuccucaaguccaacugcguccucgaggccuucggcaacgccaagaccaaccgcaacgacaacuccucccgcuucggcaaguacauggacaucaacuucgacuucaagggcgaccccaucggcggccacaucaacaacuaccuccucgagaagucccgcgucaucguccagcagcccggcgagcgcuccuuccacuccuucuaccagcuccuccagggcggcuccgagcagaugcuccgcucccuccaccuccagaagucccucuccuccuacaacuacauccacgucggcgcccagcucaaguccuccaucaacgacgccgccgaguuccgcgucgucgccgacgccaugaaggucaucggcuucaagcccgaggagauccagaccgucuacaagauccucgccgccauccuccaccucggcaaccucaaguucgucgucgacggcgacaccccccucaucgagaacggcaaggucgucuccaucaucgccgagcuccucuccaccaagaccgacauggucgagaaggcccuccucuaccgcaccgucgccaccggccgcgacaucaucgacaagcagcacaccgagcaggaggccuccuacggccgcgacgccuucgccaaggccaucuacgagcgccucuucugcuggaucgucacccgcaucaacgacaucaucgaggucaagaacuacgacaccaccauccacggcaagaacaccgucaucggcguccucgacaucuacggcuucgagaucuucgacaacaacuccuucgagcaguucugcaucaacuacugcaacgagaagcuccagcagcucuucauccagcucguccucaagcaggagcaggaggaguaccagcgcgagggcauccccuggaagcacaucgacuacuucaacaaccagaucaucgucgaccucgucgagcagcagcacaagggcaucaucgccauccucgacgacgccugcaugaacgucggcaaggucaccgacgagauguuccucgaggcccucaacuccaagcucggcaagcacgcccacuucuccucccgcaagcucugcgccuccgacaagauccucgaguucgaccgcgacuuccgcauccgccacuacgccggcgacgucgucuacuccgucaucggcuucaucgacaagaacaaggacacccucuuccaggacuucaagcgccucauguacaacuccuccaaccccguccucaagaacauguggcccgagggcaagcucuccaucaccgaggucaccaagcgcccccucaccgccgccacccucuucaagaacuccaugaucgcccucgucgacaaccucgccuccaaggagcccuacuacguccgcugcaucaagcccaacgacaagaaguccccccagaucuucgacgacgagcgcugccgccaccaggucgaguaccucggccuccucgagaacguccgcguccgccgcgccggcuucgccuuccgccagaccuacgagaaguuccuccaccgcuacaagaugaucuccgaguucaccuggcccaaccacgaccuccccuccgacaaggaggccgucaagaagcucaucgagcgcugcggcuuccaggacgacgucgccuacggcaagaccaagaucuucauccgcaccccccgcacccucuucacccucgaggagcuccgcgcccagaugcucauccgcaucguccucuuccuccagaaggucuggcgcggcacccucgcccgcaugcgcuacaagcgcaccaaggccgcccucaccaucauccgcuacuaccgccgcuacaaggucaaguccuacauccacgaggucgcccgccgcuuccacggcgucaagaccaugcgcgacuacggcaagcacgucaaguggcccuccccccccaagguccuccgccgcuucgaggaggcccuccagaccaucuucaaccgcuggcgcgccucccagcucaucaaguccauccccgccuccgaccucccccagguccgcgccaaggucgccgccgucgagaugcucaagggccagcgcgccgaccucggccuccagcgcgccugggagggcaacuaccucgccuccaagcccgacaccccccagaccuccggcaccuucguccccgucgccaacgagcucaagcgcaaggacaaguacaugaacguccucuucuccugccacguccgcaaggucaaccgcuucuccaaggucgaggaccgcgccaucuucgucaccgaccgccaccucuacaagauggaccccaccaagcaguacaaggucaugaagaccaucccccucuacaaccucaccggccucuccgucuccaacggcaaggaccagcucgucgucuuccacaccaaggacaacaaggaccucaucgucugccucuucuccaagcagcccacccacgagucccgcaucggcgagcucgucggcguccucgucaaccacuucaaguccgagaagcgccaccuccaggucaacgucaccaaccccguccagugcucccuccacggcaagaagugcaccgucuccgucgagacccgccucaaccagccccagcccgacuucaccaagaaccgcuccggcuucauccucuccguccccggcaacuga

SEQ ID NO: 46360 - RNA, 3327 nt, Artificial Sequence
  derived and/or modified sequence opt2 from MYO1E__Homo_sapiens__NP_004989
augggcuccaagggcgucuaccaguaccacuggcagucccacaacgucaagcacuccggcgucgacgacaugguccuccucuccaagaucaccgagaacuccaucgucgagaaccucaagaagcgcuacauggacgacuacaucuucaccuacaucggcuccguccucaucuccgucaaccccuucaagcagaugcccuacuucggcgagaaggagaucgagauguaccagggcgccgcccaguacgagaaccccccccacaucuacgcccucgccgacaacauguaccgcaacaugaucaucgaccgcgagaaccagugcgucaucaucuccggcgaguccggcgccggcaagaccgucgccgccaaguacaucauguccuacaucucccgcgucuccggcggcggcaccaagguccagcacgucaaggacaucauccuccaguccaacccccuccucgaggccuucggcaacgccaagaccguccgcaacaacaacuccucccgcuucggcaaguacuucgagauccaguucucccccggcggcgagcccgacggcggcaagaucuccaacuuccuccucgagaagucccgcgucgucaugcgcaaccccggcgagcgcuccuuccacaucuucuaccagcucaucgagggcgccuccgccgagcagaagcacucccucggcaucaccuccauggacuacuacuacuaccucucccucuccggcuccuacaaggucgacgacaucgacgaccgccgcgaguuccaggagacccuccacgccaugaacgucaucggcaucuucgccgaggagcagacccucguccuccagaucgucgccggcauccuccaccucggcaacaucuccuucaaggaggucggcaacuacgccgccgucgaguccgaggaguuccucgccuuccccgccuaccuccucggcaucaaccaggaccgccucaaggagaagcucaccucccgccagauggacuccaaguggggcggcaaguccgaguccauccacgucacccucaacgucgagcaggccugcuacacccgcgacgcccucgccaaggcccuccacgcccgcgucuucgacuuccucgucgacuccaucaacaaggccauggagaaggaccacgaggaguacaacaucggcguccucgacaucuacggcuucgagaucuuccagaagaacggcuucgagcaguucugcaucaacuucgucaacgagaagcuccagcagaucuucaucgagcucacccucaaggccgagcaggaggaguacguccaggagggcauccgcuggacccccaucgaguacuucaacaacaagaucgucugcgaccucaucgagaacaaggucaacccccccggcaucauguccauccucgacgacgucugcgccaccaugcacgccgucggcgagggcgccgaccagacccuccuccagaagcuccagaugcagaucggcucccacgagcacuucaacuccuggaaccagggcuucaucauccaccacuacgccggcaaggucuccuacgacauggacggcuucugcgagcgcaaccgcgacguccucuucauggaccucaucgagcucaugcaguccuccgagcuccccuucaucaagucccucuuccccgagaaccuccaggccgacaagaagggccgccccaccaccgccggcuccaagaucaagaagcaggccaacgaccucgucuccacccucaugaagugcaccccccacuacauccgcugcaucaagcccaacgagaccaagaagccccgcgacugggaggagucccgcgucaagcaccaggucgaguaccucggccucaaggagaacauccgcguccgccgcgccggcuacgccuaccgccgcaucuuccagaaguuccuccagcgcuacgccauccucaccaaggccaccuggcccuccuggcagggcgaggagaagcagggcguccuccaccuccuccaguccgucaacauggacuccgaccaguuccagcucggccgcuccaaggucuucaucaaggcccccgagucccucuuccuccucgaggagaugcgcgagcgcaaguacgacggcuacgcccgcgucauccagaaguccuggcgcaaguucgucgcccgcaagaaguacguccagaugcgcgaggaggccuccgaccuccuccucaacaagaaggagcgccgccgcaacuccaucaaccgcaacuucaucggcgacuacaucggcauggaggagcaccccgagcuccagcaguucgucggcaagcgcgagaagaucgacuucgccgacaccgucaccaaguacgaccgccgcuucaagggcgucaagcgcgaccuccuccucacccccaagugccucuaccucaucggccgcgagaaggucaagcagggccccgacaagggccucgucaaggagguccucaagcgcaagaucgagaucgagcgcauccucuccgucucccucuccaccaugcaggacgacaucuucauccuccacgagcaggaguacgacucccuccucgaguccgucuucaagaccgaguuccucucccuccucgccaagcgcuacgaggagaagacccagaagcagcucccccucaaguucuccaacacccucgagcucaagcucaagaaggagaacuggggccccugguccgccggcggcucccgccagguccaguuccaccagggcuucggcgaccucgccguccucaagcccuccaacaagguccuccaggucuccaucggccccggccuccccaagaacucccgccccacccgccgcaacaccacccagaacaccggcuacuccuccggcacccagaacgccaacuaccccguccgcgccgccccccccccccccggcuaccaccagaacggcgucauccgcaaccaguacguccccuacccccacgcccccggcucccagcgcuccaaccagaagucccucuacaccuccauggcccgccccccccucccccgccagcaguccaccuccuccgaccgcgucucccagacccccgagucccucgacuuccucaagguccccgaccagggcgccgccggcguccgccgccagaccaccucccgccccccccccgccggcggccgccccaagccccagcccaagcccaagccccaggucccccagugcaaggcccucuacgccuacgacgcccaggacaccgacgagcucuccuucaacgccaacgacaucaucgacaucaucaaggaggaccccuccggcugguggaccggccgccuccgcggcaagcagggccucuuccccaacaacuacgucaccaagaucuga

SEQ ID NO: 46361 - RNA, 3297 nt, Artificial Sequence
  derived and/or modified sequence opt2 from MYO1F__Homo_sapiens__NP_036467
augggcuccaaggagcgcuuccacuggcagucccacaacgucaagcaguccggcgucgacgacaugguccuccucccccagaucaccgaggacgccaucgccgccaaccuccgcaagcgcuucauggacgacuacaucuucaccuacaucggcuccguccucaucuccgucaaccccuucaagcagaugcccuacuucaccgaccgcgagaucgaccucuaccagggcgccgcccaguacgagaaccccccccacaucuacgcccucaccgacaacauguaccgcaacaugcucaucgacugcgagaaccagugcgucaucaucuccggcgaguccggcgccggcaagaccgucgccgccaaguacaucaugggcuacaucuccaaggucuccggcggcggcgagaagguccagcacgucaaggacaucauccuccaguccaacccccuccucgaggccuucggcaacgccaagaccguccgcaacaacaacuccucccgcuucggcaaguacuucgagauccaguucucccgcggcggcgagcccgacggcggcaagaucuccaacuuccuccucgagaagucccgcgucgucaugcagaacgagaacgagcgcaacuuccacaucuacuaccagcuccucgagggcgccucccaggagcagcgccagaaccucggccucaugacccccgacuacuacuacuaccucaaccaguccgacaccuaccaggucgacggcaccgacgaccgcuccgacuucggcgagacccucuccgccaugcaggucaucggcaucccccccuccauccagcagcucguccuccagcucgucgccggcauccuccaccucggcaacaucuccuucugcgaggacggcaacuacgcccgcgucgaguccgucgaccuccucgccuuccccgccuaccuccucggcaucgacuccggccgccuccaggagaagcucaccucccgcaagauggacucccgcuggggcggccgcuccgaguccaucaacgucacccucaacgucgagcaggccgccuacacccgcgacgcccucgccaagggccucuacgcccgccucuucgacuuccucgucgaggccaucaaccgcgccaugcagaagccccaggaggaguacuccaucggcguccucgacaucuacggcuucgagaucuuccagaagaacggcuucgagcaguucugcaucaacuucgucaacgagaagcuccagcagaucuucaucgagcucacccucaaggccgagcaggaggaguacguccaggagggcauccgcuggacccccauccaguacuucaacaacaaggucgucugcgaccucaucgagaacaagcucuccccccccggcaucauguccguccucgacgacgucugcgccaccaugcacgccaccggcggcggcgccgaccagacccuccuccagaagcuccaggccgccgucggcacccacgagcacuucaacuccugguccgccggcuucgucauccaccacuacgccggcaaggucuccuacgacgucuccggcuucugcgagcgcaaccgcgacguccucuucuccgaccucaucgagcucaugcagaccuccgagcaggccuuccuccgcaugcucuuccccgagaagcucgacggcgacaagaagggccgccccuccaccgccggcuccaagaucaagaagcaggccaacgaccucgucgccacccucaugcgcugcaccccccacuacauccgcugcaucaagcccaacgagaccaagcgcccccgcgacugggaggagaaccgcgucaagcaccaggucgaguaccucggccucaaggagaacauccgcguccgccgcgccggcuucgccuaccgccgccaguucgccaaguuccuccagcgcuacgccauccucacccccgagaccuggccccgcuggcgcggcgacgagcgccagggcguccagcaccuccuccgcgccgucaacauggagcccgaccaguaccagaugggcuccaccaaggucuucgucaagaaccccgagucccucuuccuccucgaggagguccgcgagcgcaaguucgacggcuucgcccgcaccauccagaaggccuggcgccgccacgucgccguccgcaaguacgaggagaugcgcgaggaggccuccaacauccuccucaacaagaaggagcgccgccgcaacuccaucaaccgcaacuucgucggcgacuaccucggccucgaggagcgccccgagcuccgccaguuccucggcaagcgcgagcgcgucgacuucgccgacuccgucaccaaguacgaccgccgcuucaagcccaucaagcgcgaccucauccucacccccaagugcgucuacgucaucggccgcgagaaggucaagaagggccccgagaagggccaggucugcgagguccucaagaagaaggucgacauccaggcccuccgcggcgucucccucuccacccgccaggacgacuucuucauccuccaggaggacgccgccgacuccuuccucgaguccgucuucaagaccgaguucgucucccuccucugcaagcgcuucgaggaggccacccgccgcccccucccccucaccuucuccgacacccuccaguuccgcgucaagaaggagggcuggggcggcggcggcacccgcuccgucaccuucucccgcggcuucggcgaccucgccguccucaaggucggcggccgcacccucaccgucuccgucggcgacggccuccccaaguccuccaagcccacccgcaagggcauggccaagggcaagccccgccgcuccucccaggcccccacccgcgccgcccccgcccccccccgcggcauggaccgcaacggcgucccccccuccgcccgcggcggcccccucccccucgagaucauguccggcggcggcacccaccgccccccccgcggcccccccuccaccucccucggcgccucccgccgcccccgcgcccgcccccccuccgagcacaacaccgaguuccucaacguccccgaccagggcauggccggcaugcagcgcaagcgcuccgucggccagcgccccguccccggcgucggccgccccaagccccagccccgcacccacggcccccgcugccgcgcccucuaccaguacgucggccaggacgucgacgagcucuccuucaacgucaacgaggucaucgagauccucauggaggaccccuccggcugguggaagggccgccuccacggccaggagggccucuuccccggcaacuacgucgagaagaucuga

SEQ ID NO: 46362 - RNA, 4851 nt, Artificial Sequence
  derived and/or modified sequence opt2 from MYO3A__Homo_sapiens__XP_011517803
auguucccccucaucggcaagaccaucaucuucgacaacuuccccgaccccuccgacaccugggagaucaccgagaccaucggcaagggcaccuacggcaaggucuucaagguccucaacaagaagaacggccagaaggccgccgucaagauccucgaccccauccacgacaucgacgaggagaucgaggccgaguacaacauccucaaggcccucuccgaccaccccaacgucguccgcuucuacggcaucuacuucaagaaggacaaggucaacggcgacaagcucuggcucguccucgagcucugcuccggcggcuccgucaccgaccucgucaagggcuuccucaagcgcggcgagcgcauguccgagccccucaucgccuacauccuccacgaggcccucaugggccuccagcaccuccacaacaacaagaccauccaccgcgacgucaagggcaacaacauccuccucaccaccgagggcggcgucaagcucgucgacuucggcgucuccgcccagcucaccuccacccgccaccgccgcaacaccuccgucggcacccccuucuggauggcccccgaggucaucgccugcgagcagcagcucgacaccaccuacgacgcccgcugcgacaccuggucccucggcaucaccgccaucgagcucggcgacggcgaccccccccucgccgaccuccaccccaugcgcgcccucuucaagaucccccgcaaccccccccccaagcuccgccagcccgagcucugguccgccgaguucaacgacuucaucuccaagugccucaccaaggacuacgagaagcgccccaccgucuccgagcuccuccagcacaaguucaucacccagaucgagggcaaggacgucaugcuccagaagcagcucaccgaguucaucggcauccaccagugcaugggcggcaccgagaaggcccgccgcgagcgcauccacaccaagaagggcaacuucaaccgcccccucaucuccaaccucaaggacgucgacgaccucgccacccucgagauccucgacgagaacaccgucuccgagcagcucgagaagugcuacucccgcgaccagaucuacgucuacgucggcgacauccucaucgcccucaaccccuuccagucccucggccucuacuccaccaagcacuccaagcucuacaucggcuccaagcgcaccgccucccccccccacaucuucgccauggccgaccucggcuaccaguccaugaucaccuacaacuccgaccagugcaucgucaucuccggcgaguccggcgccggcaagaccgagaacgcccaccuccucguccagcagcucaccguccucggcaaggccaacaaccgcacccuccaggagaagauccuccaggucaacaaccucgucgaggccuucggcaacgccugcaccaucaucaacgacaacuccucccgcuucggcaaguaccucgagaugaaguucaccuccuccggcgccgucgucggcgcccagaucuccgaguaccuccucgagaagucccgcgucauccaccaggccaucggcgagaagaacuuccacaucuucuacuacaucuacgccggccucgccgagaagaagaagcucgcccacuacaagcuccccgagaacaagcccccccgcuaccuccagaacgaccaccuccgcaccguccaggacaucaugaacaacuccuucuacaagucccaguacgagcucaucgagcagugcuucaaggucaucggcuucaccauggagcagcucggcuccaucuacuccauccucgccgccauccucaacgucggcaacaucgaguucuccuccgucgccaccgagcaccagaucgacaagucccacaucuccaaccacaccgcccucgagaacugcgccucccuccucugcauccgcgccgacgagcuccaggaggcccucaccucccacugcgucgucacccgcggcgagaccaucauccgccccaacaccgucgagaaggccaccgacguccgcgacgccauggccaagacccucuacggccgccucuucuccuggaucgucaacugcaucaacucccuccucaagcacgacuccucccccuccggcaacggcgacgagcucuccaucggcauccucgacaucuucggcuucgagaacuucaagaagaacuccuucgagcagcucugcaucaacaucgccaacgagcagauccaguacuacuacaaccagcacgucuucgccugggagcagaacgaguaccucaacgaggacgucgacgcccgcgucaucgaguacgaggacaacuggccccuccucgacauguuccuccagaagcccaugggccuccucucccuccucgacgaggagucccgcuuccccaaggccaccgaccagacccucgucgagaaguucgagggcaaccucaagucccaguacuucuggcgccccaagcgcauggagcucuccuucggcauccaccacuacgccggcaagguccucuacaacgccuccggcuuccucgccaagaaccgcgacacccuccccaccgacaucguccuccuccuccgcuccuccgacaacuccgucauccgccagcucgucaaccacccccucaccaagaccggcaaccucccccacuccaagaccaagaacgucaucaacuaccagaugcgcaccuccgagaagcucaucaaccucgccaagggcgacaccggcgaggccacccgccacgcccgcgagaccaccaacaugaagacccagaccgucgccuccuacuuccgcuacucccucauggaccuccucuccaagauggucgucggccagccccacuucguccgcugcaucaagcccaacuccgagcgccaggcccgcaaguacgacaaggagaagguccuccuccagcuccgcuacaccggcauccucgagaccgcccgcauccgccgccucggcuucucccaccgcauccucuucgccaacuucaucaagcgcuacuaccuccucugcuacaaguccuccgaggagccccgcaugucccccgacaccugcgccaccauccucgagaaggccggccucgacaacugggcccucggcaagaccaaggucuuccucaaguacuaccacgucgagcagcucaaccucaugcgcaaggaggccaucgacaagcucauccucauccaggccugcguccgcgccuuccucugcucccgccgcuaccagaagauccaggagaagcgcaaggaguccgccaucaucauccaguccgccgcccgcggccaccucguccgcaagcagcgcaaggagaucgucgacaugaagaacaccgccgucaccaccauccagaccuccgaccaggaguucgacuacaagaagaacuucgagaacacccgcgaguccuucgucaagaagcaggccgagaacgccaucuccgccaacgagcgcuucaucuccgcccccaacaacaagggcuccgucuccgucgucaagaccuccaccuucaagcccgaggaggagaccaccaacgccgucgaguccaacaaccgcgucuaccagacccccaagaagaugaacaacgucuacgaggaggaggucaagcaggaguucuaccucgucggccccgaggucucccccaagcagaaguccgucaaggaccucgaggagaacuccaaccuccgcaaggucgagaaggaggaggccaugauccaguccuacuaccagcgcuacaccgaggagcgcaacugcgaggaguccaaggccgccuaccucgagcgcaaggccaucuccgagcgccccuccuaccccguccccuggcucgccgagaacgagaccuccuucaagaagacccucgagcccacccucucccagcgcuccaucuaccagaacgccaacuccauggagaaggagaagaagaccuccgucgucacccagcgcgcccccaucugcucccaggaggagggccgcggccgccuccgccacgagaccgucaaggagcgccaggucgagcccgucacccaggcccaggaggaggaggacaaggccgccgucuucauccaguccaaguaccgcggcuacaagcgccgccagcagcuccgcaaggacaagauguccuccuucaagcaccagcgcaucgucaccacccccaccgaggucgcccgcaacacccacaaccucuacuccuaccccaccaagcacgaggagaucaacaacaucaagaagaaggacaacaaggacuccaaggccaccuccgagcgcgaggccugcggccucgccaucuucuccaagcagaucuccaagcucuccgaggaguacuucauccuccagaagaagcucaacgagaugauccucucccagcagcucaagucccucuaccucggcgucucccaccacaagcccaucaaccgccgcgucuccucccagcagugccucuccggcgucugcaagggcgaggagcccaagauccuccgccccccccgccgcccccgcaagcccaagacccucaacaaccccgaggacuccaccuacuacuaccuccuccacaaguccauccaggaggagaagcgccgcccccgcaaggacucccagggcaagcuccucgaccucgaggacuucuacuacaaggaguuccuccccucccgcuccggccccaaggagcacucccccucccuccgcgagcgccgcccccagcaggagcuccagaaccagugcaucaaggccaacgagcgcugcugggccgccgagucccccgagaaggaggaggagcgcgagcccgccgccaaccccuacgacuuccgccgccuccuccgcaagaccucccagcgccgccgccucguccagcaguccuga

SEQ ID NO: 46363 - RNA, 3945 nt, Artificial Sequence
  derived and/or modified sequence opt2 from MYO3B__Homo_sapiens__NP_001077084
augaagcaccucuacggccucuuccacuacaaccccaugaugcucggccucgagucccuccccgaccccaccgacaccugggagaucaucgagaccaucggcaagggcaccuacggcaaggucuacaaggucaccaacaagcgcgacggcucccucgccgccgucaagauccucgaccccgucuccgacauggacgaggagaucgaggccgaguacaacauccuccaguuccuccccaaccaccccaacgucgucaaguucuacggcauguucuacaaggccgaccacugcgucggcggccagcucuggcucguccucgagcucugcaacggcggcuccgucaccgagcucgucaagggccuccuccgcugcggccagcgccucgacgaggccaugaucuccuacauccucuacggcgcccuccucggccuccagcaccuccacaacaaccgcaucauccaccgcgacgucaagggcaacaacauccuccucaccaccgagggcggcgucaagcucgucgacuucggcgucuccgcccagcucaccuccacccgccuccgccgcaacaccuccgucggcacccccuucuggauggcccccgaggucaucgccugcgagcagcaguacgacuccuccuacgacgcccgcugcgacgucuggucccucggcaucaccgccaucgagcucggcgacggcgaccccccccucuucgacaugcaccccgucaagacccucuucaagaucccccgcaaccccccccccacccuccuccaccccgagaaguggugcgaggaguucaaccacuucaucucccagugccucaucaaggacuucgagcgccgccccuccgucacccaccuccucgaccaccccuucaucaagggcguccacggcaagguccucuuccuccagaagcagcucgccaagguccuccaggaccagaagcaccagaaccccgucgccaagacccgccacgagcgcaugcacacccgccgccccuaccacgucgaggacgccgagaaguacugccucgaggacgaccucgucaaccucgagguccucgacgaggacaccaucauccaccagcuccagaagcgcuacgccgaccuccucaucuacaccuacgucggcgacauccucaucgcccucaaccccuuccagaaccucuccaucuacuccccccaguucucccgccucuaccacggcgucaagcgcgccuccaaccccccccacaucuucgccuccgccgacgccgccuaccagugcauggucacccucuccaaggaccagugcaucgucaucuccggcgaguccggcuccggcaagaccgaguccgcccaccucaucguccagcaccucaccuuccucggcaaggccaacaaccagacccuccgcgagaagauccuccaggucaacucccucgucgaggccuucggcaacuccugcaccgccaucaacgacaacuccucccgcuucggcaaguaccucgagaugauguucacccccaccggcgucgucaugggcgcccgcaucuccgaguaccuccucgagaagucccgcgucaucaagcaggccgcccgcgagaagaacuuccacaucuucuacuacaucuacgccggccuccaccaccagaagaagcucuccgacuuccgccuccccgaggagaagcccccccgcuacaucgccgacgagaccggccgcgucaugcacgacaucaccuccaaggaguccuaccgccgccaguucgaggccauccagcacugcuuccgcaucaucggcuucaccgacaaggagguccacuccgucuaccgcauccucgccggcauccucaacaucggcaacaucgaguucgccgccaucuccucccagcaccagaccgacaaguccgagguccccaacgccgaggcccuccagaacgccgccuccguccucugcaucucccccgaggagcuccaggaggcccucaccucccacugcgucgucacccgcggcgagaccaucauccgcgccaacaccgucgaccgcgccgccgacguccgcgacgccauguccaaggcccucuacggccgccucuucuccuggaucgucaaccgcaucaacacccuccuccagcccgacgagaacaucugcuccgccggcggcggcaugaacgucggcauccucgacaucuucggcuucgagaacuuccagcgcaacuccuucgagcagcucugcaucaacaucgccaacgagcagauccaguacuacuucaaccagcacgucuucgcccucgagcagauggaguaccagaacgagggcaucgacgccguccccgucgaguacgaggacaaccgcccccuccucgacauguuccuccagaagccccucggccuccucgcccuccucgacgaggagucccgcuucccccaggccaccgaccagacccucgucgacaaguucgaggacaaccuccgcugcaaguacuucuggcgccccaagggcgucgagcucugcuucggcauccagcacuacgccggcaagguccucuacgacgccuccggcguccucgagaagaaccgcgacacccuccccgccgacgucgucgucguccuccgcaccuccgagaacaagcuccuccagcagcucuucuccaucccccucaccaagaccggcaaccucgcccagacccgcgcccgcaucaccgucgccuccuccucccuccccccccacuucuccgccggcaaggccaaggucgacacccucgaggucauccgccaccccgaggagaccaccaacaugaagcgccagaccgucgccuccuacuuccgcuacucccucauggaccuccucuccaagauggucgucggccagccccacuucguccgcugcaucaagcccaacgacgaccgcgaggcccuccaguucucccgcgagcgcguccucgcccagcuccgcuccaccggcauccucgagaccgucuccauccgccgccagggcuacucccaccgcauccucuucgaggaguucgucaagcgcuacuacuaccucgccuucaccgcccaccagaccccccucgccuccaaggaguccugcgucgccauccucgagaagucccgccucgaccacuggguccucggcaagaccaaggucuuccucaaguacuaccacgucgagcagcucaaccuccuccuccgcgaggucaucggccgcgucgucguccuccaggccuacaccaagggcuggcucggcgcccgccgcuacaagcgcguccgcgagaagcgcgagaagggcgccaucgccauccaguccggcgacaccuccaaccaguccuccggcccccacucccccgucgccgccggcacccgcggcuccgccgagguccaggacugcuccgagcccggcgaccacaagguccuccgcggcuccguccaccgccgcucccacucccaggccgaguccaacaacggccgcacccagaccuccuccaacucccccgccgucaccgagaagaacggccacucccaggcccaguccucccccaagggcugcgacaucuucgccggccacgccaacaagcacuccgucuccggcaccgaccuccucuccucccgcaucugccaccccgcccccgaccagcagggccucucccucuggggcgccccccagaagcccggcuccgagaacggccucgcccagaagcaccgcaccccccgccgccgcugccagcagcccaagaugcucuccucccccgaggacaccauguacuacaaccagcucaacggcacccucgaguaccagggcuccaagcgcaagccccgcaagcucggccagaucaagguccucgacggcgaggacgaguacuacaagucccucucccccgucgacugcauccccgaggagaacaacuccgcccaccccuccuucuucuccuccuccuccaagggcgacuccuucgcccagcacuga

SEQ ID NO: 46364 - RNA, 5568 nt, Artificial Sequence
  derived and/or modified sequence opt2 from MYO5A__Homo_sapiens__NP_000250
auggccgccuccgagcucuacaccaaguucgcccgcgucuggauccccgaccccgaggaggucuggaaguccgccgagcuccucaaggacuacaagcccggcgacaagguccuccuccuccaccucgaggagggcaaggaccucgaguaccaccucgaccccaagaccaaggagcucccccaccuccgcaaccccgacauccucgucggcgagaacgaccucaccgcccucuccuaccuccacgagcccgccguccuccacaaccuccgcguccgcuucaucgacuccaagcucaucuacaccuacugcggcaucguccucgucgccaucaaccccuacgagcagcuccccaucuacggcgaggacaucaucaacgccuacuccggccagaacaugggcgacauggacccccacaucuucgccgucgccgaggaggccuacaagcagauggcccgcgacgagcgcaaccaguccaucaucgucuccggcgaguccggcgccggcaagaccgucuccgccaaguacgccaugcgcuacuucgccaccgucuccggcuccgccuccgaggccaacgucgaggagaagguccucgccuccaaccccaucauggaguccaucggcaacgccaagaccacccgcaacgacaacuccucccgcuucggcaaguacaucgagaucggcuucgacaagcgcuaccgcaucaucggcgccaacaugcgcaccuaccuccucgagaagucccgcgucgucuuccaggccgaggaggagcgcaacuaccacaucuucuaccagcucugcgccuccgccaagcuccccgaguucaagaugcuccgccucggcaacgccgacaacuucaacuacaccaagcagggcggcucccccgucaucgagggcgucgacgacgccaaggagauggcccacacccgccaggccugcacccuccucggcaucuccgagucccaccagaugggcaucuuccgcauccucgccggcauccuccaccucggcaacgucggcuucaccucccgcgacgccgacuccugcaccaucccccccaagcacgagccccucugcaucuucugcgaccucaugggcgucgacuacgaggagaugugccacuggcucugccaccgcaagcucgccaccgccaccgagaccuacaucaagcccaucuccaagcuccaggccaccaacgcccgcgacgcccucgccaagcacaucuacgccaagcucuucaacuggaucgucgacaacgucaaccaggcccuccacuccgccgucaagcagcacuccuucaucggcguccucgacaucuacggcuucgagaccuucgagaucaacuccuucgagcaguucugcaucaacuacgccaacgagaagcuccagcagcaguucaacaugcacgucuucaagcucgagcaggaggaguacaugaaggagcagauccccuggacccucaucgacuucuacgacaaccagcccugcaucaaccucaucgaguccaagcucggcauccucgaccuccucgacgaggagugcaagaugcccaagggcaccgacgacaccugggcccagaagcucuacaacacccaccucaacaagugcgcccucuucgagaagccccgccucuccaacaaggccuucaucauccagcacuucgccgacaaggucgaguaccagugcgagggcuuccucgagaagaacaaggacaccgucuucgaggagcagaucaagguccucaaguccuccaaguucaagaugcuccccgagcucuuccaggacgacgagaaggccaucucccccaccuccgccaccuccuccggccgcaccccccucacccgcacccccgccaagcccaccaagggccgccccggccagauggccaaggagcacaagaagaccgucggccaccaguuccgcaacucccuccaccuccucauggagacccucaacgccaccaccccccacuacguccgcugcaucaagcccaacgacuucaaguuccccuucaccuucgacgagaagcgcgccguccagcagcuccgcgccugcggcguccucgagaccauccgcaucuccgccgccggcuuccccucccgcuggaccuaccaggaguucuucucccgcuaccgcguccucaugaagcagaaggacguccucuccgaccgcaagcagaccugcaagaacguccucgagaagcucauccucgacaaggacaaguaccaguucggcaagaccaagaucuucuuccgcgccggccaggucgccuaccucgagaagcuccgcgccgacaagcuccgcgccgccugcauccgcauccagaagaccauccgcggcuggcuccuccgcaagaaguaccuccgcaugcgcaaggccgccaucaccaugcagcgcuacguccgcggcuaccaggcccgcugcuacgccaaguuccuccgccgcaccaaggccgccaccaucauccagaaguacuggcgcauguacgucguccgccgccgcuacaagauccgccgcgccgccaccaucguccuccaguccuaccuccgcggcuuccucgcccgcaaccgcuaccgcaagauccuccgcgagcacaaggccgucaucauccagaagcgcguccgcggcuggcucgcccgcacccacuacaagcgcuccaugcacgccaucaucuaccuccagugcugcuuccgccgcaugauggccaagcgcgagcucaagaagcucaagaucgaggcccgcuccgucgagcgcuacaagaagcuccacaucggcauggagaacaagaucaugcagcuccagcgcaaggucgacgagcagaacaaggacuacaagugccucgucgagaagcucaccaaccucgagggcaucuacaacuccgagaccgagaagcuccgcuccgaccucgagcgccuccagcucuccgaggaggaggccaaggucgccaccggccgcguccucucccuccaggaggagaucgccaagcuccgcaaggaccucgagcagacccgcuccgagaagaagugcaucgaggagcacgccgaccgcuacaagcaggagaccgagcagcucgucuccaaccucaaggaggagaacacccuccucaagcaggagaaggaggcccucaaccaccgcaucguccagcaggccaaggagaugaccgagaccauggagaagaagcucgucgaggagaccaagcagcucgagcucgaccucaacgacgagcgccuccgcuaccagaaccuccucaacgaguucucccgccucgaggagcgcuacgacgaccucaaggaggagaugacccucaugguccacguccccaagcccggccacaagcgcaccgacuccacccacuccuccaacgaguccgaguacaucuucuccuccgagaucgccgagauggaggacauccccucccgcaccgaggagcccuccgagaagaaggucccccucgacaugucccucuuccucaagcuccagaagcgcgucaccgagcucgagcaggagaagcaggucaugcaggacgagcucgaccgcaaggaggagcagguccuccgcuccaaggccaaggaggaggagcgcccccagauccgcggcgccgagcucgaguacgagucccucaagcgccaggagcucgaguccgagaacaagaagcucaagaacgagcucaacgagcuccgcaaggcccucuccgagaaguccgcccccgaggucaccgcccccggcgcccccgccuaccgcguccucauggagcagcucaccuccgucuccgaggagcucgacguccgcaaggaggagguccucauccuccgcucccagcucgucucccagaaggaggccauccagcccaaggacgacaagaacaccaugaccgacuccaccauccuccucgaggacguccagaagaugaaggacaagggcgagaucgcccaggccuacaucggccucaaggagaccaaccgcuccuccgcccucgacuaccacgagcucaacgaggacggcgagcucuggcucgucuacgagggccucaagcaggccaaccgccuccucgagucccagcuccagucccagaagcgcucccacgagaacgaggccgaggcccuccgcggcgagauccagucccucaaggaggagaacaaccgccagcagcagcuccucgcccagaaccuccagcucccccccgaggcccgcaucgaggccucccuccagcacgagaucacccgccucaccaacgagaaccucgaccucauggagcagcucgagaagcaggacaagaccguccgcaagcucaagaagcagcucaaggucuucgccaagaagaucggcgagcucgaggucggccagauggagaacaucucccccggccagaucaucgacgagcccauccgccccgucaacaucccccgcaaggagaaggacuuccagggcaugcucgaguacaagaaggaggacgagcagaagcucgucaagaaccucauccucgagcucaagccccgcggcgucgccgucaaccucauccccggccuccccgccuacauccucuucaugugcguccgccacgccgacuaccucaacgacgaccagaagguccgcucccuccucaccuccaccaucaacuccaucaagaagguccucaagaagcgcggcgacgacuucgagaccgucuccuucuggcucuccaacaccugccgcuuccuccacugccucaagcaguacuccggcgaggagggcuucaugaagcacaacaccucccgccagaacgagcacugccucaccaacuucgaccucgccgaguaccgccagguccucuccgaccucgccauccagaucuaccagcagcucguccgcguccucgagaacauccuccagcccaugaucgucuccggcaugcucgagcacgagaccauccagggcgucuccggcgucaagcccaccggccuccgcaagcgcaccuccuccaucgccgacgagggcaccuacacccucgacuccauccuccgccagcucaacuccuuccacuccgucaugugccagcacggcauggaccccgagcucaucaagcaggucgucaagcagauguucuacaucaucggcgccaucacccucaacaaccuccuccuccgcaaggacaugugcuccugguccaagggcaugcagauccgcuacaacgucucccagcucgaggaguggcuccgcgacaagaaccucaugaacuccggcgccaaggagacccucgagccccucauccaggccgcccagcuccuccaggucaagaagaagaccgacgacgacgccgaggccaucugcuccaugugcaacgcccucaccaccgcccagaucgucaagguccucaaccucuacacccccgucaacgaguucgaggagcgcgucuccgucuccuucauccgcaccauccagaugcgccuccgcgaccgcaaggacuccccccagcuccucauggacgccaagcacaucuuccccgucaccuuccccuucaaccccuccucccucgcccucgagaccauccagauccccgccucccucggccucggcuucaucucccgcgucuga

SEQ ID NO: 46365 - RNA, 5547 nt, Artificial Sequence
  derived and/or modified sequence opt2 from MYO5B__Homo_sapiens__NP_001073936
auguccgucggcgagcucuacucccagugcacccgcgucuggauccccgaccccgacgaggucuggcgcuccgccgagcucaccaaggacuacaaggagggcgacaagucccuccagcuccgccucgaggacgagaccauccucgaguaccccaucgacguccagcgcaaccagcuccccuuccuccgcaaccccgacauccucgucggcgagaacgaccucaccgcccucuccuaccuccacgagcccgccguccuccacaaccucaagguccgcuuccucgaguccaaccacaucuacaccuacugcggcaucguccucgucgccaucaaccccuacgagcagcuccccaucuacggccaggacgucaucuacaccuacuccggccagaacaugggcgacauggacccccacaucuucgccgucgccgaggaggccuacaagcagauggcccgcgacgagaagaaccaguccaucaucgucuccggcgaguccggcgccggcaagaccgucuccgccaaguacgccaugcgcuacuucgccaccgucggcggcuccgccuccgagaccaacaucgaggagaagguccucgccuccucccccaucauggaggccaucggcaacgccaagaccacccgcaacgacaacuccucccgcuucggcaaguacauccagaucggcuucgacaagcgcuaccacaucaucggcgccaacaugcgcaccuaccuccucgagaagucccgcgucgucuuccaggccgacgacgagcgcaacuaccacaucuucuaccagcucugcgccgccgccggccuccccgaguucaaggagcucgcccucaccuccgccgaggacuucuucuacaccucccagggcggcgacaccuccaucgagggcgucgacgacgccgaggacuucgagaagacccgccaggccuucacccuccucggcgucaaggagucccaccagauguccaucuucaagaucaucgccuccauccuccaccucggcuccgucgccauccaggccgagcgcgacggcgacuccugcuccaucuccccccaggacgucuaccucuccaacuucugccgccuccucggcgucgagcacucccagauggagcacuggcucugccaccgcaagcucgucaccaccuccgagaccuacgucaagaccaugucccuccagcaggucaucaacgcccgcaacgcccucgccaagcacaucuacgcccagcucuucggcuggaucgucgagcacaucaacaaggcccuccacaccucccucaagcagcacuccuucaucggcguccucgacaucuacggcuucgagaccuucgaggucaacuccuucgagcaguucugcaucaacuacgccaacgagaagcuccagcagcaguucaacucccacgucuucaagcucgagcaggaggaguacaugaaggagcagauccccuggacccucaucgacuucuacgacaaccagcccugcaucgaccucaucgaggccaagcucggcauccucgaccuccucgacgaggagugcaagguccccaagggcaccgaccagaacugggcccagaagcucuacgaccgccacuccuccucccagcacuuccagaagccccgcauguccaacaccgccuucaucaucguccacuucgccgacaaggucgaguaccucuccgacggcuuccucgagaagaaccgcgacaccgucuacgaggagcagaucaacauccucaaggccuccaaguucccccucgucgccgaccucuuccacgacgacaaggaccccguccccgccaccacccccggcaagggcuccuccuccaagaucuccguccgcuccgcccgcccccccaugaaggucuccaacaaggagcacaagaagaccgucggccaccaguuccgcaccucccuccaccuccucauggagacccucaacgccaccaccccccacuacguccgcugcaucaagcccaacgacgagaagcuccccuuccacuucgaccccaagcgcgccguccagcagcuccgcgccugcggcguccucgagaccauccgcaucuccgccgccggcuaccccucccgcugggccuaccacgacuucuucaaccgcuaccgcguccucgucaagaagcgcgagcucgccaacaccgacaagaaggccaucugccgcuccguccucgagaaccucaucaaggaccccgacaaguuccaguucggccgcaccaagaucuucuuccgcgccggccaggucgccuaccucgagaagcuccgcgccgacaaguuccgcaccgccaccaucaugauccagaagaccguccgcggcuggcuccagaaggucaaguaccaccgccucaagggcgccacccucacccuccagcgcuacugccgcggccaccucgcccgccgccucgccgagcaccuccgccgcauccgcgccgccgucguccuccagaagcacuaccgcaugcagcgcgcccgccaggccuaccagcgcguccgccgcgccgccgucgucauccaggccuucacccgcgccauguucguccgccgcaccuaccgccagguccucauggagcacaaggccaccaccauccagaagcacguccgcggcuggauggcccgccgccacuuccagcgccuccgcgacgccgccaucgucauccagugcgccuuccgcaugcucaaggcccgccgcgagcucaaggcccuccgcaucgaggcccgcuccgccgagcaccucaagcgccucaacgucggcauggagaacaaggucguccagcuccagcgcaagaucgacgagcagaacaaggaguucaagacccucuccgagcagcucuccgucaccaccuccaccuacaccauggaggucgagcgccucaagaaggagcucguccacuaccagcagucccccggcgaggacaccucccuccgccuccaggaggaggucgagucccuccgcaccgagcuccagcgcgcccacuccgagcgcaagauccucgaggacgcccacucccgcgagaaggacgagcuccgcaagcgcgucgccgaccucgagcaggagaacgcccuccucaaggacgagaaggagcagcucaacaaccagauccucugccaguccaaggacgaguucgcccagaacuccgucaaggagaaccucaugaagaaggagcucgaggaggagcgcucccgcuaccagaaccucgucaaggaguacucccagcucgagcagcgcuacgacaaccuccgcgacgagaugaccaucaucaagcagacccccggccaccgccgcaaccccuccaaccaguccucccucgaguccgacuccaacuaccccuccaucuccaccuccgagaucggcgacaccgaggacgcccuccagcaggucgaggagaucggccucgagaaggccgccauggacaugaccgucuuccucaagcuccagaagcgcguccgcgagcucgagcaggagcgcaagaagcuccagguccagcucgagaagcgcgagcagcaggacuccaagaagguccaggccgagcccccccagaccgacaucgaccucgaccccaacgccgaccucgccuacaacucccucaagcgccaggagcucgaguccgagaacaagaagcucaagaacgaccucaacgagcuccgcaaggccgucgccgaccaggccacccagaacaacuccucccacggcucccccgacuccuacucccuccuccucaaccagcucaagcucgcccacgaggagcucgagguccgcaaggaggagguccucauccuccgcacccagaucgucuccgccgaccagcgccgccucgccggccgcaacgccgagcccaacaucaacgcccgcuccuccuggcccaacuccgagaagcacgucgaccaggaggacgccaucgaggccuaccacggcgucugccagaccaacuccaagaccgaggacuggggcuaccucaacgaggacggcgagcucggccucgccuaccagggccucaagcaggucgcccgccuccucgaggcccagcuccaggcccagucccucgagcacgaggaggaggucgagcaccucaaggcccagcucgaggcccucaaggaggagauggacaagcagcagcagaccuucugccagacccuccuccucucccccgaggcccaggucgaguucggcguccagcaggagaucucccgccucaccaacgagaaccucgaccucaaggagcucgucgagaagcucgagaagaacgagcgcaagcucaagaagcagcucaagaucuacaugaagaaggcccaggaccucgaggccgcccaggcccucgcccaguccgagcgcaagcgccacgagcucaaccgccaggucaccguccagcgcaaggagaaggacuuccagggcaugcucgaguaccacaaggaggacgaggcccuccucauccgcaaccucgucaccgaccucaagccccagaugcucuccggcaccguccccugccuccccgccuacauccucuacaugugcauccgccacgccgacuacaccaacgacgaccucaagguccacucccuccucaccuccaccaucaacggcaucaagaagguccucaagaagcacaacgacgacuucgagaugaccuccuucuggcucuccaacaccugccgccuccuccacugccucaagcaguacuccggcgacgagggcuucaugacccagaacaccgccaagcagaacgagcacugccucaagaacuucgaccucaccgaguaccgccagguccucuccgaccucuccauccagaucuaccagcagcucaucaagaucgccgagggcguccuccagcccaugaucgucuccgccaugcucgagaacgaguccauccagggccucuccggcgucaagcccaccggcuaccgcaagcgcuccuccuccauggccgacggcgacaacuccuacugccucgaggccaucauccgccagaugaacgccuuccacaccgucaugugcgaccagggccucgaccccgagaucauccuccaggucuucaagcagcucuucuacaugaucaacgccgucacccucaacaaccuccuccuccgcaaggacgucugcuccugguccaccggcaugcagcuccgcuacaacaucucccagcucgaggaguggcuccgcggccgcaaccuccaccaguccggcgccguccagaccauggagccccucauccaggccgcccagcuccuccagcucaagaagaagacccaggaggacgccgaggccaucugcucccucugcaccucccucuccacccagcagaucgucaagauccucaaccucuacaccccccucaacgaguucgaggagcgcgucaccgucgccuucauccgcaccauccaggcccagcuccaggagcgcaacgacccccagcagcuccuccucgacgccaagcacauguuccccguccucuuccccuucaaccccuccucccucaccauggacuccauccacauccccgccugccucaaccucgaguuccucaacgaggucuga

SEQ ID NO: 46366 - RNA, 5229 nt, Artificial Sequence
  derived and/or modified sequence opt2 from MYO5C__Homo_sapiens__NP_061198
auggccgucgccgagcucuacacccaguacaaccgcgucuggauccccgaccccgaggaggucuggaaguccgccgagaucgccaaggacuaccgcgucggcgacaagguccuccgccuccuccucgaggacggcaccgagcucgacuacuccgucaaccccgagucccuccccccccuccgcaaccccgacauccucgucggcgagaacgaccucaccgcccucuccuaccuccacgagcccgccguccuccacaaccuccgcauccgcuucgccgaguccaagcucaucuacaccuacuccggcaucauccucgucgccaugaaccccuacaagcagcuccccaucuacggcgacgccaucauccacgccuacuccggccagaacaugggcgacauggacccccacaucuucgccgucgccgaggaggccuacaagcagauggcccgcaacaaccgcaaccaguccaucaucgucuccggcgaguccggcgccggcaagaccgucuccgcccgcuacgccaugcgcuacuucgccaccgucuccaaguccggcuccaacgcccacgucgaggacaagguccucgccuccaaccccaucaccgaggccgucggcaacgccaagaccacccgcaacgacaacuccucccgcuucggcaaguacaccgagaucuccuucgacgagcagaaccagaucaucggcgccaacauguccaccuaccuccucgagaagucccgcgucgucuuccaguccgagaacgagcgcaacuaccacaucuucuaccagcucugcgccuccgcccagcaguccgaguucaagcaccucaagcucggcuccgccgaggaguucaacuacacccgcaugggcggcaacaccgucaucgagggcgucaacgaccgcgccgagauggucgagacccagaagaccuucacccuccucggcuucaaggaggacuuccagauggacgucuucaagauccucgccgccauccuccaccucggcaacguccagaucaccgccgucggcaacgagcgcuccuccgucuccgaggacgacucccaccucaaggucuucugcgagcuccucggccucgaguccggccgcgucgcccaguggcucugcaaccgcaagaucgucaccuccuccgagaccgucgucaagcccaugacccgcccccaggccgucaacgcccgcgacgcccucgccaagaagaucuacgcccaccucuucgacuucaucgucgagcgcaucaaccaggcccuccaguucuccggcaagcagcacaccuucaucggcguccucgacaucuacggcuucgagaccuucgacgucaacuccuucgagcaguucugcaucaacuacgccaacgagaagcuccagcagcaguucaacaugcacgucuucaagcucgagcaggaggaguacaugaaggaggacauccccuggacccucaucgacuucuacgacaaccagcccgucaucgaccucaucgaggccaagaugggcauccucgagcuccucgacgaggagugccuccucccccacggcaccgacgagaacuggcuccagaagcucuacaacaacuucgucaaccgcaacccccucuucgagaagccccgcauguccaacaccuccuucgucauccagcacuucgccgacaaggucgaguacaagugcgagggcuuccucgagaagaaccgcgacaccgucuacgacaugcucgucgagauccuccgcgccuccaaguuccaccucugcgccaacuucuuccaggagaaccccaccccccccucccccuucggcuccaugaucaccgucaaguccgccaagcaggucaucaagcccaacuccaagcacuuccgcaccaccgucggcuccaaguuccgcuccucccucuaccuccucauggagacccucaacgccaccaccccccacuacguccgcugcaucaagcccaacgacgagaagcuccccuucgaguucgacuccaagcgcaucguccagcagcuccgcgccugcggcguccucgagaccauccgcaucuccgcccaguccuaccccucccgcuggaccuacaucgaguucuacucccgcuacggcauccucaugaccaagcaggagcucuccuucuccgacaagaaggaggucugcaaggucguccuccaccgccucauccaggacuccaaccaguaccaguucggcaagaccaagaucuucuuccgcgccggccaggucgccuaccucgagaagcuccgccucgacaagcuccgccaguccugcgucaugguccagaagcacaugcgcggcuggcuccagcgcaagaaguuccuccgcgagcgccgcgccgcccucaucauccagcaguacuuccgcggccagcagaccguccgcaaggccaucaccgccgucgcccucaaggaggccugggccgccaucaucauccagaagcacugccgcggcuaccucguccgcucccucuaccagcucauccgcauggccaccaucaccaugcaggccuacucccgcggcuuccucgcccgccgccgcuaccgcaagaugcucgaggagcacaaggccgucauccuccagaaguacgcccgcgccuggcucgcccgccgccgcuuccaguccauccgccgcuucguccucaacauccagcucaccuaccgcguccagcgccuccagaagaagcucgaggaccagaacaaggagaaccacggccucgucgagaagcucaccucccucgccgcccuccgcgccggcgacgucgagaagauccagaagcucgaggccgagcucgagaaggccgccacccaccgccgcaacuacgaggagaagggcaagcgcuaccgcgacgccgucgaggagaagcucgccaagcuccagaagcacaacuccgagcucgagacccagaaggagcagauccagcucaagcuccaggagaagaccgaggagcucaaggagaagauggacaaccucaccaagcagcucuucgacgacguccagaaggaggagcgccagcgcaugcuccucgagaaguccuucgagcucaagacccaggacuacgagaagcagauccagucccucaaggaggagaucaaggcccucaaggacgagaagaugcagcuccagcaccucgucgagggcgagcacgucaccuccgacggccucaaggccgaggucgcccgccucuccaagcaggucaagaccaucuccgaguucgagaaggagaucgagcuccuccaggcccagaagaucgacgucgagaagcacguccagucccagaagcgcgagaugcgcgagaagauguccgagaucaccaagcagcuccucgaguccuacgacaucgaggacguccgcucccgccucuccgucgaggaccucgagcaccucaacgaggacggcgagcucugguucgccuacgagggccucaagaaggccacccgcguccucgagucccacuuccagucccagaaggacugcuacgagaaggagaucgaggcccucaacuucaaggucguccaccucucccaggagaucaaccaccuccagaagcucuuccgcgaggagaacgacaucaacgaguccauccgccacgaggucacccgccucaccuccgagaacaugaugauccccgacuucaagcagcagaucuccgagcucgagaagcagaagcaggaccucgagauccgccucaacgagcaggccgagaagaugaagggcaagcucgaggagcucuccaaccagcuccaccgcucccaggaggaggagggcacccagcgcaaggcccucgaggcccagaacgagauccacaccaaggagaaggagaagcucaucgacaagauccaggagaugcaggaggccuccgaccaccucaagaagcaguucgagaccgaguccgaggucaagugcaacuuccgccaggaggccucccgccucacccucgagaaccgcgaccucgaggaggagcucgacaugaaggaccgcgucaucaagaagcuccaggaccaggucaagacccucuccaagaccaucggcaaggccaacgacguccacuccuccuccggccccaaggaguaccucggcaugcuccaguacaagcgcgaggacgaggccaagcucauccagaaccucauccucgaccucaagccccgcggcgucgucgucaacaugauccccggccuccccgcccacauccucuucaugugcguccgcuacgccgacucccucaacgacgccaacaugcucaagucccucaugaacuccaccaucaacggcaucaagcaggucgucaaggagcaccucgaggacuucgagaugcucuccuucuggcucuccaacaccugccacuuccucaacugccucaagcaguacuccggcgaggaggaguucaugaagcacaacuccccccagcagaacaagaacugccucaacaacuucgaccucuccgaguaccgccagauccucuccgacgucgccauccgcaucuaccaccaguucaucaucaucauggagaagaacauccagcccaucaucguccccggcaugcucgaguacgagucccuccagggcaucuccggccucaagcccaccggcuuccgcaagcgcuccuccuccaucgacgacaccgacggcuacaccaugaccuccguccuccagcagcucuccuacuucuacaccaccaugugccagaacggccucgaccccgagcucguccgccaggccgucaagcagcucuucuuccucaucggcgccgucacccucaacucccucuuccuccgcaaggacaugugcuccugccgcaagggcaugcagauccgcugcaacaucuccuaccucgaggaguggcucaaggacaagaaccuccagaacucccucgccaaggagacccucgagccccucucccaggccgccuggcuccuccaggucaagaagaccaccgacuccgacgccaaggagaucuacgagcgcugcaccucccucuccgccguccagaucaucaagauccucaacuccuacacccccaucgacgacuucgagaagcgcgucacccccuccuucguccgcaagguccaggcccuccucaacucccgcgaggacuccucccagcucaugcucgacaccaaguaccucuuccaggucaccuuccccuucacccccuccccccacgcccucgagaugauccagauccccuccuccuucaagcucggcuuccucaaccgccucuga

SEQ ID NO: 46367 - RNA, 3789 nt, Artificial Sequence
  derived and/or modified sequence opt2 from MYO6__Homo_sapiens__NP_001287828
auggaggacggcaagcccgucugggccccccaccccaccgacggcuuccagaugggcaacaucgucgacaucggccccgacucccucaccaucgagccccucaaccagaagggcaagaccuuccucgcccucaucaaccaggucuuccccgccgaggaggacuccaagaaggacgucgaggacaacugcucccucauguaccucaacgaggccacccuccuccacaacaucaagguccgcuacuccaaggaccgcaucuacaccuacgucgccaacauccucaucgccgucaaccccuacuucgacauccccaagaucuacuccuccgaggccaucaaguccuaccagggcaagucccucggcacccgccccccccacgucuucgccaucgccgacaaggccuuccgcgacaugaagguccucaagaugucccaguccaucaucgucuccggcgaguccggcgccggcaagaccgagaacaccaaguucguccuccgcuaccucaccgaguccuacggcaccggccaggacaucgacgaccgcaucgucgaggccaacccccuccucgaggccuucggcaacgccaagaccguccgcaacaacaacuccucccgcuucggcaaguucgucgagauccacuucaacgagaaguccuccgucgucggcggcuucgucucccacuaccuccucgagaagucccgcaucugcguccagggcaaggaggagcgcaacuaccacaucuucuaccgccucugcgccggcgccuccgaggacauccgcgagaagcuccaccucuccucccccgacaacuuccgcuaccucaaccgcggcugcacccgcuacuucgccaacaaggagaccgacaagcagauccuccagaaccgcaagucccccgaguaccucaaggccggcuccaugaaggacccccuccucgacgaccacggcgacuucauccgcaugugcaccgccaugaagaagaucggccucgacgacgaggagaagcucgaccucuuccgcgucgucgccggcguccuccaccucggcaacaucgacuucgaggaggccggcuccaccuccggcggcugcaaccucaagaacaaguccgcccagucccucgaguacugcgccgagcuccucggccucgaccaggacgaccuccgcgucucccucaccacccgcgucaugcucaccaccgccggcggcaccaagggcaccgucaucaaggucccccucaaggucgagcaggccaacaacgcccgcgacgcccucgccaagaccgucuacucccaccucuucgaccacgucgucaaccgcgucaaccagugcuuccccuucgagaccuccuccuacuucaucggcguccucgacaucgccggcuucgaguacuucgagcacaacuccuucgagcaguucugcaucaacuacugcaacgagaagcuccagcaguucuucaacgagcgcauccucaaggaggagcaggagcucuaccagaaggagggccucggcgucaacgagguccacuacgucgacaaccaggacugcaucgaccucaucgaggccaagcucgucggcauccucgacauccucgacgaggagaaccgccucccccagcccuccgaccagcacuucaccuccgccguccaccagaagcacaaggaccacuuccgccucaccaucccccgcaaguccaagcucgccguccaccgcaacauccgcgacgacgagggcuucaucauccgccacuucgccggcgccgucugcuacgagaccacccaguucgucgagaagaacaacgacgcccuccacaugucccucgagucccucaucugcgagucccgcgacaaguucauccgcgagcucuucgaguccuccaccaacaacaacaaggacaccaagcagaaggccggcaagcucuccuucaucuccgucggcaacaaguucaagacccagcucaaccuccuccucgacaagcuccgcuccaccggcgccuccuucauccgcugcaucaagcccaaccucaagaugaccucccaccacuucgagggcgcccagauccucucccagcuccagugcuccggcauggucuccguccucgaccucaugcagggcggcuaccccucccgcgccuccuuccacgagcucuacaacauguacaagaaguacaugcccgacaagcucgcccgccucgacccccgccucuucugcaaggcccucuucaaggcccucggccucaacgagaacgacuacaaguucggccucaccaaggucuucuuccgccccggcaaguucgccgaguucgaccagaucaugaaguccgaccccgaccaccucgccgagcucgucaagcgcgucaaccacuggcucaccugcucccgcuggaagaagguccaguggugcucccucuccgucaucaagcucaagaacaagaucaaguaccgcgccgaggccugcaucaagaugcagaagaccauccgcauguggcucugcaagcgccgccacaagccccgcaucgacggccucgucaaggucggcacccucaagaagcgccucgacaaguucaacgaggucgucuccguccucaaggacggcaagcccgagaugaacaagcagaucaagaaccucgagaucuccaucgacacccucauggccaagaucaaguccaccaugaugacccaggagcagauccagaaggaguacgacgcccucgucaaguccuccgaggagcuccucuccgcccuccagaagaagaagcagcaggaggaggaggccgagcgccuccgccgcauccaggaggagauggagaaggagcgcaagcgccgcgaggaggacgagaagcgccgccgcaaggaggaggaggagcgccgcaugaagcucgagauggaggccaagcgcaagcaggaggaggaggagcgcaagaagcgcgaggacgacgagaagcgcauccaggccgaggucgaggcccagcucgcccgccagaaggaggaggagucccagcagcaggccguccucgagcaggagcgccgcgaccgcgagcucgcccuccgcaucgcccaguccgaggccgagcucaucuccgacgaggcccaggccgaccucgcccuccgccgcggccccgccguccucgccaccaaggccgccgccggcaccaagaaguacgaccucuccaaguggaaguacgccgagcuccgcgacaccaucaacaccuccugcgacaucgagcuccucgccgccugccgcgaggaguuccaccgccgccucaaggucuaccacgccuggaaguccaagaacaagaagcgcaacaccgagaccgagcagcgcgcccccaaguccgucaccgacuacgacuucgcccccuuccucaacaacuccccccagcagaaccccgccgcccagauccccgcccgccagcgcgagaucgagaugaaccgccagcagcgcuucuuccgcauccccuucauccgccccgccgaccaguacaaggacccccaguccaagaagaagggcuggugguacgcccacuucgacggccccuggaucgcccgccagauggagcuccaccccgacaagccccccauccuccucgucgccggcaaggacgacauggagaugugcgagcucaaccucgaggagaccggccucacccgcaagcgcggcgccgagauccucccccgccaguucgaggagaucugggagcgcugcggcggcauccaguaccuccagaacgccaucgagucccgccaggcccgccccaccuacgccaccgccaugcuccagucccuccucaaguga

SEQ ID NO: 46368 - RNA, 6648 nt, Artificial Sequence
  derived and/or modified sequence opt2 from MYO7A__Homo_sapiens__NP_000251
auggucauccuccagcagggcgaccacgucuggauggaccuccgccucggccaggaguucgacguccccaucggcgccgucgucaagcucugcgacuccggccagguccaggucgucgacgacgaggacaacgagcacuggaucuccccccagaacgccacccacaucaagcccaugcaccccaccuccguccacggcgucgaggacaugauccgccucggcgaccucaacgaggccggcauccuccgcaaccuccucauccgcuaccgcgaccaccucaucuacaccuacaccggcuccauccucgucgccgucaaccccuaccagcuccucuccaucuacucccccgagcacauccgccaguacaccaacaagaagaucggcgagaugcccccccacaucuucgccaucgccgacaacugcuacuucaacaugaagcgcaacucccgcgaccagugcugcaucaucuccggcgaguccggcgccggcaagaccgaguccaccaagcucauccuccaguuccucgccgccaucuccggccagcacuccuggaucgagcagcagguccucgaggccacccccauccucgaggccuucggcaacgccaagaccauccgcaacgacaacuccucccgcuucggcaaguacaucgacauccacuucaacaagcgcggcgccaucgagggcgccaagaucgagcaguaccuccucgagaagucccgcgucugccgccaggcccucgacgagcgcaacuaccacgucuucuacugcaugcucgagggcauguccgaggaccagaagaagaagcucggccucggccaggccuccgacuacaacuaccucgccaugggcaacugcaucaccugcgagggccgcgucgacucccaggaguacgccaacauccgcuccgccaugaagguccucauguucaccgacaccgagaacugggagaucuccaagcuccucgccgccauccuccaccucggcaaccuccaguacgaggcccgcaccuucgagaaccucgacgccugcgagguccucuucucccccucccucgccaccgccgccucccuccucgaggucaacccccccgaccucauguccugccucaccucccgcacccucaucacccgcggcgagaccgucuccaccccccucucccgcgagcaggcccucgacguccgcgacgccuucgucaagggcaucuacggccgccucuucgucuggaucgucgacaagaucaacgccgccaucuacaagccccccucccaggacgucaagaacucccgccgcuccaucggccuccucgacaucuucggcuucgagaacuucgccgucaacuccuucgagcagcucugcaucaacuucgccaacgagcaccuccagcaguucuucguccgccacgucuucaagcucgagcaggaggaguacgaccucgaguccaucgacuggcuccacaucgaguucaccgacaaccaggacgcccucgacaugaucgccaacaagcccaugaacaucaucucccucaucgacgaggaguccaaguuccccaagggcaccgacaccaccaugcuccacaagcucaacucccagcacaagcucaacgccaacuacaucccccccaagaacaaccacgagacccaguucggcaucaaccacuucgccggcaucgucuacuacgagacccagggcuuccucgagaagaaccgcgacacccuccacggcgacaucauccagcucguccacuccucccgcaacaaguucaucaagcagaucuuccaggccgacgucgccaugggcgccgagacccgcaagcgcucccccacccucuccucccaguucaagcgcucccucgagcuccucaugcgcacccucggcgccugccagcccuucuucguccgcugcaucaagcccaacgaguucaagaagcccaugcucuucgaccgccaccucugcguccgccagcuccgcuacuccggcaugauggagaccauccgcauccgccgcgccggcuaccccauccgcuacuccuucgucgaguucgucgagcgcuaccgcguccuccuccccggcgucaagcccgccuacaagcagggcgaccuccgcggcaccugccagcgcauggccgaggccguccucggcacccacgacgacuggcagaucggcaagaccaagaucuuccucaaggaccaccacgacaugcuccucgaggucgagcgcgacaaggccaucaccgaccgcgucauccuccuccagaaggucauccgcggcuucaaggaccgcuccaacuuccucaagcucaagaacgccgccacccucauccagcgccacuggcgcggccacaacugccgcaagaacuacggccucaugcgccucggcuuccuccgccuccaggcccuccaccgcucccgcaagcuccaccagcaguaccgccucgcccgccagcgcaucauccaguuccaggcccgcugccgcgccuaccucguccgcaaggccuuccgccaccgccucugggccguccucaccguccaggccuacgcccgcggcaugaucgcccgccgccuccaccagcgccuccgcgccgaguaccucuggcgccucgaggccgagaagaugcgccucgccgaggaggagaagcuccgcaaggagauguccgccaagaaggccaaggaggaggccgagcgcaagcaccaggagcgccucgcccagcucgcccgcgaggacgccgagcgcgagcucaaggagaaggaggccgcccgccgcaagaaggagcuccucgagcagauggagcgcgcccgccacgagcccgucaaccacuccgacauggucgacaagauguucggcuuccucggcaccuccggcggccuccccggccaggagggccaggcccccuccggcuucgaggaccucgagcgcggccgccgcgagauggucgaggaggaccucgacgccgcccucccccuccccgacgaggacgaggaggaccucuccgaguacaaguucgccaaguucgccgccaccuacuuccagggcaccaccacccacuccuacacccgccgcccccucaagcagccccuccucuaccacgacgacgagggcgaccagcucgccgcccucgccgucuggaucaccauccuccgcuucaugggcgaccuccccgagcccaaguaccacaccgccauguccgacggcuccgagaagauccccgucaugaccaagaucuacgagacccucggcaagaagaccuacaagcgcgagcuccaggcccuccagggcgagggcgaggcccagcuccccgagggccagaagaaguccuccguccgccacaagcucguccaccucacccucaagaagaaguccaagcucaccgaggaggucaccaagcgccuccacgacggcgaguccaccguccagggcaacuccaugcucgaggaccgccccaccuccaaccucgagaagcuccacuucaucaucggcaacggcauccuccgccccgcccuccgcgacgagaucuacugccagaucuccaagcagcucacccacaaccccuccaaguccuccuacgcccgcggcuggauccucgucucccucugcgucggcugcuucgcccccuccgagaaguucgucaaguaccuccgcaacuucauccacggcggcccccccggcuacgcccccuacugcgaggagcgccuccgccgcaccuucgucaacggcacccgcacccagccccccuccuggcucgagcuccaggccaccaaguccaagaagcccaucaugcuccccgucaccuucauggacggcaccaccaagacccuccucaccgacuccgccaccaccgccaaggagcucugcaacgcccucgccgacaagaucucccucaaggaccgcuucggcuucucccucuacaucgcccucuucgacaaggucuccucccucggcuccggcuccgaccacgucauggacgccaucucccagugcgagcaguacgccaaggagcagggcgcccaggagcgcaacgcccccuggcgccucuucuuccgcaaggaggucuucacccccuggcacucccccuccgaggacaacgucgccaccaaccucaucuaccagcaggucguccgcggcgucaaguucggcgaguaccgcugcgagaaggaggacgaccucgccgagcucgccucccagcaguacuucgucgacuacggcuccgagaugauccucgagcgccuccucaaccucguccccaccuacauccccgaccgcgagaucaccccccucaagacccucgagaagugggcccagcucgccaucgccgcccacaagaagggcaucuacgcccagcgccgcaccgacgcccagaaggucaaggaggacgucgucuccuacgcccgcuucaaguggccccuccucuucucccgcuucuacgaggccuacaaguucuccggccccucccuccccaagaacgacgucaucgucgccgucaacuggaccggcgucuacuucgucgacgagcaggagcagguccuccucgagcucuccuuccccgagaucauggccgucuccuccucccgcgagugccgcgucuggcucucccucggcugcuccgaccucggcugcgccgccccccacuccggcugggccggccucacccccgccggccccugcucccccugcugguccugccgcggcgccaagaccaccgcccccuccuucacccucgccaccaucaagggcgacgaguacaccuucaccuccuccaacgccgaggacauccgcgaccucgucgucaccuuccucgagggccuccgcaagcgcuccaaguacgucgucgcccuccaggacaaccccaaccccgccggcgaggaguccggcuuccucuccuucgccaagggcgaccucaucauccucgaccacgacaccggcgagcaggucaugaacuccggcugggccaacggcaucaacgagcgcaccaagcagcgcggcgacuuccccaccgacuccgucuacgucaugcccaccgucaccaugcccccccgcgagaucgucgcccucgucaccaugacccccgaccagcgccaggacgucguccgccuccuccagcuccgcaccgccgagcccgagguccgcgccaagcccuacacccucgaggaguucuccuacgacuacuuccgccccccccccaagcacacccucucccgcgucauggucuccaaggcccgcggcaaggaccgccucuggucccacacccgcgagccccucaagcaggcccuccucaagaagcuccucggcuccgaggagcucucccaggaggccugccucgccuucaucgccguccucaaguacaugggcgacuaccccuccaagcgcacccgcuccgucaacgagcucaccgaccagaucuucgagggcccccucaaggccgagccccucaaggacgaggccuacguccagauccucaagcagcucaccgacaaccacauccgcuacuccgaggagcgcggcugggagcuccucuggcucugcaccggccucuucccccccuccaacauccuccucccccacguccagcgcuuccuccagucccgcaagcacugcccccucgccaucgacugccuccagcgccuccagaaggcccuccgcaacggcucccgcaaguaccccccccaccucgucgaggucgaggccauccagcacaagaccacccagaucuuccacaaggucuacuuccccgacgacaccgacgaggccuucgaggucgaguccuccaccaaggccaaggacuucugccagaacaucgccacccgccuccuccucaaguccuccgagggcuucucccucuucgucaagaucgccgacaagguccucuccguccccgagaacgacuucuucuucgacuucguccgccaccucaccgacuggaucaagaaggcccgccccaucaaggacggcaucguccccucccucaccuaccaggucuucuucaugaagaagcucuggaccaccaccguccccggcaaggaccccauggccgacuccaucuuccacuacuaccaggagcuccccaaguaccuccgcggcuaccacaagugcacccgcgaggagguccuccagcucggcgcccucaucuaccgcgucaaguucgaggaggacaaguccuacuuccccuccauccccaagcuccuccgcgagcucgucccccaggaccucauccgccaggucucccccgacgacuggaagcgcuccaucgucgccuacuucaacaagcacgccggcaaguccaaggaggaggccaagcucgccuuccucaagcucaucuucaaguggcccaccuucggcuccgccuucuucgaggucaagcagaccaccgagcccaacuuccccgagauccuccucaucgccaucaacaaguacggcgucucccucaucgaccccaagaccaaggacauccucaccacccaccccuucaccaagaucuccaacugguccuccggcaacaccuacuuccacaucaccaucggcaaccucguccgcggcuccaagcuccucugcgagaccucccucggcuacaagauggacgaccuccucaccuccuacaucucccagaugcucaccgccauguccaagcagcgcggcucccgcuccggcaaguga

SEQ ID NO: 46369 - RNA, 6351 nt, Artificial Sequence
  derived and/or modified sequence opt2 from MYO7B__Homo_sapiens__NP_001073996
auguccggcuuccgccucggcgaccacgucuggcucgagccccccuccacccacaagaccggcgucgccaucggcggcaucaucaaggaggccaagcccggcaagguccucgucgaggacgacgagggcaaggagcacuggauccgcgccgaggacuucggcguccucucccccaugcaccccaacuccguccagggcgucgacgacaugauccgccucggcgaccucaacgaggccggcaugguccacaaccuccucauccgcuaccagcagcacaagaucuacaccuacaccggcuccauccucgucgccgucaaccccuuccagguccucccccucuacacccucgagcagguccagcucuacuacucccgccacaugggcgagcuccccccccacgucuucgccaucgccaacaacugcuacuucuccaugaagcgcaacaagcgcgaccagugcugcaucaucuccggcgaguccggcgccggcaagaccgagaccaccaagcucauccuccaguuccucgccaccaucuccggccagcacuccuggaucgagcagcagguccucgaggccaaccccauccucgaggccuucggcaacgccaagaccauccgcaacgacaacuccucccgcuucggcaaguacaucgacaucuacuucaaccccuccggcgucaucgagggcgcccgcaucgagcaguuccuccucgagaagucccgcgucugccgccaggcccccgaggagcgcaacuaccacaucuucuacugcaugcucaugggcgucuccgccgaggacaagcagcuccucucccucggcacccccuccgaguaccacuaccucaccaugggcaacugcaccuccugcgagggccucaacgacgccaaggacuacgcccacauccgcuccgccaugaagauccuccaguucuccgacuccgaguccugggacgucaucaagcuccucgccgccauccuccaccucggcaacgucggcuucauggccuccgucuucgagaaccucgacgccuccgacgucauggagacccccgccuuccccaccgucaugaagcuccucgagguccagcaccaggagcuccgcgacugccucaucaagcacaccauccucauccgcggcgaguucgucacccgcucccucaacaucgcccaggccgccgaccgccgcgacgccuucgucaagggcaucuacggccaccucuuccucuggaucgucaagaagaucaacgccgccaucuucaccccccccgcccaggaccccaagaacguccgccgcgccaucggccuccucgacaucuucggcuucgagaacuucgagaacaacuccuucgagcagcucugcaucaacuucgccaacgagcaccuccagcaguucuucguccagcacgucuucaccauggagcaggaggaguaccgcuccgagaacaucuccugggacuacauccacuacaccgacaaccgccccacccucgaccuccucgcccucaagcccauguccaucaucucccuccucgacgaggagucccgcuucccccagggcaccgaccucaccaugcuccagaagcucaacuccguccacgccaacaacaaggccuuccuccagcccaagaacauccacgacgcccgcuucggcaucgcccacuucgccggcgaggucuacuaccaggccgagggcuuccucgagaagaaccgcgacguccucuccaccgacauccucacccucgucuacuccuccaagaacaaguuccuccgcgagaucuucaaccucgagcucgccgagaccaagcucggccacggcaccauccgccaggccaaggccggcaaccaccucuucaaguccgccgacuccaacaagcgccccuccacccucggcucccaguucaagcagucccucgaccagcucaugaagauccucaccaacugccagcccuacuucauccgcugcaucaagcccaacgaguacaagaagccccuccucuucgaccgcgagcucugccuccgccagcuccgcuacuccggcaugauggagaccguccacauccgcaaguccggcuuccccauccgcuacaccuucgaggaguucucccagcgcuucggcguccuccuccccaacgccaugcgcaugcagcuccagggcaagcuccgccagaugacccucggcaucaccgacgucuggcuccgcaccgacaaggacuggaaggccggcaagaccaagaucuuccuccgcgaccaccaggacacccuccucgagguccagcgcucccagguccucgaccgcgccgcccucuccauccagaagguccuccgcggcuaccgcuaccgcaaggaguuccuccgccagcgccgcgccgccgucacccuccaggccugguggcgcggcuacugcaaccgccgcaacuucaagcucauccucgucggcuucgagcgccuccaggccaucgcccgcucccagccccucgcccgccaguaccaggccaugcgccagcgcaccguccagcuccaggcccucugccgcggcuaccucguccgccagcagguccaggccaagcgccgcgccgucgucgucauccaggcccacgcccgcggcauggccgcccgccgcaacuuccagcagcgcaaggccaacgccccccucgucauccccgccgagggccagaagucccagggcgcccuccccgccaagaagcgccgcuccaucuacgacaccgucaccgacaccgagauggucgagaaggucuucggcuuccuccccgccaugaucggcggccaggagggccaggccuccccccacuucgaggaccucgaguccaagacccagaagcuccucgaggucgaccucgacaccguccccauggccgaggagcccgaggaggacgucgacggccucgccgaguacaccuuccccaaguucgccgucaccuacuuccagaaguccgccucccacacccacauccgccgcccccuccgcuacccccuccucuaccacgaggacgacaccgacugccucgccgcccucgucaucuggaacgucauccuccgcuucaugggcgaccuccccgagcccguccucuacgcccgcuccucccagcagggcuccuccgucaugcgccagauccacgacacccucggccgcgagcacggcgcccaggucccccagcacucccgcuccgcccaggucgccucccagcucaacaucggcgaggaggcccucgagcccgacggccucggcgccgaccgccccauguccaaccucgagaagguccacuucaucgucggcuacgccauccuccgccccucccuccgcgacgagaucuacugccagaucugcaagcagcucuccgagaacuucaagaccuccucccucgcccgcggcuggauccuccucucccucugccucggcugcuucccccccuccgagcgcuucaugaaguaccuccucaacuucaucggccagggccccgccaccuacggccccuucugcgccgagcgccuccgccgcaccuacgccaacggcguccgcgccgagccccccaccuggcucgagcuccaggccgucaaguccaagaagcacauccccauccaggucauccucgccaccggcgagucccucaccguccccgucgacuccgccuccaccucccgcgagaugugcaugcacaucgcccacaagcagggccucuccgaccaccucggcuucucccuccaggucgccgucuacgacaaguucuggucccucggcuccggccgcgaccacaugauggacgccaucgcccgcugcgagcagauggcccaggagcgcggcgagucccagcgccagucccccuggcgcaucuacuuccgcaaggaguucuucacccccuggcacgacucccgcgaggaccccgucuccaccgagcucaucuaccgccagguccuccgcggcgucugguccggcgaguacuccuucgagaaggaggaggagcucgucgagcuccucgcccgccacugcuacguccagcucggcgccuccgccgaguccaaggccguccaggagcuccuccccuccugcaucccccacaagcucuaccgcaccaagccccccgaccgcugggccucccucgucaccgccgccugcgccaaggcccccuacacccagaagcaggucaccccccucgccguccgcgagcaggucgucgacgccgcccgccuccaguggccccuccucuucucccgccucuucgaggucaucacccucuccggcccccgccuccccaagacccagcucauccucgccgucaacuggaagggccucugcuuccucgaccagcaggagaagaugcuccucgagcucuccuuccccgaggucaugggccucgccaccaaccgcgaggcccagggcggccagcgccuccuccucuccaccaugcacgaggaguacgaguucgucucccccuccuccgucgccaucgccgagcucgucgcccucuuccucgagggccucaaggagcgcuccaucuucgccauggcccuccaggaccgcaaggccaccgacgacaccacccuccucgccuucaagaagggcgaccuccucguccucaccaagaagcagggccuccucgccuccgagaacuggacccucggccagaacgaccgcaccggcaagaccggccucguccccauggccugccucuacaccauccccaccgucaccaagcccuccgcccagcuccucucccuccucgccaugucccccgagaagcgcaagcucgccgcccaggagggccaguucaccgagccccgccccgaggagccccccaaggagaagcuccacacccucgaggaguucuccuacgaguucuuccgcgcccccgagaaggacauggucuccauggccguccucccccucgcccgcgcccgcggccaccucugggccuacuccugcgagccccuccgccagccccuccucaagcgcguccacgccaacgucgaccucugggacaucgccugccagaucuucgucgccauccuccgcuacaugggcgacuaccccucccgccaggccuggcccacccucgagcucaccgaccagaucuucacccucgcccuccagcaccccgcccuccaggacgaggucuacugccagauccucaagcagcucacccacaacuccaaccgccacuccgaggagcgcggcuggcagcuccucuggcucugcaccggccucuucccccccuccaagggccuccucccccacgcccagaaguucaucgacacccgccgcggcaagcuccucgcccccgacugcucccgccgcauccagaagguccuccgcaccggcccccgcaagcagcccccccaccaggucgaggucgaggccgccgagcagaacgucucccgcaucugccacaagaucuacuuccccaacgacaccuccgagaugcucgaggucgucgccaacacccgcguccgcgacgucugcgacuccaucgccacccgccuccagcucgccuccugggagggcugcucccucuucaucaagaucuccgacaaggucaucucccagaaggagggcgacuucuucuucgacucccuccgcgaggucuccgacugggucaagaagaacaagccccagaaggagggcgcccccgucacccuccccuaccaggucuacuucaugcgcaagcucuggcucaacaucucccccggcaaggacgucaacgccgacaccauccuccacuaccaccaggagcuccccaaguaccuccgcggcuuccacaagugcucccgcgaggacgccauccaccucgccggccucaucuacaaggcccaguucaacaacgaccgcucccagcucgccuccguccccaagauccuccgcgagcucguccccgagaaccucacccgccucauguccuccgaggaguggaagaaguccauccuccucgccuacgacaagcacaaggacaagaccgucgaggaggccaaggucgccuuccucaaguggaucugccgcuggcccaccuucggcuccgccuucuucgaggucaagcagaccuccgagcccuccuaccccgacgucauccucaucgccaucaaccgccacggcguccuccucauccaccccaagaccaaggaccuccucaccaccuaccccuucaccaagaucuccuccugguccuccggcuccaccuacuuccacauggcccucggcucccucggccgcggcucccgccuccucugcgagaccucccucggcuacaagauggacgaccuccucaccuccuacguccagcagcuccucuccgccaugaacaagcagcgcggcuccaaggcccccgcccucgccuccaccuga

SEQ ID NO: 46370 - RNA, 7647 nt, Artificial Sequence
  derived and/or modified sequence opt2 from MYO9A__Homo_sapiens__NP_008832
augaacaucaacgacggcggccgccgccgcuucgaggacaacgagcacacccuccgcaucuaccccggcgccaucuccgagggcaccaucuacugccccauccccgcccgcaagaacuccaccgccgccgaggucaucgagucccucaucaacaagcuccaccucgacaagaccaagugcuacguccucgccgaggucaaggaguucggcggcgaggaguggauccucaaccccaccgacugccccguccagcgcaugaugcucuggccccgcauggcccucgagaaccgccucuccggcgaggacuaccgcuuccuccuccgcgagaagaaccucgacggcuccauccacuacggcucccuccaguccuggcuccgcgucaccgaggagcgccgccgcaugauggagcgcggcuuccucccccagccccagcagaaggacuucgacgaccucugcucccuccccgaccucaacgagaagacccuccucgagaaccuccgcaaccgcuucaagcacgagaagaucuacaccuacgucggcuccauccucaucgucaucaaccccuucaaguuccuccccaucuacaaccccaaguacgucaagauguacgacaaccaccagcucggcaagcucgagccccacaucuacgccgucgccgacgucgccuaccacgccaugcuccagcgcaagaagaaccagugcaucgucaucuccggcgaguccggcuccggcaagacccaguccaccaacuuccucauccaccaccucaccgcccucucccagaagggcuucgccuccggcgucgagcagaucauccucggcgccggccccguccucgaggccuucggcaacgccaagaccgcccacaacaacaacuccucccgcuucggcaaguucauccaggucaacuaccaggagaccggcaccguccucggcgccuacgucgagaaguaccuccucgagaagucccgccucgucuaccaggagcacaacgagcgcaacuaccacgucuucuacuaccuccucgccggcgccuccgaggacgagcgcuccgccuuccaccucaagcagcccgaggaguaccacuaccucaaccagaucaccaagaagccccuccgccaguccugggacgacuacugcuacgacuccgagcccgacugcuucaccgucgagggcgaggaccuccgccacgacuucgagcgccuccagcucgccauggagauggucggcuuccuccccaagacccgccgccagaucuucucccuccucuccgccauccuccaccucggcaacaucugcuacaagaagaagaccuaccgcgacgacuccaucgacaucugcaaccccgagguccuccccaucgucuccgagcuccucgaggucaaggaggagaugcucuucgaggcccucgucacccgcaagaccgucaccgucggcgagaagcucauccuccccuacaagcucgccgaggccgucaccguccgcaacuccauggccaagucccucuacuccgcccucuucgacuggaucgucuuccgcaucaaccacgcccuccucaacuccaaggaccucgagcacaacaccaagacccucuccaucggcguccucgacaucuucggcuucgaggacuacgagaacaacuccuucgagcaguucugcaucaacuucgccaacgagcgccuccagcacuacuucaaccagcacaucuucaagcucgagcaggaggaguaccgcaccgagggcaucuccuggcacaacaucgacuacaucgacaacaccugcugcaucaaccucaucuccaagaagcccaccggccuccuccaccuccucgacgaggaguccaacuucccccaggccaccaaccagacccuccucgacaaguucaagcaccagcacgaggacaacuccuacaucgaguuccccgccgucauggagcccgccuucaucaucaagcacuacgccggcaaggucaaguacggcgucaaggacuuccgcgagaagaacaccgaccacaugcgccccgacaucgucgcccuccuccgcuccuccaagaacgccuucaucuccggcaugaucggcaucgaccccgucgccgucuuccgcugggccauccuccgcgccuucuuccgcgccauggucgccuuccgcgaggccggcaagcgcaacauccaccgcaagaccggccacgacgacaccgcccccugcgccauccucaaguccauggacuccuucuccuuccuccagcaccccguccaccagcgcucccucgagauccuccagcgcugcaaggaggagaaguacuccaucacccgcaagaacccccgcaccccccucuccgaccuccagggcaugaacgcccucaacgagaagaaccagcacgacaccuucgacaucgccuggaacggccgcaccggcauccgccagucccgccucuccuccggcaccucccuccucgacaaggacggcaucuucgccaacuccaccuccuccaagcuccucgagcgcgcccacggcauccucacccgcaacaagaacuucaaguccaagcccgcccuccccaagcaccuccucgaggucaacucccucaagcaccucacccgccucacccuccaggaccgcaucaccaagucccuccuccaccuccacaagaagaagaagccccccuccaucuccgcccaguuccaggccucccucuccaagcucauggagacccucggccaggccgagcccuacuucgucaagugcauccgcuccaacgccgagaagcucccccuccgcuucuccgacguccucguccuccgccagcuccgcuacaccggcaugcucgagaccguccgcauccgccaguccggcuacuccuccaaguacuccuuccaggacuucgucucccacuuccacguccuccucccccgcaacaucauccccuccaaguucaacauccaggacuucuuccgcaagaucaaccucaaccccgacaacuaccaggucggcaagaccauggucuuccucaaggagcaggagcgccagcaccuccaggaccuccuccaccaggagguccuccgccgcaucauccuccuccagcgcugguuccgcguccuccucugccgccagcacuuccuccaccuccgccaggccuccgucaucauccagcgcuucuggcgcaacuaccucaaccagaagcagguccgcgacgccgccguccagaaggacgccuucgucauggccuccgccgccgcccuccuccaggccuccuggcgcgcccaccucgagcgccagcgcuaccucgagcuccgcgccgccgccaucgucauccagcagaaguggcgcgacuacuaccgccgccgccacauggccgccaucugcauccaggcccgcuggaaggccuaccgcgaguccaagcgcuaccaggagcagcgcaagaagaucauccuccuccaguccaccugccgcggcuuccgcgcccgccagcgcuucaaggcccucaaggagcagcgccuccgcgagaccaagcccgaggucggccucgucaacaucaagggcuacggcucccucgagauccagggcuccgaccccuccggcugggaggacugcuccuucgacaaccgcaucaaggccaucgaggagugcaaguccgucaucgaguccaaccgcaucucccgcgaguccuccgucgacugccucaaggagucccccaacaagcagcaggagcgcgcccagucccaguccggcgucgaccuccaggaggacguccucguccgcgagcgcccccgcucccucgaggaccuccaccagaagaaggucggccgcgccaagcgcgagucccgccgcaugcgcgagcucgagcaggccaucuucucccucgagcuccucaagguccgcucccucggcggcaucucccccuccgaggaccgccgcugguccaccgagcucguccccgagggccuccaguccccccgcggcacccccgacuccgaguccucccagggcucccucgagcuccucuccuacgaggagucccagaaguccaagcucgaguccgucaucuccgacgagggcgaccuccaguuccccucccccaagaucuccuccucccccaaguucgacucccgcgacaacgcccucuccgccuccaacgagaccuccuccgccgagcaccucaaggacggcaccaugaaggagauggucgucugcuccuccgaguccaucaccugcaagccccagcucaaggacuccuucaucuccaacucccuccccaccuucuucuacaucccccagcaggacccccucaagaccaacucccagcucgacaccuccauccagcgcaacaagcuccucgagaacgaggacaccgccggcgaggcccucacccucgacaucaaccgcgagacccgccgcuaccacugcuccggcaaggaccagaucguccccucccucaacaccgaguccuccaaccccguccucaagaagcucgagaagcucaacaccgagaaggaggagcgccagaagcagcuccagcagcagaacgagaaggagaugauggagcagauccgccagcagaccgacauccucgagaaggagcgcaaggccuucaagaccaucgagaagccccgcaucggcgagugccucgucgcccccuccuccuaccaguccaagcagcgcgucgagcgccccuccucccuccucucccucaacaccuccaacaagggcgagcucaacguccucggcucccucucccucaaggacgccgcccucgcccagaaggacuccuccuccgcccaccucccccccaaggaccgccccgucaccgucuucuucgagcgcaagggcucccccugccaguccuccaccgucaaggagcucuccaagaccgaccgcaugggcacccagcucaacgucgccugcaagcucuccaacaaccgcaucuccaagcgcgagcacuuccgccccacccaguccuacucccacaacuccgacgaccucucccgcgagggcaacgcccgccccaucuucuucacccccaaggacaacauguccaucccccucgucuccaaggaggcccucaacuccaagaacccccagcuccacaaggaggacgagcccgccuggaagcccgucaagcucgccggccccggccagcgcgagaccucccagcgcuucuccuccgucgacgagcaggccaagcuccacaagaccaugucccagggcgagaucaccaagcucgccguccgccagaaggccuccgacuccgacauccgcccccagcgcgccaagaugcgcuucugggccaagggcaagcagggcgagaagaagaccacccgcgucaagcccaccacccaguccgaggucuccccccucuucgccggcaccgacgucauccccgcccaccaguuccccgacgagcucgccgccuaccaccccacccccccccucucccccgagcuccccggcuccugccgcaaggaguucaaggagaacaaggagcccucccccaaggccaagcgcaagcgcuccgucaagaucuccaacgucgcccucgacuccaugcacuggcagaacgacuccguccagaucaucgccuccgucuccgaccucaaguccauggacgaguuccuccucaagaaggucaacgaccucgacaacgaggacuccaagaaggacacccucgucgacgucgucuucaagaaggcccucaaggaguuccgccagaacaucuucuccuucuacuccuccgcccucgccauggacgacggcaaguccauccgcuacaaggaccucuacgcccucuucgagcagauccucgagaagaccaugcgccucgagcagcgcgacucccucggcgagucccccguccgcgucugggucaacaccuucaaggucuuccucgacgaguacaugaacgaguucaagaccuccgacugcaccgccaccaagguccccaagaccgagcgcaagaagcgccgcaagaaggagaccgaccucgucgaggagcacaacggccacaucuucaaggccacccaguacuccauccccaccuacugcgaguacugcuccucccucaucuggaucauggaccgcgccuccgucugcaagcucugcaaguacgccugccacaagaagugcugccucaagaccaccgccaagugcuccaagaaguacgaccccgagcucuccucccgccaguucggcgucgagcucucccgccucaccuccgaggaccgcaccgucccccucgucgucgagaagcucaucaacuacaucgagaugcacggccucuacaccgagggcaucuaccgcaaguccggcuccaccaacaagaucaaggagcuccgccagggccucgacaccgacgccgaguccgucaaccucgacgacuacaacauccacgucaucgccuccgucuucaagcaguggcuccgcgaccuccccaacccccucaugaccuucgagcucuacgaggaguuccuccgcgccaugggccuccaggagcgcaaggagaccauccgcggcgucuacuccgucaucgaccagcucucccgcacccaccucaacacccucgagcgccucaucuuccaccucguccgcaucgcccuccaggaggacaccaaccgcauguccgccaacgcccucgccaucgucuucgcccccugcauccuccgcugccccgacaccaccgacccccuccaguccguccaggacaucuccaagaccaccaccugcgucgagcucaucgucgucgagcagaugaacaaguacaaggcccgccucaaggacaucuccucccucgaguucgccgagaacaaggccaagacccgccucucccucauccgccgcuccaugggcaagggccgcauccgccgcggcaacuaccccggccccuccucccccgucgucguccgccuccccuccgucuccgacgucuccgaggagacccucaccuccgaggccgccauggagaccgacaucaccgagcagcagcaggccgccaugcagcaggaggagcgcguccucaccgagcagaucgagaaccuccagaaggagaaggaggagcucaccuucgagaugcucguccucgagccccgcgccuccgacgacgagacccucgaguccgaggccuccaucggcaccgccgacuccuccgagaaccucaacauggaguccgaguacgccaucuccgagaaguccgagcgcucccucgcccucuccucccucaagaccgccggcaaguccgagcccuccuccaagcuccgcaagcagcucaagaagcagcaggacucccucgacgucgucgacuccuccgucuccucccucugccucuccaacaccgccuccucccacggcacccgcaagcucuuccagaucuacuccaagucccccuucuaccgcgccgccuccggcaacgaggcccucggcauggagggcccccucggccagaccaaguuccucgaggacaagccccaguucaucucccgcggcaccuucaaccccgagaagggcaagcagaagcucaagaacgucaagaacuccccccagaagaccaaggagacccccgagggcaccgucauguccggccgccgcaagaccgucgaccccgacugcaccuccaaccagcagcucgcccucuucggcaacaacgaguucauggucuga

SEQ ID NO: 46371 - RNA, 6069 nt, Artificial Sequence
  derived and/or modified sequence opt2 from MYO9B__Homo_sapiens__NP_001123537
auguccgucaaggaggccggcuccuccggccgccgcgagcaggccgccuaccaccuccacaucuacccccagcucuccaccaccgagucccaggccuccugccgcgucaccgccaccaaggacuccaccaccuccgacgucaucaaggacgccaucgccucccuccgccucgacggcaccaagugcuacguccucgucgaggucaaggaguccggcggcgaggaguggguccucgacgccaacgacucccccguccaccgcguccuccucuggccccgccgcgcccaggacgagcacccccaggaggacggcuacuacuuccuccuccaggagcgcaacgccgacggcaccaucaaguacguccacaugcagcucgucgcccaggccaccgccacccgccgccucgucgagcgcggccuccucccccgccagcaggccgacuucgacgaccucugcaaccuccccgagcucaccgagggcaaccuccucaagaaccucaagcaccgcuuccuccagcagaagaucuacaccuacgccggcuccauccucgucgccaucaaccccuucaaguuccuccccaucuacaaccccaaguacgucaagauguacgagaaccagcagcucggcaagcucgagccccacgucuucgcccucgccgacgucgccuacuacaccaugcuccgcaagcgcgucaaccagugcaucgucaucuccggcgaguccggcuccggcaagacccaguccaccaacuuccucauccacugccucaccgcccucucccagaagggcuacgccuccggcgucgagcgcaccauccucggcgccggccccguccucgaggccuucggcaacgccaagaccgcccacaacaacaacuccucccgcuucggcaaguucauccaggucuccuaccucgaguccggcaucguccgcggcgccgucgucgagaaguaccuccucgagaagucccgccucgucucccaggagaaggacgagcgcaacuaccacgucuucuacuaccuccuccucggcgucuccgaggaggagcgccaggaguuccagcucaagcagcccgaggacuacuucuaccucaaccagcacaaccucaagaucgaggacggcgaggaccucaagcacgacuucgagcgccucaagcaggccauggagauggucggcuuccuccccgccaccaagaagcagaucuucgccguccucuccgccauccucuaccucggcaacgucaccuacaagaagcgcgccaccggccgcgaggagggccucgaggucggcccccccgagguccucgacacccucucccagcuccucaaggucaagcgcgagauccucgucgagguccucaccaagcgcaagaccgucaccgucaacgacaagcucauccuccccuacucccucuccgaggccaucaccgcccgcgacuccauggccaagucccucuacuccgcccucuucgacuggaucguccuccgcaucaaccacgcccuccucaacaagaaggacgucgaggaggccgucuccugccucuccaucggcguccucgacaucuucggcuucgaggacuucgagcgcaacuccuucgagcaguucugcaucaacuacgccaacgagcagcuccaguacuacuucaaccagcacaucuucaagcucgagcaggaggaguaccagggcgagggcaucaccuggcacaacaucggcuacaccgacaacgucggcugcauccaccucaucuccaagaagcccaccggccucuucuaccuccucgacgaggaguccaacuucccccacgccaccucccagacccuccucgccaaguucaagcagcagcacgaggacaacaaguacuuccucggcacccccgucauggagcccgccuucaucauccagcacuucgccggcaaggucaaguaccagaucaaggacuuccgcgagaagaacauggacuacaugcgccccgacaucgucgcccuccuccgcggcuccgacuccuccuacguccgcgagcucaucggcauggaccccgucgccgucuuccgcugggccguccuccgcgccgccauccgcgccauggccguccuccgcgaggccggccgccuccgcgccgagcgcgccgagaaggccgccggcauguccucccccggcgcccagucccaccccgaggagcucccccgcggcgccuccacccccuccgagaagcucuaccgcgaccuccacaaccagaugaucaaguccaucaagggccuccccuggcagggcgaggacccccgcucccuccuccagucccucucccgccuccagaagccccgcgccuucauccucaaguccaagggcaucaagcagaagcagaucauccccaagaaccuccucgacuccaagucccucaagcucaucaucuccaugacccuccacgaccgcaccaccaagucccuccuccaccuccacaagaagaagaagccccccuccaucuccgcccaguuccagaccucccucaacaagcuccucgaggcccucggcaaggccgagcccuucuucauccgcugcauccgcuccaacgccgagaagaaggagcucugcuucgacgacgagcucguccuccagcagcuccgcuacaccggcaugcucgagaccguccgcauccgccgcuccggcuacuccgccaaguacaccuuccaggacuucaccgagcaguuccagguccuccuccccaaggacgcccagcccugccgcgaggucaucuccacccuccucgagaagaugaagaucgacaagcgcaacuaccagaucggcaagaccaaggucuuccucaaggagaccgagcgccaggcccuccaggagacccuccaccgcgaggucguccgcaagauccuccuccuccaguccugguuccgcaugguccucgagcgccgccacuuccuccagaugaagcgcgccgccgucaccauccaggccugcuggcgcuccuaccgcguccgccgcgcccucgagcgcacccaggccgccgucuaccuccaggccuccuggcgcggcuacuggcagcgcaagcucuaccgccaccagaagcaguccaucauccgccuccagucccucugccgcggccaccuccagcgcaaguccuucucccagaugaucuccgagaagcagaaggccgaggagaaggagcgcgaggcccucgaggccgcccgcgccggcgccgaggagggcggccagggccaggccgccggcggccagcaggucgccgagcagggccccgagcccgccgaggacggcggccaccucgccuccgagcccgagguccagcccuccgaccgcuccccccucgagcacuccucccccgagaaggaggcccccucccccgagaagacccuccccccccagaagaccgucgccgccgagucccacgagaagguccccuccucccgcgagaagcgcgagucccgccgccagcgcggccucgagcacgucaaguuccagaacaagcacauccaguccugcaaggaggaguccgcccuccgcgagcccucccgccgcgucacccaggagcagggcgucucccuccucgaggacaagaaggagucccgcgaggacgagacccuccucgucgucgagaccgaggccgagaacaccucccagaagcagcccaccgagcagccccaggccauggccgucggcaaggucuccgaggagaccgagaagacccuccccuccggcuccccccgccccggccagcucgagcgccccaccucccucgcccucgacucccgcgucuccccccccgcccccggcuccgcccccgagacccccgaggacaaguccaagcccugcggcuccccccgcguccaggagaagcccgacucccccggcggcuccacccagauccagcgcuaccucgacgccgagcgccucgccuccgccgucgagcucuggcgcggcaagaagcucgucgccgccgccucccccuccgccaugcucucccagucccucgaccucuccgaccgccaccgcgccaccggcgccgcccucacccccaccgaggagcgccgcaccuccuucuccaccuccgacgucuccaagcuccuccccucccucgccaaggcccagcccgccgccgagaccaccgacggcgagcgcuccgccaagaagcccgccguccagaagaagaagcccggcgacgccuccucccuccccgacgccggccucucccccggcucccaggucgacuccaaguccaccuucaagcgccucuuccuccacaagaccaaggacaagaaguacucccucgagggcgccgaggagcucgagaacgccgucuccggccacgucguccucgaggccaccaccaugaagaagggccucgaggcccccuccggccagcagcaccgccacgccgccggcgagaagcgcaccaaggagcccggcggcaagggcaagaagaaccgcaacgucaagaucggcaagaucaccgucuccgagaaguggcgcgaguccgucuuccgccagaucaccaacgccaacgagcucaaguaccucgacgaguuccuccucaacaagaucaacgaccuccgcucccagaagacccccaucgagucccucuucaucgaggccaccgagaaguuccgcuccaacaucaagaccauguacuccguccccaacggcaagauccacgucggcuacaaggaccucauggagaacuaccagaucgucgucuccaaccucgccaccgagcgcggccagaaggacaccaaccucguccucaaccucuuccagucccuccucgacgaguucacccgcggcuacaccaagaacgacuucgagcccgucaagcaguccaaggcccagaagaagaagcgcaagcaggagcgcgccguccaggagcacaacggccacgucuucgccuccuaccaggucuccaucccccaguccugcgagcagugccucuccuacaucuggcucauggacaaggcccuccucugcuccgucugcaagaugaccugccacaagaagugcguccacaagauccagucccacugcuccuacaccuacggccgcaagggcgagcccggcgucgagcccggccacuucggcgucugcgucgacucccucaccuccgacaaggccuccguccccaucguccucgagaagcuccucgagcacgucgagaugcacggccucuacaccgagggccucuaccgcaaguccggcgccgccaaccgcacccgcgagcuccgccaggcccuccagaccgaccccgccgccgucaagcucgagaacuuccccauccacgccaucaccggcguccucaagcaguggcuccgcgagcuccccgagccccucaugaccuucgcccaguacggcgacuuccuccgcgccgucgagcuccccgagaagcaggagcagcucgccgccaucuacgccguccucgagcaccuccccgaggccaaccacaacucccucgagcgccucaucuuccaccucgucaaggucgcccuccucgaggacgucaaccgcaugucccccggcgcccucgccaucaucuucgcccccugccuccuccgcugccccgacaacuccgacccccucaccuccaugaaggacguccucaagaucaccaccugcgucgagaugcucaucaaggagcagaugcgcaaguacaaggucaagauggaggagaucucccagcucgaggccgccgaguccaucgccuuccgccgccucucccuccuccgccagaacgcccccuggccccucaagcucggcuucuccucccccuacgagggcguccucaacaagucccccaagacccgcgacauccaggaggaggagcucgagguccuccucgaggaggaggccgccggcggcgacgaggaccgcgagaaggagauccucaucgagcgcauccaguccaucaaggaggagaaggaggacaucaccuaccgccuccccgagcucgacccccgcggcuccgacgaggagaaccucgacuccgagaccuccgccuccaccgagucccuccucgaggagcgcgccggccgcggcgccuccgagggccaguacuga

SEQ ID NO: 46372 - RNA, 2961 nt, Artificial Sequence
  derived and/or modified sequence opt2 from MYOCD__Homo_sapiens__NP_001139784
augacccuccucggcuccgagcacucccuccucauccgcuccaaguuccgcuccguccuccagcuccgccuccagcagcgccgcacccaggagcagcucgccaaccagggcaucauccccccccucaagcgccccgccgaguuccacgagcagcgcaagcaccucgacuccgacaaggccaagaacucccucaagcgcaaggcccgcaaccgcugcaacuccgccgaccucgucaacaugcacauccuccaggccuccaccgccgagcgcuccauccccaccgcccagaugaagcucaagcgcgcccgccucgccgacgaccucaacgagaagaucgcccuccgccccggcccccucgagcucgucgagaagaacauccuccccgucgacuccgccgucaaggaggccaucaagggcaaccaggucuccuucuccaaguccaccgacgccuucgccuucgaggaggacuccuccuccgacggccucucccccgaccagacccgcuccgaggacccccagaacuccgccggcuccccccccgacgccaaggccuccgacacccccuccaccggcucccucggcaccaaccaggaccucgccuccggcuccgagaacgaccgcaacgacuccgccucccagcccucccaccaguccgacgccggcaagcagggccucggcccccccuccacccccaucgccguccacgccgccgucaaguccaagucccucggcgacuccaagaaccgccacaagaagcccaaggaccccaagcccaaggucaagaagcucaaguaccaccaguacaucccccccgaccagaaggccgagaagucccccccccccauggacuccgccuacgcccgccuccuccagcagcagcagcucuuccuccagcuccagauccucucccagcagcagcagcagcagcagcaccgcuucuccuaccucggcaugcaccaggcccagcucaaggagcccaacgagcagaugguccgcaaccccaacuccuccuccaccccccucuccaacaccccccucucccccgucaagaacuccuucuccggccagaccggcgucuccuccuucaagcccggcccccucccccccaaccucgacgaccucaaggucuccgagcuccgccagcagcuccgcauccgcggccuccccgucuccggcaccaagaccgcccucauggaccgccuccgccccuuccaggacugcuccggcaaccccguccccaacuucggcgacaucaccaccgucaccuuccccgucacccccaacacccuccccaacuaccaguccuccuccuccaccuccgcccucuccaacggcuucuaccacuucggcuccaccuccuccuccccccccaucucccccgccuccuccgaccucuccgucgccggcucccuccccgacaccuucaacgacgccucccccuccuucggccuccaccccucccccguccacgucugcaccgaggagucccucauguccucccucaacggcggcuccguccccuccgagcucgacggccucgacuccgagaaggacaagaugcucgucgagaagcagaaggucaucaacgagcucaccuggaagcuccagcaggagcagcgccaggucgaggagcuccgcaugcagcuccagaagcagaagcgcaacaacugcuccgagaagaagccccuccccuuccucgccgccuccaucaagcaggaggaggccgucuccuccugccccuucgccucccagguccccgucaagcgccaguccuccuccuccgagugccacccccccgccugcgaggccgcccagcuccagccccucggcaacgcccacugcgucgaguccuccgaccagaccaacguccucuccuccaccuuccucuccccccagugcuccccccagcacuccccccucggcgccgucaaguccccccagcacaucucccucccccccucccccaacaacccccacuuccuccccuccuccuccggcgcccagggcgagggccaccgcgucuccucccccaucuccucccaggucugcaccgcccagaacuccggcgcccacgacggccacccccccuccuucuccccccacuccuccucccuccacccccccuucuccggcgcccaggccgacuccucccacggcgccggcggcaaccccugccccaagucccccugcguccagcagaagauggccggccuccacuccuccgacaaggucggccccaaguucuccauccccucccccaccuucuccaaguccuccuccgccaucuccgaggucacccagccccccuccuacgaggacgccgucaagcagcagaugacccgcucccagcagauggacgagcuccucgacguccucaucgaguccggcgagaugcccgccgacgcccgcgaggaccacuccugccuccagaagguccccaagaucccccgcuccucccgcucccccaccgccguccucaccaagcccuccgccuccuucgagcaggccuccuccggcucccagauccccuucgaccccuacgccaccgacuccgacgagcaccucgagguccuccucaacucccaguccccccucggcaagauguccgacgucacccuccucaagaucggcuccgaggagccccacuucgacggcaucauggacggcuucuccggcaaggccgccgaggaccucuucaacgcccacgagauccuccccggcccccucucccccaugcagacccaguucucccccuccuccgucgacuccaacggccuccagcucuccuucaccgagucccccugggagaccauggaguggcucgaccucaccccccccaacuccacccccggcuucuccgcccucaccaccuccucccccuccaucuucaacaucgacuuccucgacgucaccgaccucaaccucaacuccuccauggaccuccaccuccagcagugguga

SEQ ID NO: 46373 - RNA, 1515 nt, Artificial Sequence
  derived and/or modified sequence opt2 from MYOC__Homo_sapiens__NP_000252
augcgcuucuucugcgcccgcugcugcuccuucggccccgagaugcccgccguccagcuccuccuccucgccugccucgucugggacgucggcgcccgcaccgcccagcuccgcaaggccaacgaccaguccggccgcugccaguacaccuucuccgucgccucccccaacgaguccuccugccccgagcagucccaggccauguccgucauccacaaccuccagcgcgacuccuccacccagcgccucgaccucgaggccaccaaggcccgccucuccucccucgagucccuccuccaccagcucacccucgaccaggccgcccgcccccaggagacccaggagggccuccagcgcgagcucggcacccuccgccgcgagcgcgaccagcucgagacccagacccgcgagcucgagaccgccuacuccaaccuccuccgcgacaaguccguccucgaggaggagaagaagcgccuccgccaggagaacgagaaccucgcccgccgccucgaguccuccucccaggaggucgcccgccuccgccgcggccagugcccccagacccgcgacaccgcccgcgccgucccccccggcucccgcgaggucuccaccuggaaccucgacacccucgccuuccaggagcucaaguccgagcucaccgagguccccgccucccgcauccucaaggagucccccuccggcuaccuccgcuccggcgagggcgacaccggcugcggcgagcucgucugggucggcgagccccucacccuccgcaccgccgagaccaucaccggcaaguacggcgucuggaugcgcgaccccaagcccaccuaccccuacacccaggagaccaccuggcgcaucgacaccgucggcaccgacguccgccaggucuucgaguacgaccucaucucccaguucaugcagggcuaccccuccaagguccacauccucccccgcccccucgaguccaccggcgccgucgucuacuccggcucccucuacuuccagggcgccgagucccgcaccgucauccgcuacgagcucaacaccgagaccgucaaggccgagaaggagauccccggcgccggcuaccacggccaguuccccuacuccuggggcggcuacaccgacaucgaccucgccgucgacgaggccggccucugggucaucuacuccaccgacgaggccaagggcgccaucguccucuccaagcucaaccccgagaaccucgagcucgagcagaccugggagaccaacauccgcaagcaguccgucgccaacgccuucaucaucugcggcacccucuacaccgucuccuccuacaccuccgccgacgccaccgucaacuucgccuacgacaccggcaccggcaucuccaagacccucaccauccccuucaagaaccgcuacaaguacuccuccaugaucgacuacaacccccucgagaagaagcucuucgccugggacaaccucaacauggucaccuacgacaucaagcucuccaagauguga

SEQ ID NO: 46374 - RNA, 963 nt, Artificial Sequence
  derived and/or modified sequence opt2 from MYOD1__Homo_sapiens__NP_002469
auggagcuccucucccccccccuccgcgacgucgaccucaccgcccccgacggcucccucugcuccuucgccaccaccgacgacuucuacgacgaccccugcuucgacucccccgaccuccgcuucuucgaggaccucgacccccgccucaugcacgucggcgcccuccucaagcccgaggagcacucccacuuccccgccgccguccaccccgcccccggcgcccgcgaggacgagcacguccgcgcccccuccggccaccaccaggccggccgcugccuccucugggccugcaaggccugcaagcgcaagaccaccaacgccgaccgccgcaaggccgccaccaugcgcgagcgccgccgccucuccaaggucaacgaggccuucgagacccucaagcgcugcaccuccuccaaccccaaccagcgccuccccaaggucgagauccuccgcaacgccauccgcuacaucgagggccuccaggcccuccuccgcgaccaggacgccgccccccccggcgccgccgccgccuucuacgcccccggcccccucccccccggccgcggcggcgagcacuacuccggcgacuccgacgccuccuccccccgcuccaacugcuccgacggcaugauggacuacuccggcccccccuccggcgcccgccgccgcaacugcuacgagggcgccuacuacaacgaggcccccuccgagccccgccccggcaaguccgccgccgucuccucccucgacugccucuccuccaucgucgagcgcaucuccaccgagucccccgccgcccccgcccuccuccucgccgacguccccuccgagucccccccccgccgccaggaggccgccgcccccuccgagggcgaguccuccggcgaccccacccagucccccgacgccgccccccagugccccgccggcgccaaccccaaccccaucuaccagguccucuga

SEQ ID NO: 46375 - RNA, 6186 nt, Artificial Sequence
  derived and/or modified sequence opt2 from MYOF__Homo_sapiens__NP_038479
augcuccgcgucaucgucgaguccgccuccaacauccccaagaccaaguucggcaagcccgaccccaucgucuccgucaucuucaaggacgagaagaagaagaccaagaaggucgacaacgagcucaaccccgucuggaacgagauccucgaguucgaccuccgcggcaucccccucgacuucuccuccucccucggcaucaucgucaaggacuucgagaccaucggccagaacaagcucaucggcaccgccaccgucgcccucaaggaccucaccggcgaccagucccgcucccuccccuacaagcucaucucccuccucaacgagaagggccaggacaccggcgccaccaucgaccucgucaucggcuacgacccccccuccgccccccaccccaacgaccucuccggccccuccguccccggcaugggcggcgacggcgaggaggacgagggcgacgaggaccgccucgacaacgccguccgcggccccggccccaagggccccgucggcaccgucuccgaggcccagcucgcccgccgccucaccaaggucaagaacucccgccgcaugcucuccaacaagccccaggacuuccagauccgcguccgcgucaucgagggccgccagcucuccggcaacaacauccgccccgucgucaagguccacgucugcggccagacccaccgcacccgcaucaagcgcggcaacaaccccuucuucgacgagcucuucuucuacaacgucaacaugacccccuccgagcucauggacgagaucaucuccauccgcgucuacaacucccacucccuccgcgccgacugccucaugggcgaguucaagaucgacgucggcuucgucuacgacgagcccggccacgccgucaugcgcaaguggcuccuccucaacgaccccgaggacaccuccuccggcuccaagggcuacaugaaggucuccauguucguccucggcaccggcgacgagcccccccccgagcgccgcgaccgcgacaacgacuccgacgacgucgaguccaaccuccuccuccccgccggcaucgcccuccgcugggucaccuuccuccucaagaucuaccgcgccgaggacaucccccagauggacgacgccuucucccagaccgucaaggagaucuucggcggcaacgccgacaagaagaaccucgucgaccccuucgucgaggucuccuucgccggcaagaaggucugcaccaacaucaucgagaagaacgccaaccccgaguggaaccaggucgucaaccuccagaucaaguuccccuccgucugcgagaagaucaagcucaccaucuacgacugggaccgccucaccaagaacgacgucgucggcaccaccuaccuccaccucuccaagaucgccgccuccggcggcgaggucgaggacuucuccuccuccggcaccggcgccgccuccuacaccgucaacaccggcgagaccgaggucggcuucguccccaccuucggccccugcuaccucaaccucuacggcuccccccgcgaguacaccggcuuccccgaccccuacgacgagcucaacaccggcaagggcgagggcgucgccuaccgcggccgcauccucgucgagcucgccaccuuccucgagaagaccccccccgacaagaagcucgagcccaucuccaacgacgaccuccucgucgucgagaaguaccagcgccgccgcaaguacucccucuccgccgucuuccacuccgccaccaugcuccaggacgucggcgaggccauccaguucgaggucuccaucggcaacuacggcaacaaguucgacaccaccugcaagccccucgccuccaccacccaguacucccgcgccgucuucgacggcaacuacuacuacuaccuccccugggcccacaccaagcccgucgucacccucaccuccuacugggaggacaucucccaccgccucgacgccgucaacacccuccucgccauggccgagcgccuccagaccaacaucgaggcccucaaguccggcauccagggcaagauccccgccaaccagcucgccgagcucuggcucaagcucaucgacgaggucaucgaggacacccgcuacacccucccccucaccgagggcaaggccaacgucaccguccucgacacccagauccgcaagcuccgcucccgcucccucucccagauccacgaggccgccguccgcaugcgcuccgaggccaccgacgucaaguccacccucgccgagaucgaggacuggcucgacaagcucaugcagcucaccgaggagccccagaacuccaugcccgacaucaucaucuggaugauccgcggcgagaagcgccucgccuacgcccgcauccccgcccaccagguccucuacuccaccuccggcgagaacgccuccggcaaguacugcggcaagacccagaccaucuuccucaaguacccccaggagaagaacaacggccccaagguccccgucgagcuccgcgucaacaucuggcucggccucuccgccgucgagaagaaguucaacuccuucgccgagggcaccuucaccgucuucgccgagauguacgagaaccaggcccucauguucggcaaguggggcaccuccggccucgucggccgccacaaguucuccgacgucaccggcaagaucaagcucaagcgcgaguucuuccucccccccaagggcugggagugggagggcgaguggaucgucgaccccgagcgcucccuccucaccgaggccgacgccggccacaccgaguucaccgacgaggucuaccagaacgagucccgcuaccccggcggcgacuggaagcccgccgaggacaccuacaccgacgccaacggcgacaaggccgccucccccuccgagcucaccugcccccccggcugggagugggaggacgacgccugguccuacgacaucaaccgcgccgucgacgagaagggcugggaguacggcaucaccaucccccccgaccacaagcccaaguccugggucgccgccgagaagauguaccacacccaccgccgccgccgccucguccgcaagcgcaagaaggaccucacccagaccgccuccuccaccgcccgcgccauggaggagcuccaggaccaggagggcugggaguacgccucccucaucggcuggaaguuccacuggaagcagcgcuccuccgacaccuuccgccgccgccgcuggcgccgcaagauggcccccuccgagacccacggcgccgccgccaucuucaagcucgagggcgcccucggcgccgacaccaccgaggacggcgacgagaagucccucgagaagcagaagcacuccgccaccaccgucuucggcgccaacacccccaucgucuccugcaacuucgaccgcgucuacaucuaccaccuccgcugcuacgucuaccaggcccgcaaccuccucgcccucgacaaggacuccuucuccgaccccuacgcccacaucugcuuccuccaccgcuccaagaccaccgagaucauccacuccacccucaaccccaccugggaccagaccaucaucuucgacgaggucgagaucuacggcgagccccagaccguccuccagaacccccccaaggucaucauggagcucuucgacaacgaccaggucggcaaggacgaguuccucggccgcuccaucuucucccccgucgucaagcucaacuccgagauggacaucacccccaagcuccucuggcaccccgucaugaacggcgacaaggccugcggcgacguccucgucaccgccgagcucauccuccgcggcaaggacggcuccaaccuccccauccuccccccccagcgcgcccccaaccucuacauggucccccagggcauccgccccgucguccagcucaccgccaucgagauccucgccuggggccuccgcaacaugaagaacuuccagauggccuccaucaccucccccucccucgucgucgagugcggcggcgagcgcgucgaguccgucgucaucaagaaccucaagaagacccccaacuuccccuccuccguccucuucaugaaggucuuccuccccaaggaggagcucuacaugcccccccucgucaucaaggucaucgaccaccgccaguucggccgcaagcccgucgucggccagugcaccaucgagcgccucgaccgcuuccgcugcgaccccuacgccggcaaggaggacaucgucccccagcucaaggccucccuccucuccgccccccccugccgcgacaucgucaucgagauggaggacaccaagccccuccucgccuccaagcucaccgagaaggaggaggagaucgucgacuggugguccaaguucuacgccuccuccggcgagcacgagaagugcggccaguacauccagaagggcuacuccaagcucaagaucuacaacugcgagcucgagaacgucgccgaguucgagggccucaccgacuucuccgacaccuucaagcucuaccgcggcaaguccgacgagaacgaggaccccuccgucgucggcgaguucaagggcuccuuccgcaucuacccccuccccgacgaccccuccguccccgcccccccccgccaguuccgcgagcuccccgacuccgucccccaggagugcaccguccgcaucuacaucguccgcggccucgagcuccagccccaggacaacaacggccucugcgaccccuacaucaagaucacccucggcaagaaggucaucgaggaccgcgaccacuacauccccaacacccucaaccccgucuucggccgcauguacgagcucuccugcuaccucccccaggagaaggaccucaagaucuccgucuacgacuacgacaccuucacccgcgacgagaaggucggcgagaccaucaucgaccucgagaaccgcuuccucucccgcuucggcucccacugcggcauccccgaggaguacugcgucuccggcgucaacaccuggcgcgaccagcuccgccccacccagcuccuccagaacgucgcccgcuucaagggcuucccccagcccauccucuccgaggacggcucccgcauccgcuacggcggccgcgacuacucccucgacgaguucgaggccaacaagauccuccaccagcaccucggcgcccccgaggagcgccucgcccuccacauccuccgcacccagggccucguccccgagcacgucgagacccgcacccuccacuccaccuuccagcccaacaucucccagggcaagcuccagaugugggucgacgucuuccccaagucccucggcccccccggcccccccuucaacaucaccccccgcaaggccaagaaguacuaccuccgcgucaucaucuggaacaccaaggacgucauccucgacgagaaguccaucaccggcgaggagauguccgacaucuacgucaagggcuggauccccggcaacgaggagaacaagcagaagaccgacguccacuaccgcucccucgacggcgagggcaacuucaacuggcgcuucgucuuccccuucgacuaccuccccgccgagcagcucugcaucgucgccaagaaggagcacuucugguccaucgaccagaccgaguuccgcauccccccccgccucaucauccagaucugggacaacgacaaguucucccucgacgacuaccucggcuuccucgagcucgaccuccgccacaccaucauccccgccaagucccccgagaagugccgccucgacaugauccccgaccucaaggccaugaacccccucaaggccaagaccgccucccucuucgagcagaaguccaugaagggcugguggcccugcuacgccgagaaggacggcgcccgcgucauggccggcaaggucgagaugacccucgagauccucaacgagaaggaggccgacgagcgccccgccggcaagggccgcgacgagcccaacaugaaccccaagcucgaccuccccaaccgccccgagaccuccuuccucugguucaccaaccccugcaagaccaugaaguucaucgucuggcgccgcuucaagugggucaucaucggccuccucuuccuccucauccuccuccucuucgucgccguccuccucuacucccuccccaacuaccucuccaugaagaucgucaagcccaacgucuga

SEQ ID NO: 46376 - RNA, 675 nt, Artificial Sequence
  derived and/or modified sequence opt2 from MYOG__Homo_sapiens__NP_002470
auggagcucuacgagaccucccccuacuucuaccaggagccccgcuucuacgacggcgagaacuaccuccccguccaccuccagggcuucgagccccccggcuacgagcgcaccgagcucacccucucccccgaggcccccggcccccucgaggacaagggccucggcacccccgagcacugccccggccagugccuccccugggccugcaaggucugcaagcgcaaguccgucuccgucgaccgccgccgcgccgccacccuccgcgagaagcgccgccucaagaaggucaacgaggccuucgaggcccucaagcgcuccacccuccucaaccccaaccagcgccuccccaaggucgagauccuccgcuccgccauccaguacaucgagcgccuccaggcccuccucuccucccucaaccaggaggagcgcgaccuccgcuaccgcggcggcggcggcccccagcccggcguccccuccgagugcuccucccacuccgccuccugcucccccgaguggggcuccgcccucgaguucuccgccaaccccggcgaccaccuccucaccgccgaccccaccgacgcccacaaccuccacucccucaccuccaucgucgacuccaucaccgucgaggacgucuccgucgccuuccccgacgagaccaugcccaacuga

SEQ ID NO: 46377 - RNA, 5058 nt, Artificial Sequence
  derived and/or modified sequence opt2 from MYOM1__Homo_sapiens__NP_003794
augucccuccccuucuaccagcgcugccaccagcacuacgaccucuccuaccgcaacaaggacguccgcuccaccgucucccacuaccagcgcgagaagaagcgcuccgccgucuacacccagggcuccaccgccuacuccucccgcuccuccgccgcccaccgccgcgaguccgaggccuuccgccgcgccuccgccuccuccucccagcagcaggccucccagcacgcccucuccuccgaggucucccgcaaggccgccuccgccuacgacuacggcuccucccacggccucaccgacuccucccuccuccucgacgacuacuccuccaagcucucccccaagcccaagcgcgccaagcacucccuccucuccggcgaggagaaggagaaccuccccuccgacuacaugguccccaucuucuccggccgccagaagcacgucuccggcaucaccgacaccgaggaggagcgcaucaaggaggccgccgccuacaucgcccagcgcaaccuccucgccuccgaggagggcaucaccaccuccaagcaguccaccgccuccaagcagaccaccgccuccaagcaguccaccgccuccaagcaguccaccgccuccaagcaguccaccgccucccgccaguccaccgccucccgccaguccgucgucuccaagcaggccaccuccgcccuccagcaggaggagaccuccgagaagaagucccgcaaggucgucauccgcgagaaggccgagcgccucucccuccgcaagacccucgaggagaccgagaccuaccacgccaagcucaacgaggaccaccuccuccacgcccccgaguucaucaucaagccccgcucccacaccgucugggagaaggagaacgucaagcuccacugcuccaucgccggcuggcccgagccccgcgucaccugguacaagaaccagguccccaucaacguccacgccaaccccggcaaguacaucaucgagucccgcuacggcaugcacacccucgagaucaacggcugcgacuucgaggacaccgcccaguaccgcgccuccgccaugaacgucaagggcgagcucuccgccuacgccuccgucgucgucaagcgcuacaagggcgaguucgacgagacccgcuuccacgccggcgccuccaccaugccccucuccuucggcgucacccccuacggcuacgccucccgcuucgagauccacuucgacgacaaguucgacgucuccuucggccgcgagggcgagaccaugucccucggcugccgcgucgucaucacccccgagaucaagcacuuccagcccgagauccagugguaccgcaacggcgucccccucucccccuccaaguggguccagacccucugguccggcgagcgcgccacccucaccuucucccaccucaacaaggaggacgagggccucuacaccauccgcguccgcaugggcgaguacuacgagcaguacuccgccuacgucuucguccgcgacgccgacgccgagaucgagggcgcccccgccgccccccucgacgucaagugccucgaggccaacaaggacuacaucaucaucuccuggaagcagcccgccgucgacggcggcucccccauccucggcuacuucaucgacaagugcgaggucggcaccgacuccuggucccagugcaacgacacccccgucaaguucgcccgcuuccccgucaccggccucaucgagggccgcuccuacaucuuccgcguccgcgccgucaacaagaugggcaucggcuuccccucccgcgucuccgagcccgucgccgcccucgaccccgccgagaaggcccgccucaagucccgccccuccgcccccuggaccggccagaucaucgucaccgaggaggagcccuccgagggcaucguccccggcccccccaccgaccucuccgucaccgaggccacccgcuccuacgucguccucuccuggaagccccccggccagcgcggccacgagggcaucauguacuucgucgagaagugcgaggccggcaccgagaacuggcagcgcgucaacaccgagcuccccgucaaguccccccgcuucgcccucuucgaccucgccgagggcaaguccuacugcuuccgcguccgcugcuccaacuccgccggcgucggcgagcccuccgaggccaccgaggucaccgucgucggcgacaagcucgacauccccaaggcccccggcaagaucauccccucccgcaacaccgacaccuccgucgucgucuccugggaggaguccaaggacgccaaggagcucgucggcuacuacaucgaggccuccgucgccggcuccggcaagugggagcccugcaacaacaaccccgucaagggcucccgcuucaccugccacggccucgucaccggccaguccuacaucuuccgcguccgcgccgucaacgccgccggccucuccgaguacucccaggacuccgaggccaucgaggucaaggccgccaucggcggcggcgucucccccgacgucugccccgcccucuccgacgagcccggcggccucaccgccucccgcggccgcguccacgaggccuccccccccaccuuccagaaggacgcccuccucggcuccaagcccaacaagcccucccuccccuccuccucccagaaccucggccagaccgaggucuccaaggucuccgagaccguccaggaggagcucaccccccccccccagaaggccgccccccagggcaaguccaaguccgacccccucaagaagaagaccgaccgcgccccccccuccccccccugcgacaucaccugccucgaguccuuccgcgacuccaugguccucggcuggaagcagcccgacaagaucggcggcgccgagaucaccggcuacuacgucaacuaccgcgaggucaucgacggcguccccggcaaguggcgcgaggccaacgucaaggccgucuccgaggaggccuacaagaucuccaaccucaaggagaacauggucuaccaguuccaggucgccgccaugaacauggccggccucggcgcccccuccgccgucuccgagugcuucaagugcgaggaguggaccaucgccguccccggccccccccacucccucaagugcuccgagguccgcaaggacucccucguccuccaguggaagccccccguccacuccggccgcacccccgucaccggcuacuucgucgaccucaaggaggccaaggccaaggaggaccaguggcgcggccucaacgaggccgccaucaagaacgucuaccucaagguccgcggccucaaggagggcgucuccuacgucuuccgcguccgcgccaucaaccaggccggcgucggcaagcccuccgaccucgccggccccgucgucgccgagacccgccccggcaccaaggaggucgucgucaacgucgacgacgacggcgucaucucccucaacuucgagugcgacaagaugacccccaaguccgaguucuccugguccaaggacuacgucuccaccgaggacuccccccgccucgaggucgaguccaagggcaacaagaccaagaugaccuucaaggaccucggcauggacgaccucggcaucuacuccugcgacgucaccgacaccgacggcaucgccuccuccuaccucaucgacgaggaggagcucaagcgccuccucgcccucucccacgagcacaaguuccccaccguccccgucaaguccgagcucgccgucgagauccucgagaagggccagguccgcuucuggaugcaggccgagaagcucuccggcaacgccaaggucaacuacaucuucaacgagaaggagaucuucgagggccccaaguacaagaugcacaucgaccgcaacaccggcaucaucgagauguucauggagaagcuccaggacgaggacgagggcaccuacaccuuccagcuccaggacggcaaggccaccaaccacuccaccgucguccucgucggcgacgucuucaagaagcuccagaaggaggccgaguuccagcgccaggaguggauccgcaagcagggcccccacuucgucgaguaccucuccugggaggucaccggcgagugcaacguccuccucaagugcaaggucgccaacaucaagaaggagacccacaucgucugguacaaggacgagcgcgagaucuccgucgacgagaagcacgacuucaaggacggcaucugcacccuccucaucaccgaguucuccaagaaggacgccggcaucuacgaggucauccucaaggacgaccgcggcaaggacaagucccgccucaagcucgucgacgaggccuucaaggagcucaugauggaggucugcaagaagaucgcccucuccgccaccgaccucaagauccaguccaccgccgagggcauccagcucuacuccuucgucaccuacuacgucgaggaccucaaggucaacuggucccacaacggcuccgccauccgcuacuccgaccgcgucaagaccggcgucaccggcgagcagaucuggcuccagaucaacgagcccacccccaacgacaagggcaaguacgucauggagcucuucgacggcaagaccggccaccagaagaccgucgaccucuccggccaggccuacgacgaggccuacgccgaguuccagcgccucaagcaggccgccaucgccgagaagaaccgcgcccgcguccucggcggccuccccgacgucgucaccauccaggagggcaaggcccucaaccucaccugcaacgucuggggcgaccccccccccgaggucuccuggcucaagaacgagaaggcccucgccuccgacgaccacugcaaccucaaguucgaggccggccgcaccgccuacuucaccaucaacggcgucuccaccgccgacuccggcaaguacggccucgucgucaagaacaaguacggcuccgagaccuccgacuucaccgucuccgucuucauccccgaggaggaggcccgcauggccgcccucgagucccucaagggcggcaagaaggccaaguga

SEQ ID NO: 46378 - RNA, 4398 nt, Artificial Sequence
  derived and/or modified sequence opt2 from MYOM2__Homo_sapiens__NP_003961
augucccucgucaccguccccuucuaccagaagcgccaccgccacuucgaccaguccuaccgcaacauccagacccgcuaccuccucgacgaguacgccuccaagaagcgcgccuccacccaggccuccucccagaagucccucucccagcgcuccuccucccagcgcgccuccucccagaccucccucggcggcaccaucugccgcgucugcgccaagcgcgucuccacccaggaggacgaggagcaggagaaccgcucccgcuaccagucccucgucgccgccuacggcgaggccaagcgccagcgcuuccucuccgagcucgcccaccucgaggaggacguccaccucgcccgcucccaggcccgcgacaagcucgacaaguacgccauccagcagaugauggaggacaagcucgccugggagcgccacaccuucgaggagcgcaucucccgcgcccccgagauccucguccgccuccgcucccacaccgucugggagcgcauguccgucaagcucugcuucaccguccagggcuuccccacccccgucguccagugguacaaggacggcucccucaucugccaggccgccgagcccggcaaguaccgcaucgaguccaacuacggcguccacacccucgagaucaaccgcgccgacuucgacgacaccgccaccuacuccgccgucgccaccaacgcccacggccaggucuccaccaacgccgccgucgucguccgccgcuuccgcggcgacgaggagcccuuccgcuccgucggccuccccaucggccucccccucuccuccaugauccccuacacccacuucgacguccaguuccucgagaaguucggcgucaccuuccgccgcgagggcgagaccgucacccucaagugcaccaugcucgucacccccgaccucaagcgcguccagccccgcgccgagugguaccgcgacgacguccuccucaaggaguccaaguggaccaagauguucuucggcgagggccaggccucccucuccuucucccaccuccacaaggacgacgagggccucuacacccuccgcaucgucucccgcggcggcgucuccgaccacuccgccuuccucuucguccgcgacgccgacccccucgucaccggcgcccccggcgcccccauggaccuccagugccacgacgccaaccgcgacuacgucaucgucaccuggaagccccccaacaccaccaccgagucccccgucaugggcuacuucgucgaccgcugcgaggucggcaccaacaacuggguccagugcaacgacgcccccgucaagaucugcaaguaccccgucaccggccucuucgagggccgcuccuacaucuuccgcguccgcgccgucaacuccgccggcaucucccgccccucccgcgucuccgacgccgucgccgcccucgacccccucgaccuccgccgccuccaggccguccaccucgagggcgagaaggagaucgccaucuaccaggacgaccucgagggcgacgcccagguccccggcccccccaccggcguccacgccuccgagaucucccgcaacuacgucguccucuccugggagccccccaccccccgcggcaaggacccccucauguacuucaucgagaaguccgucgucggcuccggcuccuggcagcgcgucaacgcccagaccgccguccgcuccccccgcuacgccgucuucgaccucauggagggcaaguccuacgucuuccgcguccucuccgccaaccgccacggccucuccgagcccuccgagaucaccucccccauccaggcccaggacgucaccgucguccccuccgcccccggccgcguccucgccucccgcaacaccaagaccuccgucgucguccagugggaccgccccaagcacgaggaggaccuccucggcuacuacgucgacugcugcgucgccggcaccaaccucugggagcccugcaaccacaagcccaucggcuacaaccgcuucgucguccacggccucaccaccggcgagcaguacaucuuccgcgucaaggccgucaacgccgucggcauguccgagaacucccaggaguccgacgucaucaagguccaggccgcccucaccguccccucccaccccuacggcaucacccuccucaacugcgacggccacuccaugacccucggcuggaagguccccaaguucuccggcggcucccccauccucggcuacuaccucgacaagcgcgagguccaccacaagaacuggcacgaggucaacuccucccccuccaagcccaccauccucaccgucgacggccucaccgagggcucccucuacgaguucaagaucgccgccgucaaccucgccggcaucggcgagcccuccgaccccuccgagcacuucaagugcgaggccuggaccaugcccgagcccggccccgccuacgaccucaccuucugcgagguccgcgacaccucccucgucaugcucuggaaggcccccgucuacuccggcuccucccccgucuccggcuacuucgucgacuuccgcgaggaggacgccggcgaguggaucaccgucaaccagaccaccaccgccucccgcuaccucaaggucuccgaccuccagcagggcaagaccuacgucuuccgcguccgcgccgucaacgccaacggcgucggcaagcccuccgacaccuccgagcccguccucgucgaggcccgccccggcaccaaggagaucuccgccggcgucgacgagcagggcaacaucuaccucggcuucgacugccaggagaugaccgacgccucccaguucaccuggugcaaguccuacgaggagaucuccgacgacgagcgcuucaagaucgagaccgucggcgaccacuccaagcucuaccucaagaaccccgacaaggaggaccucggcaccuacuccgucuccgucuccgacaccgacggcgucuccuccuccuucguccucgaccccgaggagcucgagcgccucauggcccucuccaacgagaucaagaaccccaccaucccccucaaguccgagcucgccuacgagaucuucgacaagggccgcguccgcuucuggcuccaggccgagcaccucucccccgacgccuccuaccgcuucaucaucaacgaccgcgaggucuccgacuccgagauccaccgcaucaagugcgacaaggccaccggcaucaucgagauggucauggaccgcuucuccaucgagaacgagggcaccuacaccguccagauccacgacggcaaggccaagucccaguccucccucguccucaucggcgacgccuucaagaccguccucgaggaggccgaguuccagcgcaaggaguuccuccgcaagcagggcccccacuucgccgaguaccuccacugggacgucaccgaggagugcgagguccgccucgucugcaaggucgccaacaccaagaaggagaccgucuucaaguggcucaaggacgacguccucuacgagaccgagacccuccccaaccucgagcgcggcaucugcgagcuccucauccccaagcucuccaagaaggaccacggcgaguacaaggccacccucaaggacgaccgcggccaggacgucuccauccucgagaucgccggcaaggucuacgacgacaugauccucgccaugucccgcgucugcggcaaguccgccuccccccucaagguccucugcacccccgagggcauccgccuccagugcuucaugaaguacuucaccgacgagaugaaggucaacuggugccacaaggacgccaagaucuccuccuccgagcacaugcgcaucggcggcuccgaggagauggccuggcuccagaucugcgagcccaccgagaaggacaagggcaaguacaccuucgagaucuucgacggcaaggacaaccaccagcgcucccucgaccucuccggccaggccuucgacgaggccuucgccgaguuccagcaguucaaggccgccgccuucgccgagaagaaccgcggccgccucaucggcggccuccccgacgucgucaccaucauggagggcaagacccucaaccucaccugcaccgucuucggcaaccccgaccccgaggucaucugguucaagaacgaccaggacauccagcucuccgagcacuucuccgucaaggucgagcaggccaaguacgucuccaugaccaucaagggcgucaccuccgaggacuccggcaaguacuccaucaacaucaagaacaaguacggcggcgagaagaucgacgucaccgucuccgucuacaagcacggcgagaagauccccgacauggcccccccccagcaggccaagcccaagcucauccccgccuccgccuccgccgccggccaguga

SEQ ID NO: 46379 - RNA, 945 nt, Artificial Sequence
  derived and/or modified sequence opt2 from MYOT__Homo_sapiens__NP_001129412
auggcccgccgccuccucggcccccagaacgccgccgccgucuuccaggcccaggacgacuccggcgcccaggacucccagcagcacaacuccgagcacgcccgccuccagguccccaccucccagguccgcucccgcuccaccucccgcggcgacgucaacgaccaggacgccauccaggagaaguucuaccccccccgcuucauccagguccccgagaacauguccaucgacgagggccgcuucugccgcauggacuucaaggucuccggccuccccgcccccgacgucuccugguaccucaacggccgcaccguccaguccgacgaccuccacaagaugaucgucuccgagaagggccuccacucccucaucuucgaggucguccgcgccuccgacgccggcgccuacgccugcgucgccaagaaccgcgccggcgaggccaccuucaccguccagcucgacguccucgccaaggagcacaagcgcgcccccauguucaucuacaagccccaguccaagaagguccucgagggcgacuccgucaagcucgagugccagaucuccgccauccccccccccaagcucuucuggaagcgcaacaacgagaugguccaguucaacaccgaccgcaucucccucuaccaggacaacaccggccgcgucacccuccucaucaaggacgucaacaagaaggacgccggcugguacaccgucuccgccgucaacgaggccggcgucaccaccugcaacacccgccucgacgucaccgcccgccccaaccagacccuccccgcccccaagcagcuccgcguccgccccaccuucuccaaguaccucgcccucaacggcaagggccucaacgucaagcaggccuucaaccccgagggcgaguuccagcgccucgccgcccaguccggccucuacgaguccgaggagcucuga

SEQ ID NO: 46380 - RNA, 900 nt, Artificial Sequence
  derived and/or modified sequence opt2 from MYOZ1__Homo_sapiens__NP_067068
augccccucuccggcacccccgcccccaacaagaagcgcaaguccuccaagcucaucauggagcucaccggcggcggccaggaguccuccggccucaaccucggcaagaagaucuccgucccccgcgacgucaugcucgaggagcucucccuccucaccaaccgcggcuccaagauguucaagcuccgccagaugcgcgucgagaaguucaucuacgagaaccaccccgacgucuucuccgacuccuccauggaccacuuccagaaguuccuccccaccgucggcggccagcucggcaccgccggccagggcuucuccuacuccaaguccaacggccgcggcggcucccaggccggcggcuccggcuccgccggccaguacggcuccgaccagcagcaccaccucggcuccggcuccggcgccggcggcaccggcggccccgccggccaggccggccgcggcggcgccgccggcaccgccggcgucggcgagaccggcuccggcgaccaggccggcggcgagggcaagcacaucaccgucuucaagaccuacaucucccccugggagcgcgccaugggcgucgacccccagcagaagauggagcucggcaucgaccuccucgccuacggcgccaaggccgagcuccccaaguacaaguccuucaaccgcaccgccaugcccuacggcggcuacgagaaggccuccaagcgcaugaccuuccagaugcccaaguucgaccucggcccccuccucuccgagccccucguccucuacaaccagaaccucuccaaccgccccuccuucaaccgcacccccauccccuggcucuccuccggcgagcccgucgacuacaacgucgacaucggcaucccccucgacggcgagaccgaggagcucuga

SEQ ID NO: 46381 - RNA, 795 nt, Artificial Sequence
  derived and/or modified sequence opt2 from MYOZ2__Homo_sapiens__NP_057683
augcucucccacaacaccaugaugaagcagcgcaagcagcaggccaccgccaucaugaaggagguccacggcaacgacgucgacggcauggaccucggcaagaaggucuccaucccccgcgacaucaugcucgaggagcucucccaccucuccaaccgcggcgcccgccucuucaagaugcgccagcgccgcuccgacaaguacaccuucgagaacuuccaguaccagucccgcgcccagaucaaccacuccaucgccaugcagaacggcaaggucgacggcuccaaccucgagggcggcucccagcaggccccccucaccccccccaacacccccgacccccgcuccccccccaaccccgacaacaucgcccccggcuacuccggcccccucaaggagaucccccccgagaaguucaacaccaccgccguccccaaguacuaccagucccccugggagcaggccaucuccaacgaccccgagcuccucgaggcccucuaccccaagcucuucaagcccgagggcaaggccgagcuccccgacuaccgcuccuucaaccgcgucgccacccccuucggcggcuucgagaaggccucccgcauggucaaguucaagguccccgacuucgagcuccuccuccucaccgacccccgcuucauguccuucgucaacccccucuccggccgccgcuccuucaaccgcacccccaagggcuggaucuccgagaacauccccaucgucaucaccaccgagcccaccgacgacaccaccguccccgaguccgaggaccucuga

SEQ ID NO: 46382 - RNA, 756 nt, Artificial Sequence
  derived and/or modified sequence opt2 from MYOZ3__Homo_sapiens__XP_011536006
augauccccaaggagcagaagggccccgucauggccgccaugggcgaccucaccgagcccguccccacccucgaccucggcaagaagcucuccgucccccaggaccucaugauggaggagcucucccuccgcaacaaccgcggcucccuccucuuccagaagcgccagcgccgcguccagaaguucaccuucgagcucgccgccucccagcgcgccaugcucgccggcuccgcccgccgcaaggucaccggcaccgccgaguccggcaccgucgccaacgccaacggccccgagggccccaacuaccgcuccgagcuccacaucuuccccgccucccccggcgccucccucggcggccccgagggcgcccaccccgccgccgcccccgccggcugcguccccucccccuccgcccucgcccccggcuacgccgagccccucaagggcgucccccccgagaaguucaaccacaccgccaucuccaagggcuaccgcugccccuggcaggaguucgucuccuaccgcgacuaccaguccgacggccgcucccacacccccucccccaacgacuaccgcaacuucaacaagacccccguccccuucggcggcccccucgucggcggcaccuucccccgccccggcacccccuucauccccgagccccucuccggccucgagcuccuccgccuccgccccuccuucaaccgcgucgcccagggcuggguccgcaaccuccccgaguccgaggagcucuga

SEQ ID NO: 46383 - RNA, 3963 nt, Artificial Sequence
  derived and/or modified sequence opt2 from MYPN__Homo_sapiens__NP_001243196
augcaggacgacuccaucgaggccuccaccuccaucucccagcuccuccgcgaguccuaccucgccgagacccgccaccgcggcaacaacgagcgcucccgcgccgagcccuccuccaaccccugccacuucggcucccccuccggcgccgccgagggcggcggcggccaggacgaccuccccgaccucuccgccuuccucucccaggaggagcucgacgaguccgucaaccucgcccgccucgccaucaacuacgacccccucgagaaggccgacgagacccaggcccgcaagcgccucucccccgaccagaugaagcacucccccaaccucuccuucgagcccaacuucugccaggacaacccccgcucccccaccuccuccaaggaguccccccaggaggccaagcgcccccaguacugcuccgagacccaguccaagaaggucuuccucaacaaggccgccgacuucaucgaggagcucuccucccucuucaagucccacuccuccaagcgcauccgcccccgcgccugcaagaaccacaaguccaagcucgagucccagaacaaggucaugcaggagaacuccuccuccuucuccgaccucuccgagcgccgcgagcgcuccuccguccccauccccauccccgccgacacccgcgacaacgaggucaaccacgcccucgagcagcaggaggccaagcgccgcgaggccgagcaggccgccuccgaggccgccggcggcgacaccacccccggcuccucccccuccucccucuacuacgaggagccccucggccagcccccccgcuucacccagaagcuccgcucccgcgagguccccgagggcacccgcguccagcucgacugcaucgucgucggcaucccccccccccagguccgcugguacugcgagggcaaggagcucgagaacucccccgacauccacaucguccaggccggcaaccuccacucccucaccaucgccgaggccuucgaggaggacaccggccgcuacuccugcuucgccuccaacaucuacggcaccgacuccaccuccgccgagaucuacaucgagggcgucuccuccuccgacuccgagggcgaccccaacaaggaggagaugaaccgcauccagaagcccaacgaggucuccuccccccccaccaccuccgccgucaucccccccgccgucccccaggcccagcaccucgucgcccagccccgcgucgccaccauccagcagugccagucccccaccaacuaccuccagggccucgacggcaagcccaucaucgccgcccccgucuucaccaagaugcuccagaaccucuccgccuccgagggccagcucgucgucuucgagugccgcgucaagggcgcccccucccccaaggucgagugguaccgcgagggcacccucaucgaggacucccccgacuuccgcauccuccagaagaagccccgcuccauggccgagcccgaggagaucugcacccucgucaucgccgaggucuucgccgaggacuccggcugcuucaccugcaccgccuccaacaaguacggcaccgucuccuccaucgcccagcuccacguccgcggcaacgaggaccucuccaacaacggcucccuccacuccgccaacuccaccaccaaccucgccgccaucgagccccagcccucccccccccacuccgagccccccuccgucgagcagccccccaagcccaagcucgagggcguccucgucaaccacaacgagccccgcuccuccucccgcaucggccuccgcguccacuucaaccuccccgaggacgacaagggcuccgaggccuccuccgaggccggcgucgucaccacccgccagacccgccccgacuccuuccaggagcgcuucaacggccaggccaccaagacccccgagcccuccucccccgucaaggagcccccccccguccucgccaagcccaagcucgacuccacccagcuccagcagcuccacaaccagguccuccucgagcagcaccagcuccagaaccccccccccuccucccccaaggaguuccccuucuccaugaccguccucaacuccaacgccccccccgccgucaccaccuccuccaagcaggucaaggcccccuccucccagaccuucucccucgcccgccccaaguacuucuuccccuccaccaacaccaccgccgccaccgucgcccccuccuccucccccgucuucacccucuccuccaccccccagaccauccagcgcaccgucuccaaggagucccuccucgucucccaccccuccguccagaccaagucccccggcggccucuccauccagaacgagccccucccccccggccccaccgagcccacccccccccccuucaccuucuccauccccuccggcaaccaguuccagccccgcugcgucucccccauccccgucucccccaccucccgcauccagaaccccgucgccuuccucuccuccguccuccccucccuccccgccaucccccccaccaacgccaugggccucccccgcuccgcccccuccaugcccucccagggccucgccaagaagaacaccaaguccccccagcccgucaacgacgacaacauccgcgagaccaagaacgccgucauccgcgaccucggcaagaagaucaccuucuccgacguccgccccaaccagcaggaguacaagaucuccuccuucgagcagcgccucaugaacgagaucgaguuccgccucgagcgcacccccgucgacgaguccgacgacgagauccagcacgacgagauccccaccggcaagugcaucgcccccaucuucgacaagcgccucaagcacuuccgcgucaccgagggcucccccgucaccuucaccugcaagaucgucggcauccccguccccaaggucuacugguucaaggacggcaagcagaucuccaagcgcaacgagcacugcaagaugcgccgcgagggcgacggcaccugcucccuccacaucgaguccaccaccuccgacgacgacggcaacuacaccaucauggccgccaacccccagggccgcaucuccugcuccggccaccucaugguccagucccuccccauccgcucccgccucaccuccgccggccagucccaccgcggccgcucccgcguccaggagcgcgacaaggagccccuccaggagcgcuucuuccgcccccacuuccuccaggcccccggcgacauggucgcccacgagggccgccucugccgccucgacugcaaggucuccggccuccccccccccgagcucaccuggcuccucaacggccagcccguccuccccgacgccucccacaagaugcucguccgcgagaccggcguccacucccuccucaucgacccccucacccagcgcgacgccggcaccuacaagugcaucgccaccaacaagaccggccagaacuccuucucccucgagcucuccgucgucgccaaggaggucaagaaggcccccgucauccucgagaagcuccagaacugcggcguccccgagggccaccccguccgccucgagugccgcgucaucggcaugcccccccccgucuucuacuggaagaaggacaacgagaccauccccugcacccgcgagcgcaucuccaugcaccaggacaccaccggcuacgccugccuccucauccagcccgccaagaaguccgacgccggcugguacacccucuccgccaagaacgaggccggcaucgucuccugcaccgcccgccucgacaucuacgcccaguggcaccaccagauccccccccccauguccguccgccccuccggcucccgcuacggcucccucaccuccaagggccucgacaucuucuccgccuucuccuccauggaguccaccauggucuacuccugcuccucccgcuccgucgucgaguccgacgagcucuga

SEQ ID NO: 46384 - RNA, 3456 nt, Artificial Sequence
  derived and/or modified sequence opt2 from MYRF__Homo_sapiens__NP_001120864
auggaggucgucgacgagaccgaggcccuccagcgcuucuucgagggccacgacaucaacggcgcccucgagcccuccaacaucgacaccuccauccucgaggaguacaucuccaaggaggacgccuccgaccucugcuuccccgacaucuccgcccccgccuccuccgccuccuacucccacggccagcccgccaugcccggcuccuccggcguccaccaccucuccccccccggcggcggccccucccccggccgccacggcccccuccccccccccggcuacggcaccccccucaacugcaacaacaacaacggcaugggcgccgcccccaagcccuuccccggcggcaccggcccccccaucaaggccgagcccaaggcccccuacgcccccggcacccuccccgacuccccccccgacuccggcuccgaggccuacuccccccagcaggucaacgagccccaccuccuccgcaccaucacccccgagacccucugccacgucggcguccccucccgccucgagcaccccccccccccccccgcccaccuccccggcccccccccccccccccccccccccccccacuaccccguccuccagcgcgaccucuacaugaaggccgagccccccaucccccacuacgccgccaugggccagggccucguccccaccgaccuccaccacacccagcagucccagaugcuccaccagcuccuccagcagcacggcgccgagcuccccacccaccccuccaagaagcgcaagcacuccgaguccccccccuccacccucaacgcccagaugcucaacggcaugaucaagcaggagcccggcaccgucaccgcccucccccuccaccccacccgcgcccccuccccccccuggcccccccagggcccccucucccccggccccggcucccucccccucuccaucgcccgcguccagaccccccccuggcacccccccggcgcccccucccccggccuccuccaggacuccgacucccucuccggcuccuaccucgaccccaacuaccaguccaucaaguggcagccccaccagcagaacaagugggccacccucuacgacgccaacuacaaggagcuccccaugcucaccuaccgcgucgacgccgacaagggcuucaacuucuccgucggcgacgacgccuucgucugccagaagaagaaccacuuccaggucaccgucuacaucggcaugcucggcgagcccaaguacgucaagacccccgagggccucaagccccucgacugcuucuaccucaagcuccacggcgucaagcucgaggcccucaaccaguccaucaacaucgagcagucccaguccgaccgcuccaagcgccccuucaaccccgucaccgucaaccucccccccgagcaggucaccaaggucaccgucggccgccuccacuucuccgagaccaccgccaacaacaugcgcaagaagggcaagcccaaccccgaccagcgcuacuucaugcucgucgucgcccuccaggcccacgcccagaaccagaacuacacccucgccgcccagaucuccgagcgcaucaucguccgcgccuccaaccccggccaguucgaguccgacuccgacguccucuggcagcgcgcccagguccccgacaccgucuuccaccacggccgcgucggcaucaacaccgaccgccccgacgaggcccucgucguccacggcaacgucaaggucaugggcucccucaugcaccccuccgaccuccgcgccaaggagcacguccaggaggucgacaccaccgagcagcucaagcgcaucucccgcaugcgccucguccacuaccgcuacaagcccgaguucgccgccuccgccggcaucgaggccaccgcccccgagaccggcgucaucgcccaggaggucaaggagauccuccccgaggccgucaaggacaccggcgacauggucuucgccaacggcaagaccaucgagaacuuccucgucgucaacaaggagcgcaucuucauggagaacgucggcgccgucaaggagcucugcaagcucaccgacaaccucgagacccgcaucgacgagcucgagcgcuggucccacaagcucgccaagcuccgccgccucgacucccucaaguccaccggcuccuccggcgccuucucccacgccggcucccaguucucccgcgccggcuccgucccccacaagaagcgcccccccaaggucgccuccaaguccuccuccgucguccccgaccaggccugcaucucccagcgcuuccuccagggcaccaucaucgcccucgucgucgucauggccuucuccgucgucuccauguccacccucuacguccucucccuccgcaccgaggaggaccucgucgacaccgacggcuccuucgccgucuccaccuccugccuccucgcccuccuccgcccccagccccccggcggcuccgaggcccucugccccugguccucccaguccuucggcaccacccagcuccgccaguccccccucaccaccggccuccccggcauccagcccucccuccuccucgucaccaccucccucaccuccuccgcccccggcuccgccguccgcacccucgacaugugcuccucccaccccugccccgucaucugcugcuccucccccaccaccaaccccaccaccggccccucccucggccccuccuucaaccccggccacguccucucccccucccccucccccuccaccaaccgcuccggccccucccagauggcccuccuccccgucaccaacauccgcgccaaguccuggggccucuccgucaacggcaucggccacuccaagcaccacaagucccucgagccccucgccucccccgccguccccuuccccggcggccagggcaaggccaagaacucccccucccucggcuuccacggccgcgcccgccgcggcgcccuccaguccuccgucggccccgccgagcccaccugggcccagggccaguccgccucccuccucgccgagcccguccccucccucaccuccauccagguccucgagaacuccauguccaucaccucccaguacugcgcccccggcgacgccugccgccccggcaacuucaccuaccacauccccgucuccuccggcaccccccuccaccucucccucacccuccagaugaacuccuccucccccgucuccgucguccucugcucccuccgcuccaaggaggagcccugcgaggagggcucccucccccagucccuccacacccaccaggacacccagggcaccucccaccgcuggcccaucaccauccucuccuuccgcgaguucaccuaccacuuccgcgucgcccuccucggccaggccaacugcuccuccgaggcccucgcccagcccgccaccgacuaccacuuccacuucuaccgccucugcgacuga

SEQ ID NO: 46385 - RNA, 2208 nt, Artificial Sequence
  derived and/or modified sequence opt2 from MYRFL__Homo_sapiens__XP_011537358
augaacuucaccgccaccacccagaccgagaugaccucccgcucccgcuccuccgagguccaggaccccgacuccgagggccagaaccgcaugcccaccgaccagugcucccccgcccucaaguggcagcccugccacuccguccccuggcacucccuccucaacucccacuacgagaagcuccccgacgucggcuaccgcgucgucaccgacaagggcuucaacuucucccccgccgacgaggccuucgucugccagaagaagaaccacuuccagaucaccauccacauccaggucuggggcucccccaaguucgucgagaccgagaugggccucaagcccaucgagauguucuaccucaaggucuucggcaccaaggucgaggccaccaaccagaucaucgccaucgagcagucccaggccgaccgcuccaagaagaucuucaaccccgucaagaucgaccuccucgccgaccaggucaccaaggucacccucggccgccuccacuucuccgagaccaccgccaacaacaugcgcaagaagggcaagcccaaccccgaccagcgcuacuucaugcucgucgucggccucuacgccgccaaccaggaccaguucuaccuccucuccgcccacaucuccgagcgcaucaucguccgcgccuccaaccccggccaguucgagaacgacuccgacgcccucuggcagcgcggccagguccccgaguccaucgucugccacggccgcgucggcaucaacaccgacgcccccgacgaggcccucgucgucugcggcaacaugaaggucaugggcaccaucaugcaccccuccgacucccgcgccaagcagaacauccaggaggucgacaccaacgagcagcucaagcgcaucgcccagaugcgcaucgucgaguacgacuacaagcccgaguucgccuccgccaugggcaucaacaccgcccaccagaccggcaugaucgcccaggagguccaggagauccucccccgcgccguccgcgaggucggcgacgucaccugcggcaacggcgagacccucgagaacuuccucauggucgacaaggaccagaucuucauggagaacgucggcgccgucaagcagcucugcaagcucaccaacaaccucgaggagcgcaucgaggagcucgagaucuggaaccgcaagcucgcccgccucaagcgccucuccuccuggaaguccuccgccuccgaggccuccaccaucuccaaguccucccgcgccgucuccgccuccuccccccgccgcgccguccacaagaagaacaacaaggucuacuucuccggcaagcgccaggccugccccaacugggucuuccagacccucgucaucacccucaucgccgucauggccuucugcgcccucaccaucgucgcccucuacauccucucccucaaggaccaggaccgccgcguccccaaccucccccccuccaacaucaccuccucccaggagcccgcccuccuccccaccgccuccuccuccgcccccaacaccucccucgucaccacccccgccucccuccagguccccgagaucaccuucugcgagauccuccccugccaggagaccuacugcugccccauccgcggcaugaaggaggucuccuccucccccguccagcgccaguccgaggagaaggaguuccaccagcgccgcugguccgaggacaaguccaaguccguccucgcccgcaacgcccucuccggccccgacugggaguccgacuggaucgacaccaccaucuccuccauccagaucauggagauccagcagaucaucgaccaccaguacugcauccagucccuccagugcggcuccggcaacuacaacuacaacauccccgucaacaagcacacccccaccaacgucaaguucucccucgagaucaacaccaccgagccccucaucgucuuccagugcaaguucacccucggcaacaucugcuuccacuccaagcgcggcaccaagggccucgagucccaccgcgagaucucccaggagaugacccagggcuaccagcacaucuggucccuccccgucgcccccuucuccgacuccauguuccacuuccgcgucgccgcccccgaccucgccgacugcuccaccgaccccuacuucgccggcaucuucuucaccgacuacuucuucuacuucuaccgccgcugcgccuga

SEQ ID NO: 46386 - RNA, 2580 nt, Artificial Sequence
  derived and/or modified sequence opt2 from MYRIP__Homo_sapiens__NP_001271352
augggccgcaagcucgaccucuccggccucaccgacgacgagaccgagcacguccuccaggucguccagcgcgacuucaaccuccgcaagaaggaggaggagcgccucuccgagcucaagcagaagcucgacgaggagggcuccaagugcuccauccucuccaagcaccagcaguucgucgagcacugcugcaugcgcugcugcucccccuucaccuuccucgucaacaccaagcgccagugcggcgacugcaaguucaacgucugcaaguccugcugcuccuaccagaagcacgagaaggccugggucugcugcgucugccagcaggcccgccuccuccgcgcccagucccucgagugguucuacaacaacgucaagucccgcuucaagcgcuucggcuccgccaagguccucaagaaccucuaccgcaagcaccgccucgaguccggcgccugcuucgacauccucggcggcucccucuucgaguccaaccucgagaacgagggcuccaucuccggcuccgacuccaccuucuaccgccaguccgagggccacuccgucauggacacccucgccgucgcccuccgcgucgccgaggaggccaucgaggaggccaucuccaaggccgaggccuacggcgacucccucgacaagcagaacgaggccuccuaccuccgcgaccacaaggaggagcucaccgaggagcucgccaccaccauccuccagaagaucauccgcaagcagaaguccaaguccgagcagcaggucgaggaggagcccggcuggccccacccccaguccugcuccaccaaggucgccgacgagggcaccuccgccucccccggcggcuaccgcgcccccgccgcccucuggcgcucccaguccgccuucuccaucaccggcgaggaggcccucaagaccccccccgucgaggcccccucccgccagccccgcgaccagggccagcacccccgcgccgaguccgcccuccccuccuggaaguccgucgaccgccucgacgagaccaaccucgcccccguccuccagucccccgacggcaacugggucgcccucaaggacggcgcccccccccccacccgccuccucgccaagcccaaguccggcaccuuccaggcccucgaggucgccuccuccgucgccuccgccuacgacgagaugggcuccgacuccgaggaggacuucgacugguccgaggcccucuccaagcucugcccccgcucccgcgcccucccccgcaacccccagccccagcccacccaggcccaguccuccgaccagggccccaucgccgccucccccuccuccgcccucucccccaaccccgaggccaugugcuccgacuccgagaccuccuccgccggcuccucccgcgaggucggccaccaggcccgccucuccuggcuccagcgcaaggccccccgcaaccccgccgccgagaagaugcgccuccacggcgagcucgacgucaacuucaacccccagcucgccucccgcgagaccuccgacuccuccgagcccgaggaggccccccacaccaccgaccgccgcgcccgccgcuggcgccgcgcccgccucggcuccgaggagcccuccaaggagcccuccucccccuccgcccagcuccgcgaccucgacacccaccaggucuccgacgaccucuccgagaccgacaucuccaacgaggcccgcgacccccagacccucaccgacaccaccgaggagaagcgccgcaaccgccucuacgagcucgccaugaagauguccgagaaggagaccuccuccggcgaggaccaggaguccgagcccaagaccgaguccgagaaccagaaggagucccucuccuccgaggacaacucccaguccguccaggaggagcucaagaagaaguucuccgccgucucccucugcaacaucuccaccgagguccucaaggucaucaacgccaccgaggagcucaucgccggcuccaccggccccugggaguccccccaggucccccccgaccgccagaagggcauguucccccgcggcaccgaccagguccgccucgacgagcagcucaccucccucgaggagaacgucuaccucgccgccggcaccgucuacggccucgagacccagcucaccgagcucgaggacgccgcccgcugcauccacuccggcaccgacgagacccaccucgccgaccucgaggaccaggucgccaccgccgccgcccagguccaccacgccgagcuccagaucuccgacaucgagucccgcaucuccgcccucaccaucgccggccucaacaucgcccccugcguccgcuucacccgccgccgcgaccagaagcagcgcacccagguccagaccaucgacaccucccgccagcagcgccgcaagcuccccgccccccccgucaaggccgagaagaucgagaccuccuccgucaccaccaucaagaccuucaaccacaacuucauccuccagggcuccuccaccaaccgcaccaaggagcgcaagggcaccaccaaggaccucauggagcccgcccucgaguccgccgucauguacuga

SEQ ID NO: 46387 - RNA, 3366 nt, Artificial Sequence
  derived and/or modified sequence opt2 from MYT1__Homo_sapiens__NP_004526
augucccucgagaacgaggacaagcgcgcccgcacccgcuccaaggcccuccgcggcccccccgagaccaccgccgccgaccucuccugccccacccccggcugcaccggcuccggccacguccgcggcaaguacucccgccaccgcucccuccaguccugcccccucgccaagaagcgcaagcucgagggcgccgaggccgagcaccucgucuccaagcgcaagucccacccccucaagcucgcccucgacgagggcuacggcgucgacuccgacggcuccgaggacaccgaggucaaggacgccuccgucuccgacgaguccgagggcacccucgagggcgccgaggccgagaccuccggccaggacgagauccaccgccccgagaccgccgagggccgcucccccgucaagucccacuucggcuccaaccccaucggcuccgccaccgccuccuccaagggcuccuacuccuccuaccagggcaucaucgccaccucccuccucaaccucggccagaucgccgaggagacccucgucgaggaggaccucggccaggccgccaagcccggccccggcaucguccaccuccuccaggaggccgccgagggcgccgccuccgaggagggcgagaagggccucuucauccagcccgaggacgccgaggaggucgucgaggucaccaccgagcgcucccaggaccucugcccccagucccucgaggacgccgccuccgaggaguccuccaagcagaagggcauccucucccacgaggaggaggacgaggaggaggaggaggaggaggaggaggaggaggaggacgaggaggaggaggaggaggaggaggaggaggaggaggaggaggaggaggaggaggaggaggaggaggaggaggaggaggaggaggaggaggaggaggccgcccccgacgucaucuuccaggaggacaccucccacaccuccgcccagaaggcccccgagcuccgcggccccgagucccccucccccaagcccgaguacuccgucaucgucgagguccgcuccgacgacgacaaggacgaggacacccacucccgcaaguccaccgucaccgacgaguccgagaugcaggacaugaugacccgcggcaaccucggccuccucgagcaggccaucgcccucaaggccgagcagguccgcaccgucugcgagcccggcugcccccccgccgagcagucccagcucggccucggcgagcccggcaaggccgccaagccccucgacaccguccgcaaguccuacuacuccaaggaccccucccgcgccgagaagcgcgagaucaagugccccacccccggcugcgacggcaccggccacgucaccggccucuacccccaccaccgcucccucuccggcugcccccacaaggaccgcaucccccccgagauccucgccaugcacgagaacguccucaagugccccacccccggcugcaccggccagggccacgucaacuccaaccgcaacacccaccgcucccucuccggcugccccaucgccgccgccgagaagcucgccaagucccacgagaagcagcagccccagaccggcgaccccuccaaguccuccuccaacuccgaccgcauccuccgccccaugugcuucgucaagcagcucgaggucccccccuacggcuccuaccgccccaacgucgcccccgccaccccccgcgccaaccucgccaaggagcucgagaaguucuccaaggucaccuucgacuacgccuccuucgacgcccaggucuucggcaagcgcaugcucgcccccaagauccagaccuccgagaccucccccaaggccuuccagugcuucgacuacucccaggacgccgaggccgcccacauggccgccaccgccauccucaaccucuccacccgcugcugggagaugcccgagaaccucuccaccaagccccaggaccuccccuccaaguccgucgacaucgaggucgacgagaacggcacccucgaccucuccaugcacaagcaccgcaagcgcgagaacgccuuccccuccuccuccuccugcuccuccucccccggcgucaagucccccgacgccucccagcgccacuccuccaccuccgcccccuccuccuccaugaccuccccccaguccucccaggccucccgccaggacgagugggaccgcccccucgacuacaccaagcccucccgccuccgcgaggaggagcccgaggaguccgagcccgccgcccacuccuucgccuccuccgaggccgacgaccaggaggucuccgaggagaacuucgaggagcgcaaguaccccggcgaggucacccucaccaacuucaagcucaaguuccucuccaaggacaucaagaaggagcuccucaccugccccacccccggcugcgacggcuccggccacaucaccggcaacuacgccucccaccgcucccucuccggcugcccccucgccgacaagucccuccgcaaccucauggccgcccacuccgccgaccucaagugccccacccccggcugcgacggcuccggccacaucaccggcaacuacgccucccaccgcucccucuccggcugcccccgcgccaagaaguccggcgucaaggucgcccccaccaaggacgacaaggaggaccccgagcucaugaagugccccguccccggcugcgucggccucggccacaucuccggcaaguacgccucccaccgcuccgccuccggcugcccccucgccgcccgccgccagaaggagggcucccucaacggcuccuccuucuccuggaagucccucaagaacgagggccccaccugccccacccccggcugcgacggcuccggccacgccaacggcuccuuccucacccaccgcucccucuccggcugcccccgcgccaccuucgccggcaagaagggcaagcucuccggcgacgagguccucucccccaaguucaagaccuccgacguccucgagaacgacgaggagaucaagcagcucaaccaggagauccgcgaccucaacgaguccaacuccgagauggaggccgccaugguccagcuccagucccagaucuccuccauggagaagaaccucaagaacaucgaggaggagaacaagcucaucgaggagcagaacgaggcccucuuccucgagcucuccggccucucccaggcccucauccagucccucgccaacauccgccucccccacauggagcccaucugcgagcagaacuucgacgccuacgucuccacccucaccgacauguacuccaaccaggaccccgagaacaaggaccuccucgaguccaucaagcaggccguccgcggcauccaggucuga

SEQ ID NO: 46388 - RNA, 3561 nt, Artificial Sequence
  derived and/or modified sequence opt2 from MYT1L__Homo_sapiens__NP_001289981
auggaggucgacaccgaggagaagcgccaccgcacccgcuccaagggcguccgcguccccgucgagcccgccauccaggagcucuucuccugccccacccccggcugcgacggcuccggccacgucuccggcaaguacgcccgccaccgcuccgucuacggcugcccccucgccaagaagcgcaagacccaggacaagcagccccaggagcccgcccccaagcgcaagcccuucgccgucaaggccgacuccuccuccgucgacgagugcgacgacuccgacggcaccgaggacauggacgagaaggaggaggacgagggcgaggaguacuccgaggacaacgacgagcccggcgacgaggacgaggaggacgaggagggcgaccgcgaggaggaggaggagaucgaggaggaggacgaggacgacgacgaggacggcgaggacgucgaggacgaggaggaggaggaggaggaggaggaggaggaggaggaggaggaggagaacgaggaccaccagaugaacugccacaacacccgcaucaugcaggacaccgagaaggacgacaacaacaacgacgaguacgacaacuacgacgagcucgucgccaagucccuccucaaccucggcaagaucgccgaggacgccgccuaccgcgcccgcaccgaguccgagaugaacuccaacaccuccaacucccucgaggacgacuccgacaagaacgagaaccucggccgcaaguccgagcucucccucgaccucgacuccgacgucguccgcgagaccgucgacucccucaagcuccucgcccagggccacggcgucguccucuccgagaacaugaacgaccgcaacuacgccgacuccaugucccagcaggacucccgcaacaugaacuacgucaugcucggcaagcccaugaacaacggccucauggagaagauggucgaggaguccgacgaggaggucugccucuccucccucgagugccuccgcaaccagugcuucgaccucgcccgcaagcucuccgagaccaacccccaggagcgcaacccccagcagaacaugaacauccgccagcacguccgccccgaggaggacuuccccggccgcacccccgaccgcaacuacuccgacaugcucaaccucaugcgccucgaggagcagcucuccccccgcucccgcgucuucgccuccugcgccaaggaggacggcugccacgagcgcgacgacgacaccaccuccgucaacuccgaccgcuccgaggaggucuucgacaugaccaagggcaaccucacccuccucgagaaggccaucgcccucgagaccgagcgcgccaaggccaugcgcgagaagauggccauggaggccggccgccgcgacaacaugcgcuccuacgaggaccaguccccccgccagcuccccggcgaggaccgcaagcccaaguccuccgacucccacgucaagaagcccuacuacggcaaggaccccucccgcaccgagaagaaggaguccaagugccccacccccggcugcgacggcaccggccacgucaccggccucuacccccaccaccgcucccucuccggcugcccccacaaggaccgcgucccccccgagauccucgccaugcacgaguccguccucaagugccccacccccggcugcaccggccgcggccacgucaacuccaaccgcaacucccaccgcucccucuccggcugccccaucgccgccgccgagaagcucgccaaggcccaggagaagcaccaguccugcgacgucuccaaguccucccaggccuccgaccgcguccuccgccccaugugcuucgucaagcagcucgagaucccccaguacggcuaccgcaacaacguccccaccaccaccccccgcuccaaccucgccaaggagcucgagaaguacuccaagaccuccuucgaguacaacuccuacgacaaccacaccuacggcaagcgcgccaucgcccccaagguccagacccgcgacaucucccccaagggcuacgacgacgccaagcgcuacugcaaggaccccucccccuccuccuccuccaccuccuccuacgcccccuccuccuccuccaaccucuccugcggcggcggcuccuccgccuccuccaccugcuccaaguccuccuucgacuacacccacgacauggaggccgcccacauggccgccaccgccauccucaaccucuccacccgcugccgcgagaugccccagaaccucuccaccaagccccaggaccucugcgccacccgcaaccccgacauggaggucgacgagaacggcacccucgaccucuccaugaacaagcagcgcccccgcgacuccugcugccccauccucaccccccucgagcccauguccccccagcagcaggccgucaugaacaaccgcugcuuccagcucggcgagggcgacugcugggaccuccccgucgacuacaccaagaugaagccccgccgcaucgacgaggacgaguccaaggacaucacccccgaggaccucgaccccuuccaggaggcccucgaggagcgccgcuaccccggcgaggucaccauccccucccccaagcccaaguacccccagugcaaggaguccaagaaggaccucaucacccucuccggcugcccccucgccgacaaguccauccgcuccaugcucgccaccuccucccaggagcucaagugccccacccccggcugcgacggcuccggccacaucaccggcaacuacgccucccaccgcucccucuccggcugcccccgcgccaagaaguccggcauccgcaucgcccaguccaaggaggacaaggaggaccaggagcccauccgcugccccguccccggcugcgacggccagggccacaucaccggcaaguacgccucccaccgcuccgccuccggcugcccccucgccgccaagcgccagaaggacggcuaccucaacggcucccaguucuccuggaaguccgucaagaccgagggcauguccugccccacccccggcugcgacggcuccggccacgucuccggcuccuuccucacccaccgcucccucuccggcugcccccgcgccaccuccgccaugaagaaggccaagcucuccggcgagcagaugcucaccaucaagcagcgcgccuccaacggcaucgagaacgacgaggagaucaagcagcucgacgaggagaucaaggagcucaacgaguccaacucccagauggaggccgacaugaucaagcuccgcacccagaucaccaccauggaguccaaccucaagaccaucgaggaggagaacaaggucaucgagcagcagaacgagucccuccuccacgagcucgccaaccucucccagucccucauccacucccucgccaacauccagcucccccacauggaccccaucaacgagcagaacuucgacgccuacgucaccacccucaccgagauguacaccaaccaggaccgcuaccagucccccgagaacaaggcccuccucgagaacaucaagcaggccguccgcggcauccaggucuga

SEQ ID NO: 46389 - RNA, 1401 nt, Artificial Sequence
  derived and/or modified sequence opt2 from MYZAP__Homo_sapiens__NP_001018110
augcuccgcuccaccuccaccgucacccuccucuccggcggcgccgcccgcacccccggcgcccccucccgccgcgccaacgucugccgccuccgccucaccgucccccccgagucccccguccccgagcagugcgagaagaagaucgagcgcaaggagcagcuccucgaccucuccaacggcgagcccacccgcaagcucccccagggcgucgucuacggcgucguccgccgcuccgaccagaaccagcagaaggagauggucgucuacggcugguccaccucccagcucaaggaggagaugaacuacaucaaggacguccgcgccacccucgagaagguccgcaagcgcauguacggcgacuacgacgagaugcgccagaagauccgccagcucacccaggagcucuccgucucccacgcccagcaggaguaccucgagaaccacauccagacccaguccuccgcccucgaccgcuucaacgccaugaacuccgcccucgccuccgacuccaucggccuccagaagacccucgucgacgucacccucgagaacuccaacaucaaggaccagauccgcaaccuccagcagaccuacgaggccuccauggacaagcuccgcgagaagcagcgccagcucgaggucgcccaggucgagaaccagcuccucaagaugaaggucgaguccucccaggaggccaacgccgaggucaugcgcgagaugaccaagaagcucuacucccaguacgaggagaagcuccaggaggagcagcgcaagcacuccgccgagaaggaggcccuccucgaggagaccaacuccuuccucaaggccaucgaggaggccaacaagaagaugcaggccgccgagaucucccucgaggagaaggaccagcgcaucggcgagcucgaccgccucaucgagcgcauggagaaggagcgccaccagcuccagcuccagcuccucgagcacgagaccgagauguccggcgagcucaccgacuccgacaaggagcgcuaccagcagcucgaggaggccuccgccucccuccgcgagcgcauccgccaccucgacgacaugguccacugccagcagaagaaggucaagcagauggucgaggagaucgagucccucaagaagaagcuccagcagaagcagcuccucauccuccagcuccucgagaagaucuccuuccucgagggcgagaacaacgagcuccagucccgccucgacuaccucaccgagacccaggccaagaccgaggucgagacccgcgagaucggcgucggcugcgaccuccuccccucccagaccggccgcacccgcgagaucgucaugcccucccgcaacuacacccccuacacccgcguccucgagcucaccaugaagaagacccucaccuga

SEQ ID NO: 46390 - RNA, 570 nt, Artificial Sequence
  derived and/or modified sequence opt2 from MZB1__Homo_sapiens__NP_057543
augcgccucucccucccccuccuccuccuccuccucggcgccugggccauccccggcggccucggcgaccgcgccccccucaccgccaccgccccccagcucgacgacgaggagauguacuccgcccacaugcccgcccaccuccgcugcgacgccugccgcgccgucgccuaccagauguggcagaaccucgccaaggccgagaccaagcuccacaccuccaacuccggcggccgccgcgagcucuccgagcucgucuacaccgacguccucgaccgcuccugcucccgcaacuggcaggacuacggcguccgcgaggucgaccaggucaagcgccucaccggccccggccucuccgagggccccgagcccuccaucuccgucauggucaccggcggccccuggcccacccgccucucccgcaccugccuccacuaccucggcgaguucggcgaggaccagaucuacgaggcccaccagcagggccgcggcgcccucgaggcccuccucugcggcggcccccagggcgccugcuccgagaaggucuccgccacccgcgaggagcucuga

SEQ ID NO: 46391 - RNA, 873 nt, Artificial Sequence
  derived and/or modified sequence opt2 from MZF1__Homo_sapiens__NP_001253962
augcgccccgccguccucggcucccccgaccgcgccccccccgaggacgagggccccgucauggucaagcucgaggacuccgaggaggagggcgaggccgcccucugggaccccggccccgaggccgcccgccuccgcuuccgcugcuuccgcuacgaggaggccaccggcccccaggaggcccucgcccagcuccgcgagcucugccgccaguggcuccgccccgagguccgcuccaaggagcagaugcucgagcuccucguccucgagcaguuccucggcgcccucccccccgagauccaggcccgcguccagggccagcgccccggcucccccgaggaggccgccgcccucgucgacggccuccgccgcgagcccggcggcccccgccgcugggucaccguccagguccagggccaggagguccucuccgagaagauggagcccuccuccuuccagccccuccccgagaccgagccccccacccccgagcccggccccaagacccccccccgcaccaugcaggaguccccccucggccuccaggucaaggaggaguccgaggucaccgaggacuccgacuuccucgaguccggcccccucgccgccacccaggaguccguccccacccuccuccccgaggaggcccagcgcugcggcaccguccucgaccagaucuucccccacuccaagaccggccccgagggccccuccuggcgcgagcacccccgcgcccucuggcacgaggaggccggcggcaucuucucccccggcgccggcgccggcgccgcccccgcccucggcgccggcuggcucggcgccgccgucgccauguacgucgcccgcugcuccgccaacgccgccaccugcuga

SEQ ID NO: 46392 - RNA, 2691 nt, Artificial Sequence
  derived and/or modified sequence opt2 from N4BP1__Homo_sapiens__NP_694574
auggccgcccgcgccguccucgacgaguucaccgcccccgccgagaaggccgagcuccucgagcagucccgcggccgcaucgagggccucuucggcgucucccucgccguccucggcgcccucggcgccgaggagccccuccccgcccgcaucuggcuccagcucugcggcgcccaggaggccguccacuccgccaaggaguacaucaagggcaucugcgagcccgagcucgaggagcgcgagugcuaccccaaggacaugcacugcaucuucgucggcgccgagucccucuuccucaagucccucauccaggacaccugcgccgaccucugcauccucgacaucggccuccucggcauccgcggcuccgccgaggccgucgucauggcccgcucccacauccagcaguucgucaagcucuucgagaacaaggagaaccuccccuccucccagaaggaguccgaggucaagcgcgaguucaagcaguucgucgaggcccacgccgacaacuacaccauggaccuccucauccuccccaccucccucaagaaggagcuccucacccucacccagggcgaggagaaccucuucgagaccggcgacgacgaggucaucgagaugcgcgacucccagcagaccgaguucacccagaacgccgccaccggccucaacaucucccgcgacgagaccguccuccaggaggaggcccgcaacaaggccggcacccccgucuccgagcucaccaagcagauggacaccguccucuccuccucccccgacguccucuucgaccccaucaacggccucacccccgacgaggaggcccucuccaacgagcgcaucugccagaagcgccgcuucuccgacuccgaggagcgccacaccaagaagcaguucucccucgagaacguccaggagggcgagauccuccacgacgccaagacccucgccggcaacgucaucgccgaccucuccgacuccuccgccgacuccgagaaccucucccccgacaucaaggagaccaccgaggagauggaguacaacauccucgucaacuucuucaagaccaugggcuacucccaggagaucgucgagaaggucaucaaggucuacggccccuccaccgagccccuccuccuccucgaggagaucgagaaggagaacaagcgcuuccaggaggaccgcgaguucuccgccggcaccgucuaccccgagaccaacaagaccaagaacaagggcgucuacuccuccaccaacgagcucaccaccgacuccacccccaagaagacccaggcccacacccagcagaacauggucgagaaguucucccagcuccccuucaaggucgaggccaagcccugcaccuccaacugccgcaucaacaccuuccgcaccguccccaucgagcagaagcacgaggucuggggcuccaaccagaacuacaucugcaacaccgaccccgagaccgacggccucucccccuccgucgccucccccucccccaaggaggucaacuucgucucccgcggcgccuccucccaccagccccgcgucccccucuuccccgagaacggccuccaccagcagcccgagccccuccuccccaacaacaugaaguccgccugcgagaagcgccucggcugcugcuccuccccccacuccaagcccaacugcuccacccucuccccccccaugccccucccccagcuccuccccuccgucaccgacgcccgcuccgccggccccuccgaccacaucgacuccuccgucaccggcguccagcgcuuccgcgacacccucaagauccccuacaagcucgagcucaagaacgagcccggccgcaccgaccucaagcacaucgucaucgacggcuccaacgucgccaucacccacggccucaagaaguucuucuccugccgcggcaucgccaucgccgucgaguacuucuggaagcucggcaaccgcaacaucaccgucuucgucccccaguggcgcacccgccgcgaccccaacgucaccgagcagcacuuccucacccagcuccaggagcucggcauccucucccucacccccgcccgcauggucuucggcgagcgcaucgccucccacgacgaccgcuuccuccuccaccucgccgacaagaccggcggcaucaucgucaccaacgacaacuuccgcgaguucgucaacgaguccgucuccuggcgcgagaucaucaccaagcgccuccuccaguacaccuucgucggcgacaucuucaugguccccgacgacccccucggccgcuccggcccccgccucgaggaguuccuccagaaggaggucugccuccgcgacaugcagccccuccucuccgcccuccccaacgucggcauguucgaccccuccuuccgcguccccggcacccaggccgccuccaccucccaccagccccccacccgcauccagggcgcccccuccucccacuggcucccccagcagccccacuucccccuccuccccgcccuccccucccuccagcagaaccuccccaugcccgcccagcgcuccuccgccgagaccaacgagcuccgcgaggcccuccucaagaucuuccccgacuccgagcagcgccucaagaucgaccagauccucgucgcccaccccuacaugaaggaccucaacgcccucuccgccaugguccucgacuga

SEQ ID NO: 46393 - RNA, 522 nt, Artificial Sequence
  derived and/or modified sequence opt2 from N4BP2L1__Homo_sapiens__NP_001073159
auggaggacuccuuccuccaguccuucggccgccucucccuccagccccagcagcagcagcagcgccagcgccccccccgcccccccccccgcggcacccccccccgccgccacuccuuccgcaagcaccucuaccuccuccgcggccuccccggcuccggcaagaccacccucgcccgccagcuccagcacgacuucccccgcgcccucaucuucuccaccgacgacuucuucuuccgcgaggacggcgccuacgaguucaaccccgacuuccucgaggaggcccacgaguggaaccagaagcgcgcccgcaaggccaugcgcaacggcaucucccccaucaucaucgacaacaccaaccuccacgccugggagaugaagcccuacgccgucauggucuuccagaccgagcagaagaaccucuuccgccucgagauggacauggucgucuuccgccccgagaugaagaagcacuccuggugccucaagcgcaagaacccccccaacgagcgcaccgucuga

SEQ ID NO: 46394 - RNA, 2214 nt, Artificial Sequence
  derived and/or modified sequence opt2 from N4BP2L2__Homo_sapiens__NP_001265361
auggcccucugcuccgcccucaugaccaucuucaccaucaagaugggcaccgccaagcaggccaucgaccagggccgcucccccgucaucaucgacaacaccaacauccaggccugggagaugaagcccuacgucgaggucgccaucggcaagggcuaccgcgucgaguuccacgagcccgagaccugguggaaguucgaccccgaggagcucgagaagcgcaacaagcacggcgucucccgcaagaagaucgcccagaugcucgaccgcuacgaguaccagauguccaucuccaucgucaugaacuccgucgagcccucccacaaguccacccagcgccccccccccccccagggccgccagcgcgagcgcguccucaagaagaccggccaccgccucuccaagaccaagcagaagcgcaaccgcaagcgcaacaagaagcagaacucccagaaccgcaucauggaggagaacucccucgaguuccucuccgaccucacccccggcgaccaggaccccucccaguccgaggaggaggacaucgagaagacccgccgcgaguccgaguaccccuucaucgacggccuccagaacgaggucggcgacuucgucaccggcuacaaggagaagcgcuggaagaacaaggaccccaaggacuccuuccagaacgucauguccaucgucgagcucgacaacacccccaagaacuaccucuccaaggagggcgacaaccucuucgucucccuccuccuccgccccaacgagaucuccgucaccugccccauccucacccagaaccucuccugcgucaccaccgacgacugcuccggcaugaaggucgagaagcacauccgcaaccgccacaccaucgcccucgacacccaggaccucuccgccgagaccuccugccucuucaugaagaagcgcgagaucgucgacaagaaccucucccacgagcccauccucugccaccagcacggcauccgcauguccgacaagguccuccgcgaggagcaggucuacaccaccaagaucaaccacugggccuucuucaccaccaaccucuccgacgaggaccuccagcucggcuccgaccgccagcccuacuucggcuccuggcccgccggcccccacaaguucaucugcgagcagcgccccaagaaggaccgcgccugcaagcucgccggccccgacucccgcggccaguggauccagaugaucuucaccuccgucgccgccuccgagcccggcaacaaccccgagauccucaccgacaagcuccucaucggcaacgaggacuucucccccccccccgagaccauggacuccuucaucgagaccaaccucuuccgcuccugccucccccagcccgacauccccaagaacgcccucgaguccaccaagaacaagaagcgccgcaagaagcgcaucuucaaccucguccccaacuucgaccuccucggccagucccgcaucggcgucaaggagcgcgagaagugcgaccuccucaccaagaaccacggccucaagaucacccucggcgaggagaaggaccgcaucuccgagcgcaacuccgaggaggagaacaagcagaagcucaugaccuucgaccaccacccccucugguucuaccucgacaucaucaaggccaccccccucaacaucgacggccagcgcuacucccacugccucuccuucaaccgccuccgcugcuccgccucccucuacaagaacuacauccccuccuucguccuccacaaccucuccuccaucuggaagcccuccuucaccaacaagaagcucuuccucaccuucgagucccagacccgcgucggcaacaagcucaacgacgccggcuucaucucccccgagauccuccacucccaccccgacaccuccugcucccucggcgucaccuccgacuuccacuuccucaacgagcgcuucgaccgcaagcucaagcgcugggaggagcccaaggagcuccccgccgaggacucccaggaccucaccuccaccgacuaccgcucccucgagcucccccucucccagggcuucgccuuccagcucgucaagcucuucggcucccccggcguccccauggagucccuccuccccgacgacuacgucgucccccucgacuggaagacccucaagaugaucuaccuccaguggaagauguccgucgagaagcgccagaagaagaucggcuga

SEQ ID NO: 46395 - RNA, 663 nt, Artificial Sequence
  derived and/or modified sequence opt2 from NAA10__Homo_sapiens__NP_001243048
augaacauccgcaacgcccgccccgaggaccucaugaacaugcagcacugcaaccuccucugccuccccgagaacuaccagaugaaguacuacuucuaccacggccucuccuggccccagcucuccuacaucgccgaggacgagaacggcaagaucgucggcuacguccucgccaagauggaggaggaccccgacgacgucccccacggccacaucaccucccucgccgucaagcgcucccaccgccgccucggccucgcccagaagcucauggaccaggccucccgcgccaugaucgagaacuucaacgccaaguacgucucccuccacguccgcaagcgcaucuccgaggucgagcccaaguacuacgccgacggcgaggacgccuacgccaugaagcgcgaccucacccagauggccgacgagcuccgccgccaccucgagcucaaggagaagggccgccacgucguccucggcgccaucgagaacaaggucgaguccaagggcaacuccccccccuccuccggcgaggccugccgcgaggagaagggccucgccgccgaggacuccggcggcgacuccaaggaccucuccgaggucuccgagaccaccgaguccaccgacgucaaggacuccuccgaggccuccgacuccgccuccuga

SEQ ID NO: 46396 - RNA, 2601 nt, Artificial Sequence
  derived and/or modified sequence opt2 from NAA15__Homo_sapiens__NP_476516
augcccgccgucucccucccccccaaggagaacgcccucuucaagcgcauccuccgcugcuacgagcacaagcaguaccgcaacggccucaaguucugcaagcagauccucuccaaccccaaguucgccgagcacggcgagacccucgccaugaagggccucacccucaacugccucggcaagaaggaggaggccuacgagcucguccgccgcggccuccgcaacgaccucaagucccacgucugcuggcacgucuacggccuccuccagcgcuccgacaagaaguacgacgaggccaucaagugcuaccgcaacgcccucaagugggacaaggacaaccuccagauccuccgcgaccucucccuccuccagauccagaugcgcgaccucgagggcuaccgcgagacccgcuaccagcuccuccagcuccgccccgcccagcgcgccuccuggaucggcuacgccaucgccuaccaccuccucgaggacuacgagauggccgccaagauccucgaggaguuccgcaagacccagcagaccucccccgacaaggucgacuacgaguacuccgagcuccuccucuaccagaaccagguccuccgcgaggccggccucuaccgcgaggcccucgagcaccucugcaccuacgagaagcagaucugcgacaagcucgccgucgaggagaccaagggcgagcuccuccuccagcucugccgccucgaggacgccgccgacgucuaccgcggccuccaggagcgcaaccccgagaacugggccuacuacaagggccucgagaaggcccucaagcccgccaacaugcucgagcgccucaagaucuacgaggaggccuggaccaaguacccccgcggccucgucccccgccgccucccccucaacuuccucuccggcgagaaguucaaggagugccucgacaaguuccuccgcaugaacuucuccaagggcugcccccccgucuucaacacccuccgcucccucuacaaggacaaggagaaggucgccaucaucgaggagcucgucgucggcuacgagaccucccucaaguccugccgccucuucaaccccaacgacgacggcaaggaggagccccccaccacccuccucuggguccaguacuaccucgcccagcacuacgacaagaucggccagcccuccaucgcccucgaguacaucaacaccgccaucgaguccacccccacccucaucgagcucuuccucgucaaggccaagaucuacaagcacgccggcaacaucaaggaggccgcccgcuggauggacgaggcccaggcccucgacaccgccgaccgcuucaucaacuccaagugcgccaaguacaugcucaaggccaaccucaucaaggaggccgaggagaugugcuccaaguucacccgcgagggcaccuccgccgucgagaaccucaacgagaugcagugcaugugguuccagaccgagugcgcccaggccuacaaggccaugaacaaguucggcgaggcccucaagaagugccacgagaucgagcgccacuucaucgagaucaccgacgaccaguucgacuuccacaccuacugcaugcgcaagaucacccuccgcuccuacgucgaccuccucaagcucgaggacguccuccgccagcaccccuucuacuucaaggccgcccgcaucgccaucgagaucuaccucaagcuccacgacaacccccucaccgacgagaacaaggagcacgaggccgacaccgccaacauguccgacaaggagcucaagaagcuccgcaacaagcagcgccgcgcccagaagaaggcccagaucgaggaggagaagaagaacgccgagaaggagaagcagcagcgcaaccagaagaagaagaaggacgacgacgacgaggagaucggcggccccaaggaggagcucauccccgagaagcucgccaaggucgagaccccccucgaggaggccaucaaguuccucaccccccucaagaaccucgucaagaacaagaucgagacccaccucuucgccuucgagaucuacuuccgcaaggagaaguuccuccucaugcuccaguccgucaagcgcgccuucgccaucgacuccucccaccccuggcuccacgagugcaugauccgccucuucaacaccgccgucugcgaguccaaggaccucuccgacaccguccgcaccguccucaagcaggagaugaaccgccucuucggcgccaccaaccccaagaacuucaacgagaccuuccucaagcgcaacuccgacucccucccccaccgccucuccgccgccaagauggucuacuaccucgaccccuccucccagaagcgcgccaucgagcucgccaccacccucgacgagucccucaccaaccgcaaccuccagaccugcauggagguccucgaggcccucuacgacggcucccucggcgacugcaaggaggccgccgagaucuaccgcgccaacugccacaagcucuuccccuacgcccucgccuucaugccccccggcuacgaggaggacaugaagaucaccgucaacggcgacuccuccgccgaggccgaggagcucgccaacgagaucuga

SEQ ID NO: 46397 - RNA, 1290 nt, Artificial Sequence
  derived and/or modified sequence opt2 from NAA16__Homo_sapiens__NP_001104268
augcccaacguccuccucccccccaaggaguccaaccucuucaagcgcauccucaagugcuacgagcagaagcaguacaagaacggccucaaguucugcaagaugauccucuccaaccccaaguucgccgagcacggcgagacccucgccaugaagggccucacccucaacugccucggcaagaaggaggaggccuacgaguucguccgcaagggccuccgcaacgacgucaagucccacgucugcuggcacgucuacggccuccuccagcgcuccgacaagaaguacgacgaggccaucaagugcuaccgcaacgcccucaagcucgacaaggacaaccuccagauccuccgcgaccucucccuccuccagauccagaugcgcgaccucgagggcuaccgcgagacccgcuaccagcuccuccagcuccgccccacccagcgcgccuccuggaucggcuacgccaucgccuaccaccuccucaaggacuacgacauggcccucaagcuccucgaggaguuccgccagacccagcaggucccccccaacaagaucgacuacgaguacuccgagcucauccucuaccagaaccaggucaugcgcgaggccgaccuccuccaggagucccucgagcacaucgagauguacgagaagcagaucugcgacaagcuccucgucgaggagaucaagggcgagauccuccucaagcucggccgccucaaggaggccuccgaggucuucaagaaccucaucgaccgcaacgccgagaacuggugcuacuacgagggccucgagaaggcccuccagaucuccacccucgaggagcgccuccagaucuacgaggagaucuccaagcagcaccccaaggccaucaccccccgccgccucccccucacccucguccccggcgagcgcuuccgcgagcucauggacaaguuccuccgcgucaacuucuccaagggcugccccccccucuucaccacccucaagucccucuacuacaacaccgagaaggucuccaucauccaggagcucgucaccaacuacgaggccucccucaagaccugcgacuucuucucccccuacgagaacggcgagaaggagccccccaccacccuccucuggguccaguacuuccucgcccagcacuucgacaagcucggccaguacucccucgcccucgacuacaucaacgccgccaucgccuccacccccacccucaucgagcucuucuacaugaaggccaagaucuacaaggucaaguccgaguccugcuuccucuccuccuga

SEQ ID NO: 46398 - RNA, 537 nt, Artificial Sequence
  derived and/or modified sequence opt2 from NAA20__Homo_sapiens__NP_057184
augaccacccuccgcgccuucaccugcgacgaccucuuccgcuucaacaacaucaaccucgacccccucaccgagaccuacggcauccccuucuaccuccaguaccucgcccacuggcccgaguacuucaucgucgccgaggcccccggcggcgagcucaugggcuacaucaugggcaaggccgagggcuccgucgcccgcgaggaguggcacggccacgucaccgcccucuccgucgcccccgaguuccgccgccucggccucgccgccaagcucauggagcuccucgaggagaucuccgagcgcaagggcggcuucuucgucgaccucuucguccgcgucuccaaccaggucgccgucaacauguacaagcagcucggcuacuccgucuaccgcaccgucaucgaguacuacuccgccuccaacggcgagcccgacgaggacgccuacgacaugcgcaaggcccucucccgcgacaccgagaagaaguccaucaucccccucccccaccccguccgccccgaggacaucgaguga

SEQ ID NO: 46399 - RNA, 2919 nt, Artificial Sequence
  derived and/or modified sequence opt2 from NAA25__Homo_sapiens__NP_079229
auggccacccgcggccacguccaggaccccaacgaccgccgccuccgccccaucuacgacuaccucgacaacggcaacaacaagauggccauccagcaggccgacaagcuccucaagaagcacaaggaccuccacugcgccaagguccucaaggccaucggccuccagcgcaccggcaagcaggaggaggccuucacccucgcccaggaggucgccgcccucgagcccaccgacgacaacucccuccaggcccucaccauccucuaccgcgagaugcaccgccccgagcucgucaccaagcucuacgaggccgccgucaagaagguccccaacuccgaggaguaccacucccaccucuucauggccuacgcccgcgucggcgaguacaagaagaugcagcaggccggcauggcccucuacaagaucguccccaagaaccccuacuacuucugguccgucaugucccucaucaugcaguccaucuccgcccaggacgagaaccucuccaagaccauguuccucccccucgccgagcgcauggucgagaagauggucaaggaggacaagaucgaggccgaggccgaggucgagcucuacuacaugauccucgagcgccucggcaaguaccaggaggcccucgacgucauccgcggcaagcucggcgagaagcucaccuccgagauccagucccgcgagaacaagugcauggccauguacaagaagcucucccgcuggcccgagugcaacgcccucucccgccgccuccuccucaagaacuccgacgacuggcaguucuaccucaccuacuucgacuccgucuuccgccucaucgaggaggccugguccccccccgccgagggcgagcacucccucgagggcgagguccacuacuccgccgagaaggccgucaaguucaucgaggaccgcaucaccgaggaguccaaguccucccgccaccuccgcggcccccaccucgccaagcucgagcucauccgccgccuccgcucccagggcugcaacgacgaguacaagcucggcgaccccgaggagcucauguuccaguacuucaagaaguucggcgacaagcccugcugcuucaccgaccucaaggucuucgucgaccuccuccccgccacccagugcaccaaguucaucaaccagcuccucggcgucgucccccucuccacccccaccgaggacaagcucgcccuccccgccgacauccgcgcccuccagcagcaccucugcgucguccagcucacccgccuccucggccucuaccacaccauggacaagaaccagaagcucuccgucguccgcgagcucaugcuccgcuaccagcacggccucgaguucggcaagaccugccucaagaccgagcuccaguucuccgacuacuacugccuccucgccguccacgcccucaucgacgucuggcgcgagaccggcgacgagaccaccgucuggcaggcccucacccuccucgaggagggccucacccacucccccuccaacgcccaguucaagcuccuccucguccgcaucuacugcaugcucggcgccuucgagcccgucgucgaccucuacuccucccucgacgccaagcacauccagcacgacaccaucggcuaccuccucacccgcuacgccgagucccucggccaguacgccgccgccucccaguccugcaacuucgcccuccgcuucuuccacuccaaccagaaggacaccuccgaguacaucauccaggccuacaaguacggcgccuucgagaagauccccgaguucaucgccuuccgcaaccgccucaacaacucccuccacuucgcccagguccgcaccgagcgcaugcuccucgaccuccuccucgaggccaacaucuccaccucccucgccgaguccaucaaguccaugaaccuccgccccgaggaggacgacauccccugggaggaccuccgcgacaaccgcgaccucaacgucuucuucuccugggaccccaaggaccgcgacgucuccgaggagcacaagaagcucucccucgaggaggagacccucuggcuccgcauccgcucccucacccuccgccucaucuccggccuccccucccucaaccaccccgucgagcccaagaacuccgagaagaccgccgagaacggcgucuccucccgcaucgacauccuccgccuccuccuccagcagcucgaggccacccucgagaccggcaagcgcuucaucgagaaggacauccaguaccccuuccucggccccguccccacccgcaugggcggcuucuucaacuccggcugcucccagugccagaucuccuccuucuaccucgucaacgacaucuacgagcucgacaccuccggccucgaggacaccauggagauccaggagcgcaucgagaacuccuucaagucccuccucgaccagcucaaggacgucuucuccaagugcaagggcgaccuccucgaggucaaggacggcaaccucaagacccaccccacccuccucgagaaccucgucuucuucgucgagaccaucuccgucauccucugggucuccuccuacugcgaguccguccuccgccccuacaagcucaaccuccagaagaagaagaagaagaagaaggagaccuccaucaucaugccccccgucuucaccuccuuccaggacuacgucaccggccuccagacccucaucuccaacgucgucgaccacaucaagggccucgagacccaccucaucgcccucaagcucgaggagcucauccucgaggacaccucccucucccccgaggagcgcaaguucuccaagaccguccagggcaagguccaguccuccuaccuccacucccuccucgagaugggcgagcuccucaagaagcgccucgagaccaccaagaagcucaagaucuga

SEQ ID NO: 46400 - RNA, 1089 nt, Artificial Sequence
  derived and/or modified sequence opt2 from NAA30__Homo_sapiens__NP_001011713
auggccgaggucccccccggccccuccucccuccuccccccccccgccccccccgcccccgccgccgucgagccccgcugccccuuccccgccggcgccgcccucgccugcugcuccgaggacgaggaggacgacgaggagcacgagggcggcggcucccgcucccccgccggcggcgaguccgccaccgucgccgccaagggccaccccugccuccgcugcccccagcccccccaggagcagcagcagcucaacggccucaucucccccgagcuccgccaccuccgcgccgccgccucccucaaguccaagguccucuccgucgccgaggucgccgccaccaccgccacccccgacggcggcccccgcgccaccgccaccaagggcgccggcguccacuccggcgagcgccccccccacucccucuccuccaacgcccgcaccgccguccccucccccgucgaggccgccgccgccuccgaccccgccgccgcccgcaacggccucgccgagggcaccgagcaggaggaggaggaggaggacgagcagguccgccuccucuccuccucccucaccgccgacugcucccuccgcucccccuccggccgcgaggucgagcccggcgaggaccgcaccauccgcuacguccgcuacgaguccgagcuccagaugcccgacaucaugcgccucaucaccaaggaccucuccgagcccuacuccaucuacaccuaccgcuacuucauccacaacuggccccagcucugcuuccucgccauggucggcgaggagugcgucggcgccaucgucugcaagcucgacaugcacaagaagauguuccgccgcggcuacaucgccaugcucgccgucgacuccaaguaccgccgcaacggcaucggcaccaaccucgucaagaaggccaucuacgccauggucgagggcgacugcgacgaggucguccucgagaccgagaucaccaacaaguccgcccucaagcucuacgagaaccucggcuucguccgcgacaagcgccucuuccgcuacuaccucaacggcgucgacgcccuccgccucaagcucuggcuccgcuga

SEQ ID NO: 46401 - RNA, 2178 nt, Artificial Sequence
  derived and/or modified sequence opt2 from NAA35__Homo_sapiens__NP_078911
auggucaugaaggccuccgucgacgacgacgacuccggcugggagcucuccaugcccgagaagauggagaaguccaacaccaacugggucgacaucacccaggacuucgaggaggccugccgcgagcucaagcucggcgagcuccuccacgacaagcucuucggccucuucgaggccauguccgccaucgagaugauggaccccaagauggacgccggcaugaucggcaaccaggucaaccgcaagguccucaacuucgagcaggccaucaaggacggcaccaucaagaucaaggaccucacccuccccgagcucaucggcaucauggacaccugcuucugcugccucaucaccuggcucgagggccacucccucgcccagaccgucuucaccugccucuacauccacaaccccgacuucaucgaggaccccgccaugaaggccuucgcccucggcauccucaagaucugcgacaucgcccgcgagaaggucaacaaggccgccgucuucgaggaggaggacuuccaguccaugaccuacggcuucaagauggccaacuccgucaccgaccuccgcgucaccggcaugcucaaggacgucgaggacgacaugcagcgccgcgucaaguccacccgcucccgccagggcgaggagcgcgaccccgaggucgagcucgagcaccagcagugccucgccgucuucucccgcgucaaguucacccgcguccuccucaccguccucaucgccuucaccaagaaggagaccuccgccgucgccgaggcccagaagcucaugguccaggccgccgaccuccucuccgccauccacaacucccuccaccacggcauccaggcccagaacgacaccaccaagggcgaccaccccaucaugaugggcuucgagccccucgucaaccagcgccuccucccccccaccuucccccgcuacgccaagaucaucaagcgcgaggagauggucaacuacuucgcccgccucaucgaccgcaucaagaccgucugcgaggucgucaaccucaccaaccuccacugcauccucgacuucuucugcgaguucuccgagcagucccccugcguccucucccgcucccuccuccagaccaccuuccucgucgacaacaagaaggucuucggcacccaccucaugcaggacauggucaaggacgcccuccgcuccuucgucuccccccccguccucucccccaagugcuaccucuacaacaaccaccaggccaaggacugcaucgacuccuucgucacccacugcguccgccccuucugcucccucauccagauccacggccacaaccgcgcccgccagcgcgacaagcucggccacauccucgaggaguucgccacccuccaggacgaggccgagaaggucgacgccgcccuccacaccaugcuccucaagcaggagccccagcgccagcaccucgccugccucggcaccuggguccucuaccacaaccuccgcaucaugauccaguaccuccucuccggcuucgagcucgagcucuacuccaugcacgaguacuacuacaucuacugguaccucuccgaguuccucuacgccuggcucauguccacccucucccgcgccgacggcucccagauggccgaggagcgcaucauggaggagcagcagaagggccgcuccuccaagaagaccaagaagaagaagaagguccgcccccucucccgcgagaucaccaugucccaggccuaccagaacaugugcgccggcauguucaagaccauggucgccuucgacauggacggcaagguccgcaagcccaaguucgagcucgacuccgagcagguccgcuacgagcaccgcuucgcccccuucaacuccgucaugacccccccccccguccacuaccuccaguucaaggagauguccgaccucaacaaguacuccccccccccccagucccccgagcucuacgucgccgccuccaagcacuuccagcaggccaagaugauccucgagaacauccccaaccccgaccacgaggucaaccgcauccucaaggucgccaagcccaacuucgucgucaugaagcuccucgccggcggccacaagaaggaguccaaggucccccccgaguucgacuucuccgcccacaaguacuuccccgucgucaagcucgucuga

SEQ ID NO: 46402 - RNA, 651 nt, Artificial Sequence
  derived and/or modified sequence opt2 from NAA40__Homo_sapiens__NP_001287729
auggacgccgucugcgccaaggucgacgccgccaaccgccucggcgacccccucgaggccuuccccgucuucaagaaguacgaccgcaacggccucaacgucuccaucgagugcaagcgcgucuccggccucgagcccgccaccgucgacugggccuucgaccucaccaagaccaacaugcagaccauguacgagcaguccgaguggggcuggaaggaccgcgagaagcgcgaggagaugaccgacgaccgcgccugguaccucaucgccugggagaacuccuccguccccgucgccuucucccacuuccgcuucgacgucgagugcggcgacgagguccucuacugcuacgagguccagcucgaguccaagguccgccgcaagggccucggcaaguuccucauccagauccuccagcucauggccaacuccacccagaugaagaaggucaugcucaccgucuucaagcacaaccacggcgccuaccaguucuuccgcgaggcccuccaguucgagaucgacgacuccucccccuccauguccggcugcugcggcgaggacugcuccuacgagauccucucccgccgcaccaaguucggcgacucccaccacucccacgccggcggccacugcggcggcugcugccacuga

SEQ ID NO: 46403 - RNA, 510 nt, Artificial Sequence
  derived and/or modified sequence opt2 from NAA50__Homo_sapiens__NP_079422
augaagggcucccgcaucgagcucggcgacgucaccccccacaacaucaagcagcucaagcgccucaaccaggucaucuuccccgucuccuacaacgacaaguucuacaaggacguccucgaggucggcgagcucgccaagcucgccuacuucaacgacaucgccgucggcgccgucugcugccgcgucgaccacucccagaaccagaagcgccucuacaucaugacccucggcugccucgcccccuaccgccgccucggcaucggcaccaagaugcucaaccacguccucaacaucugcgagaaggacggcaccuucgacaacaucuaccuccacguccagaucuccaacgaguccgccaucgacuucuaccgcaaguucggcuucgagaucaucgagaccaagaagaacuacuacaagcgcaucgagcccgccgacgcccacguccuccagaagaaccucaagguccccuccggccagaacgccgacguccagaagaccgacaacuga

SEQ ID NO: 46404 - RNA, 729 nt, Artificial Sequence
  derived and/or modified sequence opt2 from NAA60__Homo_sapiens__NP_001077069
augaccgaggucguccccuccuccgcccucuccgaggucucccuccgccuccucugccacgacgacaucgacaccgucaagcaccucugcggcgacugguuccccaucgaguaccccgacuccugguaccgcgacaucaccuccaacaagaaguucuucucccucgccgccaccuaccgcggcgccaucgucggcaugaucgucgccgagaucaagaaccgcaccaagauccacaaggaggacggcgacauccucgccuccaacuucuccgucgacacccaggucgccuacauccucucccucggcgucgucaaggaguuccgcaagcacggcaucggcucccuccuccucgagucccucaaggaccacaucuccaccaccgcccaggaccacugcaaggccaucuaccuccacguccucaccaccaacaacaccgccaucaacuucuacgagaaccgcgacuucaagcagcaccacuaccuccccuacuacuacuccauccgcggcguccucaaggacggcuucaccuacguccucuacaucaacggcggccacccccccuggaccauccucgacuacauccagcaccucggcuccgcccucgccucccucucccccugcuccaucccccaccgcgucuaccgccaggcccacucccuccucugcuccuuccuccccugguccggcaucuccuccaaguccggcaucgaguacucccgcaccauguga

SEQ ID NO: 46405 - RNA, 972 nt, Artificial Sequence
  derived and/or modified sequence opt2 from NAAA__Homo_sapiens__NP_001035861
augcgcaccgccgaccgcgaggcccgccccggccuccccucccuccuccuccuccuccucgccggcgccggccucuccgccgccuccccccccgccgccccccgcuucaacgucucccucgacuccguccccgagcuccgcuggcuccccguccuccgccacuacgaccucgaccucguccgcgccgccauggcccaggucaucggcgaccgcguccccaaguggguccacguccucaucggcaaggucguccucgagcucgagcgcuuccucccccagcccuucaccggcgagauccgcggcaugugcgacuucaugaaccucucccucgccgacugccuccucgucaaccucgccuacgaguccuccgucuucugcaccuccaucgucgcccaggacucccgcggccacaucuaccacggccgcaaccucgacuaccccuucggcaacguccuccgcaagcucaccgucgacguccaguuccucaagaacggccagaucgccuucaccggcaccaccuucaucggcuacgucggccucuggaccggccaguccccccacaaguucaccgucuccggcgacgagcgcgacaagggcugguggugggagaacgccaucgccgcccucuuccgccgccacauccccgucuccuggcucauccgcgccacccucuccgaguccgagaacuucgaggccgccgucggcaagcucgccaagaccccccucaucgccgacgucuacuacaucgucggcggcaccuccccccgcgagggcgucgucaucacccgcaaccgcgacggccccgccgacaucuggccccucgacccccucaacggcgccugguuccgcgucgagaccaacuacgaccacuggaagcccgcccccaaggaggacgaccgccgcaccuccgccaucaaggcccucaacgccaccggccaggccaaccucucccucgaggcccucuuccaguga

SEQ ID NO: 46406 - RNA, 2328 nt, Artificial Sequence
  derived and/or modified sequence opt2 from NAALAD2__Homo_sapiens__XP_011540854
auggccuuccaggacugccgcugccgccuccagcgccgccaguccuaccucucccccgaggcccgcgagugcucccgccgccccaagcucggcccccaggaggccauggccgagucccgcggccgccucuaccucuggaugugccucgccgccgcccucgccuccuuccucaugggcuucauggucggcugguucaucaagccccucaaggagaccaccaccuccguccgcuaccaccaguccauccgcuggaagcucgucuccgagaugaaggccgagaacaucaaguccuuccuccgcuccuucaccaagcucccccaccucgccggcaccgagcagaacuuccuccucgccaagaagauccagacccaguggaagaaguucggccucgacuccgccaagcucguccacuacgacguccuccucuccuaccccaacgagaccaacgccaacuacaucuccaucgucgacgagcacgagaccgagaucuucaagaccuccuaccucgagcccccccccgacggcuacgagaacgucaccaacaucgucccccccuacaacgccuucuccgcccagggcaugcccgagggcgaccucgucuacgucaacuacgcccgcaccgaggacuucuucaagcucgagcgcgagaugggcaucaacugcaccggcaagaucgucaucgcccgcuacggcaagaucuuccgcggcaacaaggucaagaacgccaugcucgccggcgccaucggcaucauccucuacuccgaccccgccgacuacuucgcccccgagguccagcccuaccccaagggcuggaaccuccccggcaccgccgcccagcgcggcaacguccucaaccucaacggcgccggcgacccccucacccccggcuaccccgccaaggaguacaccuuccgccucgacgucgaggagggcgucggcaucccccgcauccccguccaccccaucggcuacaacgacgccgagauccuccuccgcuaccucggcggcaucgccccccccgacaaguccuggaagggcgcccucaacgucuccuacuccaucggccccggcuucaccggcuccgacuccuuccgcaagguccgcaugcacgucuacaacaucaacaagaucacccgcaucuacaacgucgucggcaccauccgcggcuccgucgagcccgaccgcuacgucauccucggcggccaccgcgacuccugggucuucggcgccaucgaccccaccuccggcgucgccguccuccaggagaucgcccgcuccuucggcaagcucauguccaagggcuggcgcccccgccgcaccaucaucuucgccuccugggacgccgaggaguucggccuccucggcuccaccgagugggccgaggagaacgucaagauccuccaggagcgcuccaucgccuacaucaacuccgacuccuccaucgagggcaacuacacccuccgcgucgacugcaccccccuccucuaccagcucgucuacaagcucaccaaggagauccccucccccgacgacggcuucgaguccaagucccucuacgaguccuggcucgagaaggaccccucccccgagaacaagaaccucccccgcaucaacaagcucggcuccggcuccgacuucgaggccuacuuccagcgccucggcaucgccuccggccgcgcccgcuacaccaagaacaagaagaccgacaaguacuccuccuaccccgucuaccacaccaucuacgagaccuucgagcucgucgagaaguucuacgaccccaccuucaagaagcagcucuccgucgcccagcuccgcggcgcccucgucuacgagcucgucgacuccaagaucauccccuucaacauccaggacuacgccgaggcccucaagaacuacgccgccuccaucuacaaccucuccaagaagcacgaccagcagcucaccgaccacggcgucuccuucgacucccucuucuccgccgucaagaacuucuccgaggccgccuccgacuuccacaagcgccucauccaggucgaccucaacaaccccaucgccguccgcaugaugaacgaccagcucaugcuccucgagcgcgccuucaucgacccccucggccuccccggcaagcucuucuaccgccacaucaucuucgcccccuccucccacaacaaguacgccggcgaguccuuccccggcaucuacgacgccaucuucgacaucgagaacaaggccaacucccgccucgccuggaaggaggucaagaagcacaucuccaucgccgccuucaccauccaggccgccgccggcacccucaaggagguccucuga

SEQ ID NO: 46407 - RNA, 2223 nt, Artificial Sequence
  derived and/or modified sequence opt2 from NAALADL1__Homo_sapiens__NP_005459
augcaguggaccaagguccucggccucggccucggcgccgccgcccuccucggccucggcaucauccucggccacuucgccauccccaagaaggccaacucccucgccccccaggaccucgaccucgagauccucgagaccgucaugggccagcucgacgcccaccgcauccgcgagaaccuccgcgagcucucccgcgagccccaccucgccuccuccccccgcgacgaggaccucguccagcuccuccuccagcgcuggaaggaccccgaguccggccucgacuccgccgaggccuccaccuacgagguccuccucuccuuccccucccaggagcagcccaacgucgucgacaucgucggccccaccggcggcaucauccacuccugccaccgcaccgaggagaacgucaccggcgagcagggcggccccgacgucguccagcccuacgccgccuacgcccccuccggcaccccccagggccuccucgucuacgccaaccgcggcgccgaggaggacuucaaggagcuccagacccagggcaucaagcucgagggcaccaucgcccucacccgcuacggcggcgucggccgcggcgccaaggccgucaacgccgccaagcacggcgucgccggcguccucgucuacaccgaccccgccgacaucaacgacggccucuccucccccgacgagaccuuccccaacuccugguaccucccccccuccggcgucgagcgcggcuccuacuacgaguacuucggcgacccccucacccccuaccuccccgccguccccuccuccuuccgcgucgaccucgccaacgucuccggcuucccccccauccccacccagcccaucggcuuccaggacgcccgcgaccuccucugcaaccucaacggcacccucgcccccgccaccuggcagggcgcccucggcugccacuaccgccucggccccggcuuccgccccgacggcgacuuccccgccgacucccaggucaacgucuccgucuacaaccgccucgagcuccgcaacuccuccaacguccucggcaucauccgcggcgccgucgagcccgaccgcuacguccucuacggcaaccaccgcgacuccuggguccacggcgccgucgaccccuccuccggcaccgccguccuccucgagcucucccgcguccucggcacccuccucaagaagggcaccuggcgcccccgccgcuccaucgucuucgccuccuggggcgccgaggaguucggccucaucggcuccaccgaguucaccgaggaguucuucaacaagcuccaggagcgcaccgucgccuacaucaacgucgacaucuccgucuucgccaacgccacccuccgcguccagggcaccccccccguccaguccgucgucuucuccgccaccaaggagauccgcucccccggccccggcgaccucuccaucuacgacaacuggauccgcuacuucaaccgcuccucccccgucuacggccucguccccucccucggcucccucggcgccggcuccgacuacgcccccuucguccacuuccucggcaucuccuccauggacaucgccuacaccuacgaccgcuccaagaccuccgcccgcaucuaccccaccuaccacaccgccuucgacaccuucgacuacgucgacaaguuccucgaccccggcuucuccucccaccaggccgucgcccgcaccgccggcuccgucauccuccgccucuccgacuccuucuuccucccccucaaggucuccgacuacuccgagacccuccgcuccuuccuccaggccgcccagcaggaccucggcgcccuccucgagcagcacuccaucucccucggcccccucgucaccgccgucgagaaguucgaggccgaggccgccgcccucggccagcgcaucuccacccuccagaagggcucccccgacccccuccagguccgcaugcucaacgaccagcucaugcuccucgagcgcaccuuccucaacccccgcgccuuccccgaggagcgcuacuacucccacguccucugggccccccgcaccggcuccgucgucaccuuccccggccucuccaacgccugcucccgcgcccgcgacaccgccuccggcuccgaggccugggccgagguccagcgccagcucuccaucgucgucaccgcccucgagggcgccgccgccacccuccgccccgucgccgaccucuga

SEQ ID NO: 46408 - RNA, 2388 nt, Artificial Sequence
  derived and/or modified sequence opt2 from NAALADL2__Homo_sapiens__NP_996898
augggcgagaacgaggccucccuccccaacaccucccuccagggcaagaagauggccuaccagaagguccacgccgaccagcgcgcccccggccacucccaguaccucgacaacgacgaccuccaggccaccgcccucgaccucgagugggacauggagaaggagcucgaggaguccggcuucgaccaguuccagcucgacggcgccgagaaccagaaccucggccacuccgagaccaucgaccucaaccucgacuccauccagcccgccaccucccccaagggccgcuuccagcgccuccaggaggaguccgacuacaucacccacuacacccgcuccgcccccaaguccaaccgcugcaacuucugccacguccucaagauccucugcaccgccaccauccucuucaucuucggcauccucaucggcuacuacguccacaccaacugccccuccgacgcccccuccuccggcaccgucgacccccagcucuaccaggagauccucaagaccauccaggccgaggacaucaagaaguccuuccgcaaccucguccagcucuacaagaacgaggacgacauggagaucuccaagaagaucaagacccaguggaccucccucggccucgaggacguccaguucgucaacuacuccguccuccucgaccuccccggccccucccccuccaccgucacccucuccuccuccggccagugcuuccaccccaacggccagcccugcuccgaggaggcccgcaaggacuccucccaggaccuccucuacuccuacgccgccuacuccgccaagggcacccucaaggccgaggucaucgacgucuccuacggcauggccgacgaccucaagcgcauccgcaagaucaagaacgucaccaaccagaucgcccuccucaagcucggcaagcucccccuccucuacaagcucuccucccucgagaaggccggcuucggcggcguccuccucuacaucgaccccugcgaccuccccaagaccgucaaccccucccacgacaccuucauggucucccucaaccccggcggcgaccccuccacccccggcuaccccuccgucgacgaguccuuccgccagucccgcuccaaccucaccucccuccucguccagcccaucuccgccccccucgucgccaagcucaucuccucccccaaggcccgcaccaagaacgaggccugcuccucccucgagcuccccaacaacgagauccgcgucgucuccaugcagguccagaccgucaccaagcucaagaccgucaccaacgucgucggcuucgucaugggccucaccucccccgaccgcuacaucaucgucggcucccaccaccacaccgcccacuccuacaacggccaggagugggccuccuccaccgccaucaucaccgccuucauccgcgcccucauguccaaggucaagcgcggcuggcgccccgaccgcaccaucgucuucugcuccuggggcggcaccgccuucggcaacaucggcuccuacgaguggggcgaggacuucaagaagguccuccagaagaacgucgucgccuacaucucccuccacucccccauccgcggcaacuccucccucuaccccgucgccucccccucccuccagcagcucgucgucgagaagaacaacuucaacugcacccgccgcgcccagugccccgagaccaacaucuccuccauccagauccagggcgacgccgacuacuucaucaaccaccucggcguccccaucguccaguucgccuacgaggacaucaagacccucgagggccccuccuuccucuccgaggcccgcuucuccacccgcgccaccaagaucgaggagauggaccccuccuucaaccuccacgagaccaucaccaagcucuccggcgaggucauccuccagaucgccaacgagcccguccuccccuucaacgcccucgacaucgcccucgagguccagaacaaccucaagggcgaccagcccaacacccaccagcuccucgccauggcccuccgccuccgcgaguccgccgagcucuuccaguccgacgagaugcgccccgccaacgaccccaaggagcgcgcccccauccgcauccgcaugcucaacgacauccuccaggacauggagaaguccuuccucgucaagcaggccccccccggcuucuaccgcaacauccucuaccaccucgacgagaagaccucccgcuucuccauccucaucgaggccugggagcacugcaagccccucgccuccaacgagacccuccaggaggcccucuccgagguccucaacuccaucaacuccgcccaggucuacuucaaggccggccucgacgucuucaaguccguccucgacggcaagaacuga

SEQ ID NO: 46409 - RNA, 1464 nt, Artificial Sequence
  derived and/or modified sequence opt2 from NAB1__Homo_sapiens__NP_005957
auggccgccgcccucccccgcacccucggcgagcuccagcucuaccgcauccuccagaaggccaaccuccucuccuacuucgacgccuucauccagcagggcggcgacgacguccagcagcucugcgaggccggcgaggaggaguuccucgagaucauggcccucgucggcauggccuccaagccccuccacguccgccgccuccagaaggcccuccgcgacugggucaccaaccccggccucuucaaccagccccucaccucccuccccgucuccuccauccccaucuacaagcuccccgagggcucccccaccuggcucggcaucuccugcuccuccuacgagcgcuccuccaacgcccgcgagccccaccucaagauccccaagugcgccgccaccaccugcguccagucccucggccagggcaaguccgacgucgucggcucccucgcccuccaguccgucggcgagucccgccucuggcagggccaccacgccaccgaguccgagcacucccucucccccgccgaccucggcucccccgccucccccaaggaguccuccgaggcccucgacgccgccgccgcccucuccgucgccgagugcgucgagcgcauggcccccacccuccccaaguccgaccucaacgaggucaaggagcuccucaagaccaacaagaagcucgccaagaugaucggccacaucuucgagaugaacgacgacgacccccacaaggaggaggagauccgcaaguacuccgccaucuacggccgcuucgacuccaagcgcaaggacggcaagcaccucacccuccacgagcucaccgucaacgaggccgccgcccagcucugcgucaaggacaacgcccuccucacccgccgcgacgagcucuucgcccucgcccgccagaucucccgcgaggucaccuacaaguacaccuaccgcaccaccaaguccaagugcggcgagcgcgacgagcucucccccaagcgcaucaaggucgaggacggcuuccccgacuuccaggacuccguccagacccucuuccagcaggcccgcgccaaguccgaggagcucgccgcccucuccucccagcagcccgagaaggucauggccaagcagauggaguuccucugcaaccaggccggcuacgagcgccuccagcacgccgagcgccgccucuccgccggccucuaccgccaguccuccgaggagcacucccccaacggccucaccuccgacaacuccgacggccagggcgagcgcccccucaaccuccgcaugcccaaccuccagaaccgccagccccaccacuucgucgucgacggcgagcucucccgccucuaccccuccgaggccaagucccacuccuccgagucccucggcauccucaaggacuacccccacuccgccuucacccucgagaagaaggucaucaagaccgagcccgaggacucccgcuga

SEQ ID NO: 46410 - RNA, 1578 nt, Artificial Sequence
  derived and/or modified sequence opt2 from NAB2__Homo_sapiens__NP_005958
augcaccgcgcccccucccccaccgccgagcagccccccggcggcggcgacuccgcccgccgcacccuccagccccgccucaagcccuccgcccgcgccauggcccucccccgcacccucggcgagcuccagcucuaccgcguccuccagcgcgccaaccuccucuccuacuacgagaccuucauccagcagggcggcgacgacguccagcagcucugcgaggccggcgaggaggaguuccucgagaucauggcccucgucggcauggccaccaagccccuccacguccgccgccuccagaaggcccuccgcgagugggccaccaaccccggccucuucucccagcccguccccgccguccccgucuccuccaucccccucuucaagaucuccgagaccgccggcacccgcaagggcuccauguccaacggccacggcucccccggcgagaaggccggcuccgcccgcuccuucucccccaaguccccccucgagcucggcgagaagcucuccccccuccccggcggccccggcgccggcgacccccgcaucuggcccggccgcuccacccccgaguccgacgucggcgccggcggcgaggaggaggccggcuccccccccuucuccccccccgccggcggcggcguccccgagggcaccggcgccggcggccucgccgccggcggcaccggcggcggccccgaccgccucgagcccgagaugguccgcauggucgucgaguccgucgagcgcaucuuccgcuccuucccccgcggcgacgccggcgaggucaccucccuccucaagcucaacaagaagcucgcccgcuccgucggccacaucuucgagauggacgacaacgacucccagaaggaggaggagauccgcaaguacuccaucaucuacggccgcuucgacuccaagcgccgcgagggcaagcagcucucccuccacgagcucaccaucaacgaggccgccgcccaguucugcaugcgcgacaacacccuccuccuccgccgcgucgagcucuucucccucucccgccaggucgcccgcgaguccaccuaccucuccucccucaagggcucccgccuccaccccgaggagcucggcggccccccccucaagaagcucaagcaggaggucggcgagcagucccaccccgagauccagcagcccccccccggccccgaguccuacgucccccccuaccgccccucccucgaggaggacuccgccucccucuccggcgagucccucgacggccaccuccaggccgucggcuccugcccccgccucacccccccccccgccgaccucccccucgcccuccccgcccacggccucuggucccgccacauccuccagcagacccucauggacgagggccuccgccucgcccgccucgucucccacgaccgcgucggccgccucucccccugcguccccgccaagcccccccucgccgaguucgaggagggccuccucgaccgcugccccgcccccggcccccaccccgcccucgucgagggccgccgcuccuccgucaaggucgaggccgaggccucccgccaguga

SEQ ID NO: 46411 - RNA, 615 nt, Artificial Sequence
  derived and/or modified sequence opt2 from NABP1__Homo_sapiens__NP_001026886
augaaccgcgucaacgacccccucaucuucauccgcgacaucaagcccggccucaagaaccucaacgucgucuucaucguccucgagaucggccgcgucaccaagaccaaggacggccacgagguccgcuccugcaaggucgccgacaagaccggcuccaucaccaucuccgucugggacgagaucggcggccucauccagcccggcgacaucauccgccucacccgcggcuacgccuccauguggaagggcugccucacccucuacaccggccgcggcggcgagcuccagaagaucggcgaguucugcauggucuacuccgagguccccaacuucuccgagcccaaccccgacuaccgcggccagcagaacaagggcgcccaguccgagcagaagaacaacuccaugaacuccaacaugggcaccggcaccuucggccccgucggcaacggcguccacaccggccccgagucccgcgagcaccaguucucccacgccggccgcuccaacggccgcggccucaucaacccccagcuccagggcaccgccuccaaccagaccgucaugaccaccaucuccaacggccgcgacccccgccgcgccuucaagcgcuga

SEQ ID NO: 46412 - RNA, 636 nt, Artificial Sequence
  derived and/or modified sequence opt2 from NABP2__Homo_sapiens__NP_076973
augaccaccgagaccuucgucaaggacaucaagcccggccucaagaaccucaaccucaucuucaucguccucgagaccggccgcgucaccaagaccaaggacggccacgagguccgcaccugcaaggucgccgacaagaccggcuccaucaacaucuccgucugggacgacgucggcaaccucauccagcccggcgacaucauccgccucaccaagggcuacgccuccgucuucaagggcugccucacccucuacaccggccgcggcggcgaccuccagaagaucggcgaguucugcauggucuacuccgagguccccaacuucuccgagcccaaccccgaguacuccacccagcaggcccccaacaaggccguccagaacgacuccaaccccuccgccucccagcccaccaccggccccuccgccgccucccccgccuccgagaaccagaacggcaacggccucuccgccccccccggccccggcggcggcccccaccccccccacacccccucccacccccccuccacccgcaucacccgcucccagcccaaccacacccccgccggcccccccggccccuccuccaaccccgucuccaacggcaaggagacccgccgcuccuccaagcgcuga

SEQ ID NO: 46413 - RNA, 2778 nt, Artificial Sequence
  derived and/or modified sequence opt2 from NACA__Homo_sapiens__NP_001106674
augcccggcgaggccaccgagaccguccccgccaccgagcaggagcucccccagccccaggccgagaccgccguccuccccauguccuccgcccucuccgucaccgccgcccucggccagcccggccccacccuccccccccccugcucccccgccccccagcagugcccccucuccgccgccaaccaggccucccccuuccccucccccuccaccaucgccuccaccccccucgagguccccuucccccaguccuccuccggcaccgcccucccccucggcaccgcccccgaggcccccaccuuccuccccaaccucaucggcccccccaucucccccgccgcccucgcccucgccucccccaugaucgcccccacccucaagggcacccccuccuccuccgccccccucgcccucgucgcccucgccccccacuccguccagaaguccuccgccuucccccccaaccuccucaccuccccccccuccgucgccgucgccgaguccggcuccgucaucacccucuccgcccccaucgcccccuccgagcccaagaccaaccucaacaagguccccuccgaggucguccccaaccccaagggcacccccuccccccccugcaucgucuccaccguccccuaccacugcgucacccccauggccuccauccaguccggcgucgccucccucccccagaccacccccaccaccacccucgccaucgccuccccccaggucaaggacaccaccaucuccuccguccucaucuccccccagaaccccggcucccucucccucaagggccccgucuccccccccgccgcccucucccucuccacccagucccuccccgucgucaccuccucccagaagaccgccggccccaacaccccccccgacuuccccaucucccucggcucccaccucgccccccuccaccaguccuccuucggcuccguccagcuccucggccagaccggccccuccgcccucuccgaccccaccgucaagaccaucuccgucgaccacuccuccaccggcgccuccuaccccucccagcgcuccgucauccccccccuccccucccgcaacgaggucguccccgccaccgucgccgccuuccccgucgucgcccccuccgucgacaagggccccuccaccaucuccuccaucaccugcucccccuccggcucccucaacgucgccaccuccuucucccucucccccaccaccucccucauccucaaguccucccccaacgccaccuaccacuacccccucgucgcccagaugcccgucuccuccgucggcaccaccccccucgucgucaccaaccccugcaccaucgccgccgcccccaccaccaccuucgaggucgccaccugcgucuccccccccauguccuccggccccaucuccaacaucgagcccaccucccccgccgcccucgucauggcccccgucgcccccaaggagcccuccacccaggucgccaccacccuccgcauccccgucucccccccccuccccgaccccgaggaccucaagaaccuccccuccuccguccucgucaaguuccccacccagaaggaccuccagaccguccccgccucccucgagggcgcccccuucucccccgcccaggccggccucaccaccaagaaggaccccaccguccucccccucguccaggccgcccccaagaacucccccuccuuccaguccaccuccuccucccccgagaucccccucucccccgaggccacccucgccaagaagucccucggcgagccccuccccaucgucgccgccuucccccucgaguccgccgaccccgccggcgucgcccccaccaccgccaaggccgccgccuucgagaagguccuccccaagcccgaguccgccuccgucuccgccgcccccuccccccccgucucccucccccucgcccccucccccguccccacccucccccccaagcagcaguuccuccccuccucccccggccucguccucgagucccccuccaagccccucgcccccgccgacgaggacgagcuccucccccucaucccccccgagcccaucuccggcggcguccccuuccaguccguccucgucaacaugcccacccccaaguccgccggcauccccguccccacccccuccgccaagcagcccgucaccaagaacaacaagggcuccggcaccgaguccgacuccgacgaguccguccccgagcucgaggagcaggacuccacccaggccaccacccagcaggcccagcucgccgccgccgccgagaucgacgaggagcccgucuccaaggccaagcagucccgcuccgagaagaaggcccgcaaggccauguccaagcucggccuccgccaggucaccggcgucacccgcgucaccauccgcaaguccaagaacauccucuucgucaucaccaagcccgacgucuacaagucccccgccuccgacaccuacaucgucuucggcgaggccaagaucgaggaccucucccagcaggcccagcucgccgccgccgagaaguucaagguccagggcgaggccgucuccaacauccaggagaacacccagacccccaccguccaggaggaguccgaggaggaggaggucgacgagaccggcgucgaggucaaggacaucgagcucgucaugucccaggccaacgucucccgcgccaaggccguccgcgcccucaagaacaacuccaacgacaucgucaacgccaucauggagcucaccauguga

SEQ ID NO: 46414 - RNA, 1584 nt, Artificial Sequence
  derived and/or modified sequence opt2 from NACC1__Homo_sapiens__XP_005259778
auggcccagacccuccagauggagauccccaacuucggcaacuccauccucgagugccucaacgagcagcgccuccagggccucuacugcgacgucuccgucgucgucaagggccacgccuucaaggcccaccgcgccguccucgccgccuccuccuccuacuuccgcgaccucuucaacaacucccgcuccgccgucgucgagcuccccgccgccguccagccccaguccuuccagcagauccucuccuucugcuacaccggccgccucuccaugaacgucggcgaccaguuccuccucauguacaccgccggcuuccuccagauccaggagaucauggagaagggcaccgaguucuuccucaaggucuccucccccuccugcgacucccagggccuccacgccgaggaggcccccuccuccgagccccagucccccgucgcccagaccuccggcuggcccgccugcuccaccccccucccccucgucucccgcgucaagaccgagcagcaggaguccgacuccguccagugcaugcccgucgccaagcgccucugggacuccggccagaaggaggccggcggcggcggcaacggcucccgcaagauggccaaguucuccacccccgaccucgccgccaaccgcccccaccagcccccccccccccagcaggcccccgucgucgccgccgcccagcccgccgucgccgccggcgccggccagcccgccggcggcgucgccgccgccggcggcgucgucuccggccccuccaccuccgagcgcaccucccccggcaccuccuccgccuacaccuccgacucccccggcuccuaccacaacgaggaggacgaggaggaggacggcggcgaggagggcauggacgagcaguaccgccagaucugcaacauguacaccauguacuccaugaugaacgucggccagaccgccgagaaggucgaggcccuccccgagcaggucgcccccgagucccgcaaccgcauccgcguccgccaggaccucgccucccuccccgccgagcucaucaaccagaucggcaaccgcugccaccccaagcucuacgacgagggcgaccccuccgagaagcucgagcucgucaccggcaccaacgucuacaucacccgcgcccagcucaugaacugccacgucuccgccggcacccgccacaagguccuccuccgccgccuccucgccuccuucuucgaccgcaacacccucgccaacuccugcggcaccggcauccgcuccuccaccaacgacccccgccgcaagccccucgacucccgcguccuccacgccgucaaguacuacugccagaacuucgcccccaacuucaaggaguccgagaugaacgccaucgccgccgacaugugcaccaacgcccgccgcgucguccgcaaguccuggaugcccaaggucaagguccucaaggccgaggacgacgccuacaccaccuucaucuccgagaccggcaagaucgagcccgacaugaugggcgucgagcacggcuucgagaccgccucccacgagggcgaggccggccccuccgccgaggcccuccaguga

SEQ ID NO: 46415 - RNA, 1764 nt, Artificial Sequence
  derived and/or modified sequence opt2 from NACC2__Homo_sapiens__XP_011516523
augucccagaugcuccacaucgagauccccaacuucggcaacaccguccucggcugccucaacgagcagcgccuccucggccucuacugcgacgucuccaucgucgucaagggccaggccuucaaggcccaccgcgccguccucgccgccuccucccucuacuuccgcgaccucuucuccggcaacuccaaguccgccuucgagcuccccggcuccgucccccccgccugcuuccagcagauccucuccuucugcuacaccggccgccucaccaugaccgccuccgagcagcucgucgucauguacaccgccggcuuccuccagauccagcacaucgucgagcgcggcaccgaccucauguucaaggucuccuccccccacugcgacucccagaccgccgucaucgaggacgccggcuccgagccccagucccccugcaaccagcuccagcccgccgccgccgccgccgcccccuacgucgucucccccuccguccccaucccccuccucacccgcgucaagcacgaggccauggagcucccccccgccggccccggccucgcccccaagcgcccccucgagaccggcccccgcgacggcgucgccgucgccgccggcgccgccgucgccgccggcaccgccccccucaagcucccccgcgucuccuacuacggcguccccucccucgccacccucauccccggcauccagcagaugcccuacccccagggcgagcgcaccucccccggcgccuccucccuccccaccaccgacucccccaccuccuaccacaacgaggaggacgaggaggacgacgaggccuacgacaccauggucgaggagcaguacggccagauguacaucaaggccuccggcuccuacgccguccaggagaagcccgagcccgucccccucgagucccgcuccugcguccucauccgccgcgaccucgucgcccuccccgccucccucaucucccagaucggcuaccgcugccaccccaagcucuacuccgagggcgaccccggcgagaagcucgagcucgucgccggcuccggcgucuacaucacccgcggccagcucaugaacugccaccucugcgccggcgucaagcacaagguccuccuccgccgccuccucgccaccuucuucgaccgcaacacccucgccaacuccugcggcaccggcauccgcuccuccaccuccgaccccucccgcaagccccucgacucccgcguccucaacgccgucaagcucuacugccagaacuucgcccccuccuucaaggaguccgagaugaacgucaucgccgccgacaugugcaccaacgcccgccgcguccgcaagcgcuggcuccccaagaucaaguccaugcuccccgagggcgucgagauguaccgcaccgucaugggcuccgccgccgccuccgucccccucgaccccgaguucccccccgccgccgcccaggucuucgagcagcgcaucuacgccgagcgccgcggcgacgccgccaccaucgucgcccuccgcaccgacgccgucaacgucgaccucuccgccgccgccaaccccgccuucgacgccggcgaggaggucgacggcgccggcuccgucauccaggaggucgccgcccccgagccccuccccgccgacggccagucccccccccagcccuucgagcagggcggcggcggccccucccgcccccagacccccgccgccgccgcccgccgccccgagggcaccuacgccggcacccucuga

SEQ ID NO: 46416 - RNA, 2121 nt, Artificial Sequence
  derived and/or modified sequence opt2 from NADSYN1__Homo_sapiens__NP_060631
augggccgcaaggucaccgucgccaccugcgcccucaaccagugggcccucgacuucgagggcaaccuccagcgcauccucaaguccaucgagaucgccaagaaccgcggcgcccgcuaccgccucggccccgagcucgagaucugcggcuacggcugcugggaccacuacuacgaguccgacacccuccuccacuccuuccagguccucgccgcccucgucgagucccccgucacccaggacaucaucugcgacgucggcaugcccgucaugcaccgcaacguccgcuacaacugccgcgucaucuuccucaaccgcaagauccuccucauccgccccaagauggcccucgccaacgagggcaacuaccgcgagcuccgcugguucacccccuggucccgcucccgccacaccgaggaguacuuccucccccgcaugauccaggaccucaccaagcaggagaccguccccuucggcgacgccguccucgucaccugggacaccugcaucggcuccgagaucugcgaggagcucuggaccccccacuccccccacaucgacaugggccucgacggcgucgagaucaucaccaacgccuccggcucccaccagguccuccgcaaggccaacacccgcgucgaccucgucaccauggucaccuccaagaacggcggcaucuaccuccucgccaaccagaagggcugcgacggcgaccgccucuacuacgacggcugcgccaugaucgccaugaacggcuccgucuucgcccagggcucccaguucucccucgacgacgucgagguccucaccgccacccucgaccucgaggacguccgcuccuaccgcgccgagaucuccucccgcaaccucgccgccucccgcgccucccccuacccccgcgucaaggucgacuucgcccucuccugccacgaggaccuccucgcccccaucuccgagcccaucgaguggaaguaccacucccccgaggaggagaucucccucggccccgccugcuggcucugggacuuccuccgccgcucccagcaggccggcuuccuccucccccucuccggcggcgucgacuccgccgccaccgccugccucaucuacuccaugugcugccaggucugcgaggccguccgcuccggcaacgaggagguccucgccgacguccgcaccaucgucaaccagaucuccuacaccccccaggacccccgcgaccucugcggccgcauccucaccaccugcuacauggccuccaagaacuccucccaggagaccugcacccgcgcccgcgagcucgcccagcagaucggcucccaccacaucucccucaacaucgaccccgccgucaaggccgucaugggcaucuucucccucgucaccggcaaguccccccucuucgccgcccacggcggcuccucccgcgagaaccucgcccuccagaacguccaggcccgcauccgcaugguccucgccuaccucuucgcccagcucucccucuggucccgcggcguccacggcggccuccucguccucggcuccgccaacgucgacgagucccuccucggcuaccucaccaaguacgacugcuccuccgccgacaucaaccccaucggcggcaucuccaagaccgaccuccgcgccuucguccaguucugcauccagcgcuuccagcuccccgcccuccaguccauccuccucgcccccgccaccgccgagcucgagccccucgccgacggccaggucucccagaccgacgaggaggacaugggcaugaccuacgccgagcucuccgucuacggcaagcuccgcaaggucgccaagaugggccccuacuccauguucugcaagcuccucggcauguggcgccacaucugcaccccccgccaggucgccgacaaggucaagcgcuucuucuccaaguacuccaugaaccgccacaagaugaccacccucacccccgccuaccacgccgagaacuacucccccgaggacaaccgcuucgaccuccgccccuuccucuacaacaccuccuggcccuggcaguuccgcugcaucgagaaccagguccuccagcucgagcgcgccgagccccagucccucgacggcgucgacuga

SEQ ID NO: 46417 - RNA, 1587 nt, Artificial Sequence
  derived and/or modified sequence opt2 from NAE1__Homo_sapiens__NP_001018169
auggacgcccagcagaccaagaccaacgaggcccgccucuggggcgaccacggccaggaggcccucgaguccgcccacgucugccucaucaacgccaccgccaccggcaccgagauccucaagaaccucguccuccccggcaucggcuccuucaccaucaucgacggcaaccaggucuccggcgaggacgccggcaacaacuucuuccuccagcgcuccuccaucggcaagaaccgcgccgaggccgccauggaguuccuccaggagcucaacuccgacgucuccggcuccuucgucgaggagucccccgagaaccuccucgacaacgaccccuccuucuucugccgcuucaccgucgucgucgccacccagcuccccgaguccaccucccuccgccucgccgacguccucuggaacucccagaucccccuccucaucugccgcaccuacggccucgucggcuacaugcgcaucaucaucaaggagcaccccgucaucgagucccaccccgacaacgcccucgaggaccuccgccucgacaagcccuuccccgagcuccgcgagcacuuccaguccuacgaccucgaccacauggagaagaaggaccacucccacacccccuggaucgucaucaucgccaaguaccucgcccagugguacuccgagaccaacggccgcauccccaagaccuacaaggagaaggaggacuuccgcgaccucauccgccagggcauccucaagaacgagaacggcgcccccgaggacgaggagaacuucgaggaggccaucaagaacgucaacaccgcccucaacaccacccagauccccuccuccaucgaggacaucuucaacgacgaccgcugcaucaacaucaccaagcagacccccuccuucuggauccucgcccgcgcccucaaggaguucgucgccaaggagggccagggcaaccuccccguccgcggcaccauccccgacaugaucgccgacuccggcaaguacaucaagcuccagaacgucuaccgcgagaaggccaagaaggacgccgccgccgucggcaaccacgucgccaagcuccuccaguccaucggccaggcccccgaguccaucuccgagaaggagcucaagcuccucugcuccaacuccgccuuccuccgcgucguccgcugccgcucccucgccgaggaguacggccucgacaccaucaacaaggacgagaucaucuccuccauggacaaccccgacaacgagaucguccucuaccucaugcuccgcgccgucgaccgcuuccacaagcagcagggccgcuaccccggcgucuccaacuaccaggucgaggaggacaucggcaagcucaaguccugccucaccggcuuccuccaggaguacggccucuccgucauggucaaggacgacuacguccacgaguucugccgcuacggcgccgccgagccccacaccaucgccgccuuccucggcggcgccgccgcccaggaggucaucaagaucaucaccaagcaguucgucaucuucaacaacaccuacaucuacuccggcaugucccagaccuccgccaccuuccagcucuga

SEQ ID NO: 46418 - RNA, 1170 nt, Artificial Sequence
  derived and/or modified sequence opt2 from NAF1__Homo_sapiens__NP_001122403
auggaggucgucgaggccgccgccgcccagcucgagacccucaaguucaacggcaccgacuucggcgucggcgagggccccgccgcccccucccccggcuccgcccccguccccggcacccagcccccccuccaguccuucgagggcucccccgacgccggccagaccgucgaggucaagcccgccggcgagcagccccuccagcccguccucaacgccgucgccgccggcacccccgccccccagccccagccccccgccgagucccccgccugcggcgacugcgucaccucccccggcgccgccgagcccgcccgcgcccccgacucccucgagaccuccgacuccgacuccgacuccgacuccgagaccgacuccgacuccuccuccuccuccuccuccuccuccuccuccuccuccuccuccuccuccuccugcaucucccucccccccguccucuccgacggcgacgacgaccuccagaucgagaaggagaacaagaacuucccccucaagaccaaggacgagcuccuccucaacgagcuccccuccgucgaggagcucaccaucauccuccccgaggacaucgagcucaagccccucggcauggucuccuccaucaucgagcagcucgucaucaucgaguccaugaccaaccucccccccgucaacgaggagaccgucaucuucaaguccgaccgccaggccgccggcaagaucuucgagaucuucggccccgucgcccaccccuucuacguccuccgcuucaacuccuccgaccacaucgaguccaagggcaucaagaucaaggagaccauguacuucgcccccuccaugaaggacuucacccaguacaucuucaccgagaagcucaagcaggacaagggcuccgacgccuccuggaagaacgaccaggagcccccccccgaggcccucgacuucuccgacgacgagaaggagaaggaggccaagcagcgcaagaagucccagauccagggccgcaagaagcucaaguccgaguucaacgagcccggcaccggcaucucccaccgcuacugcggccucggcucccgcccccuccaguccuccgagucccacaagcucuucggcuuccagaugcacaucaaggucaccuucaccugcuacuucucccuccucuccaugcaguga

SEQ ID NO: 46419 - RNA, 1236 nt, Artificial Sequence
  derived and/or modified sequence opt2 from NAGA__Homo_sapiens__XP_005261673
augcuccucaagaccguccuccuccucggccacgucgcccagguccucaugcucgacaacggccuccuccagaccccccccaugggcuggcucgccugggagcgcuuccgcugcaacaucaacugcgacgaggaccccaagaacugcaucuccgagcagcucuucauggagauggccgaccgcauggcccaggacggcuggcgcgacaugggcuacaccuaccucaacaucgacgacugcuggaucggcggccgcgacgccuccggccgccucaugcccgaccccaagcgcuucccccacggcauccccuuccucgccgacuacguccacucccucggccucaagcucggcaucuacgccgacaugggcaacuucaccugcaugggcuaccccggcaccacccucgacaaggucguccaggacgcccagaccuucgccgaguggaaggucgacaugcucaagcucgacggcugcuucuccacccccgaggagcgcgcccagggcuaccccaagauggccgccgcccucaacgccaccggccgccccaucgccuucuccugcuccuggcccgccuacgagggcggccuccccccccgcgucaacuacucccuccucgccgacaucugcaaccucuggcgcaacuacgacgacauccaggacuccuggugguccguccucuccauccucaacugguucgucgagcaccaggacauccuccagcccgucgccggccccggccacuggaacgaccccgacaugcuccucaucggcaacuucggccucucccucgagcagucccgcgcccagauggcccucuggaccguccucgccgccccccuccucauguccaccgaccuccgcaccaucuccgcccagaacauggacauccuccagaacccccucaugaucaagaucaaccaggacccccucggcauccagggccgccgcauccacaaggagaagucccucaucgaggucuacaugcgcccccucuccaacaaggccuccgcccucgucuucuucuccugccgcaccgacaugcccuaccgcuaccacuccucccucggccagcucaacuucaccggcuccgucaucuacgaggcccaggacgucuacuccggcgacaucaucuccggccuccgcgacgagaccaacuucaccgucaucaucaaccccuccggcgucgucaugugguaccucuaccccaucaagaaccucgagaugucccagcaguga

SEQ ID NO: 46420 - RNA, 1173 nt, Artificial Sequence
  derived and/or modified sequence opt2 from NAGK__Homo_sapiens__NP_060037
augcgcacccgcaccggcucccagcucgccgcccgcgaggucaccggcuccggcgccgucccccgccagcucgagggccgccgcugccaggccggccgcgacgccaacggcggcaccuccuccgacggcuccuccuccauggccgccaucuacggcggcgucgagggcggcggcacccgcuccgagguccuccucgucuccgaggacggcaagauccucgccgaggccgacggccucuccaccaaccacuggcucaucggcaccgacaagugcgucgagcgcaucaacgagauggucaaccgcgccaagcgcaaggccggcgucgacccccucgucccccuccgcucccucggccucucccucuccggcggcgaccaggaggacgccggccgcauccucaucgaggagcuccgcgaccgcuuccccuaccucuccgaguccuaccucaucaccaccgacgccgccggcuccaucgccaccgccacccccgacggcggcgucguccucaucuccggcaccggcuccaacugccgccucaucaaccccgacggcuccgaguccggcugcggcggcuggggccacaugaugggcgacgagggcuccgccuacuggaucgcccaccaggccgucaagaucgucuucgacuccaucgacaaccucgaggccgccccccacgacaucggcuacgucaagcaggccauguuccacuacuuccagguccccgaccgccucggcauccucacccaccucuaccgcgacuucgacaagugccgcuucgccggcuucugccgcaagaucgccgagggcgcccagcagggcgacccccucucccgcuacaucuuccgcaaggccggcgagaugcucggccgccacaucgucgccguccuccccgagaucgaccccguccucuuccagggcaagaucggccuccccauccucugcgucggcuccgucuggaaguccugggagcuccucaaggagggcuuccuccucgcccucacccagggccgcgagauccaggcccagaacuucuucuccuccuucacccucaugaagcuccgccacuccuccgcccucggcggcgccucccucggcgcccgccacaucggccaccuccuccccauggacuacuccgccaacgccaucgccuucuacuccuacaccuucuccuga

SEQ ID NO: 46421 - RNA, 2232 nt, Artificial Sequence
  derived and/or modified sequence opt2 from NAGLU__Homo_sapiens__NP_000254
auggaggccgucgccgucgccgccgccgucggcguccuccuccucgccggcgccggcggcgccgccggcgacgaggcccgcgaggccgccgccguccgcgcccucgucgcccgccuccucggccccggccccgccgccgacuucuccgucuccgucgagcgcgcccucgccgccaagcccggccucgacaccuacucccucggcggcggcggcgccgcccgcguccgcguccgcggcuccaccggcgucgccgccgccgccggccuccaccgcuaccuccgcgacuucugcggcugccacgucgccugguccggcucccagcuccgccucccccgcccccuccccgccguccccggcgagcucaccgaggccacccccaaccgcuaccgcuacuaccagaacgucugcacccaguccuacuccuucgucuggugggacugggcccgcugggagcgcgagaucgacuggauggcccucaacggcaucaaccucgcccucgccugguccggccaggaggccaucuggcagcgcgucuaccucgcccucggccucacccaggccgagaucaacgaguucuucaccggccccgccuuccucgccuggggccgcaugggcaaccuccacaccugggacggcccccucccccccuccuggcacaucaagcagcucuaccuccagcaccgcguccucgaccagaugcgcuccuucggcaugacccccguccuccccgccuucgccggccacguccccgaggccgucacccgcgucuucccccaggucaacgucaccaagaugggcuccuggggccacuucaacugcuccuacuccugcuccuuccuccucgcccccgaggaccccaucuuccccaucaucggcucccucuuccuccgcgagcucaucaaggaguucggcaccgaccacaucuacggcgccgacaccuucaacgagaugcagccccccuccuccgagcccuccuaccucgccgccgccaccaccgccgucuacgaggccaugaccgccgucgacaccgaggccgucuggcuccuccagggcuggcucuuccagcaccagccccaguucuggggccccgcccagauccgcgccguccucggcgccgucccccgcggccgccuccucguccucgaccucuucgccgagucccagcccgucuacacccgcaccgccuccuuccagggccagcccuucaucuggugcaugcuccacaacuucggcggcaaccacggccucuucggcgcccucgaggccgucaacggcggccccgaggccgcccgccucuuccccaacuccaccauggucggcaccggcauggcccccgagggcaucucccagaacgaggucgucuacucccucauggccgagcucggcuggcgcaaggaccccguccccgaccucgccgccugggucaccuccuucgccgcccgccgcuacggcgucucccaccccgacgccggcgccgccuggcgccuccuccuccgcuccgucuacaacugcuccggcgaggccugccgcggccacaaccgcuccccccucguccgccgccccucccuccagaugaacaccuccaucugguacaaccgcuccgacgucuucgaggccuggcgccuccuccucaccuccgcccccucccucgccaccucccccgccuuccgcuacgaccuccucgaccucacccgccaggccguccaggagcucgucucccucuacuacgaggaggcccgcuccgccuaccucuccaaggagcucgccucccuccuccgcgccggcggcguccucgccuacgagcuccuccccgcccucgacgagguccucgccuccgacucccgcuuccuccucggcuccuggcucgagcaggcccgcgccgccgccgucuccgaggccgaggccgacuucuacgagcagaacucccgcuaccagcucacccucuggggccccgagggcaacauccucgacuacgccaacaagcagcucgccggccucgucgccaacuacuacaccccccgcuggcgccucuuccucgaggcccucgucgacuccgucgcccagggcauccccuuccagcagcaccaguucgacaagaacgucuuccagcucgagcaggccuucguccucuccaagcagcgcuaccccucccagccccgcggcgacaccgucgaccucgccaagaagaucuuccucaaguacuacccccgcugggucgccggcuccugguga

SEQ ID NO: 46422 - RNA, 1548 nt, Artificial Sequence
  derived and/or modified sequence opt2 from NAGPA__Homo_sapiens__NP_057340
auggccaccuccaccggccgcuggcuccuccuccgccucgcccucuucggcuuccucugggaggccuccggcggccucgacuccggcgccucccgcgacgacgaccuccuccuccccuacccccgcgcccgcgcccgccucccccgcgacugcacccgcguccgcgccggcaaccgcgagcacgaguccuggccccccccccccgccacccccggcgccggcggccucgccguccgcaccuucgucucccacuuccgcgaccgcgccgucgccggccaccucacccgcgccgucgagccccuccgcaccuucuccguccucgagcccggcggccccggcggcugcgccgcccgccgccgcgccaccgucgaggagaccgcccgcgccgccgacugccgcgucgcccagaacggcggcuucuuccgcaugaacuccggcgagugccucggcaacgucgucuccgacgagcgccgcgucuccuccuccggcggccuccagaacgcccaguucggcauccgccgcgacggcacccucgucaccggcuaccucuccgaggaggagguccucgacaccgagaaccccuucguccagcuccucuccggcgucgucuggcucauccgcaacggcuccaucuacaucaacgagucccaggccaccgagugcgacgagacccaggagaccggcuccuucuccaaguucgucaacgucaucuccgcccgcaccgccaucggccacgaccgcaagggccagcucguccucuuccacgccgacggccagaccgagcagcgcggcaucaaccucugggagauggccgaguuccuccucaagcaggacgucgucaacgccaucaaccucgacggcggcggcuccgccaccuucguccucaacggcacccucgccuccuaccccuccgaccacugccaggacaacauguggcgcugcccccgccaggucuccaccgucgucugcguccacgagccccgcugccagccccccgacugccacggccacggcaccugcgucgacggccacugccagugcaccggccacuucuggcgcggccccggcugcgacgagcucgacugcggccccuccaacugcucccagcacggccucugcaccgagaccggcugccgcugcgacgccggcuggaccggcuccaacugcuccgaggagugcccccucggcuggcacggccccggcugccagcgccccugcaagugcgagcaccacugccccugcgaccccaagaccggcaacugcuccgucucccgcgucaagcagugccuccagccccccgaggccacccuccgcgccggcgagcucuccuucuucacccgcaccgccuggcucgcccucacccucgcccucgccuuccuccuccucaucuccaccgccgccaaccucucccuccuccucucccgcgccgagcgcaaccgccgccuccacggcgacuacgccuaccacccccuccaggagaugaacggcgagccccucgccgccgagaaggagcagcccggcggcgcccacaaccccuucaaggacuga

SEQ ID NO: 46423 - RNA, 1605 nt, Artificial Sequence
  derived and/or modified sequence opt2 from NAGS__Homo_sapiens__NP_694551
auggccaccgcccucauggccgucguccuccgcgccgccgccgucgccccccgccuccgcggccgcggcggcaccggcggcgcccgccgccucuccugcggcgcccgccgccgcgccgcccgcggcaccucccccggccgccgccucuccaccgccuggucccagccccagcccccccccgaggaguacgccggcgccgacgacgucucccagucccccgucgccgaggagcccuccuggguccccuccccccgcccccccgucccccacgagucccccgagccccccuccggccgcucccucguccagcgcgacauccaggccuuccucaaccagugcggcgccucccccggcgaggcccgccacuggcucacccaguuccagaccugccaccacuccgccgacaagcccuucgccgucaucgaggucgacgaggagguccucaagugccagcagggcgucuccucccucgccuucgcccucgccuuccuccagcgcauggacaugaagccccucgucguccucggccuccccgcccccaccgcccccuccggcugccucuccuucugggaggccaaggcccagcucgccaaguccugcaagguccucgucgacgcccuccgccacaacgccgccgccgccguccccuucuucggcggcggcuccguccuccgcgccgccgagcccgccccccacgccuccuacggcggcaucgucuccgucgagaccgaccuccuccaguggugccucgaguccggcuccauccccauccucugccccaucggcgagaccgccgcccgccgcuccguccuccucgacucccucgaggucaccgccucccucgccaaggcccuccgccccaccaagaucaucuuccucaacaacaccggcggccuccgcgacuccucccacaagguccucuccaacgucaaccuccccgccgaccucgaccucgucugcaacgccgagugggucuccaccaaggagcgccagcagaugcgccucaucgucgacguccucucccgccucccccaccacuccuccgccgucaucaccgccgccuccacccuccucaccgagcucuucuccaacaagggcuccggcacccucuucaagaacgccgagcgcaugcuccgcguccgcucccucgacaagcucgaccagggccgccucgucgaccucgucaacgccuccuucggcaagaagcuccgcgacgacuaccucgccucccuccgcccccgccuccacuccaucuacgucuccgagggcuacaacgccgccgccauccucaccauggagcccguccucggcggcacccccuaccucgacaaguucgucgucuccuccucccgccagggccagggcuccggccagaugcucugggagugccuccgccgcgaccuccagacccucuucuggcgcucccgcgucaccaaccccaucaaccccugguacuucaagcacuccgacggcuccuucuccaacaagcaguggaucuucuucugguucggccucgccgacauccgcgacuccuacgagcucgucaaccacgccaagggccuccccgacuccuuccacaagcccgccuccgaccccggcuccuga

SEQ ID NO: 46424 - RNA, 4212 nt, Artificial Sequence
  derived and/or modified sequence opt2 from NAIP__Homo_sapiens__NP_004527
auggccacccagcagaaggccuccgacgagcgcaucucccaguucgaccacaaccuccuccccgagcucuccgcccuccucggccucgacgccguccagcucgccaaggagcucgaggaggaggagcagaaggagcgcgccaagaugcagaagggcuacaacucccagaugcgcuccgaggccaagcgccucaagaccuucgucaccuacgagcccuacuccuccuggaucccccaggagauggccgccgccggcuucuacuucaccggcgucaaguccggcauccagugcuucugcugcucccucauccucuucggcgccggccucacccgccuccccaucgaggaccacaagcgcuuccaccccgacugcggcuuccuccucaacaaggacgucggcaacaucgccaaguacgacauccgcgucaagaaccucaagucccgccuccgcggcggcaagaugcgcuaccaggaggaggaggcccgccucgccuccuuccgcaacuggcccuucuacguccagggcaucucccccugcguccucuccgaggccggcuucgucuucaccggcaagcaggacaccguccagugcuucuccugcggcggcugccucggcaacugggaggagggcgacgaccccuggaaggagcacgccaagugguuccccaagugcgaguuccuccgcuccaagaaguccuccgaggagaucacccaguacauccaguccuacaagggcuucgucgacaucaccggcgagcacuucgucaacuccuggguccagcgcgagcuccccauggccuccgccuacugcaacgacuccaucuucgccuacgaggagcuccgccucgacuccuucaaggacuggccccgcgaguccgccgucggcgucgccgcccucgccaaggccggccucuucuacaccggcaucaaggacaucguccagugcuucuccugcggcggcugccucgagaaguggcaggagggcgacgacccccucgacgaccacacccgcugcuuccccaacugccccuuccuccagaacaugaaguccuccgccgaggucacccccgaccuccagucccgcggcgagcucugcgagcuccucgagaccaccuccgaguccaaccucgaggacuccaucgccgucggccccaucguccccgagauggcccagggcgaggcccagugguuccaggaggccaagaaccucaacgagcagcuccgcgccgccuacaccuccgccuccuuccgccacaugucccuccucgacaucuccuccgaccucgccaccgaccaccuccucggcugcgaccucuccaucgccuccaagcacaucuccaagcccguccaggagccccucguccuccccgaggucuucggcaaccucaacuccgucaugugcgucgagggcgaggccggcuccggcaagaccguccuccucaagaagaucgccuuccucugggccuccggcugcugcccccuccucaaccgcuuccagcucgucuucuaccucucccucuccuccacccgccccgacgagggccucgccuccaucaucugcgaccagcuccucgagaaggagggcuccgucaccgagaugugcguccgcaacaucauccagcagcucaagaaccagguccucuuccuccucgacgacuacaaggagaucugcuccaucccccaggucaucggcaagcucauccagaagaaccaccucucccgcaccugccuccucaucgccguccgcaccaaccgcgcccgcgacauccgccgcuaccucgagaccauccucgagaucaaggccuuccccuucuacaacaccgucugcauccuccgcaagcucuucucccacaacaugacccgccuccgcaaguucauggucuacuucggcaagaaccagucccuccagaagauccagaagaccccccucuucgucgccgccaucugcgcccacugguuccaguaccccuucgaccccuccuucgacgacgucgccgucuucaaguccuacauggagcgccucucccuccgcaacaaggccaccgccgagauccucaaggccaccgucuccuccugcggcgagcucgcccucaagggcuucuucuccugcugcuucgaguucaacgacgacgaccucgccgaggccggcgucgacgaggacgaggaccucaccaugugccucauguccaaguucaccgcccagcgccuccgccccuucuaccgcuuccucucccccgccuuccaggaguuccucgccggcaugcgccucaucgagcuccucgacuccgaccgccaggagcaccaggaccucggccucuaccaccucaagcagaucaacucccccaugaugaccgucuccgccuacaacaacuuccucaacuacgucuccucccuccccuccaccaaggccggccccaagaucgucucccaccuccuccaccucgucgacaacaaggagucccucgagaacaucuccgagaacgacgacuaccucaagcaccagcccgagaucucccuccagaugcagcuccuccgcggccucuggcagaucugcccccaggccuacuucuccauggucuccgagcaccuccucguccucgcccucaagaccgccuaccaguccaacaccgucgccgccugcucccccuucguccuccaguuccuccagggccgcacccucacccucggcgcccucaaccuccaguacuucuucgaccaccccgagucccucucccuccuccgcuccauccacuuccccauccgcggcaacaagaccuccccccgcgcccacuucuccguccucgagaccugcuucgacaagucccagguccccaccaucgaccaggacuacgccuccgccuucgagcccaugaacgagugggagcgcaaccucgccgagaaggaggacaacgucaaguccuacauggacaugcagcgccgcgccucccccgaccucuccaccggcuacuggaagcucucccccaagcaguacaagauccccugccucgaggucgacgucaacgacaucgacgucgucggccaggacaugcucgagauccucaugaccgucuucuccgccucccagcgcaucgagcuccaccucaaccacucccgcggcuucaucgaguccauccgccccgcccucgagcucuccaaggccuccgucaccaagugcuccaucuccaagcucgagcucuccgccgccgagcaggagcuccuccucacccuccccucccucgagucccucgaggucuccggcaccauccagucccaggaccagaucuuccccaaccucgacaaguuccucugccucaaggagcucuccgucgaccucgagggcaacaucaacgucuucuccgucauccccgaggaguuccccaacuuccaccacauggagaagcuccucauccagaucuccgccgaguacgaccccuccaagcucgucaagcucauccagaacucccccaaccuccacgucuuccaccucaagugcaacuucuucuccgacuucggcucccucaugaccaugcucgucuccugcaagaagcucaccgagaucaaguucuccgacuccuucuuccaggccguccccuucgucgccucccuccccaacuucaucucccucaagauccucaaccucgagggccagcaguuccccgacgaggagaccuccgagaaguucgccuacauccucggcucccucuccaaccucgaggagcucauccuccccaccggcgacggcaucuaccgcgucgccaagcucaucauccagcagugccagcagcuccacugccuccgcguccucuccuucuucaagacccucaacgacgacuccgucgucgagaucgccaaggucgccaucuccggcggcuuccagaagcucgagaaccucaagcucuccaucaaccacaagaucaccgaggagggcuaccgcaacuucuuccaggcccucgacaacaugcccaaccuccaggagcucgacaucucccgccacuucaccgagugcaucaaggcccaggccaccaccgucaagucccucucccagugcguccuccgccucccccgccucauccgccucaacaugcucuccuggcuccucgacgccgacgacaucgcccuccucaacgucaugaaggagcgccacccccaguccaaguaccucaccauccuccagaaguggauccuccccuucucccccaucauccagaaguga

SEQ ID NO: 46425 - RNA, 5274 nt, Artificial Sequence
  derived and/or modified sequence opt2 from NALCN__Homo_sapiens__XP_011519369
augcaguccgccguccagaccgucguccucugccuccucaccaaggccaaccucuccaugcucaagcgcaagcaguccucccgcgucgaggcccagcccgucaccgacuucggccccgacgagucccucuccgacaacgccgacauccucuggaucaacaagcccuggguccacucccuccuccgcaucugcgccaucaucuccgucaucuccgucugcaugaacacccccaugaccuucgagcacuaccccccccuccaguacgucaccuucacccucgacacccuccucauguuccucuacaccgccgagaugaucgccaagaugcacauccgcggcaucgucaagggcgacuccuccuacgucaaggaccgcuggugcgucuucgacggcuucauggucuucugccucugggucucccucguccuccaggucuucgagaucgccgacaucgucgaccagaugucccccuggggcaugcuccgcaucccccgcccccucaucaugauccgcgccuuccgcaucuacuuccgcuucgagcucccccgcacccgcaucaccaacauccucaagcgcuccggcgagcagaucugguccgucuccaucuuccuccucuucuuccuccuccucuacggcauccucggcguccagauguucggcaccuucaccuaccacugcgucgucaacgacaccaagcccggcaacgucaccuggaacucccucgccauccccgacacccacugcucccccgagcucgaggagggcuaccagugcccccccggcuucaagugcauggaccucgaggaccucggccucucccgccaggagcucggcuacuccggcuucaacgagaucggcaccuccaucuucaccgucuacgaggccgccucccaggagggcugggucuuccucauguaccgcgccaucgacuccuucccccgcuggcgcuccuacuucuacuucaucacccucaucuucuuccucgccuggcucgucaagaacgucuucaucgccgucaucaucgagaccuucgccgagauccgcguccaguuccagcagauguggggcucccgcuccuccaccaccuccaccgccaccacccagauguuccacgaggacgccgccggcggcuggcagcucgucgccgucgacgucaacaagccccagggccgcgcccccgccugccuccagaagaugaugcgcuccuccgucuuccacauguucauccucuccauggucaccgucgacgucaucgucgccgccuccaacuacuacaagggcgagaacuuccgccgccaguacgacgaguucuaccucgccgaggucgccuucaccguccucuucgaccucgaggcccuccucaagaucuggugccucggcuucaccggcuacaucuccuccucccuccacaaguucgagcuccuccucgucaucggcaccacccuccacgucuaccccgaccucuaccacucccaguucaccuacuuccagguccuccgcgucguccgccucaucaagaucucccccgcccucgaggacuucgucuacaagaucuucggccccggcaagaagcucggcucccucgucgucuucaccgccucccuccucaucgucauguccgccaucucccuccagauguucugcuucgucgaggagcucgaccgcuucaccaccuucccccgcgccuucauguccauguuccagauccucacccaggagggcugggucgacgucauggaccagacccucaacgccgucggccacaugugggcccccgucgucgccaucuacuucauccucuaccaccucuucgccacccucauccuccucucccucuucgucgccgucauccucgacaaccucgagcucgacgaggaccucaagaagcucaagcagcucaagcaguccgaggccaacgccgacaccaaggagaagcucccccuccgccuccgcaucuucgagaaguuccccaaccgcccccagauggucaagaucuccaagcuccccuccgacuucaccguccccaagauccgcgaguccuucaugaagcaguucaucgaccgccagcagcaggacaccugcugccuccuccgcucccuccccaccaccuccuccuccuccugcgaccacuccaagcgcuccgccaucgaggacaacaaguacaucgaccagaagcuccgcaaguccgucuucuccauccgcgcccgcaaccuccucgagaaggagaccgccgucaccaagauccuccgcgccugcacccgccagcgcaugcucuccggcuccuucgagggccagcccgccaaggagcgcuccauccucuccguccagcaccacauccgccaggagcgccgcucccuccgccacggcuccaacucccagcgcaucucccgcggcaagucccucgagacccucacccaggaccacuccaacaccguccgcuaccgcaacgcccagcgcgaggacuccgagaucaagaugauccaggagaagaaggagcaggccgagaugaagcgcaagguccaggaggaggagcuccgcgagaaccaccccuacuucgacaagccccucuucaucgucggccgcgagcaccgcuuccgcaacuucugccgcgucgucguccgcgcccgcuucaacgccuccaagaccgaccccgucaccggcgccgucaagaacaccaaguaccaccagcucuacgaccuccucggccucgucaccuaccucgacugggucaugaucaucgucaccaucugcuccugcaucuccaugauguucgagucccccuuccgccgcgucaugcacgcccccacccuccagaucgccgaguacgucuucgucaucuucauguccaucgagcucaaccucaagaucauggccgacggccucuucuucacccccaccgccgucauccgcgacuucggcggcgucauggacaucuucaucuaccucgucucccucaucuuccucugcuggaugccccagaacguccccgccgaguccggcgcccagcuccucaugguccuccgcugccuccgcccccuccgcaucuucaagcucgucccccagaugcgcaaggucguccgcgagcucuucuccggcuucaaggagaucuuccucgucuccauccuccuccucacccucaugcucgucuucgccuccuucggcguccagcucuucgccggcaagcucgccaagugcaacgaccccaacaucauccgccgcgaggacugcaacggcaucuuccgcaucaacgucuccgucuccaagaaccucaaccucaagcuccgccccggcgagaagaagcccggcuucugggucccccgcgucugggccaacccccgcaacuucaacuucgacaacgucggcaacgccaugcucgcccucuucgagguccucucccucaagggcugggucgagguccgcgacgucaucauccaccgcgucggccccauccacggcaucuacauccacgucuucgucuuccucggcugcaugaucggccucacccucuucgucggcgucgucaucgccaacuucaacgagaacaagggcaccgcccuccucaccgucgaccagcgccgcugggaggaccucaagucccgccucaagaucgcccagccccuccaccuccccccccgccccgacaacgacggcuuccgcgccaagauguacgacaucacccagcaccccuucuucaagcgcaccaucgcccuccucguccucgcccaguccguccuccucuccgucaagugggacgucgaggaccccgucaccgucccccucgccaccauguccgucgucuucaccuucaucuucguccucgaggucaccaugaagaucaucgccaugucccccgccggcuucuggcagucccgccgcaaccgcuacgaccuccucgucaccucccucggcgucgucugggucguccuccacuucgcccuccucaacgccuacaccuacaugaugggcgccugcgucaucgucuuccgcuucuucuccaucugcggcaagcacgucacccucaagaugcuccuccucaccgucgucgucuccauguacaaguccuucuucaucaucgucggcauguuccuccuccuccucugcuacgccuucgccggcgucguccucuucggcaccgucaaguacggcgagaacaucaaccgccacgccaacuucuccuccgccggcaaggccaucaccguccucuuccgcaucgucaccggcgaggacuggaacaagaucaugcacgacugcaugguccagccccccuucugcacccccgacgaguucaccuacugggccaccgacugcggcaacuacgccggcgcccucauguacuucugcuccuucuacgucaucaucgccuacaucaugcucaaccuccucgucgccaucaucgucgagaacuucucccucuucuacuccaccgaggaggaccagcuccucuccuacaacgaccuccgccacuuccagaucaucuggaacauggucgacgacaagcgcgagggcgucauccccaccuuccgcgucaaguuccuccuccgccuccuccgcggccgccucgaggucgaccucgacaaggacaagcuccucuucaagcacaugugcuacgagauggagcgccuccacaacggcggcgacgucaccuuccacgacguccucuccaugcucuccuaccgcuccgucgacauccgcaagucccuccagcucgaggagcuccucgcccgcgagcagcucgaguacaccaucgaggaggaggucgccaagcagaccauccgcauguggcucaagaagugccucaagcgcauccgcgccaagcagcagcaguccugcuccaucauccacucccuccgcgagucccagcagcaggagcucucccgcuuccucaacccccccuccaucgagaccacccagcccuccgaggacaccaacgccaacucccaggacaacuccaugcagcccgagaccuccucccagcagcagcuccucucccccacccucuccgaccgcggcggcucccgccaggacgccgccgacgccggcaagccccagcgcaaguucggccaguggcgccuccccuccgcccccaagcccaucucccacuccgucuccuccgucaaccuccgcuucggcggccgcaccaccaugaaguccgucgucugcaagaugaaccccaugaccgacgccgccuccugcggcuccgaggucaagaagugguggacccgccagcucaccgucgaguccgacgaguccggcgacgaccuccucgacaucuga

SEQ ID NO: 46426 - RNA, 1476 nt, Artificial Sequence
  derived and/or modified sequence opt2 from NAMPT__Homo_sapiens__XP_005250157
augaaccccgccgccgaggccgaguucaacauccuccucgccaccgacuccuacaaggucacccacuacaagcaguacccccccaacaccuccaaggucuacuccuacuucgagugccgcgagaagaagaccgagaacuccaagcuccgcaaggucaaguacgaggagaccgucuucuacggccuccaguacauccucaacaaguaccucaagggcaaggucgucaccaaggagaagauccaggaggccaaggacgucuacaaggagcacuuccaggacgacgucuucaacgagaagggcuggaacuacauccucgagaaguacgacggccaccuccccaucgagaucaaggccguccccgagggcuucgucaucccccgcggcaacguccucuucaccgucgagaacaccgaccccgagugcuacuggcucaccaacuggaucgagaccauccucguccaguccugguaccccaucaccgucgccaccaacucccgcgagcagaagaagauccucgccaaguaccuccucgagaccuccggcaaccucgacggccucgaguacaagcuccacgacuucggcuaccgcggcgucuccucccaggagaccgccggcaucggcgccuccgcccaccucgucaacuucaagggcaccgacaccgucgccggccucgcccucaucaagaaguacuacggcaccaaggaccccguccccggcuacuccguccccgccgccgagcacuccaccaucaccgccuggggcaaggaccacgagaaggacgccuucgagcacaucgucacccaguucuccuccguccccgucuccgucgucuccgacuccuacgacaucuacaacgccugcgagaagaucuggggcgaggaccuccgccaccucaucgucucccgcuccacccaggccccccucaucauccgccccgacuccggcaacccccucgacaccguccucaagguccucgagauccucggcaagaaguuccccgucaccgagaacuccaagggcuacaagcuccucccccccuaccuccgcgucauccagggcgacggcgucgacaucaacacccuccaggagaucgucgagggcaugaagcagaagaugugguccaucgagaacaucgccuucggcuccggcggcggccuccuccagaagcucacccgcgaccuccucaacugcuccuucaagugcuccuacgucgucaccaacggccucggcaucaacgucuucaaggaccccgucgccgaccccaacaagcgcuccaagaagggccgccucucccuccaccgcacccccgccggcaacuucgucacccucgaggagggcaagggcgaccucgaggaguacggccaggaccuccuccacaccgucuucaagaacggcaaggucaccaaguccuacuccuucgacgagauccgcaagaacgcccagcucaacaucgagcucgaggccgcccaccacuga

SEQ ID NO: 46427 - RNA, 870 nt, Artificial Sequence
  derived and/or modified sequence opt2 from NANOG__Homo_sapiens__NP_001284627
auguccgucgaccccgccugcccccagucccuccccugcuucgaggccuccgacugcaaggaguccucccccaugcccgucaucugcggccccgaggagaacuaccccucccuccagauguccuccgccgagaugccccacaccgagaccgucuccccccuccccuccuccauggaccuccucauccaggacucccccgacuccuccaccucccccaagggcaagcagcccaccuccgccgagaaguccgucgccaagaaggaggacaagguccccgucaagaagcagaagacccgcaccgucuucuccuccacccagcucugcguccucaacgaccgcuuccagcgccagaaguaccucucccuccagcagaugcaggagcucuccaacauccucaaccucuccuacaagcaggucaagaccugguuccagaaccagcgcaugaaguccaagcgcuggcagaagaacaacuggcccaagaacuccaacggcgucacccagggcugccucgucaaccccaccggcaaccuccccaugugguccaaccagaccuggaacaacuccaccugguccaaccagacccagaacauccaguccugguccaaccacuccuggaacacccagaccuggugcacccaguccuggaacaaccaggccuggaacucccccuucuacaacugcggcgaggagucccuccaguccugcaugcaguuccagcccaacucccccgccuccgaccucgaggccgcccucgaggccgccggcgagggccucaacgucauccagcagaccacccgcuacuucuccaccccccagaccauggaccucuuccucaacuacuccaugaacaugcagcccgaggacgucuga

SEQ ID NO: 46428 - RNA, 879 nt, Artificial Sequence
  derived and/or modified sequence opt2 from NANOS1__Homo_sapiens__NP_955631
auggaggccuuccccugggccccccgcuccccccgccgcggccgcgcccccccccccauggcccucguccccuccgcccgcuacgucuccgcccccggccccgcccacccccagcccuucuccuccuggaacgacuaccucggccucgccacccucaucaccaaggccgucgacggcgagccccgcuucggcugcgcccgcggcggcaacggcggcggcggcuccccccccuccuccuccuccuccuccugcugcuccccccacaccggcgccggccccggcgcccucggccccgcccucggcccccccgacuacgacgaggacgacgacgacgacuccgacgagcccggcucccgcggccgcuaccucggcuccgcccucgagcuccgcgcccucgagcucugcgccggccccgccgaggccggccuccucgaggagcgcuucgccgagcucucccccuucgccggccgcgccgccgccguccuccucggcugcgcccccgccgccgccgccgccgccaccaccaccuccgaggccaccccccgcgaggagcgcgcccccgccugggccgccgagccccgccuccacgccgccuccggcgccgccgccgcccgccuccucaagcccgagcuccaggucugcgucuucugccgcaacaacaaggaggccauggcccucuacaccacccacauccucaagggccccgacggccgcguccucugccccguccuccgccgcuacaccugcccccucugcggcgccuccggcgacaacgcccacaccaucaaguacugcccccucuccaaggucccccccccccccgcccgcccccccccccgcuccgcccgcgacggcccccccggcaagaagcuccgcuga

SEQ ID NO: 46429 - RNA, 417 nt, Artificial Sequence
  derived and/or modified sequence opt2 from NANOS2__Homo_sapiens__NP_001025032
augcagcucccccccuucgacauguggaaggacuacuucaaccucucccaggucgucugggcccucaucgccucccgcggccagcgccucgagacccaggagaucgaggagcccucccccggccccccccucggccaggaccagggccucggcgcccccggcgccaacggcggccucggcacccucugcaacuucugcaagcacaacggcgagucccgccacgucuacuccucccaccagcucaagacccccgacggcgucgucgucugccccauccuccgccacuacgucugccccgucugcggcgccaccggcgaccaggcccacacccucaaguacugcccccucaacggcggccagcagucccucuaccgccgcuccggccgcaacuccgccggccgccgcgucaagcgcuga

SEQ ID NO: 46430 - RNA, 579 nt, Artificial Sequence
  derived and/or modified sequence opt2 from NANOS3__Homo_sapiens__NP_001092092
augggcaccuucgaccucuggaccgacuaccucggccucgcccaccucguccgcgcccucuccggcaaggagggccccgagacccgccucuccccccagcccgagcccgagcccaugcucgagcccgucuccgcccucgagcccaugcccgcccccgaguccguccccguccccggccccaaggaccagaagcgcucccucgaguccucccccgcccccgagcgccucugcuccuucugcaagcacaacggcgagucccgcgccaucuaccagucccacguccucaaggacgaggccggccgcguccucugccccauccuccgcgacuacgucugcccccagugcggcgccacccgcgagcgcgcccacacccgccgcuucugcccccucaccggccagggcuacaccuccgucuacucccacaccacccgcaacuccgccggcaagaagcucguccgccccgacaaggccaagacccaggacaccggccaccgccgcggcggcggcggcggcgccggcuuccgcggcgccggcaaguccgagcccucccccuccugcucccccuccauguccaccuga

SEQ ID NO: 46431 - RNA, 1080 nt, Artificial Sequence
  derived and/or modified sequence opt2 from NANS__Homo_sapiens__NP_061819
augccccucgagcucgagcucugccccggccgcugggucggcggccagcaccccugcuucaucaucgccgagaucggccagaaccaccagggcgaccucgacgucgccaagcgcaugauccgcauggccaaggagugcggcgccgacugcgccaaguuccagaaguccgagcucgaguucaaguucaaccgcaaggcccucgagcgccccuacaccuccaagcacuccuggggcaagaccuacggcgagcacaagcgccaccucgaguucucccacgaccaguaccgcgagcuccagcgcuacgccgaggaggucggcaucuucuucaccgccuccggcauggacgagauggccgucgaguuccuccacgagcucaacguccccuucuucaaggucggcuccggcgacaccaacaacuuccccuaccucgagaagaccgccaagaagggccgccccauggucaucuccuccggcaugcaguccauggacaccaugaagcaggucuaccagaucgucaagccccucaaccccaacuucugcuuccuccagugcaccuccgccuacccccuccagcccgaggacgucaaccuccgcgucaucuccgaguaccagaagcucuuccccgacauccccaucggcuacuccggccacgagaccggcaucgccaucuccgucgccgccgucgcccucggcgccaagguccucgagcgccacaucacccucgacaagaccuggaagggcuccgaccacuccgccucccucgagcccggcgagcucgccgagcucguccgcuccguccgccucgucgagcgcgcccucggcucccccaccaagcagcuccuccccugcgagauggccugcaacgagaagcucggcaaguccgucgucgccaaggucaagauccccgagggcaccauccucaccauggacaugcucaccgucaaggucggcgagcccaagggcuacccccccgaggacaucuucaaccucgucggcaagaagguccucgucaccgucgaggaggacgacaccaucauggaggagcucgucgacaaccacggcaagaagaucaaguccuga

SEQ ID NO: 46432 - RNA, 1176 nt, Artificial Sequence
  derived and/or modified sequence opt2 from NAP1L1__Homo_sapiens__NP_004528
auggccgacaucgacaacaaggagcaguccgagcucgaccaggaccucgacgacgucgaggaggucgaggaggaggagaccggcgaggagaccaagcucaaggcccgccagcucaccguccagaugaugcagaacccccagauccucgccgcccuccaggagcgccucgacggccucgucgagacccccaccggcuacaucgagucccucccccgcgucgucaagcgccgcgucaacgcccucaagaaccuccaggucaagugcgcccagaucgaggccaaguucuacgaggagguccacgaccucgagcgcaaguacgccguccucuaccagccccucuucgacaagcgcuucgagaucaucaacgccaucuacgagcccaccgaggaggagugcgaguggaagcccgacgaggaggacgagaucuccgaggagcucaaggagaaggccaagaucgaggacgagaagaaggacgaggagaaggaggaccccaagggcauccccgaguucuggcucaccgucuucaagaacgucgaccuccucuccgacaugguccaggagcacgacgagcccauccucaagcaccucaaggacaucaaggucaaguucuccgacgccggccagcccauguccuucguccucgaguuccacuucgagcccaacgaguacuucaccaacgagguccucaccaagaccuaccgcaugcgcuccgagcccgacgacuccgaccccuucuccuucgacggccccgagaucaugggcugcaccggcugccagaucgacuggaagaagggcaagaacgucacccucaagaccaucaagaagaagcagaagcacaagggccgcggcaccguccgcaccgucaccaagaccgucuccaacgacuccuucuucaacuucuucgccccccccgagguccccgaguccggcgaccucgacgacgacgccgaggccauccucgccgccgacuucgagaucggccacuuccuccgcgagcgcaucaucccccgcuccguccucuacuucaccggcgaggccaucgaggacgacgacgacgacuacgacgaggagggcgaggaggccgacgaggagggcgaggaggagggcgacgaggagaacgaccccgacuacgaccccaagaaggaccagaaccccgccgagugcaagcagcaguga

SEQ ID NO: 46433 - RNA, 1521 nt, Artificial Sequence
  derived and/or modified sequence opt2 from NAP1L3__Homo_sapiens__NP_004529
auggccgaggccgacuucaagauggucuccgagcccgucgcccacggcgucgccgaggaggagauggccuccuccaccuccgacuccggcgaggaguccgacuccuccuccuccuccuccuccaccuccgacuccuccuccuccuccuccaccuccggcuccuccuccggcuccggcuccuccuccuccuccuccggcuccaccuccucccgcucccgccucuaccgcaagaagcgcguccccgagcccucccgccgcgcccgccgcgccccccucggcaccaacuucgucgaccgccucccccaggccguccgcaaccgcguccaggcccuccgcaacauccaggacgagugcgacaaggucgacacccucuuccucaaggccauccacgaccucgagcgcaaguacgccgagcucaacaagccccucuacgaccgccgcuuccagaucaucaacgccgaguacgagcccaccgaggaggagugcgaguggaacuccgaggacgaggaguucuccuccgacgaggagguccaggacaacacccccuccgagaugcccccccucgagggcgaggaggaggagaaccccaaggagaaccccgaggucaaggccgaggagaaggagguccccaaggagauccccgaggucaaggacgaggagaaggagguccccaaggagauccccgaggucaaggccgaggagaaggccgacuccaaggacugcauggaggccacccccgaggucaaggaggaccccaaggaggucccccaggucaaggccgacgacaaggagcagcccaaggccaccgaggccaaggcccgcgccgccguccgcgagacccacaagcgcguccccgaggagcgccuccaggacuccgucgaccucaagcgcgcccgcaagggcaagcccaagcgcgaggaccccaagggcauccccgacuacuggcucaucguccucaagaacgucgacaagcucggccccaugauccagaaguacgacgagcccauccucaaguuccucuccgacgucucccucaaguucuccaagcccggccagcccgucuccuacaccuucgaguuccacuuccuccccaaccccuacuuccgcaacgagguccucgucaagaccuacaucaucaaggccaagcccgaccacaacgaccccuucuucuccuggggcugggagaucgaggacugcaagggcugcaagaucgacuggcgccgcggcaaggacgucaccgucaccaccacccagucccgcaccaccgccaccggcgagaucgagauccagccccgcgucguccccaacgccuccuucuucaacuucuucuccccccccgagauccccaugaucggcaagcucgagccccgcgaggacgccauccucgacgaggacuucgagaucggccagauccuccacgacaacgucauccucaaguccaucuacuacuacaccggcgaggucaacggcaccuacuaccaguucggcaagcacuacggcaacaagaaguaccgcaaguga

SEQ ID NO: 46434 - RNA, 1128 nt, Artificial Sequence
  derived and/or modified sequence opt2 from NAP1L4__Homo_sapiens__NP_005960
auggccgaccacuccuucuccgacggcguccccuccgacuccgucgaggccgccaagaacgccuccaacaccgagaagcucaccgaccaggucaugcagaacccccgcguccucgccgcccuccaggagcgccucgacaacgucccccacacccccuccuccuacaucgagacccuccccaaggccgucaagcgccgcaucaacgcccucaagcagcuccagguccgcugcgcccacaucgaggccaaguucuacgaggagguccacgaccucgagcgcaaguacgccgcccucuaccagccccucuucgacaagcgccgcgaguucaucaccggcgacgucgagcccaccgacgccgaguccgaguggcacuccgagaacgaggaggaggagaagcucgccggcgacaugaaguccaaggucgucgucaccgagaaggccgccgccaccgccgaggagcccgaccccaagggcauccccgaguucugguucaccaucuuccgcaacgucgacaugcucuccgagcucguccaggaguacgacgagcccauccucaagcaccuccaggacaucaaggucaaguucuccgaccccggccagcccauguccuucguccucgaguuccacuucgagcccaacgacuacuucaccaacuccguccucaccaagaccuacaagaugaaguccgagcccgacaaggccgaccccuucuccuucgagggccccgagaucgucgacugcgacggcugcaccaucgacuggaagaagggcaagaacgucaccgucaagaccaucaagaagaagcagaagcacaagggccgcggcaccguccgcaccaucaccaagcagguccccaacgaguccuucuucaacuucuucaacccccucaaggccuccggcgacggcgagucccucgacgaggacuccgaguucacccucgccuccgacuucgagaucggccacuucuuccgcgagcgcaucgucccccgcgccguccucuacuucaccggcgaggccaucgaggacgacgacaacuucgaggagggcgaggagggcgaggaggaggagcucgagggcgacgaggagggcgaggacgaggacgacgccgagaucaaccccaaggucuga

SEQ ID NO: 46435 - RNA, 549 nt, Artificial Sequence
  derived and/or modified sequence opt2 from NAP1L5__Homo_sapiens__NP_715638
auggccgacuccgagaaccagggccccgccgagcccucccaggccgccgccgccgccgaggccgccgccgaggaggucauggccgagggcggcgcccagggcggcgacugcgacuccgccgccggcgaccccgacuccgccgccggccagauggccgaggagccccagacccccgccgagaacgcccccaagcccaagaacgacuucaucgagucccuccccaacuccgucaagugccgcguccucgcccucaagaagcuccagaagcgcugcgacaagaucgaggccaaguucgacaaggaguuccaggcccucgagaagaaguacaacgacaucuacaagccccuccucgccaagauccaggagcucaccggcgagauggagggcugcgccuggacccucgagggcgaggaggaggaggaggaggaguacgaggacgacgaggaggagggcgaggacgaggaggaggaggaggccgccgccgaggccgccgccggcgccaagcacgacgacgcccacgccgagaugcccgacgacgccaagaaguga

SEQ ID NO: 46436 - RNA, 888 nt, Artificial Sequence
  derived and/or modified sequence opt2 from NAPA__Homo_sapiens__NP_003818
auggacaacuccggcaaggaggccgaggccauggcccuccucgccgaggccgagcgcaaggucaagaacucccaguccuucuucuccggccucuucggcggcuccuccaagaucgaggaggccugcgagaucuacgcccgcgccgccaacauguucaagauggccaagaacugguccgccgccggcaacgccuucugccaggccgcccagcuccaccuccagcuccaguccaagcacgacgccgccaccugcuucgucgacgccggcaacgccuucaagaaggccgacccccaggaggccaucaacugccucaugcgcgccaucgagaucuacaccgacaugggccgcuucaccaucgccgccaagcaccacaucuccaucgccgagaucuacgagaccgagcucgucgacaucgagaaggccaucgcccacuacgagcaguccgccgacuacuacaagggcgaggaguccaacuccuccgccaacaagugccuccucaaggucgccggcuacgccgcccuccucgagcaguaccagaaggccaucgacaucuacgagcaggucggcaccaacgccauggacuccccccuccucaaguacuccgccaaggacuacuucuucaaggccgcccucugccacuucugcaucgacaugcucaacgccaagcucgccguccagaaguacgaggagcucuuccccgccuucuccgacucccgcgagugcaagcucaugaagaagcuccucgaggcccacgaggagcagaacgucgacuccuacaccgaguccgucaaggaguacgacuccaucucccgccucgaccaguggcucaccaccaugcuccuccgcaucaagaagaccauccagggcgacgaggaggaccuccgcuga

SEQ ID NO: 46437 - RNA, 1182 nt, Artificial Sequence
  derived and/or modified sequence opt2 from NAPEPLD__Homo_sapiens__XP_006725119
auggacgagaacgaguccaaccagucccucaugaccuccucccaguaccccaaggaggccguccgcaagcgccagaacuccgcccgcaacuccggcgccuccgacuccucccgcuucucccgcaaguccuucaagcucgacuaccgccucgaggaggacgucaccaaguccaagaagggcaaggacggccgcuucgucaaccccuggcccaccuggaagaaccccuccauccccaacguccuccgcuggcucaucauggagaaggaccacuccuccguccccuccuccaaggaggagcucgacaaggagcuccccguccucaagcccuacuucaucaccaaccccgaggaggccggcguccgcgaggccggccuccgcgucaccuggcucggccacgccaccgucauggucgagauggacgagcucaucuuccucaccgaccccaucuucuccucccgcgccucccccucccaguacaugggccccaagcgcuuccgccgcucccccugcaccaucuccgagcucccccccaucgacgccguccucaucucccacaaccacuacgaccaccucgacuacaacuccgucaucgcccucaacgagcgcuucggcaacgagcuccgcugguucgucccccucggccuccucgacuggaugcagaagugcggcugcgagaacgucaucgagcucgacuggugggaggagaacugcguccccggccacgacaaggucaccuucgucuucacccccucccagcacuggugcaagcgcacccucauggacgacaacaagguccucuggggcuccugguccguccucggccccuggaaccgcuucuucuucgccggcgacaccggcuacugccccgccuucgaggagaucggcaagcgcuucggccccuucgaccucgccgccauccccaucggcgccuacgagccccgcugguucaugaaguaccagcacgucgaccccgaggaggccguccgcauccacaccgacguccagaccaagaaguccauggccauccacuggggcaccuucgcccucgccaacgagcacuaccucgagccccccgucaagcucaacgaggcccucgagcgcuacggccucaacgccgaggacuucuucguccucaagcacggcgagucccgcuaccucaacaacgacgacgagaacuucuga

SEQ ID NO: 46438 - RNA, 939 nt, Artificial Sequence
  derived and/or modified sequence opt2 from NAPG__Homo_sapiens__NP_003817
auggccgcccagaagaucaacgagggccucgagcaccucgccaaggccgagaaguaccucaagaccggcuuccucaaguggaagcccgacuacgacuccgccgccuccgaguacggcaaggccgccgucgccuucaagaacgccaagcaguucgagcaggccaaggacgccugccuccgcgaggccgucgcccacgagaacaaccgcgcccucuuccacgccgccaaggccuacgagcaggccggcaugaugcucaaggagaugcagaagcuccccgaggccguccagcucaucgagaaggccuccaugauguaccucgagaacggcacccccgacaccgccgccauggcccucgagcgcgccggcaagcucaucgagaacgucgaccccgagaaggccguccagcucuaccagcagaccgccaacgucuucgagaacgaggagcgccuccgccaggccgucgagcuccucggcaaggccucccgccuccucguccgcggccgccgcuucgacgaggccgcccucuccauccagaaggagaagaacaucuacaaggagaucgagaacuaccccaccugcuacaagaagaccaucgcccagguccucguccaccuccaccgcaacgacuacgucgccgccgagcgcugcguccgcgaguccuacuccauccccggcuucaacggcuccgaggacugcgccgcccucgagcagcuccucgagggcuacgaccagcaggaccaggaccaggucuccgacgucugcaacuccccccucuucaaguacauggacaacgacuacgccaagcucggccucucccucgucguccccggcggcggcaucaagaagaagucccccgccaccccccaggccaagcccgacggcgucaccgccaccgccgccgacgaggaggaggacgaguacuccggcggccucugcuga

SEQ ID NO: 46439 - RNA, 1578 nt, Artificial Sequence
  derived and/or modified sequence opt2 from NAPRT__Homo_sapiens__NP_001273758
auggccgccgagcaggaccccgaggcccgcgccgccgcccgcccccuccucaccgaccucuaccaggccaccauggcccucggcuacuggcgcgccggccgcgcccgcgacgccgccgaguucgagcucuucuuccgccgcugccccuucggcggcgccuucgcccucgccgccggccuccgcgacugcguccgcuuccuccgcgccuuccgccuccgcgacgccgacguccaguuccucgccuccguccucccccccgacaccgaccccgccuucuucgagcaccuccgcgcccucgacugcuccgaggucaccguccgcgcccuccccgagggcucccucgccuuccccggcgucccccuccuccaggucuccggcccccuccucgucguccagcuccucgagaccccccuccucugccucgucuccuacgccucccucgucgccaccaacgccgcccgccuccgccucaucgccggccccgagaagcgccuccucgagaugggccuccgccgcgcccagggccccgacggcggccucaccgccuccaccuacuccuaccucggcggcuucgacuccuccuccaacguccucgccggccagcuccgcggcguccccgucgccggcacccucgcccacuccuucgucaccuccuucuccggcuccgaggucccccccgaccccaugcucgcccccgccgccggcgagggccccggcgucgaccucgccgccaaggcccaggucuggcucgagcaggucugcgcccaccucggccucggcguccaggagccccaccccggcgagcgcgccgccuucgucgccuacgcccucgccuucccccgcgccuuccagggccuccucgacaccuacuccgucuggcgcuccggccuccccaacuuccucgccgucgcccucgcccucggcgagcucggcuaccgcgccgucggcguccgccucgacuccggcgaccuccuccagcaggcccaggagauccgcaaggucuuccgcgccgccgccgcccaguuccagguccccuggcucgaguccguccucaucgucgucuccaacaacaucgacgaggaggcccucgcccgccucgcccaggagggcuccgaggucaacgucaucggcaucggcaccuccgucgucaccugcccccagcagcccucccucggcggcgucuacaagcucgucgccgucggcggccagccccgcaugaagcucaccgaggaccccgagaagcagacccuccccggcuccaaggccgccuuccgccuccucggcuccgacggcuccccccucauggacaugcuccagcucgccgaggagcccgucccccaggccggccaggagcuccgcgucuggccccccggcgcccaggagcccugcaccguccgccccgcccagcucugcgagccccuccccucccucgccgagucccgcgcccucgcccagcucucccucucccgccucucccccgagcaccgccgccuccgcucccccgcccaguaccaggucguccucuccgagcgccuccaggcccucgucaacucccucugcgccggccagucccccuga

SEQ ID NO: 46440 - RNA, 1263 nt, Artificial Sequence
  derived and/or modified sequence opt2 from NAPSA__Homo_sapiens__XP_011525842
auguccccccccccccuccuccagccccuccuccuccuccucccccuccucaacgucgagcccuccggcgccacccucauccgcaucccccuccaccgcguccagcccggccgccgcauccucaaccuccuccgcggcuggcgcgagcccgccgagcuccccaagcucggcgcccccucccccggcgacaagcccaucuucgucccccucuccaacuaccgcgacguccaguacuucggcgagaucggccucggcacccccccccagaacuucaccgucgccuucgacaccggcuccuccaaccucuggguccccucccgccgcugccacuucuucuccguccccugcuggcuccaccaccgcuucgaccccaaggccuccuccuccuuccaggccaacggcaccaaguucgccauccaguacggcaccggccgcgucgacggcauccucuccgaggacaagcucaccaucggcggcaucaagggcgccuccgucaucuucggcgaggcccucugggagcccucccucgucuucgccuucgcccacuucgacggcauccucggccucggcuuccccauccucuccgucgagggcguccgcccccccauggacguccucgucgagcagggccuccucgacaagcccgucuucuccuucuaccucaaccgcgaccccgaggagcccgacggcggcgagcucguccucggcggcuccgaccccgcccacuacauccccccccucaccuucguccccgucaccguccccgccuacuggcagauccacauggagcgcgucaaggucggccccggccucacccucugcgccaagggcugcgccgccauccucgacaccggcaccucccucaucaccggccccaccgaggagauccgcgcccuccacgccgccaucggcggcaucccccuccucgccggcgaguacaucauccucugcuccgagauccccaagcuccccgccgucuccuuccuccucggcggcgucugguucaaccucaccgcccacgacuacgucauccagaccacccgcaacggcguccgccucugccucuccggcuuccaggcccucgacguccccccccccgccggccccuucuggauccucggcgacgucuuccucggcaccuacgucgccgucuucgaccgcggcgacaugaaguccuccgcccgcgucggccucgcccgcgcccgcacccgcggcgccgaccucggcuggggcgagaccgcccaggcccaguuccccggcuga

SEQ ID NO: 46441 - RNA, 1125 nt, Artificial Sequence
  derived and/or modified sequence opt2 from NARFL__Homo_sapiens__NP_001291728
auggccgcccccucccagcagcgccucgucgucgucuccgucuccccccagucccgcgccucccucgccgcccgcuuccagcucaaccccaccgacaccgcccgcaagcucaccuccuucuucaagaagaucggcguccacuucgucuucgacaccgccuucucccgccacuucucccuccucgagucccagcgcgaguucguccgccgcuuccgcggccaggccgacugccgccaggcccucccccuccucgccuccgccugccccggcuggaucugcuacgccgagaagacccacggcuccuucauccucccccacaucuccaccgcccgcuccccccagcaggucaugggcucccucgucaaggacuucuucgcccagcagcagcaccucacccccgacaagaucuaccacgucaccgucaugcccugcuacgacaagaagcucgaggccucccgccccgacuucuucaaccaggagcaccagacccgcgacgucgacugcguccucaccaccggcgaggucuuccgccuccucgaggaggagggcgucucccuccccgaccucgagcccgccccccucgacucccucugcuccggcgccuccgccgaggagcccaccucccaccgcggcggcggcuccggcggcuaccucgagcacgucuuccgccacgccgcccgcgagcucuucggcauccacgucgccgaggucaccuacaagccccuccgcaacaaggacuuccaggaggucacccucgagaaggagggccagguccuccuccacuucgccauggccuacggcuuccgcaacauccagaaccucguccagcgccucaagcgcggccgcugccccuaccacuacgucgaggucauggccugccccuccggcugccucaacggcggcggccagcuccaggcccccgaccgccccucccgcgagcuccuccagcacgucgagcgccucuacggcaugguccgcgccgaggcccccgaggacgcccccggcguccaggagcucuacacccacuggcuccagggcaccgacuccgagugcgccggccgccuccuccacacccaguaccacgccgucgagaaggccuccaccggccucggcauccgcugguga

SEQ ID NO: 46442 - RNA, 597 nt, Artificial Sequence
  derived and/or modified sequence opt2 from NARR__Homo_sapiens__NP_001243210
auggucggccagccccagccccgcgacgacgucggcuccccccgcccccgcgucaucgucggcaccauccgcccccgcgucaucgucggcaccauccgcccccgcgucaucgucggcuccgcccgcgcccgccccccccccgacggcaccccccgcccccagcucgccgccgaggaguccccccgcccccgcgucaucuucggcaccccccgcgcccgcgucauccucggcuccccccgcccccgcgucaucgucuccucccccuggcccgccgucgucgucgccuccccccgcccccgcacccccgucggcucccccuggccccgcgucgucgucggcaccccccgcccccgcgucaucgucggcuccccccgcgcccgcgucgccgacgccgaccccgccuccgcccccucccagggcgcccuccagggccgccgccaggacgagcacuccggcacccgcgccgagggcucccgccccggcggcgccgcccccguccccgaggagggcggccgcuucgcccgcgcccagcgccucccccccccccgccaccuccgccuccccggcgcccccgaccgccaccgcggccagaucuga

SEQ ID NO: 46443 - RNA, 1647 nt, Artificial Sequence
  derived and/or modified sequence opt2 from NARS__Homo_sapiens__NP_004530
augguccucgccgagcucuacgucuccgaccgcgagggcuccgacgccaccggcgacggcaccaaggagaagcccuucaagaccggccucaaggcccucaugaccgucggcaaggagcccuuccccaccaucuacgucgacucccagaaggagaacgagcgcuggaacgucaucuccaagucccagcucaagaacaucaagaagauguggcaccgcgagcagaugaaguccgagucccgcgagaagaaggaggccgaggacucccuccgccgcgagaagaaccucgaggaggccaagaagaucaccaucaagaacgaccccucccuccccgagcccaagugcgucaagaucggcgcccucgagggcuaccgcggccagcgcgucaaggucuucggcuggguccaccgccuccgccgccagggcaagaaccucauguuccucguccuccgcgacggcaccggcuaccuccagugcguccucgccgacgagcucugccagugcuacaacggcguccuccucuccaccgaguccuccgucgccgucuacggcaugcucaaccucacccccaagggcaagcaggcccccggcggccacgagcucuccugcgacuucugggagcucaucggccucgcccccgccggcggcgccgacaaccucaucaacgaggaguccgacgucgacguccagcucaacaaccgccacaugaugauccgcggcgagaacauguccaagauccucaaggcccgcuccauggucacccgcugcuuccgcgaccacuucuucgaccgcggcuacuacgaggucaccccccccacccucguccagacccaggucgagggcggcgccacccucuucaagcucgacuacuucggcgaggaggccuuccucacccaguccucccagcucuaccucgagaccugccuccccgcccucggcgacgucuucugcaucgcccaguccuaccgcgccgagcagucccgcacccgccgccaccucgccgaguacacccacgucgaggccgagugccccuuccucaccuucgacgaccuccucaaccgccucgaggaccucgucugcgacgucgucgaccgcauccucaagucccccgccggcuccaucguccacgagcucaaccccaacuuccagccccccaagcgccccuucaagcgcaugaacuacuccgacgccaucgucuggcucaaggagcacgacgucaagaaggaggacggcaccuucuacgaguucggcgaggacauccccgaggcccccgagcgccucaugaccgacaccaucaacgagcccauccuccucugccgcuuccccgucgagaucaaguccuucuacaugcagcgcugccccgaggacucccgccucaccgaguccgucgacguccucaugcccaacgucggcgagaucgucggcggcuccaugcgcaucuucgacuccgaggagauccucgccggcuacaagcgcgagggcaucgaccccacccccuacuacugguacaccgaccagcgcaaguacggcaccugcccccacggcggcuacggccucggccucgagcgcuuccucaccuggauccucaaccgcuaccacauccgcgacgucugccucuacccccgcuucguccagcgcugcacccccuga

SEQ ID NO: 46444 - RNA, 3078 nt, Artificial Sequence
  derived and/or modified sequence opt2 from NAT10__Homo_sapiens__XP_011518499
augcaccgcaagaaggucgacaaccgcauccgcauccucaucgagaacggcgucgccgagcgccagcgcucccucuucgucgucgucggcgaccgcggcaaggaccaggucgucauccuccaccacaugcucuccaaggccaccgucaaggcccgccccuccguccucuggugcuacaagaaggagcucggcuucuccucccaccgcaagaagcgcaugcgccagcuccagaagaagaucaagaacggcacccucaacaucaagcaggacgaccccuucgagcucuucaucgccgccaccaacauccgcuacugcuacuacaacgagacccacaagauccucggcaacaccuucggcaugugcguccuccaggacuucgaggcccucacccccaaccuccucgcccgcaccgucgagaccgucgagggcggcggccucgucgucauccuccuccgcaccaugaacucccucaagcagcucuacaccgucaccauggacguccacucccgcuaccgcaccgaggcccaccaggacgucgucggccgcuucaacgagcgcuucauccucucccucgccuccugcaagaagugccucgucaucgacgaccagcucaacauccuccccaucuccucccacgucgccaccauggaggcccuccccccccagacccccgacgagucccucggccccuccgaccucgagcuccgcgagcucaaggagucccuccaggacacccagcccgucggcguccucgucgacugcugcaagacccucgaccaggccaaggccguccucaaguucaucgagggcaucuccgagaagacccuccgcuccaccgucgcccucaccgccgcccgcggccgcggcaaguccgccgcccucggccucgccaucgccggcgccgucgccuucggcuacuccaacaucuucgucaccucccccucccccgacaaccuccacacccucuucgaguucgucuucaagggcuucgacgcccuccaguaccaggagcaccucgacuacgagaucauccagucccucaaccccgaguucaacaaggccgucauccgcgucaacgucuuccgcgagcaccgccagaccauccaguacauccaccccgccgacgccgucaagcucggccaggccgagcucgucgucaucgacgaggccgccgccaucccccucccccucgucaagucccuccucggccccuaccucgucuucauggccuccaccaucaacggcuacgagggcaccggccgcucccucucccucaagcucauccagcagcuccgccagcaguccgcccagucccaggucuccaccaccgccgagaacaagaccaccaccaccgcccgccucgccuccgcccgcacccucuacgaggucucccuccaggaguccauccgcuacgcccccggcgacgccgucgagaaguggcucaacgaccuccucugccucgacugccucaacaucacccgcaucgucuccggcugcccccuccccgaggccugcgagcucuacuacgucaaccgcgacacccucuucugcuaccacaaggccuccgaggucuuccuccagcgccucauggcccucuacgucgccucccacuacaagaacucccccaacgaccuccagaugcucuccgacgcccccgcccaccaccucuucugccuccucccccccgucccccccacccagaacgcccuccccgagguccucgccgucauccaggucugccucgagggcgagaucucccgccaguccauccucaacucccucucccgcggcaagaaggccuccggcgaccucauccccuggaccgucuccgagcaguuccaggaccccgacuucggcggccucuccggcggccgcgucguccgcaucgccguccaccccgacuaccagggcaugggcuacggcucccgcgcccuccagcuccuccagauguacuacgagggccgcuuccccugccucgaggagaagguccucgagaccccccaggagauccacaccgucuccuccgaggccgucucccuccucgaggaggucaucaccccccgcaaggaccuccccccccuccuccucaagcucaacgagcgccccgccgagcgccucgacuaccucggcgucuccuacggccucaccccccgccuccucaaguucuggaagcgcgccggcuucguccccgucuaccuccgccagacccccaacgaccucaccggcgagcacuccugcaucaugcucaagacccucaccgacgaggacgaggccgaccagggcggcuggcucgccgccuucuggaaggacuuccgccgccgcuuccucgcccuccucuccuaccaguucuccaccuucucccccucccucgcccucaacaucauccagaaccgcaacaugggcaagcccgcccagcccgcccucucccgcgaggagcucgaggcccucuuccuccccuacgaccucaagcgccucgagauguacucccgcaacauggucgacuaccaccucaucauggacaugauccccgccaucucccgcaucuacuuccucaaccagcucggcgaccucgcccucuccgccgcccaguccgcccuccuccucggcaucggccuccagcacaaguccgucgaccagcucgagaaggagaucgagcuccccuccggccagcucaugggccucuucaaccgcaucauccgcaaggucgucaagcucuucaacgagguccaggagaaggccaucgaggagcagauggucgccgccaaggacgucgucauggagcccaccaugaagacccucuccgacgaccucgacgaggccgccaaggaguuccaggagaagcacaagaaggaggucggcaagcucaaguccauggaccucuccgaguacaucauccgcggcgacgacgaggaguggaacgagguccucaacaaggccggccccaacgccuccaucaucucccucaaguccgacaagaagcgcaagcucgaggccaagcaggagcccaagcaguccaagaagcucaagaaccgcgagaccaagaacaagaaggacaugaagcucaagcgcaagaaguga

SEQ ID NO: 46445 - RNA, 621 nt, Artificial Sequence
  derived and/or modified sequence opt2 from NAT14__Homo_sapiens__NP_065111
auggcccccucccaccucuccguccgcgagaugcgcgaggacgagaagccccucguccucgagaugcucaaggccggcgucaaggacaccgagaaccgcgucgcccuccacgcccucacccgcccccccgcccuccuccuccucgccgccgccuccuccggccuccgcuucguccucgccuccuucgcccucgcccuccuccuccccgucuuccucgccgucgccgccgucaagcucggccuccgcgcccgcuggggcucccuccccccccccggcggccucggcggccccugggucgccguccgcggcuccggcgacgucugcggcguccucgcccucgcccccggcaccaacgccggcgacggcgcccgcgucacccgccucuccgucucccgcuggcaccgccgccgcggcgucggccgccgccuccucgccuucgccgaggcccgcgcccgcgccugggccggcggcaugggcgagccccgcgcccgccucgucguccccgucgccgucgccgccuggggcgucggcggcaugcucgagggcugcggcuaccaggccgagggcggcuggggcugccucggcuacacccucguccgcgaguucuccaaggaccucuga

SEQ ID NO: 46446 - RNA, 873 nt, Artificial Sequence
  derived and/or modified sequence opt2 from NAT1__Homo_sapiens__NP_001153646
auggacaucgaggccuaccucgagcgcaucggcuacaagaagucccgcaacaagcucgaccucgagacccucaccgacauccuccagcaccagauccgcgccguccccuucgagaaccucaacauccacugcggcgacgccauggaccucggccucgaggccaucuucgaccaggucguccgccgcaaccgcggcggcuggugccuccaggucaaccaccuccucuacugggcccucaccaccaucggcuucgagaccaccaugcucggcggcuacgucuacuccacccccgccaagaaguacuccaccggcaugauccaccuccuccuccaggucaccaucgacggccgcaacuacaucgucgacgccggcuucggccgcuccuaccagauguggcagccccucgagcucaucuccggcaaggaccagccccagguccccugcgucuuccgccucaccgaggagaacggcuucugguaccucgaccagauccgccgcgagcaguacauccccaacgaggaguuccuccacuccgaccuccucgaggacuccaaguaccgcaagaucuacuccuucacccucaagccccgcaccaucgaggacuucgaguccaugaacaccuaccuccagaccucccccuccuccgucuucaccuccaaguccuucugcucccuccagacccccgacggcguccacugccucgucggcuucacccucacccaccgccgcuucaacuacaaggacaacaccgaccucaucgaguucaagacccucuccgaggaggagaucgagaagguccucaagaacaucuucaacaucucccuccagcgcaagcucguccccaagcacggcgaccgcuucuucaccaucuga

SEQ ID NO: 46447 - RNA, 873 nt, Artificial Sequence
  derived and/or modified sequence opt2 from NAT2__Homo_sapiens__XP_011542660
auggacaucgaggccuacuucgagcgcaucggcuacaagaacucccgcaacaagcucgaccucgagacccucaccgacauccucgagcaccagauccgcgccguccccuucgagaaccucaacaugcacugcggccaggccauggagcucggccucgaggccaucuucgaccacaucguccgccgcaaccgcggcggcuggugccuccaggucaaccagcuccucuacugggcccucaccaccaucggcuuccagaccaccaugcucggcggcuacuucuacaucccccccgucaacaaguacuccaccggcaugguccaccuccuccuccaggucaccaucgacggccgcaacuacaucgucgacgccggcuccggcuccuccucccagauguggcagccccucgagcucaucuccggcaaggaccagccccagguccccugcaucuucugccucaccgaggagcgcggcaucugguaccucgaccagauccgccgcgagcaguacaucaccaacaaggaguuccucaacucccaccuccuccccaagaagaagcaccagaagaucuaccucuucacccucgagccccgcaccaucgaggacuucgaguccaugaacaccuaccuccagaccucccccaccuccuccuucaucaccaccuccuucugcucccuccagacccccgagggcgucuacugccucgucggcuucauccucaccuaccgcaaguucaacuacaaggacaacaccgaccucgucgaguucaagacccucaccgaggaggaggucgaggagguccuccgcaacaucuucaagaucucccucggccgcaaccucguccccaagcccggcgacggcucccucaccaucuga

SEQ ID NO: 46448 - RNA, 861 nt, Artificial Sequence
  derived and/or modified sequence opt2 from NAT6__Homo_sapiens__NP_001186947
auggagcucauccucuccaccucccccgccgagcucacccucgaccccgccugccagcccaagcucccccucgacuccaccugccagcccgagaugaccuucaaccccggccccaccgagcucacccucgaccccgagcaccagcccgaggagacccccgcccccucccucgccgagcucacccucgagcccguccaccgccgccccgagcuccucgacgccugcgccgaccucaucaacgaccaguggccccgcucccgcaccucccgccuccacucccucggccaguccuccgacgccuucccccucugccucaugcuccucuccccccaccccacccucgaggccgcccccgucgucgucggccacgcccgccucucccgcguccucaaccagccccagucccuccucgucgagaccgucgucgucgcccgcgcccuccgcggccgcggcuucggccgccgccucauggagggccucgaggucuucgcccgcgcccgcggcuuccgcaagcuccaccucaccacccacgaccagguccacuucuacacccaccucggcuaccagcucggcgagcccguccagggccucgucuucaccucccgccgccuccccgccacccuccucaacgccuuccccaccgcccccuccccccgccccccccgcaaggcccccaaccucaccgcccaggccgccccccgcggccccaagggccccccccucccccccccccccccccuccccgagugccucaccaucuccccccccguccccuccggcccccccuccaagucccuccucgagacccaguaccagaacguccgcggccgccccaucuucuggauggagaaggacaucuga

SEQ ID NO: 46449 - RNA, 684 nt, Artificial Sequence
  derived and/or modified sequence opt2 from NAT8B__Homo_sapiens__NP_057431
auggcccccuaccacauccgcaaguaccaggaguccgaccgcaaguccgucgucggccuccucucccgcggcauggccgagcacgcccccgccaccuuccgccgccuccucaagcucccccgcacccucauccuccuccucggcggcgcccucgcccuccuccucgucuccggcuccuggauccucgcccucgucuucucccucucccuccuccccgcccucugguuccucgccaagaagcccuggacccgcuacgucgacaucgcccuccgcaccgacauguccgacaucaccaaguccuaccucuccgagugcggcuccugcuucugggucggcgaguccgaggagaaggucgucggcaccgucggcgcccuccccgucgacgaccccacccuccgcgagaagcgccuccagcucuuccaccucuccgucgacaacgagcaccgcggccagggcaucgccaaggcccucguccgcaccguccuccaguucgcccgcgaccagggcuacuccgaggucguccucgacaccuccaacauccagcucuccgccaugggccucuaccagucccucggcuucaagaagaccggccaguccuucuuccacgucugggcccgccucgucgaccuccacaccguccacuucaucuaccaccuccccuccgcccaggccggccgccucuga

SEQ ID NO: 46450 - RNA, 684 nt, Artificial Sequence
  derived and/or modified sequence opt2 from NAT8__Homo_sapiens__NP_003951
auggcccccugccacauccgcaaguaccaggaguccgaccgccagugggucgucggccuccucucccgcggcauggccgagcacgcccccgccaccuuccgccagcuccucaagcucccccgcacccucauccuccuccucggcggcccccucgcccuccuccucgucuccggcuccuggcuccucgcccucgucuucuccaucucccucuuccccgcccucugguuccucgccaagaagcccuggaccgaguacgucgacaugacccucugcaccgacauguccgacaucaccaaguccuaccucuccgagcgcggcuccugcuucugggucgccgaguccgaggagaaggucgucggcauggucggcgcccuccccgucgacgaccccacccuccgcgagaagcgccuccagcucuuccaccucuucgucgacuccgagcaccgccgccagggcaucgccaaggcccucguccgcaccguccuccaguucgcccgcgaccagggcuacuccgaggucauccucgacaccggcaccauccagcucuccgccauggcccucuaccaguccaugggcuucaagaagaccggccaguccuucuucugcgucugggcccgccucgucgcccuccacaccguccacuucaucuaccaccuccccuccuccaaggucggcucccucuga

SEQ ID NO: 46451 - RNA, 909 nt, Artificial Sequence
  derived and/or modified sequence opt2 from NAT8L__Homo_sapiens__NP_848652
augcacugcggcccccccgacauggucugcgagaccaagaucgucgccgccgaggaccacgaggcccuccccggcgccaagaaggacgcccuccucgccgccgccggcgccauguggcccccccuccccgccgcccccggccccgccgccgccccccccgcccccccccccgcccccgucgcccagccccacggcggcgccggcggcgccggcccccccggcggccgcggcgucugcauccgcgaguuccgcgccgccgagcaggaggccgcccgccgcaucuucuacgacggcaucauggagcgcauccccaacaccgccuuccgcggccuccgccagcacccccgcgcccagcuccucuacgcccuccucgccgcccucugcuucgccgucucccgcucccuccuccucaccugccucguccccgccgcccuccucggccuccgcuacuacuacucccgcaaggucauccgcgccuaccucgagugcgcccuccacaccgacauggccgacaucgagcaguacuacaugaagccccccggcuccugcuucugggucgccguccucgacggcaacgucgucggcaucgucgccgcccgcgcccacgaggaggacaacaccgucgagcuccuccgcauguccgucgacucccgcuuccgcggcaagggcaucgccaaggcccucggccgcaagguccucgaguucgccgucguccacaacuacuccgccgucguccucggcaccaccgccgucaaggucgccgcccacaagcucuacgagucccucggcuuccgccacaugggcgccuccgaccacuacguccuccccggcaugacccucucccucgccgagcgccucuucuuccagguccgcuaccaccgcuaccgccuccagcuccgcgaggaguga

SEQ ID NO: 46452 - RNA, 4452 nt, Artificial Sequence
  derived and/or modified sequence opt2 from NAV1__Homo_sapiens__NP_001161210
augcuccaccucccccucccccgcuccggccgcaccgucaacuucccccgcuccugggacgaguccuccuccaucuccuccggccucuccgacgccuccgacaaccucuccuccgaggaguucaacgccuccuccucccucaacucccuccccuccacccccaccgccucccgccgcaacuccaccaucguccuccgcaccgacuccgagaagcgcucccucgccgaguccggccucuccugguucuccgaguccgaggagaaggcccccaagaagcucgaguacgacuccggcucccucaagauggagcccggcaccuccaaguggcgccgcgagcgccccgaguccugcgacgacuccuccaagggcggcgagcucaagaagcccaucucccucggccaccccggcucccucaagaagggcaagaccccccccgucgccgucaccucccccaucacccacaccgcccaguccgcccucaaggucgccggcaagcccgagggcaaggccaccgacaagggcaagcucgccgucaagaacaccggccuccagcgcuccuccuccgacgccggccgcgaccgccucuccgacgccaagaagccccccuccggcaucgcccgccccuccaccuccggcuccuucggcuacaagaagcccccccccgccaccggcaccgccaccgucaugcagaccggcggcuccgccacccucuccaagauccagaaguccuccggcauccccgucaagcccgucaacggccgcaagaccucccucgacgucuccaacuccgccgagcccggcuuccucgcccccggcgcccgcuccaacauccaguaccgcucccucccccgccccgccaaguccuccuccauguccgucaccggcggccgcggcggcccccgccccgucuccuccuccaucgaccccucccuccucuccaccaagcagggcggccucacccccucccgccucaaggagcccaccaaggucgccuccggccgcaccacccccgcccccgucaaccagaccgaccgcgagaaggagaaggccaaggccaaggccgucgcccucgacuccgacaacaucucccucaaguccaucggcucccccgaguccacccccaagaaccaggccucccaccccaccgccaccaagcucgccgagcucccccccaccccccuccgcgccaccgccaaguccuucgucaagccccccucccucgccaaccucgacaaggucaacuccaacucccucgaccuccccuccuccuccgacaccacccacgccuccaagguccccgaccuccacgccaccuccuccgccuccggcggcccccuccccuccugcuucacccccucccccgcccccauccucaacaucaacuccgccuccuucucccagggccucgagcucauguccggcuucuccguccccaaggagacccgcauguaccccaagcucuccggccuccaccgcuccauggagucccuccagaugcccaugucccuccccuccgccuuccccuccuccacccccguccccaccccccccgccccccccgccgcccccaccgaggaggagaccgaggagcucaccugguccggcuccccccgcgccggccagcucgacuccaaccagcgcgaccgcaacacccuccccaagaagggccuccgcuaccagcuccagucccaggaggagaccaaggagcgccgccacucccacaccaucggcggccuccccgaguccgacgaccaguccgagcuccccuccccccccgcccuccccaugucccucuccgccaagggccagcucaccaacaucgucucccccaccgccgccaccaccccccgcaucacccgcuccaacuccauccccacccacgaggccgccuucgagcucuacuccggcucccagaugggcuccacccucucccucgccgagcgccccaagggcaugauccgcuccggcuccuuccgcgaccccaccgacgacguccacggcuccguccucucccucgccuccuccgccuccuccaccuacuccuccgccgaggagcgcaugcaguccgagcagauccgcaagcuccgccgcgagcucgaguccucccaggagaaggucgccacccucaccucccagcucuccgccaacgccaaccucgucgccgccuucgagcagucccucgucaacaugaccucccgccuccgccaccucgccgagaccgccgaggagaaggacaccgagcuccucgaccuccgcgagaccaucgacuuccucaagaagaagaacuccgaggcccaggccgucauccagggcgcccucaacgccuccgagaccacccccaaggagcuccgcaucaagcgccagaacuccuccgacuccaucuccucccucaacuccaucaccucccacuccuccaucggcuccuccaaggacgccgacgccaagaagaagaagaagaaguccuggcuccgcuccuccuucaacaaggccuucuccaucaagaagggccccaaguccgccuccuccuacuccgacaucgaggagaucgccacccccgacuccuccgcccccuccucccccaagcuccagcacggcuccaccgagaccgccucccccuccaucaaguccuccaccuccuccuccgucggcaccgacgucaccgagggccccgcccaccccgccccccacacccgccucuuccacgccaacgaggaggaggagcccgagaagaaggaggucuccgagcuccgcuccgagcucugggagaaggagaugaagcucaccgacauccgccucgaggcccucaacuccgcccaccagcucgaccagcuccgcgagaccaugcacaacaugcagcucgaggucgaccuccucaaggccgagaacgaccgccucaaggucgcccccggccccuccuccggcuccacccccggccagguccccggcuccuccgcccucuccuccccccgccgcucccucggccucgcccucacccacuccuucggccccucccucgccgacaccgaccucucccccauggacggcaucuccaccugcggccccaaggaggaggucacccuccgcgucgucguccgcaugcccccccagcacaucaucaagggcgaccucaagcagcaggaguucuuccucggcugcuccaaggucuccggcaaggucgacuggaagaugcucgacgaggccgucuuccaggucuucaaggacuacaucuccaagauggaccccgccuccacccucggccucuccaccgaguccauccacggcuacuccaucucccacgucaagcgcguccucgacgccgagccccccgagaugccccccugccgccgcggcgucaacaacaucuccgucucccucaagggccucaaggagaagugcgucgacucccucgucuucgagacccucauccccaagcccaugaugcagcacuacaucucccuccuccucaagcaccgccgccucguccucuccggccccuccggcaccggcaagaccuaccucaccaaccgccucgccgaguaccucgucgagcgcuccggccgcgaggucaccgagggcaucgucuccaccuucaacaugcaccagcaguccugcaaggaccuccagcucuaccucuccaaccucgccaaccagaucgaccgcgagaccggcaucggcgacgucccccucgucauccuccucgacgaccucuccgaggccggcuccaucuccgagcucgucaacggcgcccucaccugcaaguaccacaagugccccuacaucaucggcaccaccaaccagcccgucaagaugacccccaaccacggccuccaccucuccuuccgcaugcucaccuucuccaacaacgucgagcccgccaacggcuuccucguccgcuaccuccgccgcaagcucgucgaguccgacuccgacaucaacgccaacaaggaggagcuccuccgcguccucgacuggguccccaagcucugguaccaccuccacaccuuccucgagaagcacuccaccuccgacuuccucaucggccccugcuucuuccucuccugccccaucggcaucgaggacuuccgcaccugguucaucgaccucuggaacaacuccaucauccccuaccuccaggagggcgccaaggacggcaucaagguccacggccagaaggccgccugggaggaccccgucgaguggguccgcgacacccuccccuggcccuccgcccagcaggaccaguccaagcucuaccaccuccccccccccaccgucggcccccacuccaucgccuccccccccgaggaccgcaccgucaaggacuccacccccuccucccucgacuccgacccccucauggccaugcuccucaagcuccaggaggccgccaacuacaucgagucccccgaccgcgagaccauccucgaccccaaccuccaggccacccucuga

SEQ ID NO: 46453 - RNA, 7098 nt, Artificial Sequence
  derived and/or modified sequence opt2 from NAV2__Homo_sapiens__NP_001104488
auggaguccgucuccgaguccucccagcagcagaagcgcaagcccgucauccacggccucgaggaccagaagcgcaucuacaccgacugggccaaccacuaccucgccaaguccggccacaagcgccucauccgcgaccuccagcaggacgucaccgacggcguccuccucgcccagaucauccaggucgucgccaacgagaagaucgaggacaucaacggcugccccaagaaccgcucccagaugaucgagaacaucgacgccugccucaacuuccucgccgccaagggcaucaacauccagggccucuccgccgaggagauccgcaacggcaaccucaaggccauccucggccucuucuucucccucucccgcuacaagcagcagcagcagcagccccagaagcagcaccucuccuccccccucccccccgccgucucccaggucgccggcgcccccucccagugccaggccggcaccccccagcagcagguccccgucaccccccaggcccccugccagccccaccagcccgccccccaccagcaguccaaggcccaggccgagaugcagucccgccuccccggccccaccgcccgcgucuccgccgccggcuccgaggccaagacccgcggcggcuccaccaccgccaacaaccgccgcucccaguccuucaacaacuacgacaaguccaagcccgucaccucccccccccccccccccuccucccacgagaaggagccccucgccuccuccgccuccucccaccccggcauguccgacaacgcccccgccucccucgaguccggcuccuccuccacccccaccaacugcuccaccuccuccgccaucccccagcccggcgccgccaccaagcccuggcgcuccaagucccucuccgucaagcacuccgccaccgucuccaugcucuccgucaagccccccggccccgaggccccccgccccacccccgaggccaugaagcccgcccccaacaaccagaaguccaugcucgagaagcucaagcucuucaacuccaagggcggcuccaaggccggcgagggccccggcucccgcgacaccuccugcgagcgccucgagacccuccccuccuucgaggaguccgaggagcucgaggccgccucccgcaugcucaccaccgucggccccgccuccuccucccccaagaucgcccucaagggcaucgcccagcgcaccuucucccgcgcccucaccaacaagaaguccucccucaagggcaacgagaaggagaaggagaagcagcagcgcgagaaggacaaggagaaguccaaggaccucgccaagcgcgccuccgucaccgagcgccucgaccucaaggaggagcccaaggaggaccccuccggcgccgccguccccgagaugcccaagaaguccuccaagaucgccuccuucauccccaagggcggcaagcucaacuccgccaagaaggagcccauggcccccucccacuccggcauccccaagcccggcaugaaguccaugcccggcaagucccccuccgcccccgcccccuccaaggagggcgagcgcucccgcuccggcaagcucuccuccggccucccccagcagaagccccagcucgacggccgccacuccuccuccuccuccucccucgccuccuccgagggcaagggccccggcggcaccacccucaaccacuccaucuccucccagaccgucuccggcuccgucggcaccacccagaccaccggcuccaacaccgucuccguccagcucccccagccccagcagcaguacaaccaccccaacaccgccaccgucgcccccuuccucuaccgcucccagaccgacaccgagggcaacgucaccgccgaguccuccuccaccggcgucuccgucgagcccucccacuucaccaagaccggccagcccgcccucgaggagcucaccggcgaggaccccgaggcccgccgccuccgcaccgucaagaacaucgccgaccuccgccagaaccucgaggagaccauguccucccuccgcggcacccaggucacccacuccacccucgagaccaccuucgacaccaacgucaccaccgagauguccggccgcuccauccucucccucaccggccgccccaccccccucuccuggcgccucggccaguccuccccccgccuccaggccggcgacgcccccuccaugggcaacggcuaccccccccgcgccaacgccucccgcuucaucaacaccgaguccggccgcuacgucuacuccgccccccuccgccgccagcucgccucccgcggcuccuccgucugccacgucgacgucuccgacaaggccggcgacgagauggaccucgagggcaucuccauggacgcccccggcuacauguccgacggcgacguccucuccaagaacauccgcaccgacgacaucaccuccggcuacaugaccgacggcggccucggccucuacacccgccgccucaaccgccuccccgacggcauggccgucguccgcgagacccuccagcgcaacaccucccucggccucggcgacgccgacuccugggacgacuccuccuccgucuccuccggcaucuccgacaccaucgacaaccucuccaccgacgacaucaacaccuccuccuccaucuccuccuacgccaacacccccgccuccucccgcaagaaccucgacguccagaccgacgccgagaagcacucccaggucgagcgcaacucccucugguccggcgacgacgucaagaaguccgacggcggcuccgacuccggcaucaagauggagcccggcuccaaguggcgccgcaaccccuccgacgucuccgacgaguccgacaaguccaccuccggcaagaagaaccccgucaucucccagaccggcuccuggcgccgcggcaugaccgcccaggucggcaucaccaugccccgcaccaagcccuccgcccccgccggcgcccucaagacccccggcaccggcaagaccgacgacgccaaggucuccgagaagggccgccucucccccaaggccucccaggucaagcgcucccccuccgacgccggccgcuccuccggcgacgaguccaagaagccccuccccuccuccucccgcacccccaccgccaacgccaacuccuucggcuucaagaagcaguccggcuccgccgccggccucgccaugaucaccgccuccggcgucaccgucaccucccgcuccgccacccucggcaagauccccaaguccuccgcccucgucucccgcuccgccggccgcaaguccuccauggacggcgcccagaaccaggacgacggcuaccucgcccucuccucccgcaccaaccuccaguaccgcucccucccccgccccuccaaguccaacucccgcaacggcgccggcaaccgcuccuccaccuccuccaucgacuccaacaucuccuccaaguccgccggccuccccguccccaagcuccgcgagcccuccaagaccgcccucggcuccucccuccccggccucgucaaccagaccgacaaggagaagggcaucuccuccgacaacgaguccgucgccuccugcaacuccgucaaggucaaccccgccgcccagcccgucuccucccccgcccagaccucccuccagcccggcgccaaguaccccgacgucgccucccccacccuccgccgccucuucggcggcaagcccaccaagcagguccccaucgccaccgccgagaacaugaagaacuccgucgucaucuccaacccccacgccaccaugacccagcagggcaaccucgacucccccuccggcuccggcguccucuccuccggcuccuccuccccccucuacuccaagaacgucgaccucaaccaguccccccucgccuccucccccuccuccgcccacuccgcccccuccaacucccucaccuggggcaccaacgccuccuccuccuccgccgucuccaaggacggccucggcuuccaguccgucuccucccuccacaccuccugcgaguccaucgacaucucccucuccuccggcggcguccccucccacaacuccuccaccggccucaucgccuccuccaaggacgacucccucacccccuucguccgcaccaacuccgucaagaccacccucuccgaguccccccucuccucccccgccgccucccccaaguucugccgcuccacccucccccgcaagcaggacuccgacccccaccucgaccgcaacacccuccccaagaagggccuccgcuacacccccaccucccagcuccgcacccaggaggacgccaaggaguggcuccgcucccacuccgccggcggccuccaggacaccgccgccaacucccccuucuccuccggcuccuccgucaccucccccuccggcacccgcuucaacuucucccagcucgccucccccaccaccgucacccagaugucccucuccaaccccaccaugcuccgcacccacucccucuccaacgccgacggccaguacgaccccuacaccgacucccgcuuccgcaacuccuccaugucccucgacgagaagucccgcaccaugucccgcuccggcuccuuccgcgacggcuucgaggagguccacggcuccucccucucccucgucuccuccaccuccuccgucuacuccacccccgaggagaagugccaguccgagauccgcaagcuccgccgcgagcucgacgccucccaggagaaggucuccgcccucaccacccagcucaccgccaacgcccaccucgucgccgccuucgagcagucccucggcaacaugaccauccgccuccagucccucaccaugaccgccgagcagaaggacuccgagcucaacgagcuccgcaagaccaucgagcuccucaagaagcagaacgccgccgcccaggccgccaucaacggcgucaucaacacccccgagcucaacugcaagggcaacggcaccgcccaguccgccgaccuccgcauccgccgccagcacuccuccgacuccgucuccuccaucaacuccgccaccucccacuccuccgucggcuccaacaucgaguccgacuccaagaagaagaagcgcaagaacuggcuccgcuccuccuucaagcaggccuucggcaagaagaagucccccaaguccgccuccucccacuccgacaucgaggagaugaccgacuccucccuccccuccucccccaagcucccccacaacggcuccaccggcuccaccccccuccuccgcaacucccacuccaacucccucaucuccgagugcauggacuccgaggccgagaccgucaugcagcuccgcaacgagcuccgcgacaaggagaugaagcucaccgacauccgccucgaggcccucuccuccgcccaccagcucgaccagcuccgcgaggccaugaaccgcaugcaguccgagaucgagaagcucaaggccgagaacgaccgccucaaguccgagucccagggcuccggcugcucccgcgcccccucccaggucuccaucuccgccuccccccgccaguccaugggccucucccagcacucccucaaccucaccgaguccaccucccucgacaugcuccucgacgacaccggcgagugcuccgcccgcaaggagggcggccgccacgucaagaucgucgucuccuuccaggaggagaugaaguggaaggaggacucccgcccccaccucuuccucaucggcugcaucggcgucuccggcaagaccaagugggacguccucgacggcgucguccgccgccucuucaaggaguacaucauccacgucgaccccgucucccagcucggccucaacuccgacuccguccucggcuacuccaucggcgagaucaagcgcuccaacaccuccgagacccccgagcuccuccccugcggcuaccucgucggcgagaacaccaccaucuccgucaccgucaagggccucgccgagaacucccucgacucccucgucuucgagucccucauccccaagcccauccuccagcgcuacgucucccuccucaucgagcaccgccgcaucauccucuccggccccuccggcaccggcaagaccuaccucgccaaccgccucuccgaguacaucguccuccgcgagggccgcgagcucaccgacggcgucaucgccaccuucaacgucgaccacaaguccuccaaggagcuccgccaguaccucuccaaccucgccgaccagugcaacuccgagaacaacgccgucgacaugccccucgucaucauccucgacaaccuccaccacgucuccucccucggcgagaucuucaacggccuccucaacugcaaguaccacaagugccccuacaucaucggcaccaugaaccaggccaccuccuccacccccaaccuccagcuccaccacaacuuccgcuggguccucugcgccaaccacaccgagcccgucaagggcuuccucggccgcuuccuccgccgcaagcucauggagaccgagaucuccggccgcguccgcaacauggagcucgucaagaucaucgacuggauccccaaggucuggcaccaccucaaccgcuuccucgaggcccacuccuccuccgacgucaccaucggcccccgccucuuccucuccugccccaucgacgucgacggcucccgcgucugguucaccgaccucuggaacuacuccaucauccccuaccuccucgaggccguccgcgagggccuccagcucuacggccgccgcgcccccugggaggaccccgccaagugggucauggacaccuaccccugggccgccuccccccagcagcacgaguggcccccccuccuccagcuccgccccgaggacgucggcuucgacggcuacuccaugccccgcgagggcuccaccuccaagcagaugccccccuccgacgccgagggcgacccccucaugaacaugcucaugcgccuccaggaggccgccaacuacuccuccccccaguccuacgacuccgacuccaacuccaacucccaccacgacgacauccucgacuccucccucgaguccacccucuga

SEQ ID NO: 46454 - RNA, 7158 nt, Artificial Sequence
  derived and/or modified sequence opt2 from NAV3__Homo_sapiens__NP_001019554
augcccguccucggcgucgccuccaagcuccgccagcccgccgucggcuccaagcccguccacaccgcccuccccauccccaaccucggcaccaccggcucccagcacugcuccucccgcccccucgagcucaccgagaccgaguccuccaugcucuccugccagcucgcccucaaguccaccugcgaguucggcgagaagaagccccuccagggcaaggccaaggagaaggaggacuccaagaucuacaccgacugggccaaccacuaccucgccaaguccggccacaagcgccucaucaaggaccuccagcaggacaucgccgacggcguccuccucgccgagaucauccagaucaucgccaacgagaaggucgaggacaucaacggcugcccccgcucccagucccagaugaucgagaacgucgacgucugccucuccuuccucgccgcccgcggcgucaacguccagggccucuccgccgaggagauccgcaacggcaaccucaaggccauccucggccucuucuucucccucucccgcuacaagcagcagcagcaccaccagcagcaguacuaccagucccucgucgagcuccagcagcgcgucacccacgccuccccccccuccgaggccucccaggccaagacccagcaggacaugcaguccucccucgccgcccgcuacgccacccaguccaaccacuccggcaucgccaccucccagaagaagcccacccgccuccccggccccucccgcguccccgccgccggcuccuccuccaagguccagggcgccuccaaccucaaccgccgcucccaguccuucaacuccaucgacaagaacaagccccccaacuacgccaacggcaacgagaaggacuccuccaagggcccccaguccuccuccggcgucaacggcaacguccagccccccuccaccgccggccagccccccgccuccgccauccccucccccuccgccuccaagcccuggcgcuccaaguccaugaacgucaagcacuccgccaccuccaccaugcucaccgucaagcaguccuccaccgccaccucccccacccccuccuccgaccgccucaagccccccgucuccgagggcgucaagaccgcccccuccggccagaaguccaugcucgagaaguucaagcucgucaacgcccgcaccgcccuccgccccccccagccccccuccuccggccccuccgacggcggcaaggacgacgacgccuucuccgaguccggcgagauggagggcuucaacuccggccucaacuccggcggcuccaccaacuccucccccaaggucucccccaagcucgccccccccaaggccggcuccaagaaccucuccaacaagaagucccuccuccagcccaaggagaaggaggagaagaaccgcgacaagaacaaggucugcaccgagaagcccgucaaggaggagaaggaccaggucaccgagauggcccccaagaagaccuccaagaucgccucccucauccccaagggcuccaagaccaccgccgccaagaaggagucccucauccccuccuccuccggcauccccaagcccggcuccaagguccccaccgucaagcagaccaucucccccggcuccaccgccuccaaggaguccgagaaguuccgcaccaccaagggcucccccucccagucccucuccaagcccaucaccauggagaaggccuccgccuccuccugccccgccccccucgagggccgcgaggccggccaggccucccccuccggcuccugcaccaugaccgucgcccaguccuccggccaguccaccggcaacggcgccguccagcucccccagcagcagcagcacucccaccccaacaccgccaccgucgcccccuucaucuaccgcgcccacuccgagaacgagggcaccgcccuccccuccgccgacuccugcaccucccccaccaagauggaccucuccuacuccaagaccgccaagcagugccucgaggagaucuccggcgaggaccccgagacccgccgcaugcgcaccgucaagaacaucgccgaccuccgccagaaccucgaggagaccauguccucccuccgcggcacccagaucucccacuccacccucgagaccaccuucgacuccaccgucaccaccgaggucaacggccgcaccauccccaaccucaccucccgccccacccccaugaccuggcgccucggccaggccugcccccgccuccaggccggcgacgcccccucccucggcgccggcuacccccgcuccggcaccucccgcuucauccacaccgaccccucccgcuucauguacaccaccccccuccgccgcgccgccgucucccgccucggcaacaugucccagaucgacauguccgagaaggccuccuccgaccucgacauguccuccgaggucgacgucggcggcuacauguccgacggcgacauccucggcaagucccuccgcaccgacgacaucaacuccggcuacaugaccgacggcggccucaaccucuacacccgcucccucaaccgcauccccgacaccgccaccucccgcgacaucauccagcgcggcguccacgacgucaccgucgacgccgacuccugggacgacuccuccuccgucuccuccggccucuccgacacccucgacaacaucuccaccgacgaccucaacaccaccuccuccgucuccuccuacuccaacaucaccguccccucccgcaagaacacccagcuccgcaccgacuccgagaagcgcuccaccaccgacgagaccugggacucccccgaggagcucaagaagcccgaggaggacuucgacucccacggcgacgccggcggcaaguggaagaccgucuccuccggccuccccgaggaccccgagaaggccggccagaaggccucccucuccgucucccagaccggcuccuggcgccgcggcauguccgcccagggcggcgcccccucccgccagaaggccggcaccuccgcccucaagacccccggcaagaccgacgacgccaaggccuccgagaagggcaaggccccccucaagggcuccucccuccagcgcucccccuccgacgccggcaaguccuccggcgacgagggcaagaagccccccuccggcaucggccgcuccaccgccaccuccuccuucggcuucaagaagcccuccggcgucggcuccuccgccaugaucaccuccuccggcgccaccaucaccuccggcuccgccacccucggcaagauccccaaguccgccgccaucggcggcaaguccaacgccggccgcaagaccucccucgacggcucccagaaccaggacgacgucguccuccacgucuccuccaagaccacccuccaguaccgcucccucccccgccccuccaaguccuccaccuccggcauccccggccgcggcggccaccgcuccuccaccuccuccaucgacuccaacgucuccuccaaguccgccggcgccaccaccuccaagcuccgcgagcccaccaagaucggcuccggccgcuccucccccgucaccgucaaccagaccgacaaggagaaggagaaggucgccgucuccgacuccgaguccgucucccucuccggcucccccaaguccucccccaccuccgccuccgccugcggcgcccagggccuccgccagcccggcuccaaguaccccgacaucgccucccccaccuuccgccgccucuucggcgccaaggccggcggcaaguccgccuccgcccccaacaccgagggcgucaaguccuccuccgucaugcccucccccuccaccacccucgcccgccagggcucccucgagucccccuccuccggcaccggcuccaugggcuccgccggcggccucuccggcuccuccuccccccucuucaacaagcccuccgaccucaccaccgacgucaucucccucucccacucccucgccuccucccccgccuccguccacuccuucaccuccggcggccucgucugggccgccaacauguccuccuccuccgccggcuccaaggacacccccuccuaccaguccaugaccucccuccacaccuccuccgaguccaucgaccucccccucucccaccacggcucccucuccggccucaccaccggcacccacgagguccagucccuccucaugcgcaccggcuccguccgcuccacccucuccgaguccaugcagcucgaccgcaacacccuccccaagaagggccuccgcuacacccccuccucccgccaggccaaccaggaggagggcaaggaguggcuccgcucccacuccaccggcggccuccaggacaccggcaaccaguccccccucgucucccccuccgccauguccuccuccgccgccggcaaguaccacuucuccaaccucgucucccccaccaaccucucccaguucaaccuccccggccccuccaugaugcgcuccaacuccauccccgcccaggacuccuccuucgaccucuacgacgacucccagcucugcggcuccgccaccucccucgaggagcgcccccgcgccaucucccacuccggcuccuuccgcgacuccauggaggagguccacggcuccucccucucccucgucuccuccaccuccucccucuacuccaccgccgaggagaaggcccacuccgagcagauccacaagcuccgccgcgagcucgucgccucccaggagaaggucgccacccucaccucccagcucuccgccaacgcccaccucgucgccgccuucgagaagucccucggcaacaugaccggccgccuccagucccucaccaugaccgccgagcagaaggaguccgagcucaucgagcuccgcgagaccaucgagaugcucaaggcccagaacuccgccgcccaggccgccauccagggcgcccucaacggccccgaccacccccccaaggaccuccgcauccgccgccagcacuccuccgaguccgucuccuccaucaacuccgccaccucccacuccuccaucggcuccggcaacgacgccgacuccaagaagaagaagaagaagaacugggucaacucccgcggcuccgagcuccgcuccuccuucaagcaggccuucggcaagaagaaguccaccaagccccccuccucccacuccgacaucgaggagcucaccgacuccucccuccccgccucccccaagcucccccacaacgccggcgacugcggcuccgccuccaugaagcccucccaguccgccuccgccuccccccucgucuggccccccaagaagcgccagaacggccccgucaucuacaagcaccgcucccgcaucugcgagugcaccgaggccgaggccgagaucauccuccagcucaaguccgagcuccgcgagaaggagcucaagcucaccgacauccgccucgaggcccucuccuccgcccaccaccucgaccagauccgcgaggccaugaaccgcaugcagaacgagaucgagauccucaaggccgagaacgaccgccucaaggccgagaccggcaacaccgccaagcccacccgcccccccuccgaguccuccuccuccaccuccuccuccuccucccgccagucccucggccucucccucaacaaccucaacaucaccgaggccgucuccuccgacauccuccucgacgacgccggcgacgccaccggccacaaggacggccgcuccgucaagaucaucgucuccaucuccaagggcuacggccgcgccaaggaccagaagucccaggccuaccucaucggcuccaucggcgucuccggcaagaccaagugggacguccucgacggcgucauccgccgccucuucaaggaguacgucuuccgcaucgacaccuccaccucccucggccucuccuccgacugcaucgccuccuacugcaucggcgaccucauccgcucccacaaccucgagguccccgagcuccuccccugcggcuaccucgucggcgacaacaacaucaucaccgucaaccucaagggcgucgaggagaacucccucgacuccuucgucuucgacacccucauccccaagcccaucacccagcgcuacuucaaccuccucauggagcaccaccgcaucauccucuccggccccuccggcaccggcaagaccuaccucgccaacaagcucgccgaguacgucaucaccaaguccggccgcaagaagaccgaggacgccaucgccaccuucaacgucgaccacaaguccuccaaggagcuccagcaguaccucgccaaccucgccgagcagugcuccgccgacaacaacggcgucgagcuccccgucgucaucauccucgacaaccuccaccacgucggcucccucuccgacaucuucaacggcuuccucaacugcaaguacaacaagugccccuacaucaucggcaccaugaaccagggcgucuccuccucccccaaccucgagcuccaccacaacuuccgcuggguccucugcgccaaccacaccgagcccgucaagggcuuccucggccgcuaccuccgccgcaagcucaucgagaucgagaucgagcgcaacauccgcaacaacgaccucgucaagaucaucgacuggauccccaagaccuggcaccaccucaacuccuuccucgagacccacuccuccuccgacgucaccaucggcccccgccucuuccuccccugccccauggacgucgagggcucccgcgucugguucauggaccucuggaacuacucccucguccccuacauccucgaggccguccgcgagggccuccagauguacggcaagcgcacccccugggaggaccccuccaaguggguccucgacaccuaccccugguccuccgccacccucccccaggagucccccgcccuccuccagcuccgccccgaggacgucggcuacgaguccugcaccuccaccaaggaggccaccaccuccaagcacaucccccagaccgacaccgagggcgacccccucaugaacaugcucaugaagcuccaggaggccgccaacuacuccuccacccaguccugcgacuccgaguccaccucccaccacgaggacauccucgacuccucccucgaguccacccucuga

SEQ ID NO: 46455 - RNA, 7116 nt, Artificial Sequence
  derived and/or modified sequence opt2 from NBAS__Homo_sapiens__NP_056993
auggccgcccccgaguccggccccgcccucucccccggcaccgccgagggcgaggaggagaccauccucuacgaccuccucgucaacaccgaguggccccccgagaccgagguccagccccgcggcaaccagaagcacggcgccuccuucaucaucaccaaggccauccgcgaccgccuccucuuccuccgccaguacaucugguacucccccgcccccuuccuccuccccgacggccucguccgccucgucaacaagcagaucaacuggcaccucguccucgccuccaacggcaagcuccucgccgccguccaggaccagugcgucgagauccgcuccgccaaggacgacuucaccuccaucaucggcaagugccagguccccaaggaccccaagccccaguggcgccgcgucgccugguccuacgacugcacccuccucgccuacgccgaguccaccggcaccguccgcgucuucgaccucaugggcuccgagcucuucgucaucucccccgccuccuccuucaucggcgaccucuccuacgccaucgccggccucaucuuccucgaguacaaggccuccgcccagugguccgccgagcuccucgucaucaacuaccgcggcgagcuccgcuccuaccucgucuccgucggcaccaaccaguccuaccaggagucccacugcuucuccuucuccucccacuacccccacggcaucaacaccgccaucuaccaccccggccaccgccuccuccucgucggcggcugcgagaccgccgaggucggcauguccaaggccuccuccugcggccucuccgccuggcgcguccucuccggcucccccuacuacaagcaggucaccaacggcggcgacggcgucaccgccguccccaagacccucggccuccuccgcaugcucuccgucaaguucuacucccgccagggccaggagcaggacggcaucuucaagaugucccucucccccgacggcaugcuccucgccgccauccacuucuccggcaagcucuccaucugggccauccccucccucaagcagcagggcgaguggggccagaacgagcagcccggcuacgacgaccucaaccccgacuggcgccucuccaccgagaagcgcaagaagaucaaggacaaggaguccuucuacccccucaucgacgucaacuggugggccgacuccgccgucacccucgcccgcugcuccggcgcccucaccgucuccuccgucaagacccucaagaaccuccucggcaaguccugcgagugguucgagcccuccccccaggucaccgccacccacgacggcggcuuccucucccucgagugcgagaucaagcucgcccccaagcgcucccgccucgagacccgcgccggcgaggaggacgagggcgaggaggacuccgacuccgacuacgagaucuccgccaaggcccgcuacuucggcuacaucaagcagggccucuaccucgucaccgagauggagcgcuucgcccccccccgcaagcgcccccgcaccaucaccaagaacuaccgccucgucucccuccgcuccaccacccccgaggagcucuaccagcgcaagaucgaguccgaggaguacgaggaggcccucucccucgcccacaccuacggccucgacaccgaccucgucuaccagcgccaguggcgcaaguccgccgucaacgucgccuccauccagaacuaccucuccaagaucaagaagcgcuccuggguccuccacgagugccucgagcgcguccccgagaacgucgacgccgccaaggagcuccuccaguacggccucaagggcaccgaccucgaggcccuccucgccaucggcaagggcgccgacgacggccgcuucacccuccccggcgagaucgacaucgacuccaucuccuacgaggagcucuccccccccgacgaggagcccgccaagaacaagaaggagaaggagcucaagaagcgccaggagcuccucaagcucgucaacuucuccaagcucacccucgagcagaaggagcucugccgcugccgccgcaagcuccucaccuaccucgaccgccucgccaccuacgaggagauccucggcgucccccacgccuccgagcagcgcuacgacgccgaguucuucaagaaguuccgcaaccagaacaucguccucuccgcccgcaccuacgcccaggaguccaacguccaggcccucgagauccucuucaccuaccacggcuccgaccuccucccccaccgccucgccauccucuccaacuuccccgagaccaccuccccccacgaguacuccguccuccuccccgaggccugcuucaacggcgacucccucaugaucauccccuggcacgagcacaagcaccgcgccaaggacuggugcgaggagcucgccugccgcauggucgucgagcccaaccuccaggacgaguccgaguuccucuacgccgcccagcccgagcuccuccgcuuccgcaugacccagcucaccgucgagaaggucauggacugguaccagacccgcgccgaggagaucgagcacuacgcccgccaggucgacugcgcccucucccucauccgccucggcauggagcgcaacauccccggccuccucguccucugcgacaaccucgucacccucgagacccucgucuacgaggcccgcugcgacgucacccucacccucaaggagcuccagcagaugaaggacaucgagaagcuccgccuccucaugaacuccugcuccgaggacaaguacgucaccuccgccuaccaguggaugguccccuuccuccaccgcugcgagaagcagucccccggcgucgccaacgagcuccucaaggaguaccucgucacccucgccaagggcgaccucaaguucccccucaagaucuuccagcacuccaagcccgaccuccagcagaagaucauccccgaccaggaccagcucauggccaucgcccucgagugcaucuacaccugcgagcgcaacgaccagcucugccucugcuacgaccuccucgagugccuccccgagcgcggcuacggcgacaagaccgaggccaccaccaagcuccacgacauggucgaccagcucgagcagauccucuccgucuccgagcuccucgagaagcacggccucgagaagcccaucuccuucgucaagaacacccaguccuccuccgaggaggcccgcaagcucaugguccgccucacccgccacaccggccgcaagcagccccccgucuccgagucccacuggcgcacccuccuccaggacaugcucaccaugcagcagaacgucuacaccugccucgacuccgacgccugcuacgagaucuucaccgagucccuccucugcuccucccgccucgagaacauccaccucgccggccagaugaugcacugcuccgccugcuccgagaacccccccgccggcaucgcccacaagggcaagccccacuaccgcgucuccuacgagaaguccaucgaccucguccucgccgccucccgcgaguacuucaacuccuccaccaaccucaccgacuccugcauggaccucgcccgcugcugccuccagcucaucaccgaccgcccccccgccauccaggaggagcucgaccucauccaggccgucggcugccucgaggaguucggcgucaagauccucccccuccagguccgccucugccccgaccgcaucucccucaucaaggagugcaucucccagucccccaccugcuacaagcaguccaccaagcuccucggccucgccgagcuccuccgcgucgccggcgagaaccccgaggagcgccgcggccagguccucauccuccucgucgagcaggcccuccgcuuccacgacuacaaggccgccuccaugcacugccaggagcucauggccaccggcuaccccaaguccugggacgucugcucccagcucggccaguccgagggcuaccaggaccucgccacccgccaggagcucauggccuucgcccucacccacugcccccccuccuccaucgagcuccuccucgccgccuccuccucccuccagaccgagauccucuaccagcgcgucaacuuccagauccaccacgagggcggcgagaacaucuccgccuccccccucaccuccaaggccguccaggaggacgaggucggcguccccggcuccaacuccgccgaccuccuccgcuggaccaccgccaccaccaugaagguccucuccaacaccaccaccaccaccaaggccguccuccaggccgucuccgacggccagugguggaagaagucccucaccuaccuccgcccccuccagggccagaagugcggcggcgccuaccagaucggcaccaccgccaacgaggaccucgagaagcagggcugccaccccuucuacgaguccgucaucuccaaccccuucgucgccgaguccgagggcaccuacgacaccuaccagcacguccccgucgaguccuucgccgagguccuccuccgcaccggcaagcucgccgaggccaagaacaagggcgaggucuuccccaccaccgagguccuccuccagcucgccuccgaggcccuccccaacgacaugacccucgcccucgccuaccuccucgcccucccccagguccucgacgccaaccgcugcuucgagaagcagucccccuccgcccucucccuccagcucgccgccuacuacuacucccuccagaucuacgcccgccucgcccccugcuuccgcgacaagugccacccccucuaccgcgccgaccccaaggagcucaucaagauggucacccgccacgucacccgccacgagcacgaggccuggcccgaggaccucaucucccucaccaagcagcuccacugcuacaacgagcgccuccucgacuucacccaggcccagauccuccagggccuccgcaagggcgucgacguccagcgcuucaccgccgacgaccaguacaagcgcgagaccauccucggccucgccgagacccucgaggaguccgucuacuccaucgccaucucccucgcccagcgcuacuccgucucccgcugggaggucuucaugacccaccucgaguuccucuucaccgacuccggccucuccacccucgagaucgagaaccgcgcccaggaccuccaccucuucgagacccucaagaccgaccccgaggccuuccaccagcacauggucaaguacaucuaccccaccaucggcggcuucgaccacgagcgccuccaguacuacuucacccuccucgagaacugcggcugcgccgaccucggcaacugcgccaucaagcccgagacccacauccgccuccucaagaaguucaaggucgucgccuccggccucaacuacaagaagcucaccgacgagaacauguccccccucgaggcccucgagcccguccucuccucccagaacauccucuccaucuccaagcucguccccaagauccccgagaaggacggccagaugcucucccccuccucccucuacaccaucuggcuccagaagcucuucuggaccggcgacccccaccucaucaagcagguccccggcuccucccccgaguggcuccacgccuacgacgucugcaugaaguacuucgaccgccuccaccccggcgaccucaucaccgucgucgacgccgucaccuucucccccaaggccgucaccaagcucuccgucgaggcccgcaaggagaugacccgcaaggccaucaagaccgucaagcacuucaucgagaagccccgcaagcgcaacuccgaggacgaggcccaggaggccaaggacuccaaggucaccuacgccgacacccucaaccaccucgagaagucccucgcccaccucgagacccucucccacuccuucauccucucccucaagaacuccgagcaggagacccuccagaaguacucccaccucuacgaccucucccgcuccgagaaggagaagcuccacgacgaggccgucgccaucugccucgacggccagccccucgccaugauccagcagcuccucgaggucgccgucggcccccucgacaucucccccaaggacaucguccaguccgccaucaugaagaucaucuccgcccucuccggcggcuccgccgaccucggcggcccccgcgacccccucaagguccucgagggcgucgucgccgccguccacgccuccgucgacaagggcgaggagcucgucucccccgaggaccuccucgaguggcuccgccccuucugcgccgacgacgccuggcccguccgcccccgcauccacguccuccagauccucggccaguccuuccaccucaccgaggaggacuccaagcuccucgucuucuuccgcaccgaggccauccucaaggccuccuggccccagcgccaggucgacaucgccgacaucgagaacgaggagaaccgcuacugccucuucauggagcuccucgaguccucccaccacgaggccgaguuccagcaccucguccuccuccuccaggccuggccccccaugaaguccgaguacgucaucaccaacaaccccuggguccgccucgccaccgucaugcucacccgcugcaccauggagaacaaggagggccucggcaacgagguccucaagaugugccgcucccucuacaacaccaagcagaugcuccccgccgagggcgucaaggagcucugccuccuccuccucaaccagucccuccuccuccccucccucaagcuccuccucgagucccgcgacgagcaccuccacgagauggcccucgagcagaucaccgccgucaccaccgucaacgacuccaacugcgaccaggagcuccucucccuccuccucgacgccaagcuccucgucaagugcgucuccacccccuucuacccccgcaucgucgaccaccuccucgccucccuccagcagggccgcugggacgccgaggagcucggccgccaccuccgcgaggccggccacgaggccgaggccggcucccuccuccucgccguccgcggcacccaccaggccuuccgcaccuucuccaccgcccuccgcgccgcccagcacugggucuga

SEQ ID NO: 46456 - RNA, 2220 nt, Artificial Sequence
  derived and/or modified sequence opt2 from NBEA__Homo_sapiens__NP_001191126
auguucuccgagauccgcgccgucuucucccgccgcuaccuccuccagaacaccgcccucgaggucuucauggccaaccgcaccuccgucauguucaacuuccccgaccaggccaccgucaagaaggucgucuacucccucccccgcgucggcgucggcaccuccuacggccucccccaggcccgccgcaucucccucgccaccccccgccagcucuacaaguccuccaacaugacccagcgcuggcagcgccgcgagaucuccaacuucgaguaccucauguuccucaacaccaucgccggccgcaccuacaacgaccucaaccaguaccccgucuuccccuggguccucaccaacuacgaguccgaggagcucgaccucacccuccccggcaacuuccgcgaccucuccaagcccaucggcgcccucaaccccaagcgcgccgucuucuacgccgagcgcuacgagaccugggaggacgaccaguccccccccuaccacuacaacacccacuacuccaccgccaccuccacccucuccuggcucguccgcaucgagcccuucaccaccuucuuccucaacgccaacgacggcaaguucgaccaccccgaccgcaccuucuccuccgucgcccgcuccuggcgcaccucccagcgcgacaccuccgacgucaaggagcucauccccgaguucuacuaccuccccgagauguucgucaacuccaacggcuacaaccucggcguccgcgaggacgaggucgucgucaacgacgucgaccucccccccugggccaagaagcccgaggacuucguccgcaucaaccgcauggcccucgaguccgaguucgucuccugccagcuccaccaguggaucgaccucaucuucggcuacaagcagcgcggccccgaggccguccgcgcccucaacgucuuccacuaccucaccuacgagggcuccgucaaccucgacuccaucaccgaccccguccuccgcgaggccauggaggcccagauccagaacuucggccagacccccucccagcuccucaucgagccccaccccccccgcuccuccgccaugcaccucugcuuccucccccaguccccccucauguucaaggaccagaugcagcaggacgucaucaugguccucaaguuccccuccaacucccccgucacccacgucgccgccaacacccucccccaccucaccauccccgccgucgucaccgucaccugcucccgccucuucgccgucaaccgcuggcacaacaccgucggccuccgcggcgcccccggcuacucccucgaccaggcccaccaccuccccaucgagauggacccccucaucgccaacaacuccggcgucaacaagcgccagaucaccgaccucgucgaccaguccauccagaucaacgcccacugcuucgucgucaccgccgacaaccgcuacauccucaucugcggcuucugggacaaguccuuccgcgucuacuccaccgagaccggcaagcucacccagaucgucuucggccacugggacgucgucaccugccucgcccgcuccgaguccuacaucggcggcgacugcuacaucgucuccggcucccgcgacgccacccuccuccucugguacugguccggccgccaccacaucaucggcgacaaccccaacuccuccgacuaccccgccccccgcgccguccucaccggccacgaccacgaggucgucugcgucuccgucugcgccgagcucggccucgucaucuccggcgccaaggagggccccugccucguccacaccaucaccggcgaccuccuccgcgcccucgagggccccgagaacugccucuucccccgccucaucuccgucuccuccgagggccacugcaucaucuacuacgagcgcggccgcuucuccaacuucuccaucaacggcaagcuccucgcccagauggagaucaacgacuccacccgcgccauccuccucuccuccgacggccagaaccucgucaccggcggcgacaacggcgucgucgaggucuggcaggccugcgacuucaagcagcucuacaucuaccccggcugcgacgccggcauccgcgccauggaccucucccacgaccagcgcacccucaucaccggcauggccuccggcuccaucgucgccuucaacaucgacuucaaccgcuggcacuacgagcaccagaaccgcuacuga

SEQ ID NO: 46457 - RNA, 8085 nt, Artificial Sequence
  derived and/or modified sequence opt2 from NBEAL1__Homo_sapiens__NP_001107604
auggccucccgcgagcgccucuucgagcucuggaugcucuacugcaccaagaaggaccccgacuaccucaagcucuggcucgacaccuucgucuccuccuacgagcaguuccucgacgucgacuucgagaagcuccccacccgcgucgacgacaugccccccggcaucucccuccuccccgacaacauccuccagguccuccgcauccagcuccuccagugcguccagaagauggccgacggccucgaggagcagcagcaggcccucuccauccuccucgucaaguucuucaucauccucugccgcaaccucuccaacgucgaggagaucggcaccugcuccuacaucaacuacgucaucaccaugaccacccucuacauccagcagcucaaguccaagaagaaggagaaggagauggccgaccagaccugcaucgaggaguucgucauccacgcccucgccuucugcgagucccucuacgaccccuaccgcaacuggcgccaccgcaucuccggccgcauccucuccaccgucgagaagucccgccagaaguacaagcccgccucccucaccgucgaguucguccccuucuucuaccagugcuuccaggaguccgagcaccucaaggagucccucaagugcugccuccuccaccucuucggcgccaucgucgccggcggccagcgcaacgcccuccaggccaucucccccgccaccauggagguccucaugcgcguccucgccgacugcgacuccugggaggacggcgaccccgaggaggucggccgcaaggccgagcucacccucaagugccucaccgaggucguccacauccuccucuccuccaacuccgaccagcgccaggucgagaccuccaccauccucgagaacuacuucaagcuccucaacuccgaccacuccgcccuccccaaccagcgccgcucccgccagugggagaaccgcuucaucgcccuccagaucaagaugcucaacaccaucaccgccaugcucgacugcaccgaccgccccguccuccaggccaucuuccucaacuccaacugcuucgagcaccucauccgccuccuccagaacugcaaggucuuccagggccagcucgacugccucgccaucuccaccauccaggcccucaccgccgucaugaacaagucccccgccgccaaggaggucuucaaggagcgcaucggcuacacccacaugcucgagguccucaagucccucggccagcccccccucgagcuccucaaggagcucaugaacauggccgucgagggcgaccacaccuccgucggcauccucggcaucuccaacguccagccccuccuccuccucauccaguggcuccccgagcuccagucccacgaccuccagaucuucaucuccgacuggcucaagcgcaucugcugcaucaaccgccagucccgcaccaccugcgucaacgccaacaugggcauccgcaucaucgagacccucgaccuccacuccucccuccaccagaccugcgccgagaaccucaucgccauccacggcucccucggcucccaguccgucuccuccgaggagauccgccgccuccuccgccuccuccgcgucgacgaguccgaguccguccaccccuacgucacccccgucacccgcgccauccucaccauggcccgcaagcucucccucgaguccgcccuccaguacuucaaccucucccacuccauggccggcaucuccgucccccccauccagaaguggcccggcuccgccuucuccuucuccgccugguucugccucgaccaggaccagcucacccucggcaucgccaacaagggcggcaagcgcaagcagcucuacuccuucuucaccggcuccggcaugggcuucgaggccuucaucacccacuccggcaugcucgucgucgccgucugcaccaagcgcgaguacgccaccgucaugcuccccgaccacuccuucugcgacucccucuggcacaacaucaccgucguccacaugcccggcaagcgccccuucggccaguccuucgucuacaucuacgacaacggccagcagaaggucuccgccccccuccgcuuccccgccaugaacgagcccuucaccuccugcugcaucggcuccgccggccagcgcaccaccacccccccccccucccagauccccgacccccccuucuccucccccaucaccccccaccgcaccuccuucggcggcauccucuccuccgccuccuggggcggcaccaucgagaaguccaagcucaucaccaagcucaucuccgccggcacccaggacuccgaguggggcugccccaccucccucgagggccagcucggcuccgucaucaucuucuacgagccccuccagcccccccaggucaaggcccucuaccucgccggccccaacugccucucccccuggaagugccaggaguccgacauggccgaccuccccggcaacauccuccucuacuacaccgccaaggccugcaagaacuccaucugccucgaccucuccaccaacugccuccacggccgccucaccggcaacaaggucgucaacugggacaucaaggacaucaucaacugcaucggcggccucaacguccucuucccccuccucgagcagaucucccacuucuccgagggccagauccccgaggagaagaacgaguccaccguccccgaguccgucacccccgucgagggcgacuggcucgucuggaccuccaccaaggccuccgagucccgccucgagcgcaaccucgucgccaccuucauccucaucgucaagcacuucauccagcgccaccccaucaaccagggcaaccucauccacucccacggcgucgccacccucggcgcccuccuccagaagguccccuccacccucauggacgucaacguccucauggccguccagcuccucaucgagcaggucucccucgagaagaacaugcagcuccuccagcagauguaccaguaccuccucuucgacuuccgcaucuggaaccgcggcgacuuccccuuccgcaucggccacauccaguaccucuccaccaucaucaaggacucccgccgcgucuuccgcaagaaguacggcguccaguuccuccucgacacccuccgcaucuacuacggcaacggcugcaaguacaacgagcucucccucgacgacauccgcaccauccgcaccucccucuacggccucaucaaguacuuccucugcaagggcggcucccacgaggagauccaguccaucaugggcuacaucgccgccaccaacgaggaggagcagcucuucggcauccucgacguccucuucucccuccuccgcaccucccccacccgcggccagcucuuccuccuccucuucgagcccggcaacgccgacauccucuacgcccuccuccucaaccagaaguacuccgaccgccuccgcgagaucaucuucaagaucauggagcagaugcucaagugcaccaacgucuacgagcgcuccaagcagcacauccgccuccgcgaggucggcuacuccggccucggccuccuccucaacgaggcccucgucaacaccucccucaucaagaaccucacccaccagaucaucaacaccgaccccgucaucaacuucaaggaccuccucuccgucgucuacaucucccaccgcgcccacaucaacguccgcgucgccaucugccgcaagguccuccagauccuccaguuccagcccgacgccgcccaccagaucucccagcaggucggcuggcaggacacccucguccgccucuuccucaaggccaaguucgagaacggcaacacccuccacaagcacucccgcgccguccucaugaaggacaacgacaagaacauguccaccgaggacaccaagaagaacuccgacgagaagaccgacgaggagaagaucaccuccuucgccuccgccaacgucuccuccgaccaguggucccucgaggaccgccacucccucgacuccaacaccccccucuuccccgaggacuccuccgucggcgagcucuccuucaaguccgagaaccaggaggaguucuggcacuccaaccccucccaccucucccucgaccucuccggcaucgacuccugcgagauguccgacuccggcucccagguccccgacucccuccccuccacccccucccccgucgaguccaccaaguccuucuccguccacuccgaccgcgaguccuccaucaccaacgacaugggcuucuccgacgacuucucccuccucgagucccaggagcgcugcgaggaggagcuccuccagcuccucacccacauccucaacuacgucaugugcaagggccucgagaaguccgacgacgacaccuggaucgagcgcggccaggucuucuccgcccucuccaagcccggcaucuccuccgagcuccuccgccccuccgacgagaucaagcucacccuccuccagaagaugcucgagugggccaucuccgagaaccgcgaggccaagaccaaccccgucaccgccgagaacgccuuccgccucguccucaucauccaggacuuccuccaguccgagggccucgucaacuccaacauguggaccgagaagcuccucgaggacaugaugcuccucuucgacugccucuccgucugcuacuccgagucccccgucugggucaagcucucccagauccagauccagcuccuccucggcuucaucggccgcggcaaccuccaggucugcgccauggccuccgccaagcucaacacccuccuccagaccaaggucaucgagaaccaggacgaggccugcuacauccucggcaagcucgagcacguccucucccaguccaucaaggagcagaccgagaucuacuccuuccucaucccccucguccgcacccucgucuccaagaucuacgagcuccucuucaugaaccuccaccuccccucccuccccuucaccaacggcuccuccuccuucuucgaggacuuccaggaguacugcaacuccaacgaguggcaggucuacaucgagaaguacaucguccccuacaugaagcaguacgaggcccacaccuucuacgacggccacgagaacauggcccucuacuggaaggacugcuacgaggcccucauggucaacaugcacaagcgcgaccgcgagggcggcgaguccaagcucaaguuccaggagcucuucgucgagcccuucaaccgcaaggcccgccaggagaaccuccgcuacaacaacaugcucaagcagcucuccucccagcagcucgccacccuccgccgcuggaaggccauccagcucuaccucaccugcgagcgcggccccugggccaagcgcaagcagaaccccauccacuggaagcucgccaacgucgagaacuacucccgcaugcgccucaagcucguccccaacuacaacuucaagacccacgaggaggccuccgcccuccgcgacaaccucggcauccagcacucccagcccuccuccgacacccuccuccucgaggucgucaagcaggucaaggucuccgacauggucgaggacaagcucgaccuccccgaggaggacaucaccgcccgcgucaacgucgacgagaaggaggagcaggaccagaaggagaagcucguccucauggaggacugcgagcucaucaccaucaucgacgucauccccggccgccucgagaucaccacccagcacaucuacuucuacgacggcuccaucgagaaggaggacggcgucggcuucgacuucaaguggccccacucccagauccgcgagauccaccuccgccgcuacaaccuccgccgcuccgcccucgagaucuuccacgucgaccaguccaacuacuuccucaacuucaagaaggagguccgcaacaagaucuacucccgccuccucucccuccacucccccaacuccuacuacggcucccgcuccccccaggagcucuucaaggccuccggccucacccagaagugggucaaccgcgagaucuccaacuucgacuaccucauccagaucaacaccauggccggccgcaccuacaacgaccucgcccaguaccccgucuuccccuggauccuccaggacuacaccuccgaggagcucgaccucaacaaccccgccgucuuccgcgaccucuccaagcccaucggcgucgucaacgagaagaacgccaaggccaugcgcgagaaguacgagaacuucgaggaccccaugggcaccaucgacaaguuccacuacggcacccacuacuccaacuccgccggcgucaugcacuaccucauccgcgucgagcccuucaccacccuccacauccagcuccaguccggccgcuucgacugcgccgaccgccaguuccacuccauccccgccaccuggcaggcccucauggacaaccccuacgacgucaaggagcucauccccgaguucuucuacuuccccgaguuccucgagaaccagaaccaguucaaccucggccgccuccagaucuccaaggagcucgucaacgacgucauccuccccaagugggccaaguccgccgaggacuucaucuacaagcaccgcaaggcccucgaguccgaguacgucuccgcccaccuccacgaguggaucgaccucaucuucggcuacaagcagcgcggccccgccgccgucgaggcccucaacgucuucuacuacugcuccuacgagggcgccgucgaccucgacgcccucaccgacgagaaggagcgcaaggcccucgagggcaugaucaacaacuucggccagacccccugccagcuccucaaggagccccaccccccccgccucuccgccgaggaggccguccagaagcccaccaagaucgacaccuccacccucaaccucuuccagcaccuccccgagcucaaguccuucuucaucgagggcaucuccgacggcaucccccuccucaaggccaccauccccaagaaccaguaccgcuccuucaugucccagggcucccccgagcuccucaucaccaucuccaugaacuacgucaucggcacccacggcuggcuccccuacgaccgcaacaucuccaacuacuucaccuucaucaaggaccagaccgucaccaaccccaagacccagcgcuccaucaacggcuccuucgcccccggccucgagaucaccuccaagcucuucgucgucucccacgacgccaagcuccucuucuccgccggcuacugggacaacuccauccaggucaugucccucaccaagggcaagaucaucucccacaucauccgccacauggacaucgucaccugccucgccaccgacuacugcggcauccaccucaucuccggcucccgcgacaccaccugcaugaucuggcagaucacccagcagggcggcguccccgucggccucgccuccaagcccuuccagauccucuacggccacaccaacgagguccucuccgucggcaucuccaccgagcucgacauggccgucuccggcucccgcgacggcaccgucaucauccacaccauccagaagggccaguacaugcgcacccuccgcccccccugcgaguccucccucuuccucaccauccccaaccucgccaucuccugggagggccacaucgucgucuacuccuccaccgaggagaagaccacccucaaggacaagaacgcccuccaccucuucuccaucaacggcaaguaccucggcucccagauccucaaggagcaggucuccgacaucugcaucaucggcgagcacaucgucaccggcuccauccagggcuuccucuccauccgcgaccuccacucccucaaccucuccaucaacccccucgccaugcgccuccccauccacugcgucugcgucaccaaggaguacucccacauccucgucggccucgaggacggcaagcucaucgucgucggcgucggcaagcccgccgagaugcgcuccggccagcucucccgcaaguucuggggcuccuccaagcgccucucccagaucuccgccggcgagaccgaguacaacacccaggacuccaaguga

SEQ ID NO: 46458 - RNA, 8265 nt, Artificial Sequence
  derived and/or modified sequence opt2 from NBEAL2__Homo_sapiens__NP_055990
auggccgccuccgagcgccucuacgagcucuggcuccucuacuacgcccagaaggaccucggcuaccuccagcaguggcucaaggccuucgucggcgccuucaagaaguccaucucccucuccucccucgagccccgccgccccgaggaggccggcgccgaggucccccuccucccccucgacgagcuccacguccucgccgagcagcuccaccaggccgaccucgagcaggcccuccuccuccucaagcucuucaucauccucugccgcaaccucgagaacaucgaggccggccgcggccagguccucgucccccgcguccucgcccuccucaccaagcucgucgccgagcucaagggcugcccccccccccagggccgcggcacccagcucgagaacgucgcccuccacgcccuccuccucugcgagggccucuucgaccccuaccagaccuggcgccgccagcgcuccggcgaggucaucuccuccaaggagaaguccaaguacaaguucccccccgccgcccucccccaggaguucuccgccuucuuccaggagucccuccagaacgccgaccaccucccccccauccuccuccuccgccucauccaccucuucugcgccguccucgccggcggcaaggagaacggccagauggccgucuccgacggcuccgucaagggccuccucuccgucguccgcggcuggucccgcggccccgcccccgaccccugccucgucccccucgcccucgaggcccucgucggcgccguccacguccuccacgccucccgcgcccccccccgcggccccgagcuccgcgcccuccucgaguccuacuuccacguccucaacgccgacuggcccgccggccucuccuccggccccgaggaggcccucgucacccuccgcgucuccaugcucgacgccauccccaugaugcucgccugcgaggaccgccccguccuccaggccaccuuccucuccaacaacugcuucgagcaccucacccgccucauccagaacuccaagcucuaccuccagucccgcgccccccccgagggcgacuccgaccucgccacccgccuccucaccgagcccgacguccagaagguccucgaccaggacaccgacgccaucgccguccacgucguccgcguccucaccugcaucauguccgacucccccuccgccaaggaggucuucaaggagcgcaucggcuacccccaccuccaggagguccuccagucccacggcccccccacccaccgccuccuccaggagcuccucaacauggccgucgagggcgaccacuccaugugcccccccccccccauccgcaacgagcagcccguccucguccucgcccaguggcuccccucccuccccaccgccgagcuccgccucuuccucgcccagcgccuccgcuggcucugcgacuccugccccgccucccgcgccaccugcguccaggccggccucgucggcugccuccucgagacccucuccaccggccucgcccucgaggcccgcugccaggagcagcuccucgcccuccuccaggcccucggccgcgucuccauccgccccauggagcuccgccaccuccuccgcccccgccccggccucgacuccgagcccggcggcgccgaggccggcaaggcccgccacgccggcgccgucauccgcacccucuccggcauggcccgccaccagggccccgcccgcgcccuccgcuacuucgaccucacccccuccauggccggcaucauggucccccccguccagcgcuggcccggccccggcuucaccuuccacgccuggcucugccuccaccccauggacaccgcccccacccccgcccccacccgcccccuccagcgcaagcagcucuacuccuucuucaccuccuccggcuccggcuucgaggccuucuucaccgccgccggcacccucgucgucgccgucugcacccgcaaggaguaccucaccaugucccuccccgaggucuccuucgccgacuccgccuggcacugcgucgccaucguccacguccccggccgccgccccuucucccagaaccucguccacgucuacaaggacggccaccucgucaagaccgccccccuccgcugccccucccucuccgagcccuucuccuccugcugcaucggcuccgccggcuaccgcaccaccaccaccaccaccggccuccccaccccccccguccccgccacccucgccuacacccaccccgcccucacccgcucccaguccguccccgccuccaccggccucggcuggggcuccggccucgucgccccccuccaggagggcuccaucgacuccacccucgccggcacccaggacacccgcuggggcucccccaccucccucgagggcgagcucggcgccgucgccaucuuccacgaggcccuccaggccaccgcccuccgcacccucugcacccucggccccaacgagaccgcccccuucaagcccgagggcgagcuccacgagcucuccacccgccuccuccuccacuacuccccccaggccugcaagaacaacaucugccucgaccucucccccucccacggccucgacggccgccucaccggccaccgcgucgagaccugggacgucaaggacgucgucaacugcgucggcggcaugggcgcccuccucccccuccucgagcgcgucgccgcccagcccaaggaggccgaggccggccccgccgagacccacgaccucgucggccccgagcucaccuccggccacaacacccagggccucguccucccccucggcaaguccuccgaggagcgcauggagcgcaacgccgucgccgccuuccuccucaugcuccgcaacuuccuccagggccacauggucaaccaggagucccucguccagugccagggccccgccaucaucggcgcccuccuccgcaagguccccuccugggccauggacaugaacguccucauguccgcccagcuccucauggagcaggucgccgccgagggcuccggcccccuccucuaccuccucuaccagcaccuccucuucaacuuccaccucuggacccucuccgacuucgccguccgccucggccacauccaguacauguccuccaucguccgcgagcaccgccagaagcuccgcaagaaguacggcguccaguucauccucgacgcccuccgcacccacuacuccccccagcgcgagcgcccccucgccgccgacgaccuccgcaccguccagaccucccuccucggccucgcccgcgaguuccucguccgcucccucuccgccgacgacguccaggucacccagaccaugcucuccuuccucgccgccaccggcgacgacggccaggccgucggcgcccucgaccuccuccucgcccuccuccacggcucccucguccaggagucccucgccgucuuccuccucgagcccggcaaccucgagguccuccucgcccuccucguccgccccggcucccucccccuccuccccgaccgcgucugcaagauccuccgccgccuccagcagaacgagcgccuccccgagcgcucccgccagcgccuccgccuccgcgagugcggccuccagggccucgucgccugccuccccgagggcaccgucuccccccagcucugccagggccucuacaagcucuuccucggcgccgacugccucaaccucuccgaccuccucgccgucguccagcucucccuccaggccgaccucuccguccgccucgacaucugccgccagcucuuccaccucaucuacggccagcccgacgucguccgccuccucgcccgccaggccggcuggcaggacguccucacccgccucuacguccucgaggccgccaccgccggcucccccccccccuccucccccgagucccccaccucccccaagcccgccccccccaagccccccaccgagucccccgccgagcccuccgacgucuuccuccccuccgaggcccccugccccgaccccgacggcuucuaccacgcccucucccccuucugcacccccuucgaccucggccucgagcgcuccuccgucggcuccggcaacaccgccggcggcggcggcuccuccggcacccucacccccgccucccagcccggcacccccuccccccucgacggcccccgccccuuccccgccgcccccggccgccacuccuccucccucuccaacguccucgaggacggcucccuccccgagcccaccaucuccggcgacgacaccuccaacaccuccaacccccagcagaccuccgaggaggagcucugcaaccuccucaccaacguccucuucuccgucaccuggcgcggcgucgagggcuccgacgaggccgccuggcgcgagcgcggccaggucuucuccguccucacccagcucggcgccuccgccacccucguccgcccccccgacugcaucaagcgcucccuccucgagaugaugcucgaguccgcccucaccgacaucaaggaggcccccgucggcguccucgccucccucacccagcaggcccucuggcuccuccgccuccuccaggacuuccucugcgccgagggccacggcaaccaggagcucugguccgagaagcucuucgagggcgucugcucccuccucgaccgccucggcgccuggccccaccucgccaacggcaccgccgaccuccgcgagauggcccagaucggccuccgccucguccucggcuacauccuccucgaggacccccagcuccacgcccaggccuacguccgccuccacaugcuccuccagaccgccguccccgcccgccgcgaggaggccugcuacguccucuccaagcucgaggccgcccucggccgcguccucaacaccuccucccucgaguccgccaccgacgaggccggcuccccccucgccgccgccgccgccgccgccgccgccgagcgcugcuccuggcucgucccccucguccgcacccuccucgaccgcgccuacgagccccucggccuccaguggggccuccccucccucccccccaccaacggcucccccaccuucuucgaggacuuccaggccuucugcgccacccccgaguggcgccacuucaucgacaagcagguccagcccaccaugucccaguucgagauggacaccuacgccaagucccacgaccucauguccggcuucuggaacgccugcuacgacaugcucauguccuccggccagcgccgccagugggagcgcgcccagucccgccgcgccuuccaggagcucguccucgagcccgcccagcgccgcgcccgccucgagggccuccgcuacaccgccguccucaagcagcaggccacccagcacuccauggcccuccuccacuggggcgcccucuggcgccagcucgccucccccugcggcgccugggcccuccgcgacacccccaucccccgcuggaagcucuccuccgccgagaccuacucccgcaugcgccucaagcucguccccaaccaccacuucgacccccaccucgaggccuccgcccuccgcgacaaccucggcgaggucccccucacccccaccgaggaggccucccucccccucgccgucaccaaggaggccaaggucuccaccccccccgagcuccuccaggaggaccagcucggcgaggacgagcucgccgagcucgagacccccauggaggccgccgagcucgacgagcagcgcgagaagcucguccucuccgccgagugccagcucgucaccgucgucgccgucguccccggccuccucgaggucaccacccagaacgucuacuucuacgacggcuccaccgagcgcgucgagaccgaggagggcaucggcuacgacuuccgccgcccccucgcccagcuccgcgagguccaccuccgccgcuucaaccuccgccgcuccgcccucgagcucuucuucaucgaccaggccaacuacuuccucaacuuccccugcaaggucggcaccacccccgucuccucccccucccagaccccccgcccccagcccggccccauccccccccacacccagguccgcaaccaggucuacuccuggcuccuccgccuccgcccccccucccagggcuaccucuccucccgcuccccccaggagaugcuccgcgccuccggccucacccagaaguggguccagcgcgagaucuccaacuucgaguaccucaugcagcucaacaccaucgccggccgcaccuacaacgaccucucccaguaccccgucuuccccuggguccuccaggacuacgucucccccacccucgaccucuccaaccccgccgucuuccgcgaccucuccaagcccaucggcgucgucaaccccaagcacgcccagcucguccgcgagaaguacgaguccuucgaggaccccgccggcaccaucgacaaguuccacuacggcacccacuacuccaacgccgccggcgucaugcacuaccucauccgcgucgagcccuucaccucccuccacguccagcuccaguccggccgcuucgacugcuccgaccgccaguuccacuccgucgccgccgccuggcaggcccgccucgagucccccgccgacgucaaggagcucauccccgaguucuucuacuuccccgacuuccucgagaaccagaacggcuucgaccucggcugccuccagcucaccaacgagaaggucggcgacgucguccucccccccugggccuccucccccgaggacuucauccagcagcaccgccaggcccucgaguccgaguacgucuccgcccaccuccacgaguggaucgaccucaucuucggcuacaagcagcgcggccccgccgccgaggaggcccucaacgucuucuacuacugcaccuacgagggcgccgucgaccucgaccacgucaccgacgagcgcgagcgcaaggcccucgagggcaucaucuccaacuucggccagacccccugccagcuccucaaggagccccaccccacccgccucuccgccgaggaggccgcccaccgccucgcccgccucgacaccaacucccccuccaucuuccagcaccucgacgagcucaaggccuucuucgccgaggucgucuccgacggcgucccccucguccucgcccucgucccccaccgccagccccacuccuucaucacccagggcucccccgaccuccucgucaccgucuccgccuccggccuccucggcacccacuccuggcuccccuacgaccgcaacaucuccaacuacuucuccuucuccaaggaccccaccaugggcucccacaagacccagcgccuccucuccggccccuggguccccggcuccggcgucuccggccaggcccucgccgucgcccccgacggcaagcuccucuucuccggcggccacugggacggcucccuccgcgucaccgcccucccccgcggcaagcuccucucccagcucuccugccaccucgacgucgucaccugccucgcccucgacaccugcggcaucuaccucaucuccggcucccgcgacaccaccugcauggucuggcgccuccuccaccagggcggccucuccgucggccucgcccccaagcccguccagguccucuacggccacggcgccgccgucuccugcgucgccaucuccaccgagcucgacauggccgucuccggcuccgaggacggcaccgucaucauccacaccguccgccgcggccaguucgucgccgcccuccgcccccucggcgccaccuuccccggccccaucuuccaccucgcccucggcuccgagggccagaucgucguccaguccuccgccugggagcgccccggcgcccaggucaccuacucccuccaccucuacuccgucaacggcaagcuccgcgccucccucccccucgccgagcagcccaccgcccucaccgucaccgaggacuucguccuccucggcaccgcccagugcgcccuccacauccuccagcucaacacccuccuccccgccgcccccccccuccccaugaaggucgccauccgcuccgucgccgucaccaaggagcgcucccacguccucgucggccucgaggacggcaagcucaucgucgucgucgccggccagcccuccgagguccgcuccucccaguucgcccgcaagcucuggcgcuccucccgccgcaucucccaggucuccuccggcgagaccgaguacaaccccaccgaggcccgcuga

SEQ ID NO: 46459 - RNA, 2265 nt, Artificial Sequence
  derived and/or modified sequence opt2 from NBN__Homo_sapiens__NP_002476
auguggaagcuccuccccgccgccggccccgccggcggcgagcccuaccgccuccucaccggcgucgaguacgucgucggccgcaagaacugcgccauccucaucgagaacgaccaguccaucucccgcaaccacgccguccucaccgccaacuucuccgucaccaaccucucccagaccgacgagauccccguccucacccucaaggacaacuccaaguacggcaccuucgucaacgaggagaagaugcagaacggcuucucccgcacccucaaguccggcgacggcaucaccuucggcgucuucggcuccaaguuccgcaucgaguacgagccccucgucgccugcuccuccugccucgacgucuccggcaagaccgcccucaaccaggccauccuccagcucggcggcuucaccgucaacaacuggaccgaggagugcacccaccucgucauggucuccgucaaggucaccaucaagaccaucugcgcccucaucugcggccgccccaucgucaagcccgaguacuucaccgaguuccucaaggccgucgaguccaagaagcagcccccccagaucgaguccuucuaccccccccucgacgagcccuccaucggcuccaagaacgucgaccucuccggccgccaggagcgcaagcagaucuucaagggcaagaccuucaucuuccucaacgccaagcagcacaagaagcucuccuccgccgucgucuucggcggcggcgaggcccgccucaucaccgaggagaacgaggaggagcacaacuucuuccucgcccccggcaccugcgucgucgacaccggcaucaccaacucccagacccucauccccgacugccagaagaaguggauccaguccaucauggacaugcuccagcgccagggccuccgccccauccccgaggccgagaucggccucgccgucaucuucaugaccaccaagaacuacugcgacccccagggccaccccuccaccggccucaagaccaccacccccggccccucccucucccagggcgucuccgucgacgagaagcucaugcccuccgcccccgucaacaccaccaccuacgucgccgacaccgaguccgagcaggccgacaccugggaccucuccgagcgccccaaggagaucaaggucuccaagauggagcagaaguuccgcaugcucucccaggacgcccccaccgucaaggaguccugcaagaccuccuccaacaacaacuccauggucuccaacacccucgccaagaugcgcauccccaacuaccagcucucccccaccaagcuccccuccaucaacaaguccaaggaccgcgccucccagcagcagcagaccaacuccauccgcaacuacuuccagcccuccaccaagaagcgcgagcgcgacgaggagaaccaggagauguccuccugcaaguccgcccgcaucgagaccuccugcucccuccucgagcagacccagcccgccacccccucccucuggaagaacaaggagcagcaccucuccgagaacgagcccgucgacaccaacuccgacaacaaccucuucaccgacaccgaccucaaguccaucgucaagaacuccgccuccaagucccacgccgccgagaagcuccgcuccaacaagaagcgcgagauggacgacgucgccaucgaggacgagguccucgagcagcucuucaaggacaccaagcccgagcucgagaucgacgucaagguccagaagcaggaggaggacgucaacguccgcaagcgcccccgcauggacaucgagaccaacgacaccuucuccgacgaggccguccccgaguccuccaagaucucccaggagaacgagaucggcaagaagcgcgagcucaaggaggacucccucugguccgccaaggagaucuccaacaacgacaagcuccaggacgacuccgagaugcuccccaagaagcuccuccucaccgaguuccgcucccucgucaucaagaacuccaccucccgcaaccccuccggcaucaacgacgacuacggccagcucaagaacuucaagaaguucaagaaggucaccuaccccggcgccggcaagcucccccacaucaucggcggcuccgaccucaucgcccaccacgcccgcaagaacaccgagcucgaggaguggcuccgccaggagauggagguccagaaccagcacgccaaggaggagucccucgccgacgaccucuuccgcuacaaccccuaccucaagcgccgccgcuga

SEQ ID NO: 46460 - RNA, 1734 nt, Artificial Sequence
  derived and/or modified sequence opt2 from NBPF3__Homo_sapiens__XP_011540583
auggucgucuccgccggccccugguccggcgagaaggccgagaugaacauccucgagaucaacaagaagucccgcccccagcucgccgagaacaagcagcaguuccgcaaccucaagcagaagugccucgucacccaggucgccuacuuccucgccaaccgccagaacaacuacgacuacgaggacugcaaggaccucaucaaguccaugcuccgcgacgagcgccuccucaccgaggagaagcucgccgaggagcucggccaggccgaggagcuccgccaguacaagguccucguccacucccaggagcgcgagcucacccagcuccgcgagaagcuccaggagggccgcgacgccucccgcucccucaaccagcaccuccaggcccuccucacccccgacgagcccgacaacucccagggccgcgaccuccgcgagcagcucgccgagggcugccgccucgcccagcaccucguccagaagcucucccccgagaacgacgacgacgaggacgaggacgucaaggucgaggaggccgagaagguccaggagcucuacgccccccgcgagguccagaaggccgaggagaaggagguccccgaggacucccucgaggagugcgccaucaccugcuccaacucccaccaccccugcgaguccaaccagcccuacggcaacacccgcaucaccuucgaggaggaccaggucgacuccacccucaucgacuccuccucccacgacgaguggcucgacgccgucugcaucauccccgagaacgaguccgaccacgagcaggaggaggagaagggccccgucuccccccgcaaccuccaggaguccgaggaggaggaggccccccaggaguccugggacgagggcgacuggacccucuccaucccccccgacauguccgccuccuaccaguccgaccgcuccaccuuccacuccgucgaggagcagcaggucggccucgcccucgacaucggccgccacuggugcgaccaggucaagaaggaggaccaggaggccaccuccccccgccucucccgcgagcuccucgacgagaaggagcccgagguccuccaggacucccucgaccgcuucuacuccacccccuucgaguaccucgagcuccccgaccucugccagcccuaccgcuccgacuucuacucccuccaggagcagcaccucggccucgcccucgaccucgaccgcaugaagaaggaccaggaggaggaggaggaccagggcccccccugcccccgccucucccgcgagcuccccgaggucgucgagcccgaggaccuccaggacucccucgaccgcugguacuccacccccuucuccuaccccgagcuccccgacuccugccagcccuacggcuccugcuucuacucccucgaggaggagcacgucggcuucucccucgacgucgacgagaucgagaaguaccaggagggcgaggaggaccagaagccccccugcccccgccucaacgagguccucauggaggccgaggagcccgagguccuccaggacucccucgaccgcugcuacuccaccaccuccaccuacuuccagcuccacgccuccuuccagcaguaccgcuccgccuucuacuccuucgaggagcaggacgucucccucgcccucgacgucgacaaccgcuucuucacccucaccgucauccgccaccaccucgccuuccagaugggcgucaucuucccccacuga

SEQ ID NO: 46461 - RNA, 2814 nt, Artificial Sequence
  derived and/or modified sequence opt2 from NBR1__Homo_sapiens__NP_001278500
auggagccccaggucacccucaacgucaccuucaagaacgagauccaguccuuccucgucuccgaccccgagaacaccaccugggccgacaucgaggccauggucaaggucuccuucgaccucaacaccauccagaucaaguaccucgacgaggagaacgaggaggucuccaucaacucccagggcgaguacgaggaggcccucaagauggccgucaagcagggcaaccagcuccagaugcagguccacgagggccaccacgucgucgacgaggcccccccccccgucgucggcgccaagcgccucgccgcccgcgccggcaagaagccccucgcccacuacuccucccucguccgcguccucggcuccgacaugaagacccccgaggaccccgccguccaguccuucccccucguccccugcgacaccgaccagccccaggacaagccccccgacugguucaccuccuaccucgagaccuuccgcgagcaggucgucaacgagaccgucgagaagcucgagcagaagcuccacgagaagcucguccuccagaaccccucccucggcuccugccccuccgaggucuccaugcccaccuccgaggagacccucuuccuccccgagaaccaguucuccuggcacaucgccugcaacaacugccagcgccgcaucgucggcguccgcuaccagugcucccucugccccuccuacaacaucugcgaggacugcgaggccggccccuacggccacgacaccaaccacguccuccucaagcuccgccgccccgucgucggcuccuccgagcccuucugccacuccaaguacuccaccccccgccuccccgccgcccucgagcagguccgccuccagaagcaggucgacaagaacuuccucaaggccgagaagcagcgccuccgcgccgagaagaagcagcgcaaggccgaggucaaggagcucaagaagcagcucaagcuccaccgcaagauccaccucuggaacuccauccacggccuccagucccccaaguccccccucggccgccccgagucccuccuccaguccaacacccucaugcucccccuccagcccugcaccuccgucaugcccaugcucuccgccgccuucgucgacgagaaccuccccgacggcacccaccuccagcccggcaccaaguucaucaagcacuggcgcaugaagaacaccggcaacgucaagugguccgccgacaccaagcucaaguucauguggggcaaccucacccucgccuccaccgagaagaaggacguccucguccccugccucaaggccggccacgucggcgucgucuccgucgaguucaucgcccccgcccucgagggcaccuacaccucccacuggcgccucucccacaagggccagcaguucggcccccgcgucuggugcuccaucaucgucgaccccuuccccuccgaggagucccccgacaacaucgagaagggcaugaucuccuccuccaagaccgacgaccucaccugccagcaggaggagaccuuccuccucgccaaggaggagcgccagcucggcgaggucaccgagcagaccgagggcaccgccgccugcaucccccagaaggccaagaacgucgccuccgagcgcgagcucuacauccccuccgucgaccuccucaccgcccaggaccuccucuccuucgagcuccucgacaucaacaucguccaggagcucgagcgcgucccccacaacacccccgucgacgucacccccugcauguccccccucccccacgacuccccccucaucgagaagcccggccucggccagaucgaggaggagaacgagggcgccggcuucaaggcccuccccgacuccauggucuccgucaagcgcaaggccgagaacaucgccuccgucgaggaggccgaggaggaccucuccggcacccaguucgucugcgagaccgucauccgcucccucacccucgacgccgcccccgaccacaacccccccugccgccagaagucccuccagaugaccuucgcccuccccgagggcccccucggcaacgagaaggaggagaucauccacaucgccgaggaggaggccgucauggaggaggaggaggacgaggaggacgaggaggaggaggacgagcucaaggacgagguccagucccaguccuccgccuccuccgaggacuacaucaucauccuccccgagugcuucgacaccucccgcccccucggcgacuccauguacuccuccgcccucucccagcccggccucgagcgcggcgccgagggcaagcccggcgucgaggccggccaggagcccgccgaggccggcgagcgccuccccggcggcgagaaccagccccaggagcacuccaucuccgacauccucaccaccucccagacccucgagaccgucccccucauccccgaggucgucgagcucccccccucccucccccgcuccucccccugcguccaccaccacggcucccccggcgucgaccuccccgucaccauccccgaggucuccuccguccccgaccagauccgcggcgagccccgcggcuccuccggccucgucaacucccgccagaaguccuacgaccacucccgccaccaccacggcuccuccaucgccggcggccucgucaagggcgcccucuccgucgccgccuccgccuacaaggcccucuucgccggcccccccgucaccgcccagggccucuggggccuccucuccuuccuccaccucgccaagaagugcuucuuccucaaggcccccuccgaggccuucuccugguucuga

SEQ ID NO: 46462 - RNA, 582 nt, Artificial Sequence
  derived and/or modified sequence opt2 from NCALD__Homo_sapiens__XP_011515637
augggcaagcagaacuccaagcuccgccccgaggucaugcaggaccuccucgaguccaccgacuucaccgagcacgagauccaggagugguacaagggcuuccuccgcgacugccccuccggccaccucuccauggaggaguucaagaagaucuacggcaacuucuuccccuacggcgacgccuccaaguucgccgagcacgucuuccgcaccuucgacgccaacggcgacggcaccaucgacuuccgcgaguucaucaucgcccucuccgucaccucccgcggcaagcucgagcagaagcucaagugggccuucuccauguacgaccucgacggcaacggcuacaucuccaaggccgagaugcucgagaucguccaggccaucuacaagauggucuccuccgucaugaagaugcccgaggacgaguccacccccgagaagcgcaccgagaagaucuuccgccagauggacaccaaccgcgacggcaagcucucccucgaggaguucauccgcggcgccaaguccgaccccuccaucguccgccuccuccagugcgaccccuccuccgccggccaguucuga

SEQ ID NO: 46463 - RNA, 2547 nt, Artificial Sequence
  derived and/or modified sequence opt2 from NCAM1__Homo_sapiens__NP_000606
augcuccagaccaaggaccucaucuggacccucuucuuccucggcaccgccgucucccuccaggucgacaucguccccucccagggcgagaucuccgucggcgaguccaaguucuuccucugccaggucgccggcgacgccaaggacaaggacaucuccugguucucccccaacggcgagaagcucacccccaaccagcagcgcaucuccgucgucuggaacgacgacuccuccuccacccucaccaucuacaacgccaacaucgacgacgccggcaucuacaagugcgucgucaccggcgaggacggcuccgaguccgaggccaccgucaacgucaagaucuuccagaagcucauguucaagaacgcccccaccccccaggaguuccgcgagggcgaggacgccgucaucgucugcgacgucgucuccucccucccccccaccaucaucuggaagcacaagggccgcgacgucauccucaagaaggacguccgcuucaucguccucuccaacaacuaccuccagauccgcggcaucaagaagaccgacgagggcaccuaccgcugcgagggccgcauccucgcccgcggcgagaucaacuucaaggacauccaggucaucgucaacgucccccccaccauccaggcccgccagaacaucgucaacgccaccgccaaccucggccaguccgucacccucgucugcgacgccgagggcuuccccgagcccaccauguccuggaccaaggacggcgagcagaucgagcaggaggaggacgacgagaaguacaucuucuccgacgacuccucccagcucaccaucaagaaggucgacaagaacgacgaggccgaguacaucugcaucgccgagaacaaggccggcgagcaggacgccaccauccaccucaaggucuucgccaagcccaagaucaccuacgucgagaaccagaccgccauggagcucgaggagcaggucacccucaccugcgaggccuccggcgaccccauccccuccaucaccuggcgcaccuccacccgcaacaucuccuccgaggagaagacccucgacggccacauggucguccgcucccacgcccgcgucuccucccucacccucaaguccauccaguacaccgacgccggcgaguacaucugcaccgccuccaacaccaucggccaggacucccaguccauguaccucgagguccaguacgcccccaagcuccagggccccgucgccgucuacaccugggagggcaaccaggucaacaucaccugcgaggucuucgccuaccccuccgccaccaucuccugguuccgcgacggccagcuccuccccuccuccaacuacuccaacaucaagaucuacaacacccccuccgccuccuaccucgaggucacccccgacuccgagaacgacuucggcaacuacaacugcaccgccgucaaccgcaucggccaggagucccucgaguucauccucguccaggccgacacccccuccucccccuccaucgaccaggucgagcccuacuccuccaccgcccagguccaguucgacgagcccgaggccaccggcggcguccccauccucaaguacaaggccgaguggcgcgccgucggcgaggaggucuggcacuccaagugguacgacgccaaggaggccuccauggagggcaucgucaccaucgucggccucaagcccgagaccaccuacgccguccgccucgccgcccucaacggcaagggccucggcgagaucuccgccgccuccgaguucaagacccagcccguccagggcgagcccuccgcccccaagcucgagggccagaugggcgaggacggcaacuccaucaaggucaaccucaucaagcaggacgacggcggcucccccauccgccacuaccucguccgcuaccgcgcccucuccuccgaguggaagcccgagauccgccuccccuccggcuccgaccacgucaugcucaagucccucgacuggaacgccgaguacgaggucuacgucgucgccgagaaccagcagggcaaguccaaggccgcccacuucgucuuccgcaccuccgcccagcccaccgccauccccgccaacggcucccccaccuccggccucuccaccggcgccaucgucggcauccucaucgucaucuucguccuccuccucgucgucgucgacaucaccugcuacuuccucaacaagugcggccucuucaugugcaucgccgucaaccucugcggcaaggccggccccggcgccaagggcaaggacauggaggagggcaaggccgccuucuccaaggacgaguccaaggagcccaucgucgagguccgcaccgaggaggagcgcacccccaaccacgacggcggcaagcacaccgagcccaacgagaccaccccccucaccgagcccgagaagggccccgucgaggccaagcccgagugccaggagaccgagaccaagcccgcccccgccgaggucaagaccguccccaacgacgccacccagaccaaggagaacgaguccaaggccuga

SEQ ID NO: 46464 - RNA, 2514 nt, Artificial Sequence
  derived and/or modified sequence opt2 from NCAM2__Homo_sapiens__NP_004531
augucccuccuccucuccuucuaccuccucggccuccucgucuccuccggccaggcccuccuccaggucaccaucucccucuccaaggucgagcucuccgucggcgaguccaaguucuucaccugcaccgccaucggcgagcccgaguccaucgacugguacaacccccagggcgagaagaucaucuccacccagcgcgucgucguccagaaggagggcguccgcucccgccucaccaucuacaacgccaacaucgaggacgccggcaucuaccgcugccaggccaccgacgccaagggccagacccaggaggccaccgucguccucgagaucuaccagaagcucaccuuccgcgaggucgucuccccccaggaguucaagcagggcgaggacgccgaggucgucugccgcgucuccuccucccccgcccccgccgucuccuggcucuaccacaacgaggaggucaccaccaucuccgacaaccgcuucgccaugcucgccaacaacaaccuccagauccucaacaucaacaaguccgacgagggcaucuaccgcugcgagggccgcgucgaggcccgcggcgagaucgacuuccgcgacaucaucgucaucgucaacgucccccccgccaucuccaugccccagaaguccuucaacgccaccgccgagcgcggcgaggagaugaccuucuccugccgcgccuccggcucccccgagcccgccaucuccugguuccgcaacggcaagcucaucgaggagaacgagaaguacauccucaagggcuccaacaccgagcucaccguccgcaacaucaucaacuccgacggcggccccuacgucugccgcgccaccaacaaggccggcgaggacgagaagcaggccuuccuccaggucuucguccagccccacaucauccagcucaagaacgagaccaccuacgagaacggccaggucacccucgucugcgacgccgagggcgagcccauccccgagaucaccuggaagcgcgccgucgacggcuucaccuucaccgagggcgacaagucccucgacggccgcaucgaggucaagggccagcacggcuccuccucccuccacaucaaggacgucaagcucuccgacuccggccgcuacgacugcgaggccgccucccgcaucggcggccaccagaaguccauguaccucgacaucgaguacgcccccaaguucaucuccaaccagaccaucuacuacuccugggagggcaaccccaucaacaucuccugcgacgucaaguccaacccccccgccuccauccacuggcgccgcgacaagcucguccuccccgccaagaacaccaccaaccucaagaccuacuccaccggccgcaagaugauccucgagaucgcccccaccuccgacaacgacuucggccgcuacaacugcaccgccaccaaccacaucggcacccgcuuccaggaguacauccucgcccucgccgacguccccuccucccccuacggcgucaagaucaucgagcucucccagaccaccgccaaggucuccuucaacaagcccgacucccacggcggcguccccauccaccacuaccaggucgacgucaaggaggucgccuccgagaucuggaagaucguccgcucccacggcguccagaccauggucguccucaacaaccucgagcccaacaccaccuacgagauccgcgucgccgccgucaacggcaagggccagggcgacuacuccaagaucgagaucuuccagacccuccccguccgcgagcccuccccccccuccauccacggccagcccuccuccggcaaguccuucaagcucuccaucaccaagcaggacgacggcggcgcccccauccucgaguacaucgucaaguaccgcuccaaggacaaggaggaccaguggcucgagaagaagguccagggcaacaaggaccacaucauccucgagcaccuccaguggaccaugggcuacgagguccagaucaccgccgccaaccgccucggcuacuccgagcccaccgucuacgaguucuccaugccccccaagcccaacaucaucaaggacacccucuucaacggccucggccucggcgccgucaucggccucggcgucgccgcccuccuccucauccucgucgucaccgacgucuccugcuucuucauccgccagugcggccuccucaugugcaucacccgccgcaugugcggcaagaaguccggcuccuccggcaaguccaaggagcucgaggagggcaaggccgccuaccucaaggacggcuccaaggagcccaucgucgagaugcgcaccgaggacgagcgcgucaccaaccacgaggacggcucccccgucaacgagcccaacgagaccaccccccucaccgagcccgagaagcucccccucaaggaggaggacggcaaggaggcccucaaccccgagaccaucgagaucaaggucuccaacgacaucauccaguccaaggaggacgacuccaaggccuga

SEQ ID NO: 46465 - RNA, 3966 nt, Artificial Sequence
  derived and/or modified sequence opt2 from NCAN__Homo_sapiens__NP_004377
augggcgcccccuucgucugggcccucggccuccucaugcuccagaugcuccucuucgucgccggcgagcagggcacccaggacaucaccgacgccuccgagcgcggccuccacaugcagaagcucggcuccggcuccguccaggccgcccucgccgagcucgucgcccuccccugccucuucacccuccagccccgccccuccgccgcccgcgacgccccccgcaucaaguggaccaagguccgcaccgccuccggccagcgccaggaccuccccauccucgucgccaaggacaacgucguccgcgucgccaaguccuggcagggccgcgucucccuccccuccuacccccgccgccgcgccaacgccacccuccuccucggcccccuccgcgccuccgacuccggccucuaccgcugccaggucguccgcggcaucgaggacgagcaggaccucgucccccucgaggucaccggcgucgucuuccacuaccgcuccgcccgcgaccgcuacgcccucaccuucgccgaggcccaggaggccugccgccucuccuccgccaucaucgccgccccccgccaccuccaggccgccuucgaggacggcuucgacaacugcgacgccggcuggcucuccgaccgcaccguccgcuaccccaucacccagucccgccccggcugcuacggcgaccgcuccucccuccccggcguccgcuccuacggccgccgcaacccccaggagcucuacgacgucuacugcuucgcccgcgagcucggcggcgaggucuucuacgucggccccgcccgccgccucacccucgccggcgcccgcgcccagugccgccgccagggcgccgcccucgccuccgucggccagcuccaccucgccuggcacgagggccucgaccagugcgaccccggcuggcucgccgacggcuccguccgcuaccccauccagaccccccgccgccgcugcggcggccccgcccccggcguccgcaccgucuaccgcuucgccaaccgcaccggcuuccccucccccgccgagcgcuucgacgccuacugcuuccgcgcccaccaccccaccucccagcacggcgaccucgagacccccuccuccggcgacgagggcgagauccucuccgccgagggcccccccguccgcgagcucgagcccacccucgaggaggaggaggucgucacccccgacuuccaggagccccucgucuccuccggcgaggaggagacccucauccucgaggagaagcaggagucccagcagacccucucccccacccccggcgaccccaugcucgccuccuggcccaccggcgaggucuggcucuccaccgucgcccccucccccuccgacaugggcgccggcaccgccgccuccucccacaccgaggucgcccccaccgaccccaugccccgccgccgcggccgcuucaagggccucaacggccgcuacuuccagcagcaggagcccgagcccggccuccagggcggcauggaggccuccgcccagccccccaccuccgaggccgccgucaaccagauggagcccccccucgccauggccgucaccgagaugcucggcuccggccagucccgcucccccugggccgaccucaccaacgaggucgacaugcccggcgccggcuccgccggcggcaaguccucccccgagcccuggcucuggccccccaccauggucccccccuccaucuccggccacucccgcgcccccguccucgagcucgagaaggccgagggccccuccgcccgccccgccacccccgaccucuucugguccccccucgaggccaccgucuccgcccccucccccgcccccugggaggccuuccccgucgccaccucccccgaccuccccaugauggccaugcuccgcggccccaaggaguggaugcucccccaccccacccccaucuccaccgaggccaaccgcgucgaggcccacggcgaggccaccgccaccgccccccccucccccgccgccgagaccaaggucuacucccucccccucucccucacccccaccggccagggcggcgaggccaugcccaccacccccgaguccccccgcgccgacuuccgcgagaccggcgagaccucccccgcccaggucaacaaggccgagcacuccuccuccucccccuggcccuccgucaaccgcaacgucgccgucggcuucguccccaccgagaccgccaccgagcccaccggccuccgcggcauccccggcuccgaguccggcgucuucgacaccgccgagucccccaccuccggccuccaggccaccgucgacgagguccaggaccccuggcccuccgucuacuccaagggccucgacgccuccucccccuccgccccccucggcucccccggcgucuuccucguccccaaggucacccccaaccucgagcccugggucgccaccgacgagggccccaccgucaaccccauggacuccaccgucacccccgcccccuccgacgccuccggcaucugggagcccggcucccaggucuucgaggaggccgaguccaccacccucuccccccaggucgcccucgacaccuccaucgucaccccccucaccacccucgagcagggcgacaaggucggcguccccgccauguccacccucggcuccuccuccucccagccccaccccgagcccgaggaccaggucgagacccagggcaccuccggcgccuccguccccccccaccaguccuccccccucggcaagcccgccgucccccccggcacccccaccgccgccuccgucggcgaguccgccuccgucuccuccggcgagcccaccguccccugggaccccuccuccacccuccuccccgucacccucggcaucgaggacuucgagcucgagguccucgccggcucccccggcgucgaguccuucugggaggaggucgccuccggcgaggagcccgcccuccccggcacccccaugaacgccggcgccgaggagguccacuccgaccccugcgagaacaaccccugccuccacggcggcaccugcaacgccaacggcaccauguacggcugcuccugcgaccagggcuucgccggcgagaacugcgagaucgacaucgacgacugccucugcucccccugcgagaacggcggcaccugcaucgacgaggucaacggcuucgucugccucugccuccccuccuacggcggcuccuucugcgagaaggacaccgagggcugcgaccgcggcuggcacaaguuccagggccacugcuaccgcuacuucgcccaccgccgcgccugggaggacgccgagaaggacugccgccgccgcuccggccaccucaccuccguccacucccccgaggagcacuccuucaucaacuccuucggccacgagaacaccuggaucggccucaacgaccgcaucgucgagcgcgacuuccaguggaccgacaacaccggccuccaguucgagaacuggcgcgagaaccagcccgacaacuucuucgccggcggcgaggacugcgucgucauggucgcccacgaguccggccgcuggaacgacguccccugcaacuacaaccuccccuacgucugcaagaagggcaccguccucugcggccccccccccgccgucgagaacgccucccucaucggcgcccgcaaggccaaguacaacguccacgccaccguccgcuaccagugcaacgagggcuucgcccagcaccacgucgccaccauccgcugccgcuccaacggcaagugggaccgcccccagaucgucugcaccaagccccgccgcucccaccgcaugcgccgccaccaccaccaccaccagcaccaccaccagcaccaccaccacaagucccgcaaggagcgccgcaagcacaagaagcaccccaccgaggacugggagaaggacgagggcaacuucugcuga

SEQ ID NO: 46466 - RNA, 4206 nt, Artificial Sequence
  derived and/or modified sequence opt2 from NCAPD2__Homo_sapiens__NP_055680
auggccccccagauguacgaguuccaccucccccucucccccgaggagcuccucaaguccggcggcgucaaccaguacgucguccaggagguccucuccaucaagcaccuccccccccagcuccgcgccuuccaggccgccuuccgcgcccagggcccccucgccaugcuccagcacuucgacaccaucuacuccauccuccaccacuuccgcuccaucgaccccggccucaaggaggacacccuccaguuccucaucaaggucgucucccgccacucccaggagcuccccgccauccucgacgacaccacccucuccggcuccgaccgcaacgcccaccucaacgcccucaagaugaacugcuacgcccucauccgccuccucgaguccuucgagaccauggccucccagaccaaccucgucgaccucgaccucggcggcaagggcaagaaggcccgcaccaaggccgcccacggcuucgacugggaggaggagcgccagcccauccuccagcuccucacccagcuccuccagcucgacauccgccaccucuggaaccacuccaucaucgaggaggaguucgucucccucgucaccggcugcugcuaccgccuccucgagaaccccaccaucaaccaccagaagaaccgccccacccgcgaggccaucacccaccuccucggcgucgcccucacccgcuacaaccacaugcucuccgccaccgucaagaucauccagaugcuccagcacuucgagcaccucgcccccguccucgucgccgccgucucccucugggccaccgacuacggcaugaaguccaucgucggcgagaucguccgcgagaucggccagaagugcccccaggagcucucccgcgaccccuccggcaccaagggcuucgccgccuuccucaccgagcucgccgagcgcguccccgccauccucauguccuccaugugcauccuccucgaccaccucgacggcgagaacuacaugaugcgcaacgccguccucgccgccauggccgagaugguccuccagguccucuccggcgaccagcucgaggccgccgcccgcgacacccgcgaccaguuccucgacacccuccaggcccacggccacgacgucaacuccuucguccgcucccgcguccuccagcucuucacccgcaucguccagcagaaggcccucccccucacccgcuuccaggccgucgucgcccucgccgucggccgccucgccgacaaguccguccucgucugcaagaacgccauccagcuccucgccuccuuccucgccaacaaccccuucuccugcaagcucuccgacgccgaccucgccggcccccuccagaaggagacccagaagcuccaggagaugcgcgcccagcgccgcaccgccgccgccuccgccguccucgaccccgaggaggagugggaggccaugcuccccgagcucaaguccacccuccagcagcuccuccagcucccccagggcgaggaggagauccccgagcagaucgccaacaccgagaccaccgaggacgucaagggccgcaucuaccagcuccucgccaaggccuccuacaagaaggccaucauccucacccgcgaggccaccggccacuuccaggaguccgagcccuucucccacaucgaccccgaggaguccgaggagacccgccuccucaacauccucggccucaucuucaagggccccgccgccuccacccaggagaagaacccccgcgaguccaccggcaacauggucaccggccagaccgucugcaagaacaagcccaacauguccgaccccgaggagucccgcggcaacgacgagcucgucaagcaggagaugcucguccaguaccuccaggacgccuacuccuucucccgcaagaucaccgaggccaucggcaucaucuccaagaugauguacgagaacaccaccaccgucguccaggaggucaucgaguucuucgucauggucuuccaguucggcgucccccaggcccucuucggcguccgccgcaugcucccccucaucugguccaaggagcccggcguccgcgaggccguccucaacgccuaccgccagcucuaccucaaccccaagggcgacuccgcccgcgccaaggcccaggcccucauccagaaccucucccuccuccucgucgacgccuccgucggcaccauccagugccucgaggagauccucugcgaguucguccagaaggacgagcucaagcccgccgucacccagcuccucugggagcgcgccaccgagaaggucgccugcugcccccucgagcgcugcuccuccgucaugcuccucggcaugauggcccgcggcaagcccgagaucgucggcuccaaccucgacacccucgucuccaucggccucgacgagaaguucccccaggacuaccgccucgcccagcaggucugccacgccaucgccaacaucuccgaccgccgcaagcccucccucggcaagcgccacccccccuuccgccucccccaggagcaccgccucuucgagcgccuccgcgagaccgucaccaagggcuucguccaccccgacccccucuggauccccuucaaggaggucgccgucacccucaucuaccagcucgccgagggccccgaggucaucugcgcccagauccuccagggcugcgccaagcaggcccucgagaagcucgaggagaagcgcaccucccaggaggaccccaaggagucccccgccaugcuccccaccuuccuccucaugaaccuccucucccucgccggcgacgucgcccuccagcagcucguccaccucgagcaggccgucuccggcgagcucugccgccgccgcguccuccgcgaggagcaggagcacaagaccaaggaccccaaggagaagaacaccuccuccgagaccaccauggaggaggagcucggccucgucggcgccaccgccgacgacaccgaggccgagcucauccgcggcaucugcgagauggagcuccucgacggcaagcagacccucgccgccuucgucccccuccuccucaaggucugcaacaaccccggccucuacuccaaccccgaccucuccgccgccgccucccucgcccucggcaaguucugcaugaucuccgccaccuucugcgacucccagcuccgccuccucuucaccaugcucgagaaguccccccuccccaucguccgcuccaaccucauggucgccaccggcgaccucgccauccgcuuccccaaccucgucgaccccuggaccccccaccucuacgcccgccuccgcgaccccgcccagcagguccgcaagaccgccggccucgucaugacccaccucauccucaaggacauggucaaggucaagggccaggucuccgagauggccguccuccucaucgaccccgagccccagaucgccgcccucgccaagaacuucuucaacgagcucucccacaagggcaacgccaucuacaaccuccuccccgacaucaucucccgccucuccgaccccgagcucggcgucgaggaggagcccuuccacaccaucaugaagcagcuccucuccuacaucaccaaggacaagcagaccgagucccucgucgagaagcucugccagcgcuuccgcaccucccgcaccgagcgccagcagcgcgaccucgccuacugcgucucccagcucccccucaccgagcgcggccuccgcaagaugcucgacaacuucgacugcuucggcgacaagcucuccgacgaguccaucuucuccgccuuccucuccgucgucggcaagcuccgccgcggcgccaagcccgagggcaaggccaucaucgacgaguucgagcagaagcuccgcgccugccacacccgcggccucgacggcaucaaggagcucgagaucggccaggccggcucccagcgcgcccccuccgccaagaagcccuccaccggcucccgcuaccagccccucgccuccaccgccuccgacaacgacuucgucacccccgagccccgccgcaccacccgccgccaccccaacacccagcagcgcgccuccaagaagaagcccaaggucgucuucuccuccgacgaguccuccgaggaggaccucuccgccgagaugaccgaggacgagacccccaagaagaccacccccauccuccgcgccuccgcccgccgccaccgcuccuga

SEQ ID NO: 46467 - RNA, 4497 nt, Artificial Sequence
  derived and/or modified sequence opt2 from NCAPD3__Homo_sapiens__NP_056076
auggucgcccuccgcggccucggcuccggccuccagcccuggugcccccucgaccuccgccucgagugggucgacaccgucugggagcucgacuucaccgagaccgagccccucgaccccuccaucgaggccgagaucaucgagaccggccucgccgccuucaccaagcucuacgagucccuccuccccuucgccaccggcgagcacggcuccauggaguccaucuggaccuucuucaucgagaacaacgucucccacuccacccucgucgcccucuucuaccacuucguccagaucguccacaagaagaacgucuccguccaguaccgcgaguacggccuccacgccgccggccucuacuuccuccuccucgagguccccggcuccgucgccaaccaggucuuccaccccgucauguucgacaagugcauccagacccucaagaaguccuggccccaggaguccaaccucaaccgcaagcgcaagaaggagcagcccaaguccucccaggccaaccccggccgccaccgcaagcgcggcaagcccccccgccgcgaggacaucgagauggacgagaucaucgaggagcaggaggacgagaacaucugcuucuccgcccgcgaccucucccagauccgcaacgccaucuuccaccuccucaagaacuuccuccgccuccuccccaaguucucccucaaggagaagccccagugcguccagaacugcaucgaggucuucgucucccucaccaacuucgagcccguccuccacgagugccacgucacccaggcccgcgcccucaaccaggccaaguacauccccgagcucgccuacuacggccucuaccuccucugcucccccauccacggcgagggcgacaaggucaucuccugcgucuuccaccagaugcucuccgucauccucaugcucgaggucggcgagggcucccaccgcgccccccucgccgucaccucccaggucaucaacugccgcaaccaggccguccaguucaucuccgcccucgucgacgagcucaaggaguccaucuuccccgucguccgcauccuccuccagcacaucugcgccaaggucgucgacaaguccgaguaccgcaccuucgccgcccagucccucguccagcuccucuccaagcuccccugcggcgaguacgccauguucaucgccuggcucuacaaguacucccgcuccuccaagaucccccaccgcgucuucacccucgacgucguccucgcccuccucgagcuccccgagcgcgaggucgacaacacccucucccucgagcaccagaaguuccucaagcacaaguuccucguccaggagaucauguucgaccgcugccucgacaaggcccccaccguccgcuccaaggcccucuccuccuucgcccacugccucgagcucaccgucaccuccgccuccgaguccauccucgagcuccucaucaacucccccaccuucuccgucaucgagucccaccccggcacccuccuccgcaacuccuccgccuucuccuaccagcgccagaccuccaaccgcuccgagcccuccggcgagaucaacaucgacuccuccggcgagaccgucggcuccggcgagcgcugcgucauggccaugcuccgccgccgcauccgcgacgagaagaccaacguccgcaaguccgcccuccagguccucgucuccauccucaagcacugcgacgucuccggcaugaaggaggaccucuggauccuccaggaccagugccgcgaccccgccgucuccguccgcaagcaggcccuccagucccucaccgagcuccucauggcccagccccgcugcguccagauccagaaggccuggcuccgcggcgucguccccgucgucauggacugcgaguccaccguccaggagaaggcccucgaguuccucgaccagcuccuccuccagaacauccgccaccacucccacuuccacuccggcgacgacucccagguccucgccugggcccuccucacccuccucaccaccgagucccaggagcucucccgcuaccucaacaaggccuuccacaucugguccaagaaggagaaguucucccccaccuucaucaacaacgucaucucccacaccggcaccgagcacuccgcccccgccuggaugcuccucuccaagaucgccggcuccuccccccgccucgacuacucccgcaucauccaguccugggagaagaucuccucccagcagaaccccaacuccaacacccucggccacauccucugcgucaucggccacaucgccaagcaccuccccaaguccacccgcgacaaggucaccgacgccgucaagugcaagcucaacggcuuccaguggucccucgaggucaucuccuccgccgucgacgcccuccagcgccucugccgcgccuccgccgagacccccgccgaggagcaggagcuccucacccaggucugcggcgacguccucuccaccugcgagcaccgccucuccaacaucguccucaaggagaacggcaccggcaacauggacgaggaccuccucgucaaguacaucuucacccucggcgacaucgcccagcucugccccgcccgcgucgagaagcgcaucuuccuccucauccaguccguccucgccuccuccgccgacgccgaccacucccccuccucccagggcuccuccgaggcccccgccucccagccccccccccagguccgcggcuccgucaugcccuccgucauccgcgcccacgccaucaucacccucggcaagcucugccuccagcacgaggaccucgccaagaaguccauccccgcccucguccgcgagcucgaggucugcgaggacgucgccguccgcaacaacgucaucaucgucaugugcgaccucugcauccgcuacaccaucauggucgacaaguacauccccaacaucuccaugugccucaaggacuccgaccccuucauccgcaagcagacccucauccuccucaccaaccuccuccaggaggaguucgucaaguggaagggcucccucuucuuccgcuucgucuccacccucaucgacucccaccccgacaucgccuccuucggcgaguucugccucgcccaccuccuccucaagcgcaaccccgucauguucuuccagcacuucaucgagugcaucuuccacuucaacaacuacgagaagcacgagaaguacaacaaguucccccaguccgagcgcgagaagcgccucuucucccucaagggcaaguccaacaaggagcgccgcaugaagaucuacaaguuccuccucgagcacuucaccgacgagcagcgcuucaacaucaccuccaagaucugccucuccauccucgccugcuucgccgacggcauccucccccucgaccucgacgccuccgagcuccucuccgacaccuucgagguccucuccuccaaggagaucaagcuccucgccaugcgcuccaagcccgacaaggaccuccucauggaggaggacgacauggcccucgccaacgucgucaugcaggaggcccagaagaagcucaucucccagguccagaagcgcaacuucaucgagaacaucauccccaucaucaucucccucaagaccguccucgagaagaacaagauccccgcccuccgcgagcucaugcacuaccuccgcgaggucaugcaggacuaccgcgacgagcucaaggacuucuucgccgucgacaagcagcucgccuccgagcucgaguacgacaugaagaaguaccaggagcagcucguccaggagcaggagcucgccaagcacgccgacgucgccggcaccgccggcggcgccgaggucgcccccgucgcccaggucgcccucugccucgagaccguccccguccccgccggccaggagaaccccgccaugucccccgccgucucccagcccugcaccccccgcgccuccgccggccacgucgccgucuccucccccacccccgagaccggcccccuccagcgccuccuccccaaggcccgccccaugucccucuccaccaucgccauccucaacuccgucaagaaggccgucgaguccaagucccgccaccgcucccgcucccucggcguccuccccuucacccucaacuccggcucccccgagaagaccugcucccaggucuccuccuacucccucgagcaggaguccaacggcgagaucgagcacgucaccaagcgcgccaucuccacccccgagaaguccaucuccgacgucaccuucggcgccggcgucuccuacaucggcaccccccgcacccccuccuccgccaaggagaagaucgagggccgcucccagggcaacgacauccucugccucucccuccccgacaagccccccccccagccccagcaguggaacguccgcucccccgcccgcaacaaggacacccccgccugcucccgccgcucccuccgcaagaccccccucaagaccgccaacuga

SEQ ID NO: 46468 - RNA, 3432 nt, Artificial Sequence
  derived and/or modified sequence opt2 from NCAPG2__Homo_sapiens__NP_001268861
auggagaagcgcgagaccuucguccaggccgucuccaaggagcucgucggcgaguuccuccaguucguccagcucgacaaggaggccuccgaccccuucucccucaacgagcuccucgacgagcucucccgcaagcagaaggaggagcucuggcagcgccucaagaaccuccucaccgacguccuccucgagucccccgucgacggcuggcaggucgucgaggcccagggcgaggacaacauggagaccgagcacggcuccaagaugcgcaaguccaucgagaucaucuacgccaucaccuccgucauccucgccuccgucuccgucaucaacgaguccgagaacuacgaggcccuccucgagugcgucaucauccucaacggcauccucuacgcccuccccgaguccgagcgcaagcuccaguccuccauccaggaccucugcgucaccuggugggagaagggccuccccgccaaggaggacaccggcaagaccgccuucgucaugcuccuccgccgcucccucgagaccaagaccggcgccgacgucugccgccucuggcgcauccaccaggcccucuacugcuucgacuacgaccucgaggaguccggcgagaucaaggacaugcuccucgagugcuucaucaacaucaacuacaucaagaaggaggagggccgccgcuuccucuccugccucuucaacuggaacaucaacuucaucaagaugauccacggcaccaucaagaaccagcuccagggccuccagaagucccucauggucuacaucgccgagaucuacuuccgcgccuggaagaaggccuccggcaagauccucgaggccaucgagaacgacugcauccaggacuucauguuccacggcauccaccucccccgccgcucccccguccacuccaagguccgcgagguccucuccuacuuccaccaccagaagaagguccgccagggcgucgaggagaugcucuaccgccucuacaagcccauccucuggcgcggccucaaggcccgcaacuccgagguccgcuccaacgccgcccuccucuucgucgaggccuuccccauccgcgaccccaaccuccacgccaucgagauggacuccgagauccagaagcaguucgaggagcucuacucccuccucgaggaccccuaccccaugguccgcuccaccggcauccucggcgucugcaagaucaccuccaaguacugggagaugaugccccccaccauccucaucgaccuccucaagaaggucaccggcgagcucgccuucgacaccuccuccgccgacguccgcugcuccgucuucaagugccuccccaugauccucgacaacaagcucucccacccccuccucgagcagcuccuccccgcccuccgcuacucccuccacgacaacuccgagaagguccgcgucgccuucgucgacaugcuccucaagaucaaggccguccgcgccgccaaguucuggaagaucugccccauggagcacauccucguccgccucgagaccgacucccgccccgucucccgccgccucgucucccucaucuucaacuccuuccuccccgucaaccagcccgaggaggucuggugcgagcgcugcgucacccucguccagaugaaccacgccgccgcccgccgcuucuaccaguacgcccacgagcacaccgccugcaccaacaucgccaagcucauccacgucauccgccacugccucaacgccugcauccagcgcgccguccgcgagccccccgaggacgaggaggaggaggacggccgcgagaaggagaacgucaccguccucgacaagacccucuccgucaacgacgucgccugcauggccggccuccucgagaucaucgucauccucuggaaguccaucgaccgcuccauggagaacaacaaggaggccaagcucuacaccaucaacaaguucgccuccguccuccccgaguaccucaaggucuucaaggacgaccgcugcaagaucccccucuucaugcucauguccuucaugcccgccuccgccgucccccccuucuccugcggcgucaucuccacccuccgcucccgcgaggagggcgccgucgacaaguccuacugcacccuccucgacugccucugcuccuggggccaggucggccacauccucgagcucgucgacaacuggcuccccaccgagcacgcccaggccaaguccaacaccgccuccaagggccgcguccagauccacgacacccgccccgucaagcccgagcucgcccucgucuacaucgaguaccuccucacccaccccaagaaccgcgagugccuccucuccgccccccgcaagaagcucaaccaccuccucaaggcccucgagaccuccaaggccgaccucgagucccuccuccagacccccggcggcaagccccgcggcuucuccgaggccgccgccccccgcgccuucggccuccacugccgccucuccauccaccuccagcacaaguucugcuccgagggcaaggucuaccucuccaugcucgaggacaccggcuucuggcucgaguccaagauccucuccuucauccaggaccaggaggaggacuaccucaagcuccaccgcgucaucuaccagcagaucauccagaccuaccucaccgucugcaaggacgucgucauggucggccucggcgaccaccaguuccagaugcagcuccuccagcgcucccucggcaucaugcagaccgucaagggcuucuucuacgucucccuccuccucgacauccucaaggagaucaccggcuccucccucauccagaagaccgacuccgacgaggaggucgccaugcuccucgacaccguccagaaggucuuccagaagaugcucgagugcaucgcccgcuccuuccgcaagcagcccgaggagggccuccgccuccucuacuccguccagcgcccccuccacgaguucaucaccgccguccagucccgccacaccgacacccccguccaccgcggcguccucuccacccucaucgccggccccgucgucgagaucucccaccagcuccgcaaggucuccgacgucgaggagcucaccccccccgagcaccucuccgaccucccccccuucucccgcugccucaucggcaucaucaucaaguccuccaacgucguccgcuccuuccucgacgagcucaaggccugcgucgccuccaacgacaucgagggcaucgucugccucaccgccgccguccacaucauccucgucaucaacgccggcaagcacaaguccuccaagguccgcgaggucgccgccaccguccaccgcaagcucaagaccuucauggagaucacccucgaggaggacuccaucgagcgcuuccucuacgaguccuccucccgcacccucggcgagcuccucaacuccuga

SEQ ID NO: 46469 - RNA, 3048 nt, Artificial Sequence
  derived and/or modified sequence opt2 from NCAPG__Homo_sapiens__NP_071741
augggcgccgagcgccgccuccucuccaucaaggaggccuuccgccucgcccagcagccccaccagaaccaggccaagcucgucgucgcccucucccgcaccuaccgcaccauggacgacaagaccgucuuccacgaggaguucauccacuaccucaaguacgucauggucgucuacaagcgcgagcccgccgucgagcgcgucaucgaguucgccgccaaguucgucaccuccuuccaccaguccgacauggaggacgacgaggaggaggaggacggcggccuccucaacuaccucuucaccuuccuccucaagucccacgaggccaacuccaacgccguccgcuuccgcgucugccuccucaucaacaagcuccucggcuccaugcccgagaacgcccagaucgacgacgacgucuucgacaagaucaacaaggccaugcucauccgccucaaggacaagauccccaacguccgcauccaggccguccucgcccucucccgccuccaggaccccaaggacgacgagugccccgucgucaacgccuacgccacccucaucgagaacgacuccaaccccgagguccgccgcgccguccucuccugcaucgcccccuccgccaagacccuccccaagaucgucggccgcaccaaggacgucaaggaggccguccgcaagcucgccuaccagguccucgccgagaagguccacaugcgcgccauguccaucgcccagcgcgucaugcuccuccagcagggccucaacgaccgcuccgacgccgucaagcaggccaugcagaagcaccuccuccagggcuggcuccgcuucuccgagggcaacauccucgagcuccuccaccgccucgacgucgagaacuccuccgaggucgccgucuccguccucaacgcccucuucuccaucaccccccucuccgagcucgucggccucugcaagaacaacgacggccgcaagcucauccccgucgagacccucacccccgagaucgcccucuacuggugcgcccucugcgaguaccucaaguccaagggcgacgagggcgaggaguuccucgagcagauccuccccgagcccgucgucuacgccgacuaccuccucuccuacauccaguccauccccgucgucaacgaggagcaccgcggcgacuucuccuacaucggcaaccucaugaccaaggaguucaucggccagcagcucauccucaucaucaagucccucgacaccuccgaggagggcggccgcaagaagcuccucgccguccuccaggagauccucauccuccccaccauccccaucucccucgucuccuuccucgucgagcgccuccuccacaucaucaucgacgacaacaagcgcacccagaucgucaccgagaucaucuccgagauccgcgcccccaucgucaccgucggcgucaacaacgaccccgccgacguccgcaagaaggagcucaagauggccgagaucaaggucaagcucaucgaggccaaggaggcccucgagaacugcaucacccuccaggacuucaaccgcgccuccgagcucaaggaggagaucaaggcccucgaggacgcccgcaucaaccuccucaaggagaccgagcagcucgagaucaaggagguccacaucgagaagaacgacgccgagacccuccagaagugccucauccucugcuacgagcuccucaagcagauguccaucuccaccggccucuccgccaccaugaacggcaucaucgagucccucauccuccccggcaucaucuccauccaccccgucguccgcaaccucgccguccucugccucggcugcugcggccuccagaaccaggacuucgcccgcaagcacuucguccuccuccuccagguccuccagaucgacgacgucaccaucaagaucuccgcccucaaggccaucuucgaccagcucaugaccuucggcaucgagcccuucaagaccaagaagaucaagacccuccacugcgagggcaccgagaucaacuccgacgacgagcaggaguccaaggaggucgaggagaccgccaccgccaagaacguccucaagcuccucuccgacuuccucgacuccgaggucuccgagcuccgcaccggcgccgccgagggccucgccaagcucauguucuccggccuccucgucuccucccgcauccucucccgccucauccuccucugguacaaccccgucaccgaggaggacguccagcuccgccacugccucggcgucuucuuccccgucuucgccuacgccucccgcaccaaccaggagugcuucgaggaggccuuccuccccacccuccagacccucgccaacgcccccgccuccuccccccucgccgagaucgacaucaccaacgucgccgagcuccucgucgaccucacccgccccuccggccucaacccccaggccaagaccucccaggacuaccaggcccucaccguccacgacaaccucgccaugaagaucugcaacgagauccucaccucccccugcucccccgagauccgcgucuacaccaaggcccucuccucccucgagcucuccucccaccucgccaaggaccuccucguccuccucaacgagauccucgagcaggucaaggaccgcaccugccuccgcgcccucgagaagaucaagauccagcucgagaagggcaacaaggaguucggcgaccaggccgaggccgcccaggacgccacccucaccaccaccaccuuccagaacgaggacgagaagaacaaggaggucuacaugaccccccuccgcggcgucaaggccacccaggccuccaaguccacccagcucaagaccaaccgcggccagcgcaaggucaccgucuccgcccgcaccaaccgccgcugccagaccgccgaggccgacuccgaguccgaccacgagguccccgagcccgaguccgagaugaagaugcgccucccccgccgcgccaagaccgccgcccucgagaaguccaagcucaaccucgcccaguuccucaacgaggaccucuccuga

SEQ ID NO: 46470 - RNA, 312 nt, Artificial Sequence
  derived and/or modified sequence opt2 from NCBP2__Homo_sapiens__NP_001036005
auguccggcggccuccucaaggcccuccgcuccgacuccuacgucgagcucucccaguaccgcgaccagcacuuccgcggcgacaacgaggagcaggagaagcuccucaagaaguccuacgccgagaacgccaugcgcuacaucaacggcacccgccucgacgaccgcaucauccgcaccgacugggacgccggcuucaaggagggccgccaguacggccgcggccgcuccggcggccagguccgcgacgaguaccgccaggacuacgacgccggccgcggcggcuacggcaagcucgcccagaaccaguga

SEQ ID NO: 46471 - RNA, 1347 nt, Artificial Sequence
  derived and/or modified sequence opt2 from NCEH1__Homo_sapiens__NP_001139748
auguccuccugccgcggccagaaggucgccggcggccuccgcgucgucucccccuucccccucugccagcccgccggcgagcccucccagggcaagaugcgcuccuccugcguccuccucaccgcccucgucgcccucgccgccuacuacgucuacaucccccuccccggcuccgucuccgaccccuggaagcucaugcuccucgacgccaccuuccgcggcgcccagcaggucuccaaccucauccacuaccucggccucucccaccaccuccucgcccucaacuucaucaucgucuccuucggcaagaaguccgccugguccuccgcccaggucaaggucaccgacaccgacuucgacggcgucgagguccgcgucuucgagggcccccccaagcccgaggagccccucaagcgcuccgucgucuacauccacggcggcggcugggcccucgccuccgccuccgccuccuggucccccuccgacgagauccgcuacuacgacgagcucugcaccgccauggccgaggagcucaacgccgucaucgucuccaucgaguaccgccucguccccaaggucuacuuccccgagcagauccacgacgucguccgcgccaccaaguacuuccucaagcccgagguccuccagaaguacauggucgaccccggccgcaucugcaucuccggcgacuccgccggcggcaaccucgccgccgcccucggccagcaguucacccaggacgccucccucaagaacaagcucaagcuccaggcccucaucuaccccguccuccaggcccucgacuucaacacccccuccuaccagcagaacgucaacacccccauccucccccgcuacgucauggucaaguacugggucgacuacuucaagggcaacuacgacuucguccaggccaugaucgucaacaaccacaccucccucgacgucgaggaggccgccgccguccgcgcccgccucaacuggaccucccuccuccccgccuccuucaccaagaacuacaagcccgucguccagaccaccggcaacgcccgcaucguccaggagcucccccagcuccucgacgcccgcuccgccccccucaucgccgaccaggccguccuccagcuccuccccaagaccuacauccucaccugcgagcacgacguccuccgcgacgacggcaucauguacgccaagcgccucgaguccgccggcgucgaggucacccucgaccacuucgaggacggcuuccacggcugcaugaucuucaccuccuggcccaccaacuucuccgucggcauccgcacccgcaacuccuacaucaaguggcucgaccagaaccucuga

SEQ ID NO: 46472 - RNA, 1173 nt, Artificial Sequence
  derived and/or modified sequence opt2 from NCF1__Homo_sapiens__NP_000256
augggcgacaccuucauccgccacaucgcccuccucggcuucgagaagcgcuucguccccucccagcacuacgucuacauguuccucgucaaguggcaggaccucuccgagaaggucgucuaccgccgcuucaccgagaucuacgaguuccacaagacccucaaggagauguuccccaucgaggccggcgccaucaaccccgagaaccgcaucaucccccaccuccccgcccccaagugguucgacggccagcgcgccgccgagaaccgccagggcacccucaccgaguacugcuccacccucaugucccuccccaccaagaucucccgcugcccccaccuccucgacuucuucaagguccgccccgacgaccucaagcuccccaccgacaaccagaccaagaagcccgagaccuaccucaugcccaaggacggcaaguccaccgccaccgacaucaccggccccaucauccuccagaccuaccgcgccaucgccaacuacgagaagaccuccggcuccgagauggcccucuccaccggcgacgucgucgaggucgucgagaaguccgaguccggcuggugguucugccagaugaaggccaagcgcggcuggauccccgccuccuuccucgagccccucgacucccccgacgagaccgaggaccccgagcccaacuacgccggcgagcccuacgucgccaucaaggccuacaccgccgucgagggcgacgaggucucccuccucgagggcgaggccgucgaggucauccacaagcuccucgacggcuggugggucauccgcaaggacgacgucaccggcuacuuccccuccauguaccuccagaaguccggccaggacgucucccaggcccagcgccagaucaagcgcggcgcccccccccgccgcuccuccauccgcaacgcccacuccauccaccagcgcucccgcaagcgccucucccaggacgccuaccgccgcaacuccguccgcuuccuccagcagcgccgccgccaggcccgccccggcccccagucccccggcuccccccucgaggaggagcgccagacccagcgcuccaagccccagcccgccguccccccccgccccuccgccgaccucauccucaaccgcugcuccgaguccaccaagcgcaagcucgccuccgccgucuga

SEQ ID NO: 46473 - RNA, 1338 nt, Artificial Sequence
  derived and/or modified sequence opt2 from NCF2__Homo_sapiens__NP_001177718
augucccucgucgaggccaucucccucuggaacgagggcguccucgccgccgacaagaaggacuggaagggcgcccucgacgccuucuccgccguccaggacccccacucccgcaucugcuucaacaucggcugcauguacaccauccucaagaacaugaccgaggccgagaaggccuucacccgcuccaucaaccgcgacaagcaccucgccgucgccuacuuccagcgcggcaugcucuacuaccagaccgagaaguacgaccucgccaucaaggaccucaaggaggcccucauccagcuccgcggcaaccagcucaucgacuacaagauccucggccuccaguucaagcucuucgccugcgaggucgucgccuccgucgucgaccaggacuccuucuccggcuucgccccccuccagccccaggccgccgagccccccccccgccccaagacccccgagaucuuccgcgcccucgagggcgaggcccaccgcguccucuucggcuucguccccgagaccaaggaggagcuccaggucaugcccggcaacaucgucuucguccucaagaagggcaacgacaacugggccaccgucauguucaacggccagaagggccucguccccugcaacuaccucgagcccgucgagcuccgcauccacccccagcagcagccccaggaggaguccuccccccaguccgacauccccgccccccccuccuccaaggcccccggccgcccccagcucucccccggccagaagcagaaggaggagcccaaggaggucaagcucuccguccccaugcccuacacccucaagguccacuacaaguacaccgucgucaugaagacccagcccggccuccccuacucccagguccgcgacauggucuccaagaagcucgagcuccgccucgagcacaccaagcucuccuaccgcccccgcgacuccaacgagcucgucccccucuccgaggacuccaugaaggacgccuggggccaggucaagaacuacugccucacccucuggugcgagaacaccgucggcgaccagggcuuccccgacgagcccaaggaguccgagaaggccgacgccaacaaccagaccaccgagccccagcucaagaagggcucccaggucgaggcccucuucuccuacgaggccacccagcccgaggaccucgaguuccaggagggcgacaucauccucguccucuccaaggucaacgaggaguggcucgagggcgagugcaagggcaaggucggcaucuuccccaaggucuucgucgaggacugcgccaccaccgaccucgaguccacccgccgcgaggucuga

SEQ ID NO: 46474 - RNA, 1020 nt, Artificial Sequence
  derived and/or modified sequence opt2 from NCF4__Homo_sapiens__NP_000622
auggccgucgcccagcagcuccgcgccgaguccgacuucgagcagcuccccgacgacgucgccaucuccgccaacaucgccgacaucgaggagaagcgcggcuucaccucccacuucgucuucgucaucgaggucaagaccaagggcggcuccaaguaccucaucuaccgccgcuaccgccaguuccacgcccuccaguccaagcucgaggagcgcuucggccccgacuccaaguccuccgcccucgccugcacccuccccacccuccccgccaaggucuacgucggcgucaagcaggagaucgccgagaugcgcauccccgcccucaacgccuacaugaagucccuccucucccuccccgucuggguccucauggacgaggacguccgcaucuucuucuaccagucccccuacgacuccgagcaggucccccaggcccuccgccgccuccgcccccgcacccgcaaggucaaguccgucuccccccagggcaacuccgucgaccgcauggccgccccccgcgccgaggcccucuucgacuucaccggcaacuccaagcucgagcucaacuucaaggccggcgacgucaucuuccuccucucccgcaucaacaaggacuggcucgagggcaccguccgcggcgccaccggcaucuucccccucuccuucgucaagauccucaaggacuuccccgaggaggacgaccccaccaacuggcuccgcugcuacuacuacgaggacaccaucuccaccaucaaggacaucgccgucgaggaggaccucuccuccaccccccuccucaaggaccuccucgagcucacccgccgcgaguuccagcgcgaggacaucgcccucaacuaccgcgacgccgagggcgaccucguccgccuccucuccgacgaggacgucgcccucaugguccgccaggcccgcggccuccccucccagaagcgccucuuccccuggaagcuccacaucacccagaaggacaacuaccgcgucuacaacaccaugcccuga

SEQ ID NO: 46475 - RNA, 942 nt, Artificial Sequence
  derived and/or modified sequence opt2 from NCK1__Homo_sapiens__NP_001177725
auggacuggcucaacgucuucaaggacuucuucuccaucggcaaggucaagcgcaagcccuccguccccgacuccgccucccccgccgacgacuccuucgucgaccccggcgagcgccucuacgaccucaacaugcccgccuacgucaaguucaacuacauggccgagcgcgaggacgagcucucccucaucaagggcaccaaggucaucgucauggagaagugcuccgacggcugguggcgcggcuccuacaacggccaggucggcugguuccccuccaacuacgucaccgaggagggcgacuccccccucggcgaccacgucggcucccucuccgagaagcucgccgccgucgucaacaaccucaacaccggccagguccuccacgucguccaggcccucuaccccuucuccuccuccaacgacgaggagcucaacuucgagaagggcgacgucauggacgucaucgagaagcccgagaacgaccccgagugguggaagugccgcaagaucaacggcauggucggccucguccccaagaacuacgucaccgucaugcagaacaacccccucaccuccggccucgagcccucccccccccagugcgacuacauccgccccucccucaccggcaaguucgccggcaaccccugguacuacggcaaggucacccgccaccaggccgagauggcccucaacgagcgcggccacgagggcgacuuccucauccgcgacuccgaguccucccccaacgacuucuccgucucccucaaggcccagggcaagaacaagcacuucaagguccagcucaaggagaccgucuacugcaucggccagcgcaaguucuccaccauggaggagcucgucgagcacuacaagaaggcccccaucuucaccuccgagcagggcgagaagcucuaccucgucaagcaccucuccuga

SEQ ID NO: 46476 - RNA, 252 nt, Artificial Sequence
  derived and/or modified sequence opt2 from NCK2__Homo_sapiens__NP_001004722
augaccgaggaggucaucgucaucgccaagugggacuacaccgcccagcaggaccaggagcucgacaucaagaagaacgagcgccucuggcuccucgacgacuccaagaccugguggcgcguccgcaacgccgccaaccgcaccggcuacguccccuccaacuacgucgagcgcaagaacucccucaagaagggcucccucgucaagaaccucaaggacacccucgcccagcgccuccuccgcguccccuga

SEQ ID NO: 46477 - RNA, 3387 nt, Artificial Sequence
  derived and/or modified sequence opt2 from NCKAP1__Homo_sapiens__NP_038464
augucccgcuccguccuccagcccucccagcagaagcucgccgagaagcucaccauccucaacgaccgcggcgucggcaugcucacccgccucuacaacaucaagaaggccugcggcgaccccaaggccaagcccuccuaccucaucgacaagaaccucgaguccgccgucaaguucaucguccgcaaguuccccgccgucgagacccgcaacaacaaccagcagcucgcccagcuccagaaggagaaguccgagauccucaagaaccucgcccucuacuacuucaccuucgucgacgucauggaguucaaggaccacgucugcgagcuccucaacaccaucgacgucugccaggucuucuucgacaucaccgucaacuucgaccucaccaagaacuaccucgaccucaucaucaccuacaccacccucaugauccuccucucccgcaucgaggagcgcaaggccaucaucggccucuacaacuacgcccacgagaugacccacggcgccuccgaccgcgaguacccccgccucggccagaugaucgucgacuacgagaacccccucaagaagaugauggaggaguucgucccccacuccaagucccucuccgacgcccucaucucccuccagauggucuacccccgccgcaaccucuccgccgaccaguggcgcaacgcccagcuccucucccucaucuccgcccccuccaccaugcucaaccccgcccaguccgacaccaugcccugcgaguaccucucccucgacgccauggagaaguggaucaucuucggcuucauccucugccacggcauccucaacaccgacgccaccgcccucaaccucuggaagcucgcccuccaguccuccuccugccucucccucuuccgcgacgaggucuuccacauccacaaggccgccgaggaccucuucgucaacauccgcggcuacaacaagcgcaucaacgacauccgcgagugcaaggaggccgccgucucccacgccggcuccaugcaccgcgagcgccgcaaguuccuccgcuccgcccucaaggagcucgccaccguccucuccgaccagcccggccuccucggccccaaggcccucuucgucuucauggcccucuccuucgcccgcgacgagaucaucuggcuccuccgccacgccgacaacaugcccaagaaguccgccgacgacuucaucgacaagcacaucgccgagcucaucuucuacauggaggagcuccgcgcccacguccgcaaguacggccccgucaugcagcgcuacuacguccaguaccucuccggcuucgacgccgucguccucaacgagcucguccagaaccucuccgucugccccgaggacgaguccaucaucauguccuccuucgucaacaccaugaccucccucuccgucaagcaggucgaggacggcgaggucuucgacuuccgcggcaugcgccucgacugguuccgccuccaggccuacaccuccgucuccaaggccucccucggccucgccgaccaccgcgagcucggcaagaugaugaacaccaucaucuuccacaccaagauggucgacucccucgucgagaugcucgucgagaccuccgaccucuccaucuucugcuucuacucccgcgccuucgagaagauguuccagcagugccucgagcuccccucccagucccgcuacuccaucgccuucccccuccucugcacccacuucauguccugcacccacgagcucugccccgaggagcgccaccacaucggcgaccgcucccucucccucugcaacauguuccucgacgagauggccaagcaggcccgcaaccucaucaccgacaucugcaccgagcagugcacccucuccgaccagcuccuccccaagcacugcgccaagaccaucucccaggccgucaacaagaaguccaagaagcagaccggcaagaagggcgagcccgagcgcgagaagcccggcgucgaguccaugcgcaagaaccgccucgucgucaccaaccucgacaagcuccacaccgcccucuccgagcucugcuucuccaucaacuacguccccaacauggucgucugggagcacaccuucaccccccgcgaguaccucaccucccaccucgagauccgcuucaccaaguccaucgucggcaugaccauguacaaccaggccacccaggagaucgccaagcccuccgagcuccucaccuccguccgcgccuacaugaccguccuccaguccaucgagaacuacguccagaucgacaucacccgcgucuucaacaacguccuccuccagcagacccagcaccucgacucccacggcgagcccaccaucaccucccucuacaccaacugguaccucgagacccuccuccgccaggucuccaacggccacaucgccuacuuccccgccaugaaggccuucgucaaccuccccaccgagaacgagcucaccuucaacgccgaggaguacuccgacaucuccgagaugcgcucccucuccgagcuccucggccccuacggcaugaaguuccucuccgagucccucauguggcacaucuccucccaggucgccgagcucaagaagcucgucgucgagaacgucgacguccucacccagaugcgcaccuccuucgacaagcccgaccagauggccgcccucuucaagcgccucuccuccgucgacuccguccucaagcgcaugaccaucaucggcgucauccucuccuuccgcucccucgcccaggaggcccuccgcgacguccucuccuaccacauccccuuccucgucuccuccaucgaggacuucaaggaccacaucccccgcgagaccgacaugaaggucgccaugaacgucuacgagcucuccuccgccgccggccuccccugcgagaucgaccccgcccucgucgucgcccucuccucccagaaguccgagaacaucucccccgaggaggaguacaagaucgccugccuccucauggucuucgucgccgucucccuccccacccucgccuccaacgucaugucccaguacucccccgccaucgagggccacugcaacaacauccacugccucgccaaggccaucaaccagaucgccgccgcccucuucaccauccacaagggcuccaucgaggaccgccucaaggaguuccucgcccucgccuccuccucccuccucaagaucggccaggagaccgacaagaccaccacccgcaaccgcgaguccgucuaccuccuccucgacaugaucguccaggagucccccuuccucaccauggaccuccucgaguccugcuuccccuacguccuccuccgcaacgccuaccacgccgucuacaagcaguccgucaccuccuccgccuga

SEQ ID NO: 46478 - RNA, 3234 nt, Artificial Sequence
  derived and/or modified sequence opt2 from NCKAP1L__Homo_sapiens__NP_001171905
auggagcccucccucaaguacaucaacaagaaguuccccaacaucgacguccgcaacuccacccagcaccucggccccguccaccgcgagaaggccgagaucauccgcuuccucaccaacuacuaccaguccuucgucgacgucauggaguuccgcgaccacgucuacgagcuccucaacaccaucgacgccugccagugccacuucgacaucaaccucaacuucgacuucacccgcuccuaccucgaccucaucgucaccuacaccuccgucauccuccuccucucccgcaucgaggaccgccgcauccucaucggcauguacaacugcgcccacgagaugcuccacggccacggcgaccccuccuucgcccgccucggccagaugguccucgaguacgaccacccccucaagaagcucaccgaggaguucggcccccacaccaaggccgucuccggcgcccuccucucccuccacuuccucuucguccgccgcaaccagggcgccgagcaguggcgcuccgcccagcuccucucccucaucuccaacccccccgccaugaucaaccccgccaacuccgacaccauggccugcgaguaccucuccgucgaggucauggagcgcuggaucaucaucggcuuccuccucugccacggcugccucaacuccaacucccagugccagaagcucuggaagcucugccuccagggcucccucuacaucacccucauccgcgaggacguccuccagguccacaaggucaccgaggaccucuucuccucccucaagggcuacggcaagcgcgucgccgacaucaaggaguccaaggagcacgucaucgccaacuccggccaguuccacugccagcgccgccaguuccuccgcauggccgucaaggagcucgagaccguccucgccgacgagcccggccuccucggccccaaggcccucuucgccuucauggcccucuccuucauccgcgacgaggucaccuggcucguccgccacaccgagaacgucaccaagaccaagacccccgaggacuacgccgacuccuccaucgccgagcuccucuuccuccucgagggcauccgcucccucguccgccgccacaucaaggucauccagcaguaccaccuccaguaccucgcccgcuucgacgcccucguccucuccgacaucauccagaaccucuccgucugccccgaggaggaguccaucaucauguccuccuucgucuccauccucuccucccucaaccucaagcaggucgacaacggcgagaaguucgaguucuccggccuccgccucgacugguuccgccuccaggccuacaccuccgucgccaaggccccccuccaccuccacgagaaccccgaccucgccaaggucaugaaccucaucgucuuccacucccgcaugcucgacuccgucgagaagcuccucgucgagaccuccgaccucuccaccuucugcuuccaccuccgcaucuucgagaagauguucgccaugacccucgaggaguccgccaugcuccgcuacgccaucgccuucccccucaucugcgcccacuucguccacugcacccacgagaugugccccgaggaguacccccaccucaagaaccacggccuccaccacugcaacuccuuccucgaggagcucgccaagcagaccuccaacugcguccucgagaucugcgccgagcagcgcaaccucuccgagcagcuccuccccaagcacugcgccaccaccaucuccaaggccaagaacaagaagacccgcaagcagcgccagaccccccgcaagggcgagcccgagcgcgacaagcccggcgccgagucccaccgcaagaaccgcuccaucgucaccaacauggacaagcuccaccucaaccucaccgagcucgcccucaccaugaaccacgucuacuccuucuccgucuucgagcacaccaucuuccccuccgaguaccucuccucccaccucgaggcccgccucaaccgcgccaucgucuggcucgccggcuacaacgccaccacccaggagaucguccgccccuccgagcuccucgccggcgucaaggccuacaucggcuucauccagucccucgcccaguuccucggcgccgacgccucccgcgucauccgcaacgcccuccuccagcagacccagccccucgacuccugcggcgagcagaccaucaccacccucuacaccaacugguaccucgagucccuccuccgccaggccuccuccggcaccaucauccucucccccgccaugcaggccuucgucucccucccccgcgagggcgagcagaacuucuccgccgaggaguucuccgacaucuccgagaugcgcgcccucgccgagcuccucggccccuacggcaugaaguuccucuccgagaaccucauguggcacgucaccucccagaucgucgagcucaagaagcucgucgucgagaacauggacauccucguccagauccgcuccaacuucuccaagcccgaccucauggccucccuccucccccagcucaccggcgccgagaacguccucaagcgcaugaccaucaucggcgucauccucuccuuccgcgccauggcccaggagggccuccgcgaggucuucuccucccacugccccuuccucaugggccccaucgagugccucaaggaguucgucacccccgacaccgacaucaaggucacccucuccaucuucgagcucgccuccgccgccggcgucggcugcgacaucgaccccgcccucgucgccgccaucgccaaccucaaggccgacaccuccucccccgaggaggaguacaaggucgccugccuccuccucaucuuccucgccgucucccucccccuccucgccaccgaccccuccuccuucuacuccaucgagaaggacggcuacaacaacaacauccacugccucaccaaggccaucauccaggucuccgccgcccucuucacccucuacaacaagaacaucgagacccaccucaaggaguuccucgucgucgccuccgucucccuccuccagcucggccaggagaccgacaagcucaagacccgcaaccgcgaguccaucucccuccucaugcgccucgucgucgaggaguccuccuuccucacccucgacaugcucgaguccugcuuccccuacguccuccuccgcaacgccuaccgcgaggucucccgcgccuuccaccucaacuga

SEQ ID NO: 46479 - RNA, 5730 nt, Artificial Sequence
  derived and/or modified sequence opt2 from NCKAP5__Homo_sapiens__NP_997246
auggagggcaagcgccagcucgagaagcgcgacuucggcaagcgccucucccucgacuccucccucgucgaguacauggacuccaacaaguacaucgagcaccuccucacccagcucgaggagcagcaccgcucccucuggcgcgagaagcucgccgucgcccgccuccagcgcgaggucgcccagcgcaccuccgagggcgccaugcacgagaagcucauccacgagcucgaggaggagcgccaccuccgccuccaguccgagaagcgccuccaggaggucacccucgaguccgagcgcaaccgcauccagaugcgcucccuccagcagcaguucucccgcauggaggagaccguccgcaaccuccuccagucccagggcucccccgagcagaagaaggaggagaccgucaacaucauggucuaccaggagaagcucuccgaggaggagcgcaagcacaaggaggcccucgaggaccuccacauggucgucgacgaggacucccgcuccgaguccuccuccaccgacgagggcaaggagaagaccaagcuccuccucgagcgccucaaggcccucgaggccgagaacuccgcccucgcccucgagaacgagaaccagcgcgagcaguacgagcgcugccucgacgaggucgccaaccaggucguccaggcccuccucacccagaaggaccuccgcgaggagugcgucaagcucaagacccgcgucuucgaccucgagcagcagaaccgcacccucuccauccucuuccagcagcgcguccgccccaccuccgaccuccuccuccagaagcuccacucccgccuccucgaccucuccuccggcgaccuccucuccgaggucgagcgcaaccgcucccucacccagucccgcaccgacgccgagguccacgagcaccagcucaacaccaaguccgcccucaagugccccggccucggcgccgucauccccggccaccucugcccccgcaacuccuacuccuccuccuccgagcucucccucuccuccaccugcuccgaguacuccuccggcuccuccuacaccuggcacgacggcaagaaccuccgcaagcgccaguccucccagaacugggacaagcgccucuccaucgacuccucccuccccuccggcuucgccucccccaccaacgagcucccccccacccgcaucaaggagucccacauccucgagggccuccgcaagcuccagaagcgcaagguccuccucgagccccccuccgucaucaccaaguggggcuacaaggacugcaugaacuccaacgagggcaucuacucccccggcaucaaguccuccucccucaaggaguacccccccugcaagaccgccgaccucggcucccccugcaaggagccccacaagaccuucgucuacgaccucgacucccacgucgacgccgacgacgaccccuccacccucgcccuccuccaggccguccccaaccaguccugccgcccccacggcuccaagcucacccacuccgucuccgacucccucuucggcugggagaccaaccgcaagcacuuccucgagggcaccuccuccgucuaccccaaggagcgccccgagaagcucaccuccugcgccuccuccugcccccucgagaugaagcucugccccuccguccagaccccccagguccagcgcgagcgcggcccccagggccagggccacggccgcauggcccucaaccuccagcucuccgacaccgacgacaacgagaccuucgacgagcuccacaucgaguccuccgacgagaagucccccuccgacgucucccucgccgccgacaccgacaaguccgucgagaaccucgacguccucgucggcuucggcaagucccucugcggcucccccgaggaggaggagaagcagguccccauccccuccgagacccgccccaagaccuucuccuucaucaagcagcagcgcgucgucaagcgcaccuccuccgaggagugcgucaccgucaucuucgacgccgaggacggcgagcccaucgaguucuccucccaccagaccggcgucgucaccgucacccgcaacgagaucuccaucaacuccacccccgccggccccaaggccgagcacaccgagcuccucccccagggcaucgccugccuccagccccgcgccgccgcccgcgacuacaccuucuucaagcgcuccgaggaggacaccgagaagaacauccccaaggacaacgucgacaacgucccccgcgucuccaccgaguccuucuccucccgcaccgucacccagaacccccagcagcagaagcucgucaagcccacccacaacaucuccugccaguccaacucccgcuccuccgcccccaugggcaucuaccagaagcagaaccucaccaagauccccccccgcggcaaguccuccccccagaaguccaagcucauggagcccgaggccaccacccuccuccccuccuccggccucgucacccucgagaagucccccgcccucgcccccggcaagcucucccgcuucaugaagaccgaguccuccggcccccucuucgagcuccgcuccgacccccacauccccaagcacuccgcccagcucccccacuccucccgcaugcccucccgccgcgacuggguccagugccccaagucccagacccccggcucccgcucccgccccgccaucgaguccuccgacuccggcgagccccccacccgcgacgagcacugcggcuccggccccgaggccggcgucaagucccccucccccccccccccccccggccgcuccgucucccuccucgcccgccccuccuacgacuacucccccgcccccuccuccaccaaguccgagacccgcguccccuccgagaccgcccgcacccccuucaaguccccccuccucaagggcaucuccgcccccgucaucuccuccaaccccgccaccaccgagguccagcgcaagaagcccuccgucgccuucaagaagcccaucuucacccaccccaugcccucccccgaggccgucauccagacccgcugccccgcccacgcccccuccuccuccuucaccgucauggcccucggcccccccaaggucucccccaagcgcggcguccccaagaccuccccccgccagacccucggcaccccccagcgcgacaucggccuccagaccccccgcaucucccccuccacccacgagccccucgagaugaccuccuccaaguccgucucccccggccgcaagggccagcucaacgacuccgccuccaccccccccaagcccuccuuccucggcgucaacgagucccccuccucccaggucuccuccuccuccuccuccuccucccccgccaagucccacaacuccccccacggcugccaguccgcccacgagaagggccucaagacccgccuccccgucggccucaagguccucaugaaguccccccagcuccuccgcaaguccuccaccguccccggcaagcacgagaaggacucccucaacgaggccuccaaguccuccgucgccgucaacaaguccaagcccgaggacuccaagaaccccgccuccauggagaucaccgccggcgagcgcaacgucacccuccccgacucccaggcccagggcucccucgccgacggccucccccucgagaccgcccuccaggagccccucgaguccuccauccccggcuccgacggccgcgacggcgucgacaaccgcuccaugcgccgcucccucuccuccuccaagccccaccucaagcccgcccucggcaugaacggcgccaaggcccgcucccacuccuucuccacccacuccggcgacaagcccuccaccccccccaucgagggcuccggcaagguccgcacccagaucaucaccaacaccgccgagcgcggcaacucccucacccgccagaacuccuccaccgaguccucccccaacaaggcccccuccgcccccaugcucgagucccuccccuccgucggccgccccuccggccaccccuccuccggcaagggcucccucggcuccuccggcuccuucuccucccagcacggcucccccuccaagcucccccuccgcaucccccccaaguccgagggccuccucaucccccccggcaaggaggaccagcaggccuucacccagggcgagugccccuccgccaacgucgccguccucggcgagcccggcuccgaccgccgcuccugcccccccacccccaccgacugccccgaggcccuccagucccccggccgcacccagcaccccuccaccuucgagaccuccuccaccuccaagcucgagaccuccggccgccaccccgacgccuccgccaccgccaccgacgccgucuccuccgaggccccccucucccccaccaucgaggagaaggucaugcucugcauccaggagaacgucgagaagggccagguccagaccaagcccaccuccgucgaggccaagcagaagcccggccccuccuucgccuccugguucggcuuccgcaagucccgccuccccgcccucuccucccgcaagauggacaucuccaagaccaaggucgagaagaaggacgccaagguccucggcuucggcaaccgccagcucaaguccgagcgcaagaaggagaagaagaagcccgagcuccagugcgagaccgagaacgagcucaucaaggacaccaaguccgccgacaaccccgacggcggccuccaguccaagaacaaccgccgcaccccccaggacaucuacaaccagcucaagaucgagccccgcaaccgccacucccccgucgccugcuccaccaaggacaccuucaugaccgagcuccucaaccgcgucgacaagaaggccgccccccagaccgaguccggcuccuccaacgccuccugccgcaacguccucaagggcuccucccagggcuccugccucaucggcuccuccaucuccacccagggcaaccacaagaagaacaugaagaucaaggccgacauggagguccccaaggacucccucgucaaggaggccaacgagaaccuccaggaggacgaggacgacgccgucgccgacuccgucuuccagucccacaucaucgaguccaacugccagaugcgcacccucgacuccggcaucggcaccuucccccuccccgacuccggcaaccgcuccaccggccgcuaccucugccagcccgacucccccgaggacgccgagccccuccucccccuccaguccgcccucuccgccgucuccuccaugcgcgcccagacccucgagcgcgagguccccuccuccaccgacggccagcgccccgccgacuccgccaucguccacuccaccuccgaccccaucaugaccgcccgcggcaugcgcccccuccagucccgccuccccaagcccgccuccuccggcaaggucuccucccagaagcagaacgaggccgagccccgcccccagaccugcuccuccuucggcuacgccgaggaccccauggccucccagccccuccccgacuggggcuccgaggucgccgccaccggcacccaggacaaggccccccgcaugugcaccuacuccgccuccggcggcuccaacuccgacuccgaccucgacuacggcgacaacggcuucggcgccggccgcggccagcucgucaaggcccucaaguccgccgcccccgagaucgagaccaccuga

SEQ ID NO: 46480 - RNA, 2169 nt, Artificial Sequence
  derived and/or modified sequence opt2 from NCKIPSD__Homo_sapiens__NP_057537
auguaccgcgcccucuacgccuuccgcuccgccgagcccaacgcccucgccuucgccgccggcgagaccuuccucguccucgagcgcuccuccgcccacugguggcucgccgcccgcgcccgcuccggcgagaccggcuacgucccccccgccuaccuccgccgccuccagggccucgagcaggacguccuccaggccaucgaccgcgccaucgaggccguccacaacaccgccaugcgcgacggcggcaaguacucccucgagcagcgcggcguccuccagaagcucauccaccaccgcaaggagacccucucccgccgcggccccuccgccuccuccgucgccgucaugaccuccuccaccuccgaccaccaccucgacgccgccgccgcccgccagcccaacggcgucugccgcgccggcuucgagcgccagcacucccuccccuccuccgagcaccucggcgccgacggcggccucuaccagaucccccuccccuccucccagauccccccccagccccgccgcgccgcccccaccaccccccccccccccgucaagcgccgcgaccgcgaggcccucauggccuccggcuccggcggccacaacaccaugcccuccggcggcaacuccgucuccuccggcuccuccgucuccuccaccucccucgacacccucuacaccuccuccucccccuccgagcccggcuccuccugcucccccacccccccccccgucccccgccgcggcacccacaccaccgucucccagguccagcccccccccuccaaggccuccgcccccgagccccccgccgaggaggaggucgccaccggcaccaccuccgccuccgacgaccucgaggcccucggcacccucucccucggcaccaccgaggagaaggccgccgccgaggccgccgucccccgcaccaucggcgccgagcucauggagcucguccgccgcaacaccggccucucccacgagcucugccgcgucgccaucggcaucaucgucggccacauccaggccuccguccccgccuccucccccgucauggagcagguccuccucucccucgucgagggcaaggaccucuccauggcccuccccuccggccaggucugccacgaccagcagcgccucgaggucaucuucgccgaccucgcccgccgcaaggacgacgcccagcagcgcuccugggcccucuacgaggacgagggcgucauccgcugcuaccucgaggagcuccuccacauccucaccgacgccgaccccgaggucugcaagaagaugugcaagcgcaacgaguucgaguccguccucgcccucgucgccuacuaccagauggagcaccgcgccucccuccgccuccuccuccucaagugcuucggcgccaugugcucccucgacgccgccaucaucuccacccucgucuccuccguccuccccgucgagcucgcccgcgacaugcagaccgacacccaggaccaccagaagcucugcuacuccgcccucauccucgccauggucuucuccaugggcgaggccguccccuacgcccacuacgagcaccucggcacccccuucgcccaguuccuccucaacaucgucgaggacggccucccccucgacaccaccgagcagcuccccgaccucugcgucaaccuccuccucgcccucaaccuccaccuccccgccgccgaccagaacgucaucauggccgcccucuccaagcacgccaacgucaagaucuucuccgagaagcuccuccuccuccucaaccgcggcgacgaccccguccgcaucuucaagcacgagccccagcccccccacuccguccucaaguuccuccaggacgucuucggcucccccgccaccgccgccaucuucuaccacaccgacaugauggcccucaucgacaucaccguccgccacaucgccgaccucucccccggcgacaagcuccgcauggaguaccucucccucaugcacgccaucguccgcaccacccccuaccuccagcaccgccaccgccuccccgaccuccaggccauccuccgccgcauccucaacgaggaggagaccuccccccagugccagauggaccgcaugaucguccgcgagaugugcaaggaguuccucguccucggcgaggcccccuccuga

SEQ ID NO: 46481 - RNA, 2133 nt, Artificial Sequence
  derived and/or modified sequence opt2 from NCL__Homo_sapiens__NP_005372
auggucaagcucgccaaggccggcaagaaccagggcgaccccaagaagauggcccccccccccaaggaggucgaggaggacuccgaggacgaggagauguccgaggacgaggaggacgacuccuccggcgaggaggucgucaucccccagaagaagggcaagaaggccgccgccaccuccgccaagaaggucgucgucucccccaccaagaaggucgccgucgccacccccgccaagaaggccgccgucacccccggcaagaaggccgccgccacccccgccaagaagaccgucacccccgccaaggccgucaccacccccggcaagaagggcgccacccccggcaaggcccucgucgccacccccggcaagaagggcgccgccauccccgccaagggcgccaagaacggcaagaacgccaagaaggaggacuccgacgaggaggaggacgacgacuccgaggaggacgaggaggacgacgaggacgaggacgaggacgaggacgagaucgagcccgccgccaugaaggccgccgccgccgcccccgccuccgaggacgaggacgacgaggacgacgaggacgacgaggacgacgacgacgacgaggaggacgacuccgaggaggaggccauggagaccacccccgccaagggcaagaaggccgccaaggucguccccgucaaggccaagaacgucgccgaggacgaggacgaggaggaggacgacgaggacgaggacgacgacgacgacgaggacgacgaggacgacgacgacgaggacgacgaggaggaggaggaggaggaggaggaggagcccgucaaggaggcccccggcaagcgcaagaaggagauggccaagcagaaggccgcccccgaggccaagaagcagaaggucgagggcaccgagcccaccaccgccuucaaccucuucgucggcaaccucaacuucaacaaguccgcccccgagcucaagaccggcaucuccgacgucuucgccaagaacgaccucgccgucgucgacguccgcaucggcaugacccgcaaguucggcuacgucgacuucgaguccgccgaggaccucgagaaggcccucgagcucaccggccucaaggucuucggcaacgagaucaagcucgagaagcccaagggcaaggacuccaagaaggagcgcgacgcccgcacccuccucgccaagaaccuccccuacaaggucacccaggacgagcucaaggaggucuucgaggacgccgccgagauccgccucgucuccaaggacggcaaguccaagggcaucgccuacaucgaguucaagaccgaggccgacgccgagaagaccuucgaggagaagcagggcaccgagaucgacggccgcuccaucucccucuacuacaccggcgagaagggccagaaccaggacuaccgcggcggcaagaacuccaccugguccggcgaguccaagacccucguccucuccaaccucuccuacuccgccaccgaggagacccuccaggaggucuucgagaaggccaccuucaucaaggucccccagaaccagaacggcaaguccaagggcuacgccuucaucgaguucgccuccuucgaggacgccaaggaggcccucaacuccugcaacaagcgcgagaucgagggccgcgccauccgccucgagcuccagggcccccgcggcucccccaacgcccgcucccagcccuccaagacccucuucgucaagggccucuccgaggacaccaccgaggagacccucaaggaguccuucgacggcuccguccgcgcccgcaucgucaccgaccgcgagaccggcuccuccaagggcuucggcuucgucgacuucaacuccgaggaggacgccaaggccgccaaggaggccauggaggacggcgagaucgacggcaacaaggucacccucgacugggccaagcccaagggcgagggcggcuucggcggccgcggcggcggccgcggcggcuucggcggccgcggcggcggccgcggcggccgcggcggcuucggcggccgcggccgcggcggcuucggcggccgcggcggcuuccgcggcggccgcggcggcggcggcgaccacaagccccagggcaagaagaccaaguucgaguga

SEQ ID NO: 46482 - RNA, 4326 nt, Artificial Sequence
  derived and/or modified sequence opt2 from NCOA1__Homo_sapiens__XP_005264682
auguccggccucggcgacuccuccuccgaccccgccaaccccgacucccacaagcgcaagggcucccccugcgacacccucgccuccuccaccgagaagcgccgccgcgagcaggagaacaaguaccucgaggagcucgccgagcuccucuccgccaacaucuccgacaucgacucccucuccgucaagcccgacaagugcaagauccucaagaagaccgucgaccagauccagcucaugaagcgcauggagcaggagaaguccaccaccgacgacgacguccagaaguccgacaucuccuccuccucccagggcgucaucgagaaggagucccucggcccccuccuccucgaggcccucgacggcuucuucuucgucgucaacugcgagggccgcaucgucuucgucuccgagaacgucaccuccuaccucggcuacaaccaggaggagcucaugaacaccuccgucuacuccauccuccacgucggcgaccacgccgaguucgucaagaaccuccuccccaagucccucgucaacggcguccccuggccccaggaggccacccgccgcaacucccacaccuucaacugccgcaugcucauccacccccccgacgagcccggcaccgagaaccaggaggccugccagcgcuacgaggucaugcagugcuucaccgucucccagcccaaguccauccaggaggacggcgaggacuuccaguccugccucaucugcaucgcccgccgccucccccgcccccccgccaucaccggcgucgaguccuucaugaccaagcaggacaccaccggcaagaucaucuccaucgacaccuccucccuccgcgccgccggccgcaccggcugggaggaccucguccgcaagugcaucuacgccuucuuccagccccagggccgcgagcccuccuacgcccgccagcucuuccaggaggucaugacccgcggcaccgccuccucccccuccuaccgcuucauccucaacgacggcaccaugcucuccgcccacaccaagugcaagcucugcuacccccagucccccgacaugcagcccuucaucaugggcauccacaucaucgaccgcgagcacuccggccucuccccccaggacgacaccaacuccggcauguccaucccccgcgucaaccccuccgucaaccccuccaucucccccgcccacggcgucgcccgcuccuccacccucccccccuccaacuccaacauggucuccacccgcaucaaccgccagcaguccuccgaccuccacuccuccucccacuccaacuccuccaacucccagggcuccuucggcugcucccccggcucccagaucgucgccaacgucgcccucaaccagggccaggccuccucccaguccuccaaccccucccucaaccucaacaacucccccauggagggcaccggcaucucccucgcccaguucauguccccccgccgccaggucaccuccggccucgccacccgcccccgcaugcccaacaacuccuucccccccaacaucuccacccucuccucccccgucggcaugaccuccuccgccugcaacaacaacaaccgcuccuacuccaacauccccgucaccucccuccagggcaugaacgagggccccaacaacuccgucggcuucuccgccuccucccccguccuccgccagauguccucccagaacucccccucccgccucaacauccagcccgccaaggccgaguccaaggacaacaaggagaucgccuccauccucaacgagaugauccaguccgacaacuccuccuccgacggcaagccccucgacuccggccuccuccacaacaacgaccgccucuccgacggcgacuccaaguacucccagaccucccacaagcucguccagcuccucaccaccaccgccgagcagcagcuccgccacgccgacaucgacaccuccugcaaggacguccucuccugcaccggcaccuccaacuccgccuccgccaacuccuccggcggcuccugccccuccucccacuccucccucaccgagcgccacaagauccuccaccgccuccuccaggagggcucccccuccgacaucaccacccucuccgucgagcccgacaagaaggacuccgccuccaccuccgucuccgucaccggccagguccagggcaacuccuccaucaagcucgagcucgacgccuccaagaagaaggaguccaaggaccaccagcuccuccgcuaccuccucgacaaggacgagaaggaccuccgcuccacccccaaccucucccucgacgacgucaaggucaaggucgagaagaaggagcagauggaccccugcaacaccaaccccacccccaugaccaagcccacccccgaggagaucaagcucgaggcccagucccaguucaccgccgaccucgaccaguucgaccagcuccuccccacccucgagaaggccgcccagcuccccggccucugcgagaccgaccgcauggacggcgccgucaccuccgucaccaucaaguccgagauccuccccgccucccuccaguccgccaccgcccgccccaccucccgccucaaccgccuccccgagcucgagcucgaggccaucgacaaccaguucggccagcccggcaccggcgaccagauccccuggaccaacaacaccgucaccgccaucaaccaguccaaguccgaggaccagugcaucuccucccagcucgacgagcuccucugcccccccaccaccgucgagggccgcaacgacgagaaggcccuccucgagcagcucgucuccuuccucuccggcaaggacgagaccgagcucgccgagcucgaccgcgcccucggcaucgacaagcucguccagggcggcggccucgacguccucuccgagcgcuuccccccccagcaggccacccccccccucaucauggaggagcgccccaaccucuacucccagcccuacuccucccccucccccaccgccaaccuccccucccccuuccagggcaugguccgccagaagcccucccucggcaccaugcccguccaggucacccccccccgcggcgccuucucccccggcaugggcaugcagccccgccagacccucaaccgcccccccgccgcccccaaccagcuccgccuccagcuccagcagcgccuccagggccagcagcagcucauccaccagaaccgccaggccauccucaaccaguucgccgccaccgcccccgucggcaucaacaugcgcuccggcaugcagcagcagaucaccccccagcccccccucaacgcccagaugcucgcccagcgccagcgcgagcucuacucccagcagcaccgccagcgccagcucauccagcagcagcgcgccaugcucaugcgccagcaguccuucggcaacaaccucccccccuccuccggccuccccguccagaugggcaacccccgccucccccagggcgccccccagcaguuccccuacccccccaacuacggcaccaaccccggcaccccccccgccuccaccucccccuucucccagcucgccgccaaccccgaggccucccucgccaaccgcaacuccauggucucccgcggcaugaccggcaacaucggcggccaguucggcaccggcaucaacccccagaugcagcagaacgucuuccaguaccccggcgccggcauggucccccagggcgaggccaacuucgcccccucccucucccccggcuccuccaugguccccaugcccaucccccccccccaguccucccuccuccagcagaccccccccgccuccggcuaccagucccccgacaugaaggccuggcagcagggcgccaucggcaacaacaacgucuucucccaggccguccagaaccagcccacccccgcccagcccggcgucuacaacaacauguccaucaccgucuccauggccggcggcaacaccaacguccagaacaugaaccccaugauggcccagaugcagauguccucccuccagaugcccggcaugaacaccgucugccccgagcagaucaacgaccccgcccuccgccacaccggccucuacugcaaccagcucuccuccaccgaccuccucaagaccgaggccgacggcacccagcagguccagcagguccaggucuucgccgacguccagugcaccgucaaccucgucggcggcgaccccuaccucaaccagcccggcccccucggcacccagaagcccaccuccggcccccagaccccccaggcccagcagaagucccuccuccagcagcuccucaccgaguga

SEQ ID NO: 46483 - RNA, 4395 nt, Artificial Sequence
  derived and/or modified sequence opt2 from NCOA2__Homo_sapiens__XP_005251188
auguccggcaugggcgagaacaccuccgaccccucccgcgccgagacccgcaagcgcaaggagugccccgaccagcucggccccucccccaagcgcaacaccgagaagcgcaaccgcgagcaggagaacaaguacaucgaggagcucgccgagcucaucuucgccaacuucaacgacaucgacaacuucaacuucaagcccgacaagugcgccauccucaaggagaccgucaagcagauccgccagaucaaggagcaggagaaggccgccgccgccaacaucgacgagguccagaaguccgacgucuccuccaccggccagggcgucaucgacaaggacgcccucggccccaugaugcucgaggcccucgacggcuucuucuucgucgucaaccucgagggcaacgucgucuucgucuccgagaacgucacccaguaccuccgcuacaaccaggaggagcucaugaacaaguccgucuacuccauccuccacgucggcgaccacaccgaguucgucaagaaccuccuccccaaguccaucgucaacggcggcuccugguccggcgagcccccccgccgcaacucccacaccuucaacugccgcaugcucgucaagccccuccccgacuccgaggaggagggccacgacaaccaggaggcccaccagaaguacgagaccaugcagugcuucgccgucucccagcccaaguccaucaaggaggagggcgaggaccuccaguccugccucaucugcgucgcccgccgcguccccaugaaggagcgccccguccuccccuccuccgaguccuucaccacccgccaggaccuccagggcaagaucaccucccucgacaccuccaccaugcgcgccgccaugaagcccggcugggaggaccucguccgccgcugcauccagaaguuccacgcccagcacgagggcgaguccgucuccuacgccaagcgccaccaccacgagguccuccgccagggccucgccuucucccagaucuaccgcuucucccucuccgacggcacccucgucgccgcccagaccaaguccaagcucauccgcucccagaccaccaacgagccccagcucgucaucucccuccacaugcuccaccgcgagcagaacgucugcgucaugaaccccgaccucaccggccagaccaugggcaagccccucaaccccaucuccuccaacucccccgcccaccaggcccucugcuccggcaaccccggccaggacaugacccucuccuccaacaucaacuuccccaucaacggccccaaggagcagaugggcaugcccaugggccgcuucggcggcuccggcggcaugaaccacgucuccggcaugcaggccaccaccccccagggcuccaacuacgcccucaagaugaacucccccucccaguccucccccggcaugaaccccggccagcccaccuccaugcucuccccccgccaccgcaugucccccggcgucgccggcuccccccgcaucccccccucccaguucucccccgccggcucccuccacucccccgucggcgucugcuccuccaccggcaacucccacuccuacaccaacuccucccucaacgcccuccaggcccucuccgagggccacggcgucucccucggcuccucccucgccucccccgaccucaagaugggcaaccuccagaacucccccgucaacaugaacccccccccccucuccaagaugggcucccucgacuccaaggacugcuucggccucuacggcgagcccuccgagggcaccaccggccaggccgaguccuccugccaccccggcgagcagaaggagaccaacgaccccaaccucccccccgccgucuccuccgagcgcgccgacggccagucccgccuccacgacuccaagggccagaccaagcuccuccagcuccucaccaccaaguccgaccagauggagcccuccccccucgccuccucccucuccgacaccaacaaggacuccaccggcucccuccccggcuccggcuccacccacggcaccucccucaaggagaagcacaagauccuccaccgccuccuccaggacuccuccucccccgucgaccucgccaagcucaccgccgaggccaccggcaaggaccucucccaggaguccuccuccaccgcccccggcuccgaggucaccaucaagcaggagcccgucucccccaagaagaaggagaacgcccuccuccgcuaccuccucgacaaggacgacaccaaggacaucggccuccccgagaucacccccaagcucgagcgccucgacuccaagaccgaccccgccuccaacaccaagcucaucgccaugaagaccgagaaggaggagauguccuucgagcccggcgaccagcccggcuccgagcucgacaaccucgaggagauccucgacgaccuccagaacucccagcucccccagcucuuccccgacacccgccccggcgcccccgccggcuccgucgacaagcaggccaucaucaacgaccucaugcagcucaccgccgagaacucccccgucacccccgucggcgcccagaagaccgcccuccgcaucucccaguccaccuucaacaacccccgccccggccagcucggccgccuccuccccaaccagaaccucccccucgacaucacccuccagucccccaccggcgccggccccuucccccccauccgcaacuccucccccuacuccgucaucccccagcccggcaugaugggcaaccagggcaugaucggcaaccagggcaaccucggcaacuccuccaccggcaugaucggcaacuccgccucccgccccaccaugcccuccggcgagugggccccccaguccuccgccguccgcgucaccugcgccgccaccaccuccgccaugaaccgccccguccagggcggcaugauccgcaaccccgccgccuccauccccaugcgccccuccucccagcccggccagcgccagacccuccagucccaggucaugaacaucggccccuccgagcucgagaugaacaugggcggcccccaguacucccagcagcaggccccccccaaccagaccgcccccuggcccgaguccauccuccccaucgaccaggccuccuucgccucccagaaccgccagcccuucggcuccucccccgacgaccuccucugcccccaccccgccgccgagucccccuccgacgagggcgcccuccucgaccagcucuaccucgcccuccgcaacuucgacggccucgaggagaucgaccgcgcccucggcauccccgagcucgucucccagucccaggccgucgaccccgagcaguucuccucccaggacuccaacaucaugcucgagcagaaggcccccgucuucccccagcaguacgccucccaggcccagauggcccagggcuccuacucccccaugcaggaccccaacuuccacaccaugggccagcgccccuccuacgccacccuccgcaugcagccccgccccggccuccgccccaccggccucguccagaaccagcccaaccagcuccgccuccagcuccagcaccgccuccaggcccagcagaaccgccagccccucaugaaccagaucuccaacgucuccaacgucaaccucacccuccgccccggcguccccacccaggcccccaucaacgcccagaugcucgcccagcgccagcgcgagauccucaaccagcaccuccgccagcgccagaugcaccagcagcagcagguccagcagcgcacccucaugaugcgcggccagggccucaacaugacccccuccauggucgcccccuccggcaugcccgccaccauguccaacccccgcaucccccaggccaacgcccagcaguuccccuucccccccaacuacggcaucucccagcagcccgaccccggcuucaccggcgccaccaccccccaguccccccucauguccccccgcauggcccacacccagucccccaugaugcagcagucccaggccaaccccgccuaccaggcccccuccgacaucaacggcugggcccagggcaacaugggcggcaacuccauguucucccagcagucccccccccacuucggccagcaggccaacaccuccauguacuccaacaacaugaacaucaacgucuccauggccaccaacaccggcggcauguccuccaugaaccagaugaccggccagaucuccaugaccuccgucaccuccguccccaccuccggccucuccuccaugggccccgagcaggucaacgaccccgcccuccgcggcggcaaccucuuccccaaccagcuccccggcauggacaugaucaagcaggagggcgacaccacccgcaaguacugcuga

SEQ ID NO: 46484 - RNA, 4248 nt, Artificial Sequence
  derived and/or modified sequence opt2 from NCOA3__Homo_sapiens__NP_001167559
auguccggccucggcgagaaccucgacccccucgccuccgacucccgcaagcgcaagcuccccugcgacacccccggccagggccucaccugcuccggcgagaagcgccgccgcgagcaggaguccaaguacaucgaggagcucgccgagcucaucuccgccaaccucuccgacaucgacaacuucaacgucaagcccgacaagugcgccauccucaaggagaccguccgccagauccgccagaucaaggagcagggcaagaccaucuccaacgacgacgacguccagaaggccgacgucuccuccaccggccagggcgucaucgacaaggacucccucggcccccuccuccuccaggcccucgacggcuuccucuucgucgucaaccgcgacggcaacaucgucuucgucuccgagaacgucacccaguaccuccaguacaagcaggaggaccucgucaacaccuccgucuacaacauccuccacgaggaggaccgcaaggacuuccucaagaaccuccccaaguccaccgucaacggcgucuccuggaccaacgagacccagcgccagaagucccacaccuucaacugccgcaugcucaugaagaccccccacgacauccucgaggacaucaacgccucccccgagaugcgccagcgcuacgagaccaugcagugcuucgcccucucccagccccgcgccaugauggaggagggcgaggaccuccaguccugcaugaucugcgucgcccgccgcaucaccaccggcgagcgcaccuuccccuccaaccccgaguccuucaucacccgccacgaccucuccggcaaggucgucaacaucgacaccaacucccuccgcuccuccaugcgccccggcuucgaggacaucauccgccgcugcauccagcgcuucuucucccucaacgacggccaguccuggucccagaagcgccacuaccaggaggucaccuccgacggcaucuucucccccaccgccuaccucaacggccacgccgagacccccgucuaccgcuucucccucgccgacggcaccaucgucaccgcccagaccaaguccaagcucuuccgcaaccccgucaccaacgaccgccacggcuucgucuccacccacuuccuccagcgcgagcagaacggcuaccgccccaaccccaaccccgucggccagggcauccgcccccccauggccggcugcaacuccuccgucggcggcauguccaugucccccaaccagggccuccagaugcccuccucccgcgccuacggccucgccgaccccuccaccaccggccagauguccggcgcccgcuacggcggcuccuccaacaucgccucccucacccccggccccggcaugcagucccccuccuccuaccagaacaacaacuacggccucaacauguccucccccccccacggcucccccggccucgcccccaaccagcagaacaucaugaucuccccccgcaaccgcggcucccccaagaucgccucccaccaguucucccccgucgccggcguccacucccccauggccuccuccggcaacaccggcaaccacuccuucuccuccuccucccucuccgcccuccaggccaucuccgagggcgucggcaccucccuccucuccacccucuccucccccggccccaagcucgacaacucccccaacaugaacaucacccagcccuccaaggucuccaaccaggacuccaaguccccccucggcuucuacugcgaccagaaccccgucgaguccuccaugugccaguccaacucccgcgaccaccucuccgacaaggaguccaaggaguccuccgucgagggcgccgagaaccagcgcggcccccucgaguccaagggccacaagaagcuccuccagcuccucaccugcuccuccgacgaccgcggccacuccucccucaccaacuccccccucgacuccuccugcaaggaguccuccgucuccgucaccucccccuccggcgucuccuccuccaccuccggcggcgucuccuccaccuccaacaugcacggcucccuccuccaggagaagcaccgcauccuccacaagcuccuccagaacggcaacucccccgccgaggucgccaagaucaccgccgaggccaccggcaaggacaccuccuccaucaccuccugcggcgacggcaacgucgucaagcaggagcagcucucccccaagaagaaggagaacaacgcccuccuccgcuaccuccucgaccgcgacgaccccuccgacgcccucuccaaggagcuccagccccaggucgagggcgucgacaacaagaugucccagugcaccuccuccaccauccccuccuccucccaggagaaggaccccaagaucaagaccgagaccuccgaggagggcuccggcgaccucgacaaccucgacgccauccucggcgaccucaccuccuccgacuucuacaacaacuccaucuccuccaacggcucccaccucggcaccaagcagcaggucuuccagggcaccaacucccucggccucaaguccucccaguccguccaguccauccgcccccccuacaaccgcgccgucucccucgacucccccgucuccgucggcuccuccccccccgucaagaacaucuccgccuuccccaugcuccccaagcagcccaugcucggcggcaacccccgcaugauggacucccaggagaacuacggcuccuccaugggcgacuggggccuccccaacuccaaggccggccgcauggagcccaugaacuccaacuccaugggccgccccggcggcgacuacaacaccucccucccccgccccgcccucggcggcuccauccccacccucccccuccgcuccaacuccauccccggcgcccgccccguccuccagcagcagcagcagaugcuccagaugcgccccggcgagauccccaugggcaugggcgccaaccccuacggccaggccgccgccuccaaccagcucggcuccuggcccgacggcaugcucuccauggagcaggucucccacggcacccagaaccgcccccuccuccgcaacucccucgacgaccucgucggcccccccuccaaccucgagggccaguccgacgagcgcgcccuccucgaccagcuccacacccuccucuccaacaccgacgccaccggccucgaggagaucgaccgcgcccucggcauccccgagcucgucaaccagggccaggcccucgagcccaagcaggacgccuuccagggccaggaggccgccgucaugauggaccagaaggccggccucuacggccagaccuaccccgcccagggcccccccaugcagggcggcuuccaccuccagggccagucccccuccuucaacuccaugaugaaccagaugaaccagcagggcaacuucccccuccagggcaugcacccccgcgccaacaucaugcgcccccgcaccaacacccccaagcagcuccgcaugcagcuccagcagcgccuccagggccagcaguuccucaaccagucccgccaggcccucgagcucaagauggagaaccccaccgccggcggcgccgccgucaugcgccccaugaugcagccccagcagggcuuccucaacgcccagauggucgcccagcgcucccgcgagcuccucucccaccacuuccgccagcagcgcgucgccaugaugaugcagcagcagcagcagcagcagcagcagcagcagcagcagcagcagcagcagcagcagcagcagcagcagcagcagcagcagcagcagacccaggccuucucccccccccccaacgucaccgccucccccuccauggacggccuccucgccggccccaccaugccccaggcccccccccagcaguuccccuaccagcccaacuacggcaugggccagcagcccgaccccgccuucggccgcgucuccuccccccccaacgccaugauguccucccgcaugggccccucccagaaccccaugaugcagcacccccaggccgccuccaucuaccaguccuccgagaugaagggcuggcccuccggcaaccucgcccgcaacuccuccuucucccagcagcaguucgcccaccagggcaaccccgccgucuacuccaugguccacaugaacggcuccuccggccacaugggccagaugaacaugaaccccaugcccauguccggcaugcccaugggccccgaccagaaguacugcuga

SEQ ID NO: 46485 - RNA, 1953 nt, Artificial Sequence
  derived and/or modified sequence opt2 from NCOA4__Homo_sapiens__NP_001138732
augggcgcccagcucaccaccuucgcccucgccggcgccguccgccgcaugaacaccuuccaggaccaguccggcuccuccuccaaccgcgagccccuccuccgcugcuccgacgcccgccgcgaccucgagcucgccaucggcggcguccuccgcgccgagcagcagaucaaggacaaccuccgcgaggucaaggcccagauccacuccugcaucucccgccaccucgagugccuccgcucccgcgaggucuggcucuacgagcaggucgaccucaucuaccagcucaaggaggagacccuccagcagcaggcccagcagcucuacucccuccucggccaguucaacugccucacccaccagcucgagugcacccagaacaaggaccucgccaaccaggucuccgucugccucgagcgccucggcucccucacccucaagcccgaggacuccaccguccuccucuucgaggccgacaccaucacccuccgccagaccaucaccaccuucggcucccucaagaccauccagauccccgagcaccucauggcccacgccuccuccgccaacaucggccccuuccucgagaagcgcggcugcaucuccaugcccgagcagaaguccgccuccggcaucgucgccguccccuucuccgaguggcuccucggcuccaagcccgccuccggcuaccaggcccccuacauccccuccaccgacccccaggacuggcucacccagaagcagacccucgagaacucccagaccuccucccgcgccugcaacuucuucaacaacgucggcggcaaccucaagggccucgagaacuggcuccucaaguccgagaaguccuccuaccagaagugcaacucccacuccaccaccuccuccuucuccaucgagauggagaaggucggcgaccaggagcuccccgaccaggacgagauggaccucuccgacuggcucgucaccccccaggagucccacaagcuccgcaagcccgagaacggcucccgcgagaccuccgagaaguucaagcuccucuuccaguccuacaacgucaacgacuggcucgucaagaccgacuccugcaccaacugccagggcaaccagcccaagggcgucgagaucgagaaccucggcaaccucaagugccucaacgaccaccucgaggccaagaagccccucuccacccccuccauggucaccgaggacuggcucguccagaaccaccaggaccccugcaaggucgaggaggucugccgcgccaacgagcccugcaccuccuucgccgagugcgucugcgacgagaacugcgagaaggaggcccucuacaaguggcuccucaagaaggagggcaaggacaagaacggcaugcccgucgagcccaagcccgagcccgagaagcacaaggacucccucaacauguggcucugcccccgcaaggaggucaucgagcagaccaaggcccccaaggccaugacccccucccgcaucgccgacuccuuccaggucaucaagaacuccccccucuccgaguggcucauccgcccccccuacaaggagggcucccccaaggagguccccggcaccgaggaccgcgccggcaagcagaaguucaagucccccaugaacaccuccuggugcuccuucaacaccgccgacuggguccuccccggcaagaagaugggcaaccucucccagcucuccuccggcgaggacaaguggcuccuccgcaagaaggcccaggagguccuccucaacuccccccuccaggaggagcacaacuucccccccgaccacuacggccuccccgccgucugcgaccucuucgccugcaugcagcucaaggucgacaaggagaaguggcucuaccgcaccccccuccaggccuacuucaagaugaacuuccaggacgucaccgucggcaacuuccagauccccugcggcuucuga

SEQ ID NO: 46486 - RNA, 1740 nt, Artificial Sequence
  derived and/or modified sequence opt2 from NCOA5__Homo_sapiens__NP_066018
augaacaccgcccccucccgccccucccccacccgccgcgaccccuacggcuucggcgacucccgcgacucccgccgcgaccgcucccccauccgcggcuccccccgccgcgagccccgcgacggccgcaacggccgcgacgcccgcgacucccgcgacauccgcgacccccgcgaccuccgcgaccaccgccacucccgcgaccuccgcgaccaccgcgacucccgcuccguccgcgacguccgcgacguccgcgaccuccgcgacuuccgcgaccuccgcgacucccgcgacuuccgcgaccagcgcgaccccauguacgaccgcuaccgcgacaugcgcgacucccgcgaccccauguaccgccgcgagggcuccuacgaccgcuaccuccgcauggacgacuacugccgccgcaaggacgacuccuacuucgaccgcuaccgcgacuccuucgacggccgcggcccccccggccccgagucccagucccgcgccaaggagcgccucaagcgcgaggagcgccgccgcgaggagcucuaccgccaguacuucgaggagauccagcgccgcuucgacgccgagcgccccgucgacugcuccgucaucgucgucaacaagcagaccaaggacuacgccgaguccgucggccgcaagguccgcgaccucggcauggucgucgaccucaucuuccucaacaccgaggucucccucucccaggcccucgaggacgucucccgcggcggcucccccuucgccaucgucaucacccagcagcaccagauccaccgcuccugcaccgucaacaucauguucggcaccccccaggagcaccgcaacaugccccaggccgacgccaugguccucgucgcccgcaacuacgagcgcuacaagaacgagugccgcgagaaggagcgcgaggagaucgcccgccaggccgccaagauggccgacgaggccauccuccaggagcgcgagcgcggcggccccgaggagggcguccgcggcggccacccccccgccauccagucccucaucaaccuccucgccgacaaccgcuaccucaccgccgaggagaccgacaagaucaucaacuaccuccgcgagcgcaaggagcgccucaugcgcuccuccaccgacucccuccccggccccaucucccgccagccccucggcgccaccuccggcgccucccucaagacccagcccuccucccagccccuccaguccggccagguccuccccuccgccacccccacccccuccgccccccccaccucccagcaggagcuccaggccaagauccucucccucuucaacuccggcaccgucaccgccaacuccuccuccgccucccccuccgucgccgccggcaacacccccaaccagaacuucuccaccgccgccaacucccagccccagcagcgcucccaggccuccggcaaccagccccccuccauccucggccagggcggcuccgcccagaacaugggcccccgccccggcgcccccucccagggccucuucggccagcccuccucccgccucgcccccgccuccaacaugaccucccagcgccccgucuccuccaccggcaucaacuucgacaaccccuccguccagaaggcccucgacacccucauccaguccggccccgcccucucccaccucgucucccagaccaccgcccagaugggccagccccaggcccccaugggcuccuaccagcgccacuacuga

SEQ ID NO: 46487 - RNA, 3213 nt, Artificial Sequence
  derived and/or modified sequence opt2 from NCOA6__Homo_sapiens__NP_001229468
augguccucgacgaccuccccaaccucgaggacaucuacaccucccucugcuccuccaccauggaggacuccgagauggacuucgacuccggccucgaggacgacgacaccaaguccgacuccauccucgaggacuccaccaucuucgucgccuucaagggcaacaucgacgacaaggacuucaaguggaagcucgacgccauccucaagaacguccccaaccuccuccacauggaguccuccaagcucaagguccagaaggucgagcccuggaacuccguccgcgucaccuucaacaucccccgcgaggccgccgagcgccuccgcauccucgcccaguccaacaaccagcagcuccgcgaccucggcauccucuccguccagaucgagggcgagggcgccaucaaccucgcccucgcccagaaccgcucccaggacguccgcaugaacggccccaugggcgccggcaacuccguccgcauggaggccggcuuccccauggccuccggccccggcaucauccgcaugaacaaccccgccaccgucaugaucccccccggcggcaacgucuccuccuccaugauggcccccggccccaaccccgagcuccagccccgcaccccccgccccgccucccaguccgacgccauggacccccuccucuccggccuccacauccagcagcagucccaccccuccggcucccucgcccccccccaccaccccaugcagcccgucuccgucaaccgccagaugaaccccgccaacuucccccagcuccagcagcagcagcagcagcagcagcagcagcagcagcagcagcagcagcagcagcagcagcagcagcagcagcagcuccaggcccgccccccccagcagcaccagcagcagcagccccagggcauccgcccccaguucaccgcccccacccagguccccgucccccccggcuggaaccagcuccccuccggcgcccuccagcccccccccgcccagggcucccucggcaccaugaccgccaaccagggcuggaagaaggccccccuccccggccccaugcagcagcagcuccaggcccgccccucccucgccaccguccagacccccucccacccccccccccccuaccccuucggcucccagcaggccucccaggcccacaccaacuucccccagauguccaaccccggccaguucaccgccccccagaugaagucccuccagggcggccccucccgcguccccaccccccuccagcagccccaccucaccaacaagucccccgccuccucccccuccuccuuccagcagggcucccccgccuccucccccaccgucaaccagacccagcagcagaugggcccccgccccccccagaacaacccccucccccagggcuuccagcagcccgucuccucccccggccgcaaccccaugguccagcagggcaacgucccccccaacuucauggucaugcagcagcagccccccaaccagggcccccagucccuccaccccggccucggcggcaugcccaagcgccucccccccggcuucuccgccggccaggccaaccccaacuucaugcagggccagguccccuccaccaccgccaccacccccggcaacuccggcgccccccagcuccaggccaaccagaacguccagcacgccggcggccagggcgccggccccccccagaaccagaugcaggucucccacggcccccccaacaugaugcagcccucccucaugggcauccacggcaacaugaacaaccagcaggccggcaccuccggcgucccccaggucaaccucuccaacaugcagggccagccccagcagggcccccccucccagcucaugggcaugcaccagcagaucguccccucccagggccagaugguccagcagcagggcacccucaacccccagaaccccaugauccucucccgcgcccagcucaugccccagggccagaugauggucaacccccccucccagaaccucggccccuccccccagcgcaugaccccccccaagcagaugcucucccagcagggcccccagaugauggccccccacaaccagaugaugggcccccagggccagguccuccuccagcagaaccccaugaucgagcagaucaugaccaaccagaugcagggcaacaagcagcaguucaacacccagaaccaguccaacgucaugcccggccccgcccagaucaugcgcggccccacccccaacaugcagggcaacaugguccaguucaccggccagauguccggccagaugcucccccagcagggccccgucaacaacucccccucccaggucaugggcauccagggccagguccuccgcccccccggccccuccccccacauggcccagcagcacggcgaccccgccaccaccgccaacaacgacgucucccucucccagaugaugcccgacgucuccauccagcagaccaacaugguccccccccacguccaggccaugcagggcaacuccgccuccggcaaccacuucuccggccacggcauguccuucaacgcccccuucuccggcgcccccaacggcaaccagauguccugcggccagaaccccggcuuccccgucaacaaggacgucacccucaccuccccccuccucgucaaccuccuccaguccgacaucuccgccggccacuucggcgucaacaacaagcagaacaacaccaacgccaacaagcccaagaagaagaagcccccccgcaagaagaagaacucccagcaggaccucaacacccccgacacccgccccgccggccucgaggaggccgaccagcccccccuccccggcgagcagggcaucaaccucgacaacuccggccccaagcuccccgaguucuccaaccgcccccccgcccccucccagaaccucgucuccaaggagaccuccaccaccgcccuccaggccuccgucgcccgccccgagcucgaggucaacgccgccaucgucuccggccaguccuccgagcccaaggagaucgucgagaaguccaagauccccggccgccgcaacucccgcaccgaggagcccaccgucgccuccgaguccgucgagaacggccaccgcaagcgcuccucccgccccgccuccgccuccuccuccaccaaggacaucaccuccgccguccaguccaagcgccgcaaguccaaguga

SEQ ID NO: 46488 - RNA, 2796 nt, Artificial Sequence
  derived and/or modified sequence opt2 from NCOA7__Homo_sapiens__NP_001116314
auggacaccaaggaggagaagaaggagcgcaagcaguccuacuucgcccgccucaagaagaagaagcaggccaagcagaacgccgagaccgccuccgccgucgccacccgcacccacaccggcaaggaggacaacaacaccgucguccucgagcccgacaagugcaacaucgccgucgaggaggaguacaugaccgacgagaagaagaagcgcaaguccaaccagcucaaggagauccgccgcaccgagcucaagcgcuacuacuccaucgacgacaaccagaacaagacccacgacaagaaggagaagaagauggucguccagaagccccacggcaccauggaguacaccgccggcaaccaggacacccucaacuccaucgcccucaaguucaacaucacccccaacaagcucgucgagcucaacaagcucuucacccacaccaucguccccggccagguccucuucguccccgacgccaacucccccuccuccacccuccgccucuccuccuccucccccggcgccaccgucucccccuccuccuccgacgccgaguacgacaagcuccccgacgccgaccucgcccgcaaggcccucaagcccaucgagcgcguccucuccuccaccuccgaggaggacgagcccggcgucgucaaguuccucaagaugaacugccgcuacuucaccgacggcaagggcgucgucggcggcgucaugaucgucacccccaacaacaucauguucgacccccacaaguccgacccccucgucaucgagaacggcugcgaggaguacggccucaucugccccauggaggaggucgucuccaucgcccucuacaacgacaucucccacaugaagaucaaggacgcccuccccucccccggcgagugggaggaccucgccuccgagaaggacaucaaccccuucuccaaguucaaguccaucaacaaggagaagcgccagcagaacggcgagaagaucaugaccuccgacucccgccccaucgucccccucgagaaguccaccggccacacccccaccaagcccuccggcuccuccgucuccgagaagcucaagaagcucgacuccucccgcgagaccucccacggcucccccaccgucaccaagcucuccaaggagcccuccgacaccuccuccgccuucgaguccaccgccaaggagaacuuccucggcgaggacgacgacuucgucgaccucgaggagcucuccucccagaccggcggcggcaugcacaagaaggacacccucaaggagugccucucccucgaccccgaggagcgcaagaaggccgagucccagaucaacaacuccgccgucgagaugcagguccaguccgcccucgccuuccucggcaccgagaacgacgucgagcucaagggcgcccucgaccucgagaccugcgagaagcaggacaucaugcccgaggucgacaagcaguccggcucccccgagucccgcgucgagaacacccucaacauccacgaggaccucgacaaggucaagcucaucgaguacuaccucaccaagaacaaggagggcccccaggucuccgagaaccuccagaagaccgagcucuccgacggcaaguccaucgagcccggcggcaucgacaucacccucuccuccucccucucccaggccggcgaccccaucaccgagggcaacaaggagcccgacaagaccugggucaagaagggcgagccccuccccgucaagcucaacuccuccaccgaggccaacgucaucaaggaggcccucgacuccucccucgaguccacccucgacaacuccugccagggcgcccagauggacaacaaguccgagguccagcucuggcuccucaagcgcauccagguccccaucgaggacauccuccccuccaaggaggagaaguccaagaccccccccauguuccucugcaucaaggucggcaagcccaugcgcaaguccuucgccacccacaccgccgccaugguccagcaguacggcaagcgccgcaagcagcccgaguacugguucgccgucccccgcgagcgcgucgaccaccucuacaccuucuucguccaguggucccccgacgucuacggcaaggacgccaaggagcagggcuucgucgucgucgagaaggaggagcucaacaugaucgacaacuucuucuccgagcccaccaccaaguccugggagaucaucaccgucgaggaggccaagcgccgcaaguccaccugcuccuacuacgaggacgaggacgaggagguccuccccguccuccgcccccacuccgcccuccucgagaacaugcacaucgagcagcucgcccgccgccuccccgcccgcguccagggcuaccccuggcgccucgccuacuccacccucgagcacggcaccucccucaagacccucuaccgcaaguccgccucccucgacucccccguccuccucgucaucaaggacauggacaaccagaucuucggcgccuacgccacccaccccuucaaguucuccgaccacuacuacggcaccggcgagaccuuccucuacaccuucuccccccacuucaaggucuucaagugguccggcgagaacuccuacuucaucaacggcgacaucuccucccucgagcucggcggcggcggcggccgcuucggccucuggcucgacgccgaccucuaccacggccgcuccaacuccugcuccaccuucaacaacgacauccucuccaagaaggaggacuucaucguccaggaccucgaggucugggccuucgacuga

SEQ ID NO: 46489 - RNA, 2745 nt, Artificial Sequence
  derived and/or modified sequence opt2 from NCOR1__Homo_sapiens__NP_001177367
auguccuccuccggcuacccccccaaccagggcgccuucuccaccgagcagucccgcuaccccccccacuccguccaguacaccuuccccaacacccgccaccagcaggaccccgccuucggcggcaagcacgaggcccccuccucccccaucuccggccagcccugcggcgacgaccagaacgccucccccuccaagcucuccaaggaggagcucauccaguccauggaccgcgucgaccgcgagaucgccaaggucgagcagcagauccucaagcucaagaagaagcagcagcagcucgaggaggaggccgccaagccccccgagcccgagaagcccgucucccccccccccgucgagcagaagcaccgcuccaucguccagaucaucuacgacgagaaccgcaagaaggccgaggaggcccacaagaucuucgagggccucggccccaaggucgagcucccccucuacaaccagcccuccgacaccaaggucuaccacgagaacaucaagaccaaccaggucaugcgcaagaagcucauccucuucuucaagcgccgcaaccacgcccgcaagcagcgcgagcagaagaucugccagcgcuacgaccagcucauggaggccugggagaagaaggucgaccgcaucgagaacaacccccgccgcaaggccaaggaguccaagacccgcgaguacuacgagaagcaguuccccgagauccgcaagcagcgcgagcagcaggagcgcuuccagcgcgucggccagcgcggcgccggccucuccgccaccaucgcccgcuccgagcacgagaucuccgagaucaucgacggccucuccgagcaggagaacaacgagaagcagaugcgccagcucuccgucaucccccccaugauguucgacgccgagcagcgccgcgucaaguucaucaacaugaacggccucauggaggaccccaugaaggucuacaaggaccgccaguucaugaacgucuggaccgaccacgagaaggagaucuucaaggacaaguucauccagcaccccaagaacuucggccucaucgccuccuaccucgagcgcaaguccguccccgacugcguccucuacuacuaccucaccaagaagaacgagaacuacaaggcccucguccgccgcaacuacggcaagcgccgcggccgcaaccagcagaucgcccgccccucccaggaggagaaggucgaggagaaggaggaggacaaggccgagaagaccgagaagaaggaggaggagaagaaggacgaggaggagaaggacgagaaggaggacuccaaggagaacaccaaggagaaggacaagaucgacggcaccgccgaggagaccgaggagcgcgagcaggccaccccccgcggccgcaagaccgccaacucccagggccgccgcaagggccgcaucacccgcuccaugaccaacgaggccgccgccgccuccgccgccgccgccgccgccaccgaggagcccccccccccccucccccccccccccgagcccaucuccaccgagcccgucgagaccucccgcuggaccgaggaggagauggaggucgccaagaagggccucgucgagcacggccgcaacugggccgccaucgccaagauggucggcaccaaguccgaggcccagugcaagaacuucuacuucaacuacaagcgccgccacaaccucgacaaccuccuccagcagcacaagcagaagaccucccgcaagccccgcgaggagcgcgacgucucccagugcgaguccgucgccuccaccgucuccgcccaggaggacgaggacaucgaggccuccaacgaggaggagaaccccgaggacuccgagggcgccgagaacuccuccgacaccgaguccgcccccucccccucccccgucgaggccgucaagcccuccgaggacucccccgagaacgccaccucccgcggcaacaccgagcccgccgucgagcucgagcccaccaccgagaccgcccccuccaccucccccucccucgccguccccuccaccaagcccgccgaggacgaguccgucgagacccaggucaacgacuccaucuccgccgagaccgccgagcagauggacgucgaccagcaggagcacuccgccgaggagggcuccgucugcgaccccccccccgccaccaaggccgacuccgucgacgucgagguccgcguccccgagaaccacgccuccaaggucgagggcgacaacaccaaggagcgcgaccucgaccgcgccuccgagaaggucgagccccgcgacgaggaccucgucgucgcccagcagaucaacgcccagcgccccgagccccaguccgacaacgacuccuccgccaccugcuccgccgacgaggacgucgacggcgagcccgagcgccagcgcauguuccccauggacuccaagcccucccuccucaaccccaccggcuccauccucgucuccuccccccucaagcccaacccccucgaccucccccagcuccagcaccgcgccgccgucaucccccccauggucuccugcacccccugcaacauccccaucggcacccccgucuccggcuacgcccucuaccagcgccacaucaaggccaugcacgaguccgcccuccucgaggagcagcgccagcgccaggagcagaucgaccucgagugccgcuccuccaccucccccugcggcaccuccaagucccccaaccgcgagugggagggccgcuga

SEQ ID NO: 46490 - RNA, 7377 nt, Artificial Sequence
  derived and/or modified sequence opt2 from NCOR2__Homo_sapiens__NP_001070729
auguccggcuccacccagcccgucgcccagaccuggcgcgccaccgagccccgcuaccccccccacucccucuccuaccccguccagaucgcccgcacccacaccgacgucggccuccucgaguaccagcaccacucccgcgacuacgccucccaccucucccccggcuccaucauccagccccagcgccgccgccccucccuccucuccgaguuccagcccggcaacgagcgcucccaggagcuccaccuccgccccgagucccacuccuaccuccccgagcucggcaaguccgagauggaguucaucgaguccaagcgcccccgccucgagcuccuccccgacccccuccuccgccccuccccccuccucgccaccggccagcccgccggcuccgaggaccucaccaaggaccgcucccucaccggcaagcucgagcccgucuccccccccucccccccccacaccgaccccgagcucgagcucguccccccccgccucuccaaggaggagcucauccagaacauggaccgcgucgaccgcgagaucaccauggucgagcagcagaucuccaagcucaagaagaagcagcagcagcucgaggaggaggccgccaagccccccgagcccgagaagcccgucucccccccccccaucgaguccaagcaccgcucccucguccagaucaucuacgacgagaaccgcaagaaggccgaggccgcccaccgcauccucgagggccucggcccccaggucgagcucccccucuacaaccagcccuccgacacccgccaguaccacgagaacaucaagaucaaccaggccaugcgcaagaagcucauccucuacuucaagcgccgcaaccacgcccgcaagcagugggagcagaaguucugccagcgcuacgaccagcucauggaggccugggagaagaaggucgagcgcaucgagaacaacccccgccgccgcgccaaggaguccaagguccgcgaguacuacgagaagcaguuccccgagauccgcaagcagcgcgagcuccaggagcgcaugcagcgcgucggccagcgcggcuccggccucuccauguccgccgcccgcuccgagcacgaggucuccgagaucaucgacggccucuccgagcaggagaaccucgagaagcagaugcgccagcucgccgucaucccccccaugcucuacgacgccgaccagcagcgcaucaaguucaucaacaugaacggccucauggccgaccccaugaaggucuacaaggaccgccaggucaugaacaugugguccgagcaggagaaggagaccuuccgcgagaaguucaugcagcaccccaagaacuucggccucaucgccuccuuccucgagcgcaagaccgucgccgagugcguccucuacuacuaccucaccaagaagaacgagaacuacaagucccucguccgccgcuccuaccgccgccgcggcaagucccagcagcagcagcagcagcagcagcagcagcagcagcagcagcagcagcagcccaugccccgcuccucccaggaggagaaggacgagaaggagaaggagaaggaggccgagaaggaggaggagaagcccgaggucgagaacgacaaggaggaccuccucaaggagaagaccgacgacaccuccggcgaggacaacgacgagaaggaggccgucgccuccaagggccgcaagaccgccaacucccagggccgccgcaagggccgcaucacccgcuccauggccaacgaggccaacuccgaggaggccaucaccccccagcaguccgccgagcucgccuccauggagcucaacgaguccucccgcuggaccgaggaggagauggagaccgccaagaagggccuccucgagcacggccgcaacugguccgccaucgcccgcauggucggcuccaagaccgucucccagugcaagaacuucuacuucaacuacaagaagcgccagaaccucgacgagauccuccagcagcacaagcucaagauggagaaggagcgcaacgcccgccgcaagaagaagaaggcccccgccgccgccuccgaggaggccgccuucccccccgucgucgaggacgaggagauggaggccuccggcgucuccggcaacgaggaggagauggucgaggaggccgaggccaccgucaacaacuccuccgacaccgaguccauccccuccccccacaccgaggccgccaaggacaccggccagaacggccccaagccccccgccacccucggcgccgacggccccccccccggcccccccacccccccccccgaggacauccccgcccccaccgagcccacccccgccuccgaggccaccggcgcccccacccccccccccgccccccccucccccuccgcccccccccccgucguccccaaggaggagaaggaggaggagaccgccgccgccccccccgucgaggagggcgaggagcagaagccccccgccgccgaggagcucgccgucgacaccggcaaggccgaggagcccgucaaguccgagugcaccgaggaggccgaggagggccccgccaagggcaaggacgccgaggccgccgaggccaccgccgagggcgcccucaaggccgagaagaaggagggcggcuccggccgcgccaccaccgccaaguccuccggcgccccccaggacuccgacuccuccgccaccugcuccgccgacgaggucgacgaggccgagggcggcgacaagaaccgccuccucuccccccgccccucccuccucacccccaccggcgacccccgcgccaacgccuccccccagaagccccucgaccucaagcagcucaagcagcgcgccgccgccaucccccccauccaggucaccaagguccacgagcccccccgcgaggacgccgcccccaccaagcccgccccccccgcccccccccccccccagaaccuccagcccgaguccgacgccccccagcagcccggcuccuccccccgcggcaagucccgcucccccgccccccccgccgacaaggaggccgagaagcccgucuucuuccccgccuucgccgccgaggcccagaagcuccccggcgacccccccugcuggaccuccggccuccccuuccccguccccccccgcgaggucaucaaggccuccccccacgcccccgaccccuccgccuucuccuacgccccccccggccacccccucccccucggccuccacgacaccgcccgccccguccucccccgcccccccaccaucuccaacccccccccccucaucuccuccgccaagcaccccuccguccucgagcgccagaucggcgccaucucccagggcauguccguccagcuccacguccccuacuccgagcacgccaaggcccccgucggccccgucaccaugggccucccccuccccauggaccccaagaagcucgcccccuucuccggcgucaagcaggagcagcucuccccccgcggccaggccggcccccccgagucccucggcguccccaccgcccaggaggccuccguccuccgcggcaccgcccucggcuccguccccggcggcuccaucaccaagggcauccccuccacccgcguccccuccgacuccgccaucaccuaccgcggcuccaucacccacggcacccccgccgacguccucuacaagggcaccaucacccgcaucaucggcgaggacucccccucccgccucgaccgcggccgcgaggacucccuccccaagggccacgucaucuacgagggcaagaagggccacguccucuccuacgagggcggcauguccgucacccagugcuccaaggaggacggccgcuccuccuccggccccccccacgagaccgccgcccccaagcgcaccuacgacaugauggagggccgcgucggccgcgccaucuccuccgccuccaucgagggccucaugggccgcgccaucccccccgagcgccacuccccccaccaccucaaggagcagcaccacauccgcggcuccaucacccagggcaucccccgcuccuacgucgaggcccaggaggacuaccuccgccgcgaggccaagcuccucaagcgcgagggcaccccccccccccccccccccucccgcgaccucaccgaggccuacaagacccaggcccucggcccccucaagcucaagcccgcccacgagggccucgucgccaccgucaaggaggccggccgcuccauccacgagaucccccgcgaggagcuccgccacacccccgagcucccccucgccccccgcccccucaaggagggcuccaucacccagggcaccccccucaaguacgacaccggcgccuccaccaccggcuccaagaagcacgacguccgcucccucaucggcucccccggccgcaccuucccccccguccacccccucgacgucauggccgacgcccgcgcccucgagcgcgccugcuacgaggagucccucaagucccgccccggcaccgccuccuccuccggcggcuccaucgcccgcggcgcccccgucaucguccccgagcucggcaagccccgccaguccccccucaccuacgaggaccacggcgcccccuucgccggccaccucccccgcggcucccccgucaccacccgcgagcccaccccccgccuccaggagggcucccucuccuccuccaaggccucccaggaccgcaagcucaccuccaccccccgcgagaucgccaaguccccccacuccaccguccccgagcaccacccccaccccaucucccccuacgagcaccuccuccgcggcgucuccggcgucgaccucuaccgcucccacaucccccucgccuucgaccccaccuccaucccccgcggcaucccccucgacgccgccgccgccuacuaccucccccgccaccucgcccccaaccccaccuacccccaccucuacccccccuaccucauccgcggcuaccccgacaccgccgcccucgagaaccgccagaccaucaucaacgacuacaucaccucccagcagaugcaccacaacgccgccaccgccauggcccagcgcgccgacaugcuccgcggccucuccccccgcgaguccucccucgcccucaacuacgccgccggcccccgcggcaucaucgaccucucccaggucccccaccuccccguccucgucccccccacccccggcacccccgccaccgccauggaccgccucgccuaccuccccaccgccccccagcccuucuccucccgccacuccuccuccccccucucccccggcggccccacccaccucaccaagcccaccaccaccuccuccuccgagcgcgagcgcgaccgcgaccgcgagcgcgaccgcgaccgcgagcgcgagaaguccauccucaccuccaccaccaccgucgagcacgcccccaucuggcgccccggcaccgagcaguccuccggcuccuccggcggcggcggcggcuccuccucccgccccgccucccacucccacgcccaccagcacucccccaucuccccccgcacccaggacgcccuccagcagcgccccuccguccuccacaacaccggcaugaagggcaucaucaccgccgucgagcccuccacccccaccguccuccgcuccaccuccaccuccucccccguccgccccgccgccaccuucccccccgccacccacugcccccucggcggcacccucgacggcgucuaccccacccucauggagcccguccuccuccccaaggaggccccccgcgucgcccgccccgagcgcccccgcgccgacaccggccacgccuuccucgccaagccccccgcccgcuccggccucgagcccgccuccucccccuccaagggcuccgagccccgcccccucgucccccccgucuccggccacgccaccaucgcccgcacccccgccaagaaccucgccccccaccacgccucccccgacccccccgccccccccgccuccgccuccgacccccaccgcgagaagacccaguccaagcccuucuccauccaggagcucgagcuccgcucccucggcuaccacggcuccuccuacucccccgagggcgucgagcccgucucccccgucuccucccccucccucacccacgacaagggccuccccaagcaccucgaggagcucgacaagucccaccucgagggcgagcuccgccccaagcagcccggccccgucaagcucggcggcgaggccgcccaccucccccaccuccgcccccuccccgagucccagcccuccuccuccccccuccuccagaccgcccccggcgucaagggccaccagcgcgucgucacccucgcccagcacaucuccgaggucaucacccaggacuacacccgccaccacccccagcagcucuccgccccccuccccgccccccucuacuccuuccccggcgccuccugccccguccucgaccuccgccgcccccccuccgaccucuaccuccccccccccgaccacggcgcccccgcccgcggcuccccccacuccgagggcggcaagcgcucccccgagcccaacaagaccuccguccucggcggcggcgaggacggcaucgagcccgucuccccccccgagggcaugaccgagcccggccacucccgcuccgccgucuacccccuccucuaccgcgacggcgagcagaccgagcccucccgcaugggcuccaagucccccggcaacaccucccagccccccgccuucuucuccaagcucaccgaguccaacuccgccauggucaaguccaagaagcaggagaucaacaagaagcucaacacccacaaccgcaacgagcccgaguacaacaucucccagcccggcaccgagaucuucaacaugcccgccaucaccggcaccggccucaugaccuaccgcucccaggccguccaggagcacgccuccaccaacaugggccucgaggccaucauccgcaaggcccucaugggcggcggcggcaaggccaaggucuccggccgccccuccucccgcaaggccaagucccccgcccccggccucgccuccggcgaccgcccccccuccgucuccuccguccacuccgagggcgacugcaaccgccgcaccccccucaccaaccgcgucugggaggaccgccccuccuccgccggcuccacccccuuccccuacaacccccucaucaugcgccuccaggccggcgucauggccuccccccccccccccggccuccccgccggcuccggcccccucgccggcccccaccacgccugggacgaggagcccaagccccuccucugcucccaguacgagacccucuccgacuccgaguga

SEQ ID NO: 46491 - RNA, 912 nt, Artificial Sequence
  derived and/or modified sequence opt2 from NCR1__Homo_sapiens__NP_001138929
auguccuccacccuccccgcccuccucugcgucggccucugccucucccagcgcaucuccgcccagcagcagacccuccccaagcccuucaucugggccgagccccacuucaugguccccaaggagaagcaggucaccaucugcugccagggcaacuacggcgccgucgaguaccagcuccacuucgagggcucccucuucgccgucgaccgccccaagccccccgagcgcaucaacaagguccaguucuacauccccgacaugaacucccgcauggccggccaguacuccugcaucuaccgcgucggcgagcucugguccgagcccuccaaccuccucgaccucgucgucaccgagauguacgacacccccacccucuccguccaccccggccccgaggucaucuccggcgagaaggucaccuucuacugccgccucgacaccgccaccuccauguuccuccuccucaaggagggccgcuccucccacguccagcgcggcuacggcaagguccaggccgaguucccccucggccccgucaccaccgcccaccgcggcaccuaccgcugcuucggcuccuacaacaaccacgccugguccuuccccuccgagcccgucaagcuccucgucaccggcgacaucgagaacaccucccucgcccccgaggaccccaccuuccccgacaccuggggcaccuaccuccucaccaccgagaccggccuccagaaggaccacgcccucugggaccacaccgcccagaaccuccuccgcaugggccucgccuuccucguccucgucgcccucgucugguuccucgucgaggacuggcucucccgcaagcgcacccgcgagcgcgccucccgcgccuccaccugggagggccgccgccgccucaacacccagacccucuga

SEQ ID NO: 46492 - RNA, 813 nt, Artificial Sequence
  derived and/or modified sequence opt2 from NCR2__Homo_sapiens__NP_001186438
auggccuggcgcgcccuccacccccuccuccuccuccuccuccucuuccccggcucccaggcccaguccaaggcccagguccuccaguccgucgccggccagacccucaccguccgcugccaguacccccccaccggcucccucuacgagaagaagggcuggugcaaggaggccuccgcccucgucugcauccgccucgucaccuccuccaagccccgcaccauggccuggaccucccgcuucaccaucugggacgaccccgacgccggcuucuucaccgucaccaugaccgaccuccgcgaggaggacuccggccacuacuggugccgcaucuaccgccccuccgacaacuccgucuccaaguccguccgcuucuaccucgucgucucccccgccuccgccuccacccagaccuccuggaccccccgcgaccucgucuccucccagacccagacccaguccugcgucccccccaccgccggcgcccgccaggcccccgagucccccuccaccauccccguccccucccaccccuccuccccccuccccgucccccuccccucccgcccccagaacuccacccuccgccccggccccgccgcccccaucgcccucguccccgucuucugcggccuccucgucgccaagucccucguccucuccgcccuccucgucugguggguccuccgcaaccgccacaugcagcaccagggccgcucccuccuccaccccgcccagccccgcccccaggcccaccgccacuucccccucucccaccgcgcccccggcggcaccuacggcggcaagcccuga

SEQ ID NO: 46493 - RNA, 534 nt, Artificial Sequence
  derived and/or modified sequence opt2 from NCR3__Homo_sapiens__NP_001138938
auggccuggaugcuccuccucauccucaucaugguccaccccggcuccugcgcccucugggucucccagccccccgagauccgcacccucgagggcuccuccgccuuccuccccugcuccuucaacgccucccagggccgccucgccaucggcuccgucaccugguuccgcgacgaggucguccccggcaaggagguccgcaacggcacccccgaguuccgcggccgccucgccccccucgccuccucccgcuuccuccacgaccaccaggccgagcuccacauccgcgacguccgcggccacgacgccuccaucuacgucugccgcgucgagguccucggccucggcgucggcaccggcaacggcacccgccucgucgucgagaaggagcacccccagcucggcgccggcaccguccuccuccuccgcgccggcuucuacgccgucuccuuccucuccgucgccgucggcuccaccgucuacuaccagggcaaguacgccaaguccacccucuccggcuucccccagcucuga

SEQ ID NO: 46494 - RNA, 1365 nt, Artificial Sequence
  derived and/or modified sequence opt2 from NCR3LG1__Homo_sapiens__NP_001189368
augaccuggcgcgccgccgccuccaccugcgccgcccuccucauccuccucugggcccucaccaccgagggcgaccucaaggucgagaugauggccggcggcacccagaucaccccccucaacgacaacgucaccaucuucugcaacaucuucuacucccagccccucaacaucaccuccaugggcaucaccugguucuggaagucccucaccuucgacaaggaggucaaggucuucgaguucuucggcgaccaccaggaggccuuccgccccggcgccaucgucucccccuggcgccucaaguccggcgacgccucccuccgccuccccggcauccagcucgaggaggccggcgaguaccgcugcgaggucgucgucaccccccucaaggcccagggcaccguccagcucgaggucgucgccucccccgccucccgccuccuccucgaccaggucggcaugaaggagaacgaggacaaguacaugugcgaguccuccggcuucuaccccgaggccaucaacaucaccugggagaagcagacccagaaguucccccaccccaucgagaucuccgaggacgucaucaccggccccaccaucaagaacauggacggcaccuucaacgucaccuccugccucaagcucaacuccucccaggaggaccccggcaccgucuaccagugcgucguccgccacgccucccuccacaccccccuccgcuccaacuucacccucaccgccgcccgccacucccucuccgagaccgagaagaccgacaacuucuccauccacugguggcccaucuccuucaucggcgucggccucguccuccucaucguccucauccccuggaagaagaucugcaacaaguccuccuccgccuacaccccccucaagugcauccucaagcacuggaacuccuucgacacccagacccucaagaaggagcaccucaucuucuucugcacccgcgccuggcccuccuaccagcuccaggacggcgaggccuggccccccgagggcuccgucaacaucaacaccauccagcagcucgacgucuucugccgccaggagggcaagugguccgagguccccuacguccaggccuucuucgcccuccgcgacaaccccgaccucugccagugcugccgcaucgaccccgcccuccucaccgucaccuccggcaaguccaucgacgacaacuccaccaaguccgagaagcagaccccccgcgagcacuccgacgccguccccgacgcccccauccuccccgucucccccaucugggagcccccccccgccaccaccuccaccacccccguccucuccucccagccccccacccuccuccucccccuccaguga

SEQ ID NO: 46495 - RNA, 519 nt, Artificial Sequence
  derived and/or modified sequence opt2 from NCS1__Homo_sapiens__NP_001122298
auggccaccaucaccgagaaggagguccagcagugguacaagggcuucaucaaggacugccccuccggccagcucgacgccgccggcuuccagaagaucuacaagcaguucuuccccuucggcgaccccaccaaguucgccaccuucgucuucaacgucuucgacgagaacaaggacggccgcaucgaguucuccgaguucauccaggcccucuccgucaccucccgcggcacccucgacgagaagcuccgcugggccuucaagcucuacgaccucgacaacgacggcuacaucacccgcaacgagaugcucgacaucgucgacgccaucuaccagauggucggcaacaccgucgagcuccccgaggaggagaacacccccgagaagcgcgucgaccgcaucuucgccaugauggacaagaacgccgacggcaagcucacccuccaggaguuccaggagggcuccaaggccgaccccuccaucguccaggcccucucccucuacgacggccucgucuga

SEQ ID NO: 46496 - RNA, 2070 nt, Artificial Sequence
  derived and/or modified sequence opt2 from NCSTN__Homo_sapiens__NP_001277113
auggacuucaaccucauccucgagucccucugccgcggcaacuccgucgagcgcaagaucuacaucccccucaacaagaccgcccccugcguccgccuccucaacgccacccaccagaucggcugccaguccuccaucuccggcgacaccggcgucauccacgucgucgagaaggaggaggaccuccaguggguccucaccgacggccccaacccccccuacaugguccuccucgaguccaagcacuucacccgcgaccucauggagaagcucaagggccgcaccucccgcaucgccggccucgccgucucccucaccaagcccucccccgccuccggcuucucccccuccguccagugccccaacgacggcuucggcgucuacuccaacuccuacggccccgaguucgcccacugccgcgagauccaguggaacucccucggcaacggccucgccuacgaggacuucuccuuccccaucuuccuccucgaggacgagaacgagaccaaggucaucaagcagugcuaccaggaccacaaccucucccagaacggcuccgcccccaccuucccccucugcgccaugcagcucuucucccacaugcacgccgucaucuccaccgccaccugcaugcgccgcuccuccauccaguccaccuucuccaucaaccccgagaucgucugcgacccccucuccgacuacaacgucugguccaugcucaagcccaucaacaccaccggcacccucaagcccgacgaccgcgucgucgucgccgccacccgccucgacucccgcuccuucuucuggaacgucgcccccggcgccgaguccgccgucgccuccuucgucacccagcucgccgccgccgaggcccuccagaaggcccccgacgucaccacccucccccgcaacgucauguucgucuucuuccagggcgagaccuucgacuacaucggcuccucccgcauggucuacgacauggagaagggcaaguuccccguccagcucgagaacgucgacuccuucgucgagcucggccaggucgcccuccgcaccucccucgagcucuggaugcacaccgaccccgucucccagaagaacgaguccguccgcaaccaggucgaggaccuccucgccacccucgagaaguccggcgccggcguccccgccgucauccuccgccgccccaaccagucccagccccucccccccuccucccuccagcgcuuccuccgcgcccgcaacaucuccggcgucguccucgccgaccacuccggcgccuuccacaacaaguacuaccaguccaucuacgacaccgccgagaacaucaacgucuccuaccccgaguggcucucccccgaggaggaccucaacuucgucaccgacaccgccaaggcccucgccgacgucgccaccguccucggccgcgcccucuacgagcucgccggcggcaccaacuucuccgacaccguccaggccgacccccagaccgucacccgccuccucuacggcuuccucaucaaggccaacaacuccugguuccaguccauccuccgccaggaccuccgcuccuaccucggcgacggcccccuccagcacuacaucgccgucuccucccccaccaacaccaccuacgucguccaguacgcccucgccaaccucaccggcaccgucgucaaccucacccgcgagcagugccaggaccccuccaagguccccuccgagaacaaggaccucuacgaguacuccuggguccagggcccccuccacuccaacgagaccgaccgccucccccgcugcguccgcuccaccgcccgccucgcccgcgcccucucccccgccuucgagcucucccagugguccuccaccgaguacuccaccuggaccgagucccgcuggaaggacauccgcgcccgcaucuuccucaucgccuccaaggagcucgagcucaucacccucaccgucggcuucggcauccucaucuucucccucaucgucaccuacugcaucaacgccaaggccgacguccucuucaucgccccccgcgagcccggcgccgucuccuacuga

SEQ ID NO: 46497 - RNA, 1929 nt, Artificial Sequence
  derived and/or modified sequence opt2 from NDC80__Homo_sapiens__NP_006092
augaagcgcuccuccgucuccuccggcggcgccggccgccucuccaugcaggagcuccgcucccaggacgucaacaagcagggccucuacaccccccagaccaaggagaagcccaccuucggcaagcucuccaucaacaagcccaccuccgagcgcaaggucucccucuucggcaagcgcaccuccggccacggcucccgcaacucccagcucggcaucuucuccuccuccgagaagaucaaggacccccgcccccucaacgacaaggccuucauccagcagugcauccgccagcucugcgaguuccucaccgagaacggcuacgcccacaacgucuccaugaagucccuccaggcccccuccgucaaggacuuccucaagaucuucaccuuccucuacggcuuccucugccccuccuacgagcuccccgacaccaaguucgaggaggaggucccccgcaucuucaaggaccucggcuaccccuucgcccucuccaaguccuccauguacaccgucggcgccccccacaccuggccccacaucgucgccgcccucgucuggcucaucgacugcaucaagauccacaccgccaugaaggaguccuccccccucuucgacgacggccagcccuggggcgaggagaccgaggacggcaucaugcacaacaagcucuuccucgacuacaccaucaagugcuacgaguccuucauguccggcgccgacuccuucgacgagaugaacgccgagcuccaguccaagcucaaggaccucuucaacgucgacgccuucaagcucgagucccucgaggccaagaaccgcgcccucaacgagcagaucgcccgccucgagcaggagcgcgagaaggagcccaaccgccucgagucccuccgcaagcucaaggccucccuccagggcgacguccagaaguaccaggccuacauguccaaccucgagucccacuccgccauccucgaccagaagcucaacggccucaacgaggagaucgcccgcgucgagcucgagugcgagaccaucaagcaggagaacacccgccuccagaacaucaucgacaaccagaaguacuccgucgccgacaucgagcgcaucaaccacgagcgcaacgagcuccagcagaccaucaacaagcucaccaaggaccucgaggccgagcagcagaagcucuggaacgaggagcucaaguacgcccgcggcaaggaggccaucgagacccagcucgccgaguaccacaagcucgcccgcaagcucaagcucauccccaagggcgccgagaacuccaagggcuacgacuucgagaucaaguucaaccccgaggccggcgccaacugccucgucaaguaccgcgcccaggucuacgucccccucaaggagcuccucaacgagaccgaggaggagaucaacaaggcccucaacaagaagaugggccucgaggacacccucgagcagcucaacgccaugaucaccgaguccaagcgcuccguccgcacccucaaggaggagguccagaagcucgacgaccucuaccagcagaagaucaaggaggccgaggaggaggacgagaagugcgccuccgagcucgagucccucgagaagcacaagcaccuccucgaguccaccgucaaccagggccucuccgaggccaugaacgagcucgacgccguccagcgcgaguaccagcucgucguccagaccaccaccgaggagcgccgcaaggucggcaacaaccuccagcgccuccucgagauggucgccacccacgucggcuccgucgagaagcaccucgaggagcagaucgccaaggucgaccgcgaguacgaggagugcauguccgaggaccucuccgagaacaucaaggagauccgcgacaaguacgagaagaaggccacccucaucaaguccuccgaggaguga

SEQ ID NO: 46498 - RNA, 1008 nt, Artificial Sequence
  derived and/or modified sequence opt2 from NDE1__Homo_sapiens__NP_060138
auggaggacuccggcaagaccuucuccuccgaggaggaggaggccaacuacuggaaggaccucgccaugaccuacaagcagcgcgccgagaacacccaggaggagcuccgcgaguuccaggagggcucccgcgaguacgaggccgagcucgagacccagcuccagcagaucgagacccgcaaccgcgaccuccucuccgagaacaaccgccuccgcauggagcucgagaccaucaaggagaaguucgagguccagcacuccgagggcuaccgccagaucuccgcccucgaggacgaccucgcccagaccaaggccaucaaggaccagcuccagaaguacauccgcgagcucgagcaggccaacgacgaccucgagcgcgccaagcgcgccaccaucaugucccucgaggacuucgagcagcgccucaaccaggccaucgagcgcaacgccuuccucgaguccgagcucgacgagaaggagaaccuccucgaguccguccagcgccucaaggacgaggcccgcgaccuccgccaggagcucgccguccagcagaagcaggagaagccccgcacccccaugcccuccuccgucgaggccgagcgcaccgacaccgccguccaggccaccggcuccguccccuccacccccaucgcccaccgcggccccuccuccucccucaacacccccggcuccuuccgccgcggccucgacgacuccaccggcggcaccccccucacccccgccgcccgcaucuccgcccucaacaucgucggcgaccuccuccgcaaggucggcgcccucgaguccaagcucgccuccugccgcaaccucgucuacgaccagucccccaaccgcaccggcggccccgccuccggccgcuccuccaagaaccgcgacggcggcgagcgccgccccuccuccaccuccgucccccucggcgacaagggccucgacaccuccugccgcuggcucuccaaguccaccacccgcuccuccuccuccugcuga

SEQ ID NO: 46499 - RNA, 987 nt, Artificial Sequence
  derived and/or modified sequence opt2 from NDEL1__Homo_sapiens__NP_001020750
auggacggcgaggacauccccgacuucuccucccucaaggaggagaccgccuacuggaaggagcucucccucaaguacaagcaguccuuccaggaggcccgcgacgagcucgucgaguuccaggagggcucccgcgagcucgaggccgagcucgaggcccagcucguccaggccgagcagcgcaaccgcgaccuccaggccgacaaccagcgccucaaguacgaggucgaggcccucaaggagaagcucgagcaccaguacgcccaguccuacaagcaggucuccguccucgaggacgaccucucccagacccgcgccaucaaggagcagcuccacaaguacguccgcgagcucgagcaggccaacgacgaccucgagcgcgccaagcgcgccaccaucgucucccucgaggacuucgagcagcgccucaaccaggccaucgagcgcaacgccuuccucgaguccgagcucgacgagaaggagucccuccucgucuccguccagcgccucaaggacgaggcccgcgaccuccgccaggagcucgccguccgcgagcgccagcaggaggucacccgcaaguccgcccccuccucccccacccucgacugcgagaagauggacuccgccguccaggccucccucucccuccccgccacccccgucggcaagggcaccgagaacaccuuccccucccccaaggccauccccaacggcuucggcaccuccccccucacccccuccgcccgcaucuccgcccucaacaucgucggcgaccuccuccgcaaggucggcgcccucgaguccaagcucgccgccugccgcaacuucgccaaggaccaggccucccgcaaguccuacaucuccggcaacgucaacugcggcguccucaacggcaacggcaccaaguucucccgcuccggccacaccuccuucuucgacaagggccaggagaaggucaucuuccccacccucuucaugggccaguga

SEQ ID NO: 46500 - RNA, 666 nt, Artificial Sequence
  derived and/or modified sequence opt2 from NDFIP1__Homo_sapiens__NP_085048
auggcccucgcccucgccgcccucgccgccgucgagcccgccugcggcucccgcuaccagcagcuccagaacgaggaggaguccggcgagcccgagcaggccgccggcgacgcccccccccccuacuccuccaucuccgccgaguccgccgccuacuucgacuacaaggacgaguccggcuuccccaagccccccuccuacaacgucgccaccacccuccccuccuacgacgaggccgagcgcaccaaggccgaggccaccaucccccucguccccggccgcgacgaggacuucgucggccgcgacgacuucgacgacgccgaccagcuccgcaucggcaacgacggcaucuucaugcucaccuucuucauggccuuccucuucaacuggaucggcuucuuccucuccuucugccucaccaccuccgccgccggccgcuacggcgccaucuccggcuucggccucucccucaucaaguggauccucaucguccgcuucuccaccuacuuccccggcuacuucgacggccaguacuggcucuggugggucuuccucguccucggcuuccuccucuuccuccgcggcuucaucaacuacgccaagguccgcaagaugcccgagaccuucuccaaccucccccgcacccgcguccucuucaucuacuga

SEQ ID NO: 46501 - RNA, 1011 nt, Artificial Sequence
  derived and/or modified sequence opt2 from NDFIP2__Homo_sapiens__NP_061953
auggcccgccgccgcucccagcgcgucugcgccuccggccccuccaugcucaacuccgcccgcggcgcccccgagcuccuccgcggcaccgccaccaacgccgaggucuccgccgccgccgccggcgccaccggcuccgaggagcucccccccggcgaccgcggcugccgcaacggcggcggccgcggccccgccgccaccaccuccuccaccggcgucgccgucggcgccgagcacggcgaggacucccucucccgcaagcccgaccccgagcccggccgcauggaccaccaccagcccggcaccggccgcuaccagguccuccucaacgaggaggacaacuccgaguccuccgccaucgagcagccccccaccuccaaccccgccccccagaucguccaggccgccuccuccgcccccgcccucgagaccgacuccucccccccccccuacuccuccaucaccgucgagguccccaccaccuccgacaccgaggucuacggcgaguucuaccccguccccccccccuacuccgucgccaccucccuccccaccuacgacgaggccgagaaggccaaggccgccgccauggccgccgccgccgccgagaccucccagcgcauccaggaggaggagugccccccccgcgacgacuucuccgacgccgaccagcuccgcgucggcaacgacggcaucuucaugcucgccuucuucauggccuucaucuucaacuggcucggcuucugccucuccuucugcaucaccaacaccaucgccggccgcuacggcgccaucugcggcuucggccucucccucaucaaguggauccucaucguccgcuucuccgacuacuucaccggcuacuucaacggccaguacuggcucugguggaucuuccucguccucggccuccuccucuucuuccgcggcuucgucaacuaccucaagguccgcaacauguccgaguccauggccgccgcccaccgcacccgcuacuucuuccuccucuga

SEQ ID NO: 46502 - RNA, 1707 nt, Artificial Sequence
  derived and/or modified sequence opt2 from NDNF__Homo_sapiens__NP_078850
augguccuccuccacuggugccuccucuggcuccucuucccccucuccucccgcacccagaagcuccccacccgcgacgaggagcucuuccagaugcagauccgcgacaaggccuucuuccacgacuccuccgucauccccgacggcgccgagaucuccuccuaccucuuccgcgacacccccaagcgcuacuucuucgucgucgaggaggacaacaccccccucuccgucaccgucacccccugcgacgccccccucgaguggaagcucucccuccaggagcuccccgaggaccgcuccggcgagggcuccggcgaccucgagccccucgagcagcagaagcagcagaucaucaacgaggagggcaccgagcucuucuccuacaagggcaacgacgucgaguacuucaucuccuccuccucccccuccggccucuaccagcucgaccuccucuccaccgagaaggacacccacuucaaggucuacgccaccaccacccccgaguccgaccagcccuaccccgagcuccccuacgacccccgcgucgacgucaccucccucggccgcaccaccgucacccucgccuggaagcccucccccaccgccucccuccucaagcagcccauccaguacugcgucgucaucaacaaggagcacaacuucaagucccucugcgccgucgaggccaagcucuccgccgacgacgccuucaugauggcccccaagcccggccucgacuucucccccuucgacuucgcccacuucggcuuccccuccgacaacuccggcaaggagcgcuccuuccaggccaagcccucccccaagcucggccgccacgucuacucccgccccaaggucgacauccagaagaucugcaucggcaacaagaacaucuucaccgucuccgaccucaagcccgacacccaguacuacuucgacgucuucgucgucaacaucaacuccaacauguccaccgccuacgucggcaccuucgcccgcaccaaggaggaggccaagcagaagaccgucgagcucaaggacggcaagaucaccgacgucuucgucaagcgcaagggcgccaaguuccuccgcuucgcccccgucuccucccaccagaaggucaccuucuucauccacuccugccucgacgccguccagauccagguccgccgcgacggcaagcuccuccucucccagaacgucgagggcauccagcaguuccagcuccgcggcaagcccaaggccaaguaccucguccgccucaagggcaacaagaagggcgccuccaugcucaagauccucgccaccacccgccccaccaagcaguccuuccccucccuccccgaggacacccgcaucaaggccuucgacaagcuccgcaccugcuccuccgccaccgucgccuggcucggcacccaggagcgcaacaaguucugcaucuacaagaaggaggucgacgacaacuacaacgaggaccagaagaagcgcgagcagaaccagugccucggccccgacauccgcaagaaguccgagaagguccucugcaaguacuuccacucccagaaccuccagaaggccgucaccaccgagaccaucaagggccuccagcccggcaaguccuaccuccucgacgucuacgucaucggccacggcggccacuccgucaaguaccaguccaaggucgucaagacccgcaaguucugcuga

SEQ ID NO: 46503 - RNA, 966 nt, Artificial Sequence
  derived and/or modified sequence opt2 from NDN__Homo_sapiens__NP_002478
auguccgagcaguccaaggaccucuccgaccccaacuucgccgccgaggcccccaacuccgagguccacuccucccccggcgucuccgagggcgucccccccuccgccacccucgccgagccccagucccccccccucggccccaccgccgccccccaggccgccccccccccccaggcccccaacgacgagggcgaccccaaggcccuccagcaggccgccgaggagggccgcgcccaccaggcccccuccgccgcccagcccggccccgccccccccgcccccgcccagcucguccagaaggcccacgagcucaugugguacguccucgucaaggaccagaagaagaugaucaucugguuccccgacauggucaaggacgucaucggcuccuacaagaaguggugccgcuccauccuccgccgcaccucccucauccucgcccgcgucuucggccuccaccuccgccucaccucccuccacaccauggaguucgcccucgucaaggcccucgagcccgaggagcucgaccgcgucgcccucuccaaccgcaugcccaugaccggccuccuccucaugauccucucccucaucuacgucaagggccgcggcgcccgcgaguccgccgucuggaacguccuccgcauccucggccuccgccccuggaagaagcacuccaccuucggcgacguccgcaagcucaucaccgaggaguucguccagaugaacuaccucaaguaccagcgcguccccuacgucgagccccccgaguacgaguucuucuggggcucccgcgccucccgcgagaucaccaagaugcagaucauggaguuccucgcccgcgucuucaagaaggacccccaggccuggcccucccgcuaccgcgaggcccucgaggaggcccgcgcccuccgcgaggccaaccccaccgcccacuacccccgcuccuccgucuccgaggacuga

SEQ ID NO: 46504 - RNA, 402 nt, Artificial Sequence
  derived and/or modified sequence opt2 from NDP__Homo_sapiens__NP_000257
augcgcaagcacguccucgccgccuccuucuccaugcucucccuccucgucaucaugggcgacaccgacuccaagaccgacuccuccuucaucauggacuccgacccccgccgcugcaugcgccaccacuacgucgacuccaucucccacccccucuacaagugcuccuccaagaugguccuccucgcccgcugcgagggccacugcucccaggccucccgcuccgagccccucgucuccuucuccaccguccucaagcagcccuuccgcuccuccugccacugcugccgcccccagaccuccaagcucaaggcccuccgccuccgcugcuccggcggcaugcgccucaccgccaccuaccgcuacauccucuccugccacugcgaggagugcaacuccuga

SEQ ID NO: 46505 - RNA, 1185 nt, Artificial Sequence
  derived and/or modified sequence opt2 from NDRG1__Homo_sapiens__NP_001128714
augucccgcgagaugcaggacgucgaccucgccgaggucaagccccucgucgagaagggcgagaccaucaccggccuccuccaggaguucgacguccaggagcaggacaucgagacccuccacggcuccguccacgucacccucugcggcacccccaagggcaaccgccccgucauccucaccuaccacgacaucggcaugaaccacaagaccugcuacaacccccucuucaacuacgaggacaugcaggagaucacccagcacuucgccgucugccacgucgacgcccccggccagcaggacggcgccgccuccuuccccgccggcuacauguaccccuccauggaccagcucgccgagaugcuccccggcguccuccagcaguucggccucaaguccaucaucggcaugggcaccggcgccggcgccuacauccucacccgcuucgcccucaacaaccccgagauggucgagggccucguccucaucaacgucaaccccugcgccgagggcuggauggacugggccgccuccaagaucuccggcuggacccaggcccuccccgacauggucgucucccaccucuucggcaaggaggagaugcaguccaacgucgaggucguccacaccuaccgccagcacaucgucaacgacaugaaccccggcaaccuccaccucuucaucaacgccuacaacucccgccgcgaccucgagaucgagcgccccaugcccggcacccacaccgucacccuccagugccccgcccuccucgucgucggcgacuccucccccgccgucgacgccgucgucgagugcaacuccaagcucgaccccaccaagaccacccuccucaagauggccgacugcggcggccucccccagaucucccagcccgccaagcucgccgaggccuucaaguacuucguccagggcaugggcuacaugcccuccgccuccaugacccgccucaugcgcucccgcaccgccuccggcuccuccgucaccucccucgacggcacccgcucccgcucccacaccuccgagggcacccgcucccgcucccacaccuccgagggcacccgcucccgcucccacaccuccgagggcgcccaccucgacaucacccccaacuccggcgccgccggcaacuccgccggccccaaguccauggaggucuccugcuga

SEQ ID NO: 46506 - RNA, 1104 nt, Artificial Sequence
  derived and/or modified sequence opt2 from NDRG2__Homo_sapiens__NP_001269140
auggagaacggcggcuccaugcaggccaccauggccgagcuccaggagguccagaucaccgaggagaagccccuccuccccggccagacccccgaggccgccaagacccacuccgucgagacccccuacggcuccgucaccuucaccgucuacggcacccccaagcccaagcgccccgccauccucaccuaccacgacgucggccucaacuacaaguccugcuuccagccccucuuccaguucgaggacaugcaggagaucauccagaacuucguccgcguccacgucgacgcccccggcauggaggagggcgcccccgucuucccccucggcuaccaguaccccucccucgaccagcucgccgacaugauccccugcguccuccaguaccucaacuucuccaccaucaucggcgucggcgucggcgccggcgccuacauccucgcccgcuacgcccucaaccaccccgacaccgucgagggccucguccucaucaacaucgaccccaacgccaagggcuggauggacugggccgcccacaagcucaccggccucaccuccuccauccccgagaugauccucggccaccucuucucccaggaggagcucuccggcaacuccgagcucauccagaaguaccgcaacaucaucacccacgcccccaaccucgacaacaucgagcucuacuggaacuccuacaacaaccgccgcgaccucaacuucgagcgcggcggcgacaucacccuccgcugccccgucaugcucgucgucggcgaccaggccccccacgaggacgccgucgucgagugcaacuccaagcucgaccccacccagaccuccuuccucaagauggccgacuccggcggccagccccagcucacccagcccggcaagcucaccgaggccuucaaguacuuccuccagggcaugggcuacauggccuccuccugcaugacccgccucucccgcucccgcaccgccucccucaccuccgccgccuccgucgacggcaaccgcucccgcucccgcacccucucccaguccuccgaguccggcacccucuccuccggcccccccggccacaccauggaggucuccugcuga

SEQ ID NO: 46507 - RNA, 1092 nt, Artificial Sequence
  derived and/or modified sequence opt2 from NDRG3__Homo_sapiens__NP_071922
auggacgagcuccaggacguccagcucaccgagaucaagccccuccucaacgacaaggagcacgacaucgagaccacccacggcgucguccacgucaccauccgcggccuccccaagggcaaccgccccgucauccucaccuaccacgacaucggccucaaccacaaguccugcuucaacgccuucuucaacuucgaggacaugcaggagaucacccagcacuucgccgucugccacgucgacgcccccggccagcaggagggcgcccccuccuuccccaccggcuaccaguaccccaccauggacgagcucgccgagaugcucccccccguccucacccaccucucccucaaguccaucaucggcaucggcgucggcgccggcgccuacauccucucccgcuucgcccucaaccaccccgagcucgucgagggccucguccucaucaacgucgaccccugcgccaagggcuggaucgacugggccgccuccaagcucuccggccucaccaccaacgucgucgacaucauccucgcccaccacuucggccaggaggagcuccaggccaaccucgaccucauccagaccuaccgcaugcacaucgcccaggacaucaaccaggacaaccuccagcucuuccucaacuccuacaacggccgccgcgaccucgagaucgagcgccccauccucggccagaacgacaacaaguccaagacccucaagugcuccacccuccucgucgucggcgacaacucccccgccgucgaggccgucgucgagugcaacucccgccucaaccccaucaacaccacccuccucaagauggccgacugcggcggccucccccaggucguccagcccggcaagcucaccgaggccuucaaguacuuccuccagggcaugggcuacauccccuccgccuccaugacccgccucgcccgcucccgcacccacuccaccuccuccucccucggcuccggcgagucccccuucucccgcuccgucaccuccaaccaguccgacggcacccaggaguccugcgagucccccgacguccucgaccgccaccagaccauggaggucuccugcuga

SEQ ID NO: 46508 - RNA, 1176 nt, Artificial Sequence
  derived and/or modified sequence opt2 from NDRG4__Homo_sapiens__NP_001123959
augaagguccucggccaccgccucgagcuccucaccggccuccuccuccacgacgucaccauggccggccuccaggagcuccgcuuccccgaggagaagccccuccuccgcggccaggacgccaccgagcucgaguccuccgacgccuuccuccucgccgccgacaccgacuggaaggagcacgacaucgagacccccuacggccuccuccacgucgucauccgcggcucccccaagggcaaccgccccgccauccucaccuaccacgacgucggccucaaccacaagcucugcuucaacaccuucuucaacuucgaggacaugcaggagaucaccaagcacuucgucgucugccacgucgacgcccccggccagcaggucggcgccucccaguucccccagggcuaccaguuccccuccauggagcagcucgccgccaugcuccccuccgucguccagcacuucggcuucaaguacgucaucggcaucggcgucggcgccggcgccuacguccucgccaaguucgcccucaucuuccccgaccucgucgagggccucguccucgucaacaucgaccccaacggcaagggcuggaucgacugggccgccaccaagcucuccggccucaccuccacccuccccgacaccguccucucccaccucuucucccaggaggagcucgucaacaacaccgagcucguccaguccuaccgccagcagaucggcaacgucgucaaccaggccaaccuccagcucuucuggaacauguacaacucccgccgcgaccucgacaucaaccgccccggcaccguccccaacgccaagacccuccgcugccccgucaugcucgucgucggcgacaacgcccccgccgaggacggcgucgucgagugcaacuccaagcucgaccccaccaccaccaccuuccucaagauggccgacuccggcggccucccccaggucacccagcccggcaagcucaccgaggccuucaaguacuuccuccagggcaugggcuacaugcccuccgccuccaugacccgccucgcccgcucccgcaccgccucccucaccuccgccuccuccgucgacggcucccgcccccaggccugcacccacuccgaguccuccgagggccucggccaggucaaccacaccauggaggucuccugcuga

SEQ ID NO: 46509 - RNA, 2688 nt, Artificial Sequence
  derived and/or modified sequence opt2 from NDST1__Homo_sapiens__XP_005268491
augcccgcccucgccugccuccgccgccucugccgccacgucuccccccaggccguccucuuccuccucuucaucuucugccucuucuccgucuucaucuccgccuacuaccucuacggcuggaagcgcggccucgagcccuccgccgacgcccccgagcccgacugcggcgaccccccccccgucgcccccucccgccuccucccccucaagcccguccaggccgccacccccucccgcaccgacccccucguccucgucuucgucgagucccucuacucccagcucggccaggaggucgucgccauccucgaguccucccgcuucaaguaccgcaccgagaucgcccccggcaagggcgacaugcccacccucaccgacaagggccgcggccgcuucgcccucaucaucuacgagaacauccucaaguacgucaaccucgacgccuggaaccgcgagcuccucgacaaguacugcgucgccuacggcgucggcaucaucggcuucuucaaggccaacgagaacucccuccucuccgcccagcucaagggcuucccccucuuccuccacuccaaccucggccucaaggacugcuccaucaaccccaaguccccccuccucuacgucacccgccccuccgaggucgagaagggcguccuccccggcgaggacuggaccgucuuccaguccaaccacuccaccuacgagcccguccuccucgccaagacccgcuccuccgaguccaucccccaccucggcgccgacgccggccuccacgccgcccuccacgccaccgucguccaggaccucggccuccacgacggcauccagcgcguccucuucggcaacaaccucaacuucuggcuccacaagcucgucuucgucgacgccgucgccuuccucaccggcaagcgccucucccucccccucgaccgcuacauccucgucgacaucgacgacaucuucgucggcaaggagggcacccgcaugaaggucgaggacgucaaggcccucuucgacacccagaacgagcuccgcgcccacauccccaacuucaccuucaaccucggcuacuccggcaaguucuuccacaccggcaccaacgccgaggacgccggcgacgaccuccuccucuccuacgucaaggaguucuggugguucccccacauguggucccacaugcagccccaccucuuccacaaccaguccguccucgccgagcagauggcccucaacaagaaguucgccgucgagcacggcauccccaccgacaugggcuacgccgucgccccccaccacuccggcgucuaccccguccacguccagcucuacgaggccuggaagcaggucugguccauccgcgucaccuccaccgaggaguacccccaccucaagcccgcccgcuaccgccgcggcuucauccacaacggcaucaugguccucccccgccagaccugcggccucuucacccacaccaucuucuacaacgaguaccccggcggcuccuccgagcucgacaagaucaucaacggcggcgagcucuuccucaccguccuccucaaccccaucuccaucuucaugacccaccucuccaacuacggcaacgaccgccucggccucuacaccuucaagcaccucguccgcuuccuccacuccuggaccaaccuccgccuccagacccucccccccguccagcucgcccagaaguacuuccagaucuucuccgaggagaaggacccccucuggcaggaccccugcgaggacaagcgccacaaggacaucugguccaaggagaagaccugcgaccgcuuccccaagcuccucaucaucggcccccagaagaccggcaccaccgcccucuaccucuuccucggcaugcaccccgaccucuccuccaacuaccccuccuccgagaccuucgaggagauccaguucuucaacggccacaacuaccacaagggcaucgacugguacauggaguucuuccccauccccuccaacaccaccuccgacuucuacuucgagaaguccgccaacuacuucgacuccgaggucgccccccgccgcgccgccgcccuccuccccaaggccaagguccucaccauccucaucaaccccgccgaccgcgccuacuccugguaccagcaccagcgcgcccacgacgaccccgucgcccucaaguacaccuuccacgaggucaucaccgccggcuccgacgccuccuccaagcuccgcgcccuccagaaccgcugccucguccccggcugguacgccacccacaucgagcgcuggcucuccgccuaccacgccaaccagauccucguccucgacggcaagcuccuccgcaccgagcccgccaaggucauggacaugguccagaaguuccucggcgucaccaacaccaucgacuaccacaagacccucgccuucgaccccaagaagggcuucuggugccagcuccucgagggcggcaagaccaagugccucggcaaguccaagggccgcaaguaccccgagauggaccucgacgucuccggcggccacaccaccugcuccaccugcauccgcucccgcgccuuccucaaggacuacuaccgcgaccacaacaucgagcucuccaagcuccucuacaagaugggccagacccuccccaccuggcuccgcgaggaccuccagaacacccgcuga

SEQ ID NO: 46510 - RNA, 2448 nt, Artificial Sequence
  derived and/or modified sequence opt2 from NDST2__Homo_sapiens__XP_005270312
augcuccagcucuggaaggucguccgccccgcccgccagcucgagcuccaccgccucauccuccuccucaucgccuucucccucggcuccaugggcuuccucgccuacuacgucuccaccucccccaaggccaaggagccccucccccucccccucggcgacugcuccuccggcggcgccgccggccccggccccgcccgcccccccguccccccccgccccccccgcccccccgagaccgcccgcaccgagcccgucguccucgucuucgucgaguccgccuacucccagcucggccaggagaucgucgccauccucgaguccucccgcuuccgcuacuccaccgagcucgcccccggccgcggcgacaugcccacccucaccgacaacacccacggccgcuacguccucgucaucuacgagaaccuccucaaguacgucaaccucgacgccuggucccgcgagcuccucgaccgcuacugcgucgaguacggcgucggcaucaucggcuucuuccgcgcccacgagcacucccuccucuccgcccagcucaagggcuucccccucuuccuccacuccaaccucggccuccgcgacuaccaggucaaccccuccgccccccuccuccaccucacccgccccucccgccucgagcccggcccccuccccggcgacgacuggaccaucuuccaguccaaccacuccaccuacgagcccguccuccucgccucccuccgccccgccgagcccgccguccccggccccguccuccgccgcgcccgccuccccaccgucguccaggaccucggccuccacgacggcauccagcgcguccucuucggccacggccucuccuucuggcuccacaagcucaucuucgucgacgccgucgccuaccucaccggcaagcgccucugccucgaccucgaccgcuacauccucgucgacaucgacgacaucuucgucggcaaggagggcacccgcaugaaggucgccgacgucgaggcccuccucaccacccagaacaagcuccgcacccucguccccaacuucaccuucaaccucggcuucuccggcaaguucuaccacaccggcaccgaggaggaggacgccggcgacgacaugcuccucaagcaccgcaaggaguucuggugguucccccacauguggucccacaugcagccccaccucuuccacaaccgcuccguccucgccgaccagaugcgccucaacaagcaguucgcccucgagcacggcauccccaccgaccucggcuacgccgucgccccccaccacuccggcgucuaccccauccacacccagcucuacgaggccuggaaguccgucuggggcauccaggucaccuccaccgaggaguacccccaccuccgccccgcccgcuaccgccgcggcuucauccacaacggcaucaugguccucccccgccagaccugcggccucuucacccacaccaucuucuacaacgaguaccccggcggcucccgcgagcucgaccgcuccauccgcggcggcgagcucuuccucaccguccuccucaaccccaucuccaucuucaugacccaccucuccaacuacggcaacgaccgccucggccucuacaccuucgagucccucguccgcuuccuccagugcuggacccgccuccgccuccagacccucccccccgucccccucgcccagaaguacuucgagcucuucccccaggagcgcuccccccucuggcagaaccccugcgacgacaagcgccacaaggacaucugguccaaggagaagaccugcgaccgccuccccaaguuccucaucgucggcccccagaagaccggcaccaccgccauccacuucuuccucucccuccaccccgccgucaccuccuccuuccccucccccuccaccuucgaggagauccaguucuucaacucccccaacuaccacaagggcaucgacugguacauggacuucuuccccguccccuccaacgccuccaccgacuuccucuucgagaaguccgccaccuacuucgacuccgaggucgucccccgccgcggcgccgcccuccucccccgcgccaagaucaucaccguccucaccaaccccgccgaccgcgccuacuccugguaccagcaccagcgcgcccacggcgaccccgucgcccucaacuacaccuucuaccaggucaucuccgccuccucccagaccccccucgcccuccgcucccuccagaaccgcugccucguccccggcuacuacuccacccaccuccagcgcuggcucaccuacuaccccuccggccagcuccucaucgucgacggccaggagcuccgcaccaaccccgccgccuccauggaguccauccagaaguuccucggccucaugaugauccgcgacuucggcgcccgcgaccucaaggucguccgccucgccgucuga

SEQ ID NO: 46511 - RNA, 2622 nt, Artificial Sequence
  derived and/or modified sequence opt2 from NDST3__Homo_sapiens__NP_004775
auguccuucaucaugaagcuccaccgccacuuccagcgcaccgucauccuccucgccaccuucugcauggucuccaucaucaucuccgccuacuaccucuacuccggcuacaagcaggagaacgagcucuccgagaccgccuccgaggucgacugcggcgaccuccagcaccuccccuaccagcucauggaggucaaggccaugaagcucuucgacgccucccgcaccgaccccaccguccucgucuucgucgagucccaguacuccucccucggccaggacaucaucaugauccucgaguccucccgcuuccaguaccacaucgagaucgcccccggcaagggcgaccuccccguccucaucgacaagaugaagggcaaguacauccucaucaucuacgagaacauccucaaguacaucaacauggacuccuggaaccgcucccuccucgacaaguacugcgucgaguacggcgucggcgucaucggcuuccacaagaccuccgagaaguccguccaguccuuccagcucaagggcuuccccuucuccaucuacggcaaccucgccgucaaggacugcugcaucaacccccacuccccccucauccgcgucaccaaguccuccaagcucgagaagggcucccuccccggcaccgacuggaccgucuuccagaucaaccacuccgccuaccagcccgucaucuucgccaaggucaagacccccgagaaccucucccccuccaucuccaagggcgccuucuacgccaccaucauccacgaccucggccuccacgacggcauccagcgcguccucuucggcaacaaccucaacuucuggcuccacaagcucaucuucaucgacgccaucuccuuccucuccggcaagcgccucacccucucccucgaccgcuacauccucgucgacaucgacgacaucuucgucggcaaggagggcacccgcaugaacaccaacgacgucaaggcccuccucgacacccagaaccuccuccgcgcccagaucaccaacuucaccuucaaccucggcuucuccggcaaguucuaccacaccggcaccgaggaggaggacgagggcgacgacugccuccucggcuccgucgacgaguucuggugguucccccacauguggucccacaugcagccccaccucuuccacaacgaguccucccucgucgagcagaugauccucaacaagaaguucgcccucgagcacggcauccccaccgacaugggcuacgccgucgccccccaccacuccggcgucuaccccguccacguccagcucuacgaggccuggaagaaggucuggaacaucaagaucaccuccaccgaggaguacccccaccucaagcccgcccgcuaccgccgcggcuucauccacaagaacaucaugguccucccccgccagaccugcggccucuucacccacaccaucuucuacaaggaguaccccggcggccccaaggagcucgacaaguccauccagggcggcgagcucuucuucaccgucguccucaaccccaucuccaucuucaugacccaccucuccaacuacggcaacgaccgccucggccucuacaccuucgucaaccucgccaacuucgucaaguccuggaccaaccuccgccuccagacccucccccccguccagcucgcccacaaguacuucgagcucuuccccgaccagaaggacccccucuggcagaaccccugcgacgacaagcgccaccgcgacaucugguccaaggagaagaccugcgaccgccuccccaaguuccucgucaucggcccccagaagaccggcaccaccgcccucuaccucuuccucgucaugcaccccuccauccucuccaacucccccucccccaagaccuucgaggagguccaguucuucaaccgcaacaacuaccaccgcggcaucgacugguacauggacuucuuccccguccccuccaacgucaccaccgacuuccucuucgagaaguccgccaacuacuuccacuccgaggaggcccccaagcgcgccgccucccucguccccaaggccaagaucaucaccauccucaucgaccccuccgaccgcgccuacuccugguaccagcaccagcgcucccacgaggaccccgccgcccucaaguucuccuucuacgaggucaucuccgccggcccccgcgcccccuccgagcuccgcgcccuccagaagcgcugccucguccccggcugguacgccucccacaucgagcgcuggcucgucuacuucccccccuuccagcuccucaucaucgacggccagcagcuccgcaccgaccccgccaccgucauggacgagguccagaaguuccucggcguccucccccacuacaacuacuccgaggcccucaccuucgacucccacaagggcuucuggugccagcuccucgaggagggcaagaccaagugccucggcaaguccaagggccgcaaguacccccccauggacuccgacucccgcaccuuccucuccuccuacuaccgcgaccacaacgucgagcucuccaagcuccuccacaagcucggccagccccuccccuccuggcuccgccaggagcuccagaagguccgcuga

SEQ ID NO: 46512 - RNA, 2619 nt, Artificial Sequence
  derived and/or modified sequence opt2 from NDST4__Homo_sapiens__NP_072091
augaaccucaucgucaagcuccgccgcuccuuccgcacccucaucguccuccucgccaccuucugccucgucuccaucgucaucuccgccuacuuccucuacuccggcuacaagcaggagaugacccucaucgagaccaccgccgaggccgagugcaccgacaucaagauccuccccuaccgcuccauggagcucaagaccgucaagcccaucgacaccuccaagaccgaccccaccguccuccucuucgucgagucccaguacucccagcucggccaggacaucaucgccauccucgaguccucccgcuuccaguaccacauggucaucgcccccggcaagggcgacauccccccccucaccgacaacggcaagggcaaguacacccucgucaucuacgagaacauccucaaguacgucuccauggacuccuggaaccgcgagcuccucgagaaguacugcgucgaguacuccgucuccaucaucggcuuccacaaggccaacgagaacucccuccccuccacccagcucaagggcuucccccucaaccucuucaacaaccucgcccucaaggacugcuucgucaacccccaguccccccuccuccacaucaccaaggcccccaaggucgagaagggcccccuccccggcgaggacuggaccaucuuccaguacaaccacuccaccuaccagcccguccuccucaccgagcuccagaccgagaagucccucuccucccucuccuccaagacccucuucgccaccgucauccaggaccucggccuccacgacggcauccagcgcguccucuucggcaacaaccucaacuucuggcuccacaagcucaucuucaucgacgccaucuccuuccucuccggcaagcgccucacccucucccucgaccgcuacauccucgucgacaucgacgacaucuucgucggcaaggagggcacccgcaugaacgucaaggacgucaaggcccuccucgagacccagaaccuccuccgcacccaggucgccaacuucaccuucaaccucggcuucuccggcaaguucuaccacaccggcaccgaggaggaggacgagggcgacgaccuccuccuccgcuccgucgacgaguucuggugguucccccacauguggucccacaugcagccccaccucuuccacaacgaguccucccucgucgagcagaugauccucaacaaggaguucgcccucgagcacggcauccccaucaacaugggcuacgccgucgccccccaccacuccggcgucuaccccguccacauccagcucuacgccgccuggaagaaggucuggggcauccaggucaccuccaccgaggaguacccccaccucaagcccgcccgcuaccgcaagggcuucauccacaacuccaucaugguccucccccgccagaccugcggccucuucacccacaccaucuucuacaaggaguaccccggcggcccccaggagcucgacaaguccauccgcggcggcgagcucuuccucaccauccuccucaaccccaucuccaucuucaugacccaccucuccaacuacggcaacgaccgccucggccucuacaccuucgucaaccucgucaacuucguccaguccuggaccaaccucaagcuccagacccucccccccguccagcucgcccaccaguacuucgagcucuuccccgagcagaaggacccccucuggcagaaccccugcgacgacaagcgccacaaggacaucuggucccgcgagaagaccugcgaccaccuccccaaguuccucgucaucggcccccagaagaccggcaccaccgcccucuaccucuuccuccucaugcaccccuccaucaucuccaaccuccccucccccaagaccuucgaggagguccaguucuucaacggcaacaacuaccacaagggcaucgacugguacauggacuucuuccccacccccuccaacaccaccuccgacuuccucuucgagaaguccgccaacuacuuccacuccgaggaggccccccgccgcgccgccucccucguccccaaggccaagaucaucaccauccucaucgaccccuccgaccgcgccuacuccugguaccagcaccagcgcucccacgaggaccccgccgcccuccgcuucaacuucuacgaggucaucuccaccggccacugggcccccuccgaccucaagacccuccagcgccgcugccucguccccggcugguacgccguccacaucgagcgcuggcucaccuacuucgccaccucccagcuccucaucaucgacggccagcagcuccgcuccgaccccgccaccgucauggacgagguccagaaguuccucggcgucaccccccgcuacaacuacuccgaggcccucaccuucgacccccagaagggcuucuggugccagcuccucgagggcggcaagaccaagugccucggcaaguccaagggccgcaaguacccccccauggaccccgagucccgcaccuuccucuccaacuacuaccgcgaccacaacgucgagcucuccaagcuccuccaccgccucggccagccccuccccuccuggcuccgccaggagcuccagaagguccgcuga

SEQ ID NO: 46513 - RNA, 1068 nt, Artificial Sequence
  derived and/or modified sequence opt2 from NDUFA10__Homo_sapiens__NP_004535
auggcccuccgccuccucaagcucgccgccaccuccgccuccgcccgcgucgucgccgccggcgcccagcgcguccgcggcauccacuccuccguccagugcaagcuccgcuacggcauguggcacuuccuccucggcgacaaggccuccaagcgccucaccgagcgcucccgcgucaucaccgucgacggcaacaucugcaccggcaagggcaagcucgccaaggagaucgccgagaagcucggcuucaagcacuuccccgaggccggcauccacuaccccgacuccaccaccggcgacggcaagccccucgccaccgacuacaacggcaacugcucccucgagaaguucuacgacgacccccgcuccaacgacggcaacuccuaccgccuccaguccuggcucuacuccucccgccuccuccaguacuccgacgcccucgagcaccuccucaccaccggccagggcgucguccucgagcgcuccaucuucuccgacuucgucuuccucgaggccauguacaaccagggcuucauccgcaagcagugcgucgaccacuacaacgaggucaaguccgucaccaucugcgacuaccuccccccccaccucgucaucuacaucgacguccccguccccgagguccagcgccgcauccagaagaagggcgacccccacgagaugaagaucaccuccgccuaccuccaggacaucgagaacgccuacaagaagaccuuccuccccgagauguccgagaagugcgagguccuccaguacuccgcccgcgaggcccaggacuccaagaaggucgucgaggacaucgaguaccucaaguucgacaagggccccuggcucaagcaggacaaccgcacccucuaccaccuccgccuccucguccaggacaaguucgagguccucaacuacaccuccauccccaucuuccuccccgaggucaccaucggcgcccaccagaccgaccgcguccuccaccaguuccgcgagcuccccggccgcaaguacucccccggcuacaacaccgaggucggcgacaaguggaucuggcucaaguga

SEQ ID NO: 46514 - RNA, 687 nt, Artificial Sequence
  derived and/or modified sequence opt2 from NDUFA11__Homo_sapiens__NP_001180304
auggcccccaaggucuuccgccaguacugggacauccccgacggcaccgacugccaccgcaaggccuacuccaccaccuccaucgccuccgucgccggccucaccgccgccgccuaccgcgucacccucaacccccccggcaccuuccucgagggcgucgccaaggucggccaguacaccuucaccgccgccgccgucggcgccgucuucggccucaccaccugcaucuccgcccacguccgcgagaagcccgacgacccccucaacuacuuccucggcggcugcgccggcggccucacccucggcgcccgcaagaccggcucccacugcgucguccaggccggccucaagcuccucgccuccuccuccccccacaccuccgccucccaguccgccggcaucaucggcaugucccacugcguccagcgcuucuggguccccuccuccuccgccugccucgagguccucuccggcgaguccaccgacguccacgccugcuccuccacccgcggcgccugcaacuccuccggcucccgcccccuccccgagcucggcgcccgcgccuccggcucccuccgcaagggcggccacacccaccccgccccccgcggcgccggcgcccucacccccguccaggcccucaucgagucccuccucaacacccucggcuccaacccccgcaccuga

SEQ ID NO: 46515 - RNA, 192 nt, Artificial Sequence
  derived and/or modified sequence opt2 from NDUFA12__Homo_sapiens__NP_001245267
auggagcucguccagguccucaagcgcggccuccagcagaucaccggccacggcggccuccgcggcuaccuccgcgucuucuuccgcaccaacgacgccaaggucggcacccucgucggcgaggacaaguacggcaacaaguacuacgaggacaacaagcaguucuucggcaucgucggcuucaccgucuga

SEQ ID NO: 46516 - RNA, 435 nt, Artificial Sequence
  derived and/or modified sequence opt2 from NDUFA13__Homo_sapiens__NP_057049
auggccgccuccaaggucaagcaggacaugcccccccccggcggcuacggccccaucgacuacaagcgcaaccucccccgccgcggccucuccggcuacuccaugcucgccaucggcaucggcacccucaucuacggccacugguccaucaugaaguggaaccgcgagcgccgccgccuccagaucgaggacuucgaggcccgcaucgcccuccucccccuccuccaggccgagaccgaccgccgcacccuccagaugcuccgcgagaaccucgaggaggaggccaucaucaugaaggacguccccgacuggaaggucggcgaguccgucuuccacaccacccgcuggguccccccccucaucggcgagcucuacggccuccgcaccaccgaggaggcccuccacgccucccacggcuucaugugguacaccuga

SEQ ID NO: 46517 - RNA, 213 nt, Artificial Sequence
  derived and/or modified sequence opt2 from NDUFA1__Homo_sapiens__NP_004532
augugguucgagauccuccccggccucuccgucaugggcgucugccuccucauccccggccucgccaccgccuacauccaccgcuucaccaacggcggcaaggagaagcgcgucgcccacuucggcuaccacuggucccucauggagcgcgaccgccgcaucuccggcgucgaccgcuacuacgucuccaagggccucgagaacaucgacuga

SEQ ID NO: 46518 - RNA, 231 nt, Artificial Sequence
  derived and/or modified sequence opt2 from NDUFA2__Homo_sapiens__NP_001171941
auggccgccgccgccgccucccgcggcgucggcgccaagcucggccuccgcgagauccgcauccaccucugccagcgcucccccggcucccagggcguccgcgacuucaucgagaagcgcuacgucgagcucaagaaggccaaccccgaccuccccauccucauccgcgagugcuccgacguccagcccaagcucugggcccgcuacgccucccgcguccagaacuccuga

SEQ ID NO: 46519 - RNA, 351 nt, Artificial Sequence
  derived and/or modified sequence opt2 from NDUFA5__Homo_sapiens__NP_001269349
augcccuaccgcgucggccagaccaccggccucgucggccucgccgucugcaacaccccccacgagcgccuccgcauccucuacaccaagauccucgacguccucgaggagauccccaagaacgccgccuaccgcaaguacaccgagcagaucaccaacgagaagcucgccauggucaaggccgagcccgacgucaagaagcucgaggaccagcuccagggcggccagcucgaggaggucauccuccaggccgagcacgagcucaaccucgcccgcaagaugcgcgaguggaagcucugggagccccucgucgaggagccccccgccgaccaguggaaguggcccaucuga

SEQ ID NO: 46520 - RNA, 465 nt, Artificial Sequence
  derived and/or modified sequence opt2 from NDUFA6__Homo_sapiens__NP_002481
augggcaaggacauccgcccccgcuccgcccgcgccgccugcaagggcgucggccucugguccggcugcuucggcaagauggccggcuccggcguccgccaggccaccuccaccgccuccaccuucgucaagcccaucuucucccgcgacaugaacgaggccaagcgccgcguccgcgagcucuaccgcgccugguaccgcgagguccccaacaccguccaccaguuccagcucgacaucaccgucaagaugggccgcgacaagguccgcgagauguucaugaagaacgcccacgucaccgacccccgcgucgucgaccuccucgucaucaagggcaagaucgagcucgaggagaccaucaaggucuggaagcagcgcacccacgucaugcgcuucuuccacgagaccgaggccccccgccccaaggacuuccucuccaaguucuacgucggccacgaccccuga

SEQ ID NO: 46521 - RNA, 1134 nt, Artificial Sequence
  derived and/or modified sequence opt2 from NDUFA9__Homo_sapiens__NP_004993
auggccgccgccgcccagucccgcgucguccgcguccucuccaugucccgcuccgccaucaccgccaucgccaccuccgucugccacggcccccccugccgccagcuccaccacgcccucaugccccacggcaagggcggccgcuccuccgucuccggcaucgucgccaccgucuucggcgccaccggcuuccucggccgcuacgucgucaaccaccucggccgcaugggcucccaggucaucauccccuaccgcugcgacaaguacgacaucaugcaccuccgccccaugggcgaccucggccagcuccucuuccucgagugggacgcccgcgacaaggacuccauccgccgcgucguccagcacuccaacgucgucaucaaccucaucggccgcgacugggagaccaagaacuucgacuucgaggacgucuucgucaagaucccccaggccaucgcccagcucuccaaggaggccggcgucgagaaguucauccacgucucccaccucaacgccaacaucaaguccuccucccgcuaccuccgcaacaaggccgucggcgagaaggucguccgcgacgccuuccccgaggccaucaucgucaagcccuccgacaucuucggccgcgaggaccgcuuccucaacuccuucgccuccaugcaccgcuucggccccaucccccucggcucccucggcuggaagaccgucaagcagcccgucuacgucgucgacgucuccaagggcaucgucaacgccgucaaggaccccgacgccaacggcaaguccuucgccuucgucggccccucccgcuaccuccucuuccaccucgucaaguacaucuucgccgucgcccaccgccucuuccuccccuucccccucccccucuucgccuaccgcugggucgcccgcgucuucgagaucucccccuucgagcccuggaucacccgcgacaaggucgagcgcaugcacaucaccgacaugaagcucccccaccuccccggccucgaggaccucggcauccaggccaccccccucgagcucaaggccaucgagguccuccgccgccaccgcaccuaccgcuggcucuccgccgagaucgaggacgucaagcccgccaagaccgucaacaucuga

SEQ ID NO: 46522 - RNA, 471 nt, Artificial Sequence
  derived and/or modified sequence opt2 from NDUFAB1__Homo_sapiens__NP_004994
auggccucccgcguccucuccgccuacgucucccgccuccccgccgccuucgccccccucccccgcguccgcaugcucgccgucgcccgcccccucuccaccgcccucugcuccgccggcacccagacccgccucggcacccuccagcccgcccucguccucgcccagguccccggccgcgucacccagcucugccgccaguacuccgacaugcccccccucacccucgagggcauccaggaccgcguccucuacguccucaagcucuacgacaagaucgaccccgagaagcucuccgucaacucccacuucaugaaggaccucggccucgacucccucgaccaggucgagaucaucauggccauggaggacgaguucggcuucgagauccccgacaucgacgccgagaagcucaugugcccccaggagaucgucgacuacaucgccgacaagaaggacgucuacgaguga

SEQ ID NO: 46523 - RNA, 984 nt, Artificial Sequence
  derived and/or modified sequence opt2 from NDUFAF1__Homo_sapiens__NP_057097
auggcccucguccacaagcuccuccgcggcaccuacuuccuccgcaaguucuccaagcccaccuccgcccucuaccccuuccucggcauccgcuucgccgaguacuccuccucccuccagaagcccgucgccucccccggcaaggccuccucccagcgcaagaccgagggcgaccuccagggcgaccaccagaaggaggucgcccucgacaucaccuccuccgaggagaagcccgacgucuccuucgacaaggccauccgcgacgaggccaucuaccacuuccgccuccucaaggacgagaucgucgaccacuggcgcggccccgagggccacccccuccacgagguccuccucgagcaggccaaggucgucuggcaguuccgcggcaaggaggaccucgacaaguggaccgucaccuccgacaagaccaucggcggccgcuccgaggucuuccucaagaugggcaagaacaaccaguccgcccuccucuacggcacccucuccuccgaggccccccaggacggcgaguccacccgcuccggcuacugcgccaugaucucccgcaucccccgcggcgccuucgagcgcaagauguccuacgacuggucccaguucaacacccucuaccuccgcguccgcggcgacggccgccccuggauggucaacaucaaggaggacaccgacuucuuccagcgcaccaaccagauguacuccuacuucauguucacccgcggcggccccuacuggcaggaggucaagauccccuucuccaaguucuucuucuccaaccgcggccgcauccgcgacguccagcacgagcucccccucgacaagaucuccuccaucggcuucacccucgccgacaaggucgacggccccuucuuccucgagaucgacuucaucggcgucuucaccgaccccgcccacaccgaggaguucgccuacgagaacucccccgagcucaacccccgccucuucaaguga

SEQ ID NO: 46524 - RNA, 510 nt, Artificial Sequence
  derived and/or modified sequence opt2 from NDUFAF2__Homo_sapiens__NP_777549
augggcuggucccaggaccucuuccgcgcccucuggcgcucccucucccgcgaggucaaggagcacgucggcaccgaccaguucggcaacaaguacuacuacaucccccaguacaagaacuggcgcggccagaccauccgcgagaagcgcaucgucgaggccgccaacaagaaggaggucgacuacgaggccggcgacauccccaccgagugggaggccuggauccgccgcacccgcaagaccccccccaccauggaggagauccucaagaacgagaagcaccgcgaggagaucaagaucaagucccaggacuucuacgagaaggagaagcuccucuccaaggagaccuccgaggagcuccuccccccccccguccagacccagaucaagggccacgccuccgcccccuacuucggcaaggaggagcccuccgucgcccccuccuccaccggcaagaccuuccagcccggcuccuggaugccccgcgacggcaagucccacaaccaguga

SEQ ID NO: 46525 - RNA, 555 nt, Artificial Sequence
  derived and/or modified sequence opt2 from NDUFAF3__Homo_sapiens__NP_951032
auggccaccgcccucgcccuccgcucccucuaccgcgcccgccccucccuccgcugcccccccgucgagcuccccugggccccccgccgcggccaccgccucucccccgccgacgacgagcucuaccagcgcacccgcaucucccuccuccagcgcgaggccgcccaggccauguacaucgacuccuacaacucccgcggcuucaugaucaacggcaaccgcguccucggccccugcgcccuccucccccacuccgucguccaguggaacgucggcucccaccaggacaucaccgaggacuccuucucccucuucuggcuccucgagccccgcaucgagaucgucgucgucggcaccggcgaccgcaccgagcgccuccagucccagguccuccaggccaugcgccagcgcggcaucgccgucgagguccaggacacccccaacgccugcgccaccuucaacuuccucugccacgagggccgcgucaccggcgccgcccucauccccccccccggcggcaccucccucaccucccucggccaggccgcccaguga

SEQ ID NO: 46526 - RNA, 528 nt, Artificial Sequence
  derived and/or modified sequence opt2 from NDUFAF4__Homo_sapiens__NP_054884
augggcgcccucgucauccgcggcauccgcaacuucaaccucgagaaccgcgccgagcgcgagaucuccaagaugaagcccuccgucgccccccgccaccccuccaccaacucccuccuccgcgagcagaucucccucuaccccgaggucaagggcgagaucgcccgcaaggacgagaagcuccucuccuuccucaaggacgucuacgucgacuccaaggaccccgucuccucccuccaggucaaggccgccgagaccugccaggagcccaaggaguuccgccuccccaaggaccaccacuucgacaugaucaacaucaaguccauccccaagggcaagaucuccaucgucgaggcccucacccuccucaacaaccacaagcucuuccccgagaccuggaccgccgagaagaucaugcaggaguaccagcucgagcagaaggacgucaacucccuccucaaguacuucgucaccuucgaggucgagaucuucccccccgaggacaagaaggccauccgcuccaaguga

SEQ ID NO: 46527 - RNA, 954 nt, Artificial Sequence
  derived and/or modified sequence opt2 from NDUFAF5__Homo_sapiens__NP_001034464
augcuccgccccgccggccucuggcgccucugccgccgccccugggccgcccgcguccccgccgagaaccucggccgccgcgaggucaccuccggcgucuccccccgcggcuccaccuccccccgcacccucaacaucuucgaccgcgaccucaagcgcaagcagaagaacugggccgcccgccagcccgagcccaccaaguucgacuaccucaaggaggaggucggcucccgcaucgccgaccgcgucuacgacaucccccgcaacuucccccucgcccucgaccucggcugcggccgcggcuacaucgcccaguaccucaacaagcuccagcucuuccacugccgcaagcuccucgaguccuucuccaagcucacccuccagaagaugcucugccuccacugggucaacgaccucccccgcgcccucgagcagauccacuacauccucaagcccgacggcgucuucaucggcgccauguucggcggcgacacccucuacgagcuccgcugcucccuccagcucgccgagaccgagcgcgagggcggcuucuccccccacaucucccccuucaccgccgucaacgaccucggccaccuccucggccgcgccggcuucaacacccucaccgucgacaccgacgagauccaggucaacuaccccggcauguucgagcucauggaggaccuccagggcaugggcgaguccaacugcgccuggaaccgcaaggcccuccuccaccgcgacaccaugcucgccgccgccgccgucuaccgcgagauguaccgcaacgaggacggcuccguccccgccaccuaccagaucuacuacaugaucggcuggaaguaccacgagucccaggcccgccccgccgagcgcggcuccgccaccgucuccuucggcgagcucggcaagaucaacaaccucaugccccccggcaagaagucccaguga

SEQ ID NO: 46528 - RNA, 1002 nt, Artificial Sequence
  derived and/or modified sequence opt2 from NDUFAF6__Homo_sapiens__NP_689629
auggccgccuccgcccacggcuccgucuggggcccccuccgccucggcauccccggccucugcugccgccgccccccccucggccucuacgcccgcaugcgccgccuccccggccccgaggucuccggccgcuccgucgccgccgccuccggccccggcgccuggggcaccgaccacuacugccucgagcuccuccgcaagcgcgacuacgagggcuaccucugcucccuccuccuccccgccgagucccgcuccuccgucuucgcccuccgcgccuucaacgucgagcucgcccaggucaaggacuccgucuccgagaagaccaucggccucaugcgcaugcaguucuggaagaagaccgucgaggacaucuacugcgacaaccccccccaccagcccgucgccaucgagcucuggaaggccgucaagcgccacaaccucaccaagcgcuggcucaugaagaucgucgacgagcgcgagaagaaccucgacgacaaggccuaccgcaacaucaaggagcucgagaacuacgccgagaacacccaguccucccuccucuaccucacccucgagauccucggcaucaaggaccuccacgccgaccacgccgccucccacaucggcaaggcccagggcaucgucaccugccuccgcgccacccccuaccacggcucccgccgcaaggucuuccuccccauggacaucugcaugcuccacggcgucucccaggaggacuuccuccgccgcaaccaggacaagaacguccgcgacgucaucuacgacaucgccucccaggcccaccuccaccucaagcacgcccgcuccuuccacaagaccguccccgucaaggccuuccccgccuuccuccagaccgucucccucgaggacuuccucaagaagauccagcgcgucgacuucgacaucuuccaccccucccuccagcagaagaacacccuccucccccucuaccucuacauccaguccuggcgcaagaccuacuga

SEQ ID NO: 46529 - RNA, 519 nt, Artificial Sequence
  derived and/or modified sequence opt2 from NDUFB10__Homo_sapiens__NP_004539
augcccgacuccugggacaaggacgucuaccccgagcccccccgccgcacccccguccagcccaaccccaucgucuacaugaugaaggccuucgaccucaucgucgaccgccccgucacccucguccgcgaguucaucgagcgccagcacgccaagaaccgcuacuacuacuaccaccgccaguaccgccgcguccccgacaucaccgagugcaaggaggaggacaucaugugcauguacgaggccgagaugcaguggaagcgcgacuacaaggucgaccaggagaucaucaacaucaugcaggaccgccucaaggccugccagcagcgcgagggccagaacuaccagcagaacugcaucaaggaggucgagcaguucacccaggucgccaaggccuaccaggaccgcuaccaggaccucggcgccuacuccuccgcccgcaagugccucgccaagcagcgccagcgcaugcuccaggagcgcaaggccgccaaggaggccgccgccgccaccuccuga

SEQ ID NO: 46530 - RNA, 462 nt, Artificial Sequence
  derived and/or modified sequence opt2 from NDUFB11__Homo_sapiens__NP_001129470
auggccgccggccucuucggccucuccgcccgccgccuccucgccgccgccgccacccgcggccuccccgccgcccgcguccgcugggaguccuccuucucccgcaccgucgucgcccccuccgccgucgccggcaagcgcccccccgagcccaccacccccuggcaggaggaccccgagcccgaggacgagaaccucuacgagaagaaccccgacucccacggcuacgacaaggaccccguccucgacgucuggaacaugcgccucgucuucuucuucggcgucuccaucauccucguccucggcuccaccuucgucgccuaccuccccgacuaccgcaugaaggaguggucccgccgcgaggccgagcgccucgucaaguaccgcgaggccaacggccuccccaucauggaguccaacugcuucgaccccuccaagauccagcuccccgaggacgaguga

SEQ ID NO: 46531 - RNA, 318 nt, Artificial Sequence
  derived and/or modified sequence opt2 from NDUFB2__Homo_sapiens__NP_004537
auguccgcccucacccgccucgccuccuucgcccgcgucggcggccgccucuuccgcuccggcugcgcccgcaccgccggcgacggcggcguccgccacgccggcggcggcguccacaucgagccccgcuaccgccaguucccccagcucacccgcucccaggucuuccaguccgaguucuucuccggccucaugugguucuggauccucuggcgcuucuggcacgacuccgaggagguccucggccacuuccccuaccccgaccccucccaguggaccgacgaggagcucggcaucccccccgacgacgaggacuga

SEQ ID NO: 46532 - RNA, 297 nt, Artificial Sequence
  derived and/or modified sequence opt2 from NDUFB3__Homo_sapiens__NP_001244031
auggcccacgagcacggccacgagcacggccaccacaagauggagcuccccgacuaccgccaguggaagaucgagggcaccccccucgagaccauccagaagaagcucgccgccaagggccuccgcgaccccuggggccgcaacgaggccuggcgcuacaugggcggcuucgccaaguccgucuccuucuccgacgucuucuucaagggcuucaaguggggcuucgccgccuucgucgucgccgucggcgccgaguacuaccucgagucccucaacaaggacaagaagcaccacuga

SEQ ID NO: 46533 - RNA, 363 nt, Artificial Sequence
  derived and/or modified sequence opt2 from NDUFB4__Homo_sapiens__NP_001161803
auguccuuccccaaguacaagcccuccucccuccgcacccuccccgagacccucgaccccgccgaguacaacaucucccccgagacccgccgcgcccaggccgagcgccucgccauccgcgcccagcucaagcgcgaguaccuccuccaguacaacgaccccaaccgccgcggccucaucgagaaccccgcccuccuccgcugggccuacgcccgcaccaucaacgucuaccccaacuuccgccccacccccaagaacucccucaugggcgcccucugcggcuucggcccccucaucuucaucuacuacaucaucaagaccgagcgcgucuccauccagacccgcugccucgucuucgaguga

SEQ ID NO: 46534 - RNA, 414 nt, Artificial Sequence
  derived and/or modified sequence opt2 from NDUFB5__Homo_sapiens__NP_001186886
auggccgccaugucccuccuccgccgcgucuccgucaccgccgucgccgcccucuccggccgcccccucggcacccgccucggcuucggcggcuuccucacccgcggcuuccccaaggccgccggccaggccgagcucgccgagauccccgagggcuacguccccgagcacugggaguacuacaagcaccccaucucccgcuggaucgcccgcaacuucuacgacucccccgagaagaucuacgagcgcaccauggccguccuccagaucgaggccgagaaggccgagcuccgcgucaaggagcucgagguccgcaagcucaugcacguccgcggcgacggccccugguacuacuacgagaccaucgacaaggagcucaucgaccacucccccaaggccacccccgacaacuga

SEQ ID NO: 46535 - RNA, 387 nt, Artificial Sequence
  derived and/or modified sequence opt2 from NDUFB6__Homo_sapiens__NP_002484
augaccggcuacacccccgacgagaagcuccgccuccagcagcuccgcgagcuccgccgccgcuggcucaaggaccaggagcucuccccccgcgagcccguccuccccccccagaagaugggccccauggagaaguucuggaacaaguuccucgagaacaagucccccuggcgcaagaugguccacggcgucuacaagaaguccaucuucgucuucacccacguccucguccccgucuggaucauccacuacuacaugaaguaccacgucuccgagaagcccuacggcaucgucgagaagaagucccgcaucuuccccggcgacaccauccucgagaccggcgaggucaucccccccaugaaggaguuccccgaccagcaccacuga

SEQ ID NO: 46536 - RNA, 519 nt, Artificial Sequence
  derived and/or modified sequence opt2 from NDUFB8__Homo_sapiens__NP_001271296
auggccgucgcccgcgccggcguccucggcguccaguggcuccagcgcgccucccgcaacgucaugccccucggcgcccgcaccgccucccacaugaccaaggacauguuccccggccccuacccccgcacccccgaggagcgcgccgccgccgccaagaaguacaacaugcgcgucgaggacuacgagcccuaccccgacgacggcaugggcuacggcgacuaccccaagcuccccgaccgcucccagcacgagcgcgaccccugguacuccugggaccagcccggccuccgccucaacuggggcgagcccaugcacuggcaccucgacauguacaaccgcaaccgcgucgacaccucccccacccccgucuccuggcacgucaugugcaugcagcucuucggcuuccucgccuucaugaucuucaugugcugggucggcgacgucuaccccgucuaccagcccgucugccgccaccacuucuccuacaaccucggcuuccucuccgcccucggcuga

SEQ ID NO: 46537 - RNA, 540 nt, Artificial Sequence
  derived and/or modified sequence opt2 from NDUFB9__Homo_sapiens__NP_004996
auggccuuccucgccuccggccccuaccucacccaccagcagaagguccuccgccucuacaagcgcgcccuccgccaccucgaguccuggugcguccagcgcgacaaguaccgcuacuucgccugccucaugcgcgcccgcuucgaggagcacaagaacgagaaggacauggccaaggccacccagcuccucaaggaggccgaggaggaguucugguaccgccagcacccccagcccuacaucuuccccgacucccccggcggcaccuccuacgagcgcuacgacugcuacaagguccccgaguggugccucgacgacuggcaccccuccgagaaggccauguaccccgacuacuucgccaagcgcgagcaguggaagaagcuccgccgcgaguccugggagcgcgaggucaagcagcuccaggaggagaccccccccggcggcccccucaccgaggcccucccccccgcccgcaaggagggcgaccuccccccccucuggugguacaucgucacccgcccccgcgagcgccccauguga

SEQ ID NO: 46538 - RNA, 267 nt, Artificial Sequence
  derived and/or modified sequence opt2 from NDUFC2__Homo_sapiens__NP_001190983
augaucgcccgccgcaaccccgagccccuccgcuuccuccccgacgaggcccgcucccuccccccccccaagcucaccgacccccgccuccucuacaucggcuuccucggcuacugcuccggccucaucgacaaccucauccgccgccgccccaucgccaccgccggccuccaccgccagcuccucuacaucaccgccuucuucuucgccggcuacuaccucgucaagcucgaggccuacgccaaccucuacgucgacacccucuga

SEQ ID NO: 46539 - RNA, 2076 nt, Artificial Sequence
  derived and/or modified sequence opt2 from NDUFS1__Homo_sapiens__NP_001186910
augcuccgcauccccguccgcaaggcccucgucggccucuccaagucccccaagggcugcguccgcaccaccgccaccgccgccuccaaccucaucgaggucuucgucgacggccaguccgucauggucgagcccggcaccaccguccuccaggucgucgccgccugcgccaugcccgucaugaagggcuggaacauccucaccaacuccgagaaguccaagaaggcccgcgagggcgucauggaguuccuccucgccaaccacccccucgacugccccaucugcgaccagggcggcgagugcgaccuccaggaccaguccaugauguucggcaacgaccgcucccgcuuccucgagggcaagcgcgccgucgaggacaagaacaucggcccccucgucaagaccaucaugacccgcugcauccagugcacccgcugcauccgcuucgccuccgagaucgccggcgucgacgaccucggcaccaccggccgcggcaacgacaugcaggucggcaccuacaucgagaagauguucauguccgagcucuccggcaacaucaucgacaucugccccgucggcgcccucaccuccaagcccuacgccuucaccgcccgccccugggagacccgcaagaccgaguccaucgacgucauggacgccgucggcuccaacaucgucgucuccacccgcaccggcgaggucaugcgcauccucccccgcaugcacgaggacaucaacgaggaguggaucuccgacaagacccgcuucgccuacgacggccucaagcgccagcgccucaccgagcccaugguccgcaacgagaagggccuccucaccuacaccuccugggaggacgcccucucccgcgucgccggcaugcuccaguccuuccagggcaaggacgucgccgccaucgccggcggccucgucgacgccgaggcccucgucgcccucaaggaccuccucaaccgcgucgacuccgacacccucugcaccgaggaggucuuccccaccgccggcgccggcaccgaccuccgcuccaacuaccuccucaacaccaccaucgccggcgucgaggaggccgacgucguccuccucgucggcaccaacccccgcuucgaggccccccucuucaacgcccgcauccgcaaguccuggcuccacaacgaccucaaggucgcccucaucggcucccccgucgaccucaccuacaccuacgaccaccucggcgacucccccaagauccuccaggacaucgccuccggcucccaccccuucucccagguccucaaggaggccaagaagcccauggucguccucggcuccuccgcccuccagcgcaacgacggcgccgccauccucgccgccgucuccuccaucgcccagaagauccgcaugaccuccggcgucaccggcgacuggaaggucaugaacauccuccaccgcaucgccucccaggucgccgcccucgaccucggcuacaagcccggcgucgaggccauccgcaagaacccccccaagguccucuuccuccucggcgccgacggcggcugcaucacccgccaggaccuccccaaggacugcuucaucaucuaccagggccaccacggcgacgucggcgcccccaucgccgacgucauccuccccggcgccgccuacaccgagaaguccgccaccuacgucaacaccgagggccgcgcccagcagaccaaggucgccgucaccccccccggccucgcccgcgaggacuggaagaucauccgcgcccucuccgagaucgccggcaugacccuccccuacgacacccucgaccagguccgcaaccgccucgaggaggucucccccaaccucguccgcuacgacgacaucgagggcgccaacuacuuccagcaggccaacgagcucuccaagcucgucaaccagcagcuccucgccgacccccucguccccccccagcucaccaucaaggacuucuacaugaccgacuccaucucccgcgccucccagaccauggccaagugcgucaaggccgucaccgagggcgcccaggccgucgaggagcccuccaucugcuga

SEQ ID NO: 46540 - RNA, 1374 nt, Artificial Sequence
  derived and/or modified sequence opt2 from NDUFS2__Homo_sapiens__NP_001159631
auggccgcccuccgcgcccucugcggcuuccgcggcgucgccgcccagguccuccgccccggcgccggcguccgccuccccauccagcccucccgcggcguccgccaguggcagcccgacgucgagugggcccagcaguucggcggcgccgucauguaccccuccaaggagaccgcccacuggaagcccccccccuggaacgacgucgacccccccaaggacaccaucgucaagaacaucacccucaacuucggcccccagcaccccgccgcccacggcguccuccgccucgucauggagcucuccggcgagaugguccgcaagugcgacccccacaucggccuccuccaccgcggcaccgagaagcucaucgaguacaagaccuaccuccaggcccuccccuacuucgaccgccucgacuacgucuccaugaugugcaacgagcaggccuacucccucgccgucgagaagcuccucaacauccgcccccccccccgcgcccaguggauccgcguccucuucggcgagaucacccgccuccucaaccacaucauggccgucaccacccacgcccucgaccucggcgccaugacccccuucuucuggcucuucgaggagcgcgagaagauguucgaguucuacgagcgcgucuccggcgcccgcaugcacgccgccuacauccgccccggcggcguccaccaggaccucccccucggccucauggacgacaucuaccaguucuccaagaacuucucccuccgccucgacgagcucgaggagcuccucaccaacaaccgcaucuggcgcaaccgcaccaucgacaucggcgucgucaccgccgaggaggcccucaacuacggcuucuccggcgucaugcuccgcggcuccggcauccagugggaccuccgcaagacccagcccuacgacgucuacgaccaggucgaguucgacguccccgucggcucccgcggcgacugcuacgaccgcuaccucugccgcgucgaggagaugcgccagucccuccgcaucaucgcccagugccucaacaagaugccccccggcgagaucaaggucgacgacgccaaggucuccccccccaagcgcgccgagaugaagaccuccauggagucccucauccaccacuucaagcucuacaccgagggcuaccaggucccccccggcgccaccuacaccgccaucgaggcccccaagggcgaguucggcgucuaccucgucuccgacggcuccucccgccccuaccgcugcaagaucaaggcccccggcuucgcccaccucgccggccucgacaagauguccaagggccacaugcucgccgacgucgucgccaucaucggcacccgccccaucgucuga

SEQ ID NO: 46541 - RNA, 795 nt, Artificial Sequence
  derived and/or modified sequence opt2 from NDUFS3__Homo_sapiens__NP_004542
auggccgccgccgccgucgcccgccucugguggcgcggcauccucggcgccuccgcccucacccgcggcaccggccgccccuccguccuccuccuccccguccgccgcgaguccgccggcgccgacacccgccccaccguccgcccccgcaacgacgucgcccacaagcagcucuccgccuucggcgaguacgucgccgagauccuccccaaguacguccagcagguccaggucuccugcuucaacgagcucgaggucugcauccaccccgacggcgucauccccguccucaccuuccuccgcgaccacaccaacgcccaguucaagucccucgucgaccucaccgccgucgacguccccacccgccagaaccgcuucgagaucgucuacaaccuccucucccuccgcuucaacucccgcauccgcgucaagaccuacaccgacgagcucacccccaucgaguccgccgucuccgucuucaaggccgccaacugguacgagcgcgagaucugggacauguucggcgucuucuucgccaaccaccccgaccuccgccgcauccucaccgacuacggcuucgagggccaccccuuccgcaaggacuucccccucuccggcuacgucgagcuccgcuacgacgacgaggucaagcgcgucgucgccgagcccgucgagcucgcccaggaguuccgcaaguucgaccucaacucccccugggaggccuuccccgucuaccgccagccccccgagucccucaagcucgaggccggcgacaagaagcccgacgccaaguga

SEQ ID NO: 46542 - RNA, 528 nt, Artificial Sequence
  derived and/or modified sequence opt2 from NDUFS4__Homo_sapiens__NP_002486
auggccgccgucuccauguccgucguccuccgccagacccucuggcgccgccgcgccgucgccgucgccgcccucuccgucucccgcguccccacccgcucccuccgcaccuccaccuggcgccucgcccaggaccagacccaggacacccagcucaucaccgucgacgagaagcucgacaucaccacccucaccggcguccccgaggagcacaucaagacccgcaagguccgcaucuucguccccgcccgcaacaacaugcaguccggcgucaacaacaccaagaaguggaagauggaguucgacacccgcgagcgcugggagaacccccucaugggcugggccuccaccgccgacccccucuccaacaugguccucaccuucuccaccaaggaggacgccgucuccuucgccgagaagaacggcugguccuacgacaucgaggagcgcaagguccccaagcccaaguccaaguccuacggcgccaacuucuccuggaacaagcgcacccgcgucuccaccaaguga

SEQ ID NO: 46543 - RNA, 375 nt, Artificial Sequence
  derived and/or modified sequence opt2 from NDUFS6__Homo_sapiens__NP_004544
auggccgccgccaugaccuucugccgccuccucaaccgcugcggcgaggccgcccgcucccucccccucggcgcccgcugcuucggcguccgcgucucccccaccggcgagaaggucacccacaccggccaggucuacgacgacaaggacuaccgccgcauccgcuucgucggccgccagaaggaggucaacgagaacuucgccaucgaccucaucgccgagcagcccgucuccgaggucgagacccgcgucaucgccugcgacggcggcggcggcgcccucggccaccccaaggucuacaucaaccucgacaaggagaccaagaccggcaccugcggcuacugcggccuccaguuccgccagcaccaccacuga

SEQ ID NO: 46544 - RNA, 642 nt, Artificial Sequence
  derived and/or modified sequence opt2 from NDUFS7__Homo_sapiens__NP_077718
auggccguccucuccgcccccggccuccgcggcuuccgcauccucggccuccgcuccuccgucggccccgccguccaggcccgcggcguccaccaguccgucgccaccgacggccccuccuccacccagcccgcccuccccaaggcccgcgccgucgcccccaagcccuccucccgcggcgaguacgucgucgccaagcucgacgaccucgucaacugggcccgccgcuccucccucuggcccaugaccuucggccucgccugcugcgccgucgagaugaugcacauggccgccccccgcuacgacauggaccgcuucggcgucgucuuccgcgccuccccccgccaguccgacgucaugaucgucgccggcacccucaccaacaagauggcccccgcccuccgcaaggucuacgaccagaugcccgagccccgcuacgucgucuccaugggcuccugcgccaacggcggcggcuacuaccacuacuccuacuccgucguccgcggcugcgaccgcaucguccccgucgacaucuacauccccggcugcccccccaccgccgaggcccuccucuacggcauccuccagcuccagcgcaagaucaagcgcgagcgccgccuccagaucugguaccgccgcuga

SEQ ID NO: 46545 - RNA, 633 nt, Artificial Sequence
  derived and/or modified sequence opt2 from NDUFS8__Homo_sapiens__NP_002487
augcgcugccucaccacccccaugcuccuccgcgcccucgcccaggccgcccgcgccggcccccccggcggccgcucccuccacuccuccgccgucgccgccaccuacaaguacgucaacaugcaggaccccgagauggacaugaaguccgucaccgaccgcgccgcccgcacccuccucuggaccgagcucuuccgcggccucggcaugacccucuccuaccucuuccgcgagcccgccaccaucaacuaccccuucgagaagggcccccucuccccccgcuuccgcggcgagcacgcccuccgccgcuaccccuccggcgaggagcgcugcaucgccugcaagcucugcgaggccaucugccccgcccaggccaucaccaucgaggccgagccccgcgccgacggcucccgccgcaccacccgcuacgacaucgacaugaccaagugcaucuacugcggcuucugccaggaggccugccccgucgacgccaucgucgagggccccaacuucgaguucuccaccgagacccacgaggagcuccucuacaacaaggagaagcuccucaacaacggcgacaagugggaggccgagaucgccgccaacauccaggccgacuaccucuaccgcuga

SEQ ID NO: 46546 - RNA, 1368 nt, Artificial Sequence
  derived and/or modified sequence opt2 from NDUFV1__Homo_sapiens__NP_001159574
augcucgccacccgccgccuccucggcuggucccuccccgcccgcaccgcccccaagaagaccuccuucggcucccucaaggacgaggaccgcaucuucaccaaccucuacggccgccacgacuggcgccucaagggcucccucucccgcggcgacugguacaagaccaaggagauccuccucaagggccccgacuggauccucggcgagaucaagaccuccggccuccgcggccgcggcggcgccggcuuccccaccggccucaagugguccuucaugaacaagcccuccgacggccgccccaaguaccucgucgucaacgccgacgagggcgagcccggcaccugcaaggaccgcgagauccuccgccacgacccccacaagcuccucgagggcugccucgucggcggccgcgccaugggcgcccgcgccgccuacaucuacauccgcggcgaguucuacaacgaggccuccaaccuccaggucgccauccgcgaggccuacgaggccggccucaucggcaagaacgccugcggcuccggcuacgacuucgacgucuucgucguccgcggcgccggcgccuacaucugcggcgaggagaccgcccucaucgaguccaucgagggcaagcagggcaagccccgccucaagccccccuuccccgccgacgucggcgucuucggcugccccaccaccgucgccaacgucgagaccgucgccgucucccccaccaucugccgccgcggcggcaccugguucgccggcuucggccgcgagcgcaacuccggcaccaagcucuucaacaucuccggccacgucaaccaccccugcaccgucgaggaggagauguccgucccccucaaggagcucaucgagaagcacgccggcggcgucaccggcggcugggacaaccuccucgccgucauccccggcggcuccuccaccccccucauccccaaguccgucugcgagaccguccucauggacuucgacgcccucguccaggcccagaccggccucggcaccgccgccgucaucgucauggaccgcuccaccgacaucgucaaggccaucgcccgccucaucgaguucuacaagcacgaguccugcggccagugcacccccugccgcgagggcgucgacuggaugaacaaggucauggcccgcuucguccgcggcgacgcccgccccgccgagaucgacucccucugggagaucuccaagcagaucgagggccacaccaucugcgcccucggcgacggcgccgccuggcccguccagggccucauccgccacuuccgccccgagcucgaggagcgcaugcagcgcuucgcccagcagcaccaggcccgccaggccgccuccuga

SEQ ID NO: 46547 - RNA, 750 nt, Artificial Sequence
  derived and/or modified sequence opt2 from NDUFV2__Homo_sapiens__NP_066552
auguucuucuccgccgcccuccgcgcccgcgccgccggccucaccgcccacuggggccgccacguccgcaaccuccacaagaccgucaugcagaacggcgccggcggcgcccucuucguccaccgcgacacccccgagaacaaccccgacacccccuucgacuucacccccgagaacuacaagcgcaucgaggccaucgucaagaacuaccccgagggccacaaggccgccgccguccuccccguccucgaccucgcccagcgccagaacggcuggcuccccaucuccgccaugaacaaggucgccgagguccuccaggucccccccaugcgcgucuacgaggucgccaccuucuacaccauguacaaccgcaagcccgucggcaaguaccacauccaggucugcaccaccacccccugcaugcuccgcaacuccgacuccauccucgaggccauccagaagaagcucggcaucaaggucggcgagaccacccccgacaagcucuucacccucaucgaggucgagugccucggcgccugcgucaacgcccccaugguccagaucaacgacaacuacuacgaggaccucaccgccaaggacaucgaggagaucaucgacgagcucaaggccggcaagauccccaagcccggcccccgcuccggccgcuucuccugcgagcccgccggcggccucaccucccucaccgagccccccaagggccccggcuucggcguccaggccggccucuga

SEQ ID NO: 46548 - RNA, 327 nt, Artificial Sequence
  derived and/or modified sequence opt2 from NDUFV3__Homo_sapiens__NP_001001503
auggccgcccccugccuccuccgccagggccgcgccggcgcccucaagaccaugcuccaggaggcccaggucuuccgcggccucgccuccaccgucucccucuccgccgaguccggcaaguccgagaagggccagccccagaacuccaagaagcaguccccccccaagaagcccgcccccguccccgccgagcccuucgacaacaccaccuacaagaaccuccagcaccacgacuacuccaccuacaccuuccucgaccucaaccucgagcucuccaaguuccgcaugccccagcccuccuccggccgcgaguccccccgccacuga

SEQ ID NO: 46549 - RNA, 25578 nt, Artificial Sequence
  derived and/or modified sequence opt2 from NEB__Homo_sapiens__NP_001157979
auggccgacgacgaggacuacgaggaggucgucgaguacuacaccgaggaggucgucuacgaggagguccccggcgagaccaucaccaagaucuacgagaccaccaccacccgcaccuccgacuacgagcaguccgagaccuccaagcccgcccucgcccagcccgcccucgcccagcccgccuccgccaagcccgucgagcgccgcaaggucauccgcaagaaggucgaccccuccaaguucaugacccccuacaucgcccacucccagaagaugcaggaccucuucucccccaacaaguacaaggagaaguucgagaagaccaagggccagcccuacgccuccaccaccgacacccccgagcuccgccgcaucaagaagguccaggaccagcucuccgaggucaaguaccgcauggacggcgacgucgccaagaccaucugccacgucgacgagaaggccaaggacaucgagcacgccaagaaggucucccagcaggucuccaagguccucuacaagcagaacugggaggacaccaaggacaaguaccuccucccccccgacgcccccgagcucguccaggccgucaagaacaccgccauguucuccaagaagcucuacaccgaggacugggaggccgacaagucccucuucuaccccuacaacgacucccccgagcuccgccgcgucgcccaggcccagaaggcccucuccgacgucgccuacaagaagggccucgccgagcagcaggcccaguucaccccccucgccgacccccccgacaucgaguucgccaagaaggucaccaaccaggucuccaagcagaaguacaaggaggacuacgagaacaagaucaagggcaagugguccgagacccccugcuucgaggucgccaacgcccgcaugaacgccgacaacaucuccacccgcaaguaccaggaggacuucgagaacaugaaggaccagaucuacuucaugcagaccgagacccccgaguacaagaugaacaagaaggccggcgucgccgccuccaaggucaaguacaaggaggacuacgagaagaacaagggcaaggccgacuacaacguccuccccgccuccgagaacccccagcuccgccagcucaaggccgccggcgacgcccucuccgacaagcucuacaaggagaacuacgagaagaccaaggccaaguccaucaacuacugcgagacccccaaguucaagcucgacaccguccuccagaacuucuccuccgacaagaaguacaaggacuccuaccucaaggacauccucggccacuacgucggcuccuucgaggaccccuaccacucccacugcaugaaggucaccgcccagaacuccgacaagaacuacaaggccgaguacgaggaggaccgcggcaagggcuucuucccccagaccaucacccaggaguacgaggccaucaagaagcucgaccagugcaaggaccacaccuacaagguccaccccgacaagaccaaguucacccaggucaccgacucccccguccuccuccaggcccaggucaacuccaagcagcucuccgaccucaacuacaaggccaagcacgaguccgagaaguucaagugccacaucccccccgacacccccgccuucauccagcacaaggucaacgccuacaaccucuccgacaaccucuacaagcaggacugggagaaguccaaggccaagaaguucgacaucaaggucgacgccaucccccuccucgccgccaaggccaacaccaagaacaccuccgacgucauguacaagaaggacuacgagaagaacaagggcaagaugaucggcguccucuccaucaacgacgaccccaagaugcuccacucccucaaggucgccaagaaccaguccgaccgccucuacaaggagaacuacgagaagaccaaggccaaguccaugaacuacugcgagacccccaaguaccagcucgacacccagcucaagaacuucuccgaggcccgcuacaaggaccucuacgucaaggacguccucggccacuacgucggcuccauggaggaccccuaccacacccacugcaugaaggucgccgcccagaacuccgacaaguccuacaaggccgaguacgaggaggacaagggcaagugcuacuucccccagaccaucacccaggaguacgaggccaucaagaagcucgaccagugcaaggaccacaccuacaagguccaccccgacaagaccaaguucaccgccgucaccgacucccccguccuccuccaggcccagcucaacaccaagcagcucuccgaccucaacuacaaggccaagcacgagggcgagaaguucaagugccacauccccgccgacgccccccaguucauccagcaccgcgucaacgccuacaaccucuccgacaacgucuacaagcaggacugggagaaguccaaggccaagaaguucgacaucaaggucgacgccaucccccuccucgccgccaaggccaacaccaagaacaccuccgacgucauguacaagaaggacuacgagaaguccaagggcaagaugaucggcgcccucuccaucaacgacgaccccaagaugcuccacucccucaagaccgccaagaaccaguccgaccgcgaguaccgcaaggacuacgagaaguccaagaccaucuacaccgccccccucgacaugcuccaggucacccaggccaagaagucccaggccaucgccuccgacgucgacuacaagcacauccuccacuccuacuccuacccccccgacuccaucaacgucgaccucgccaagaaggccuacgcccuccaguccgacgucgaguacaaggccgacuacaacuccuggaugaagggcugcggcuggguccccuucggcucccucgagauggagaaggccaagcgcgccuccgacauccucaacgagaagaaguaccgccagcaccccgacacccucaaguucaccuccaucgaggacgcccccaucaccguccaguccaagaucaaccaggcccagcgcuccgacaucgccuacaaggccaagggcgaggagaucauccacaaguacaaccucccccccgaccucccccaguucauccaggccaaggucaacgccuacaacaucuccgagaacauguacaaggccgaccucaaggaccucuccaagaagggcuacgaccuccgcaccgacgccauccccauccgcgccgccaaggccgcccgccaggccgccuccgacguccaguacaagaaggacuacgagaaggccaagggcaagauggucggcuuccagucccuccaggacgaccccaagcucguccacuacaugaacgucgccaagauccaguccgaccgcgaguacaagaaggacuacgagaagaccaaguccaaguacaacaccccccacgacauguucaacgucgucgccgccaagaaggcccaggacgucgucuccaacgucaacuacaagcacucccuccaccacuacaccuaccuccccgacgccauggaccucgagcucuccaagaacaugaugcagauccaguccgacaacgucuacaaggaggacuacaacaacuggaugaagggcaucggcuggauccccaucggcucccucgacgucgagaaggucaagaaggccggcgacgcccucaacgagaagaaguaccgccagcaccccgacacccucaaguucaccuccaucgucgacucccccgucaugguccaggccaagcagaacaccaagcaggucuccgacauccucuacaaggccaagggcgaggacgucaagcacaaguacaccaugucccccgaccucccccaguuccuccaggccaagugcaacgccuacaacaucuccgacgucugcuacaagcgcgacuggcacgaccucaucgccaagggcaacaacguccucggcgacgccauccccaucaccgccgccaaggccucccgcaacaucgccuccgacuacaaguacaaggaggccuacgagaaguccaagggcaagcacgucggcuuccgcucccuccaggacgaccccaagcucguccacuacaugaacgucgccaagcuccaguccgaccgcgaguacaagaagaacuacgagaacaccaagaccuccuaccacacccccggcgacauggucuccaucaccgccgccaagauggcccaggacgucgccaccaacgucaacuacaagcagccccuccaccacuacaccuaccuccccgacgccaugucccucgagcacacccgcaacgucaaccagauccaguccgacaacgucuacaaggacgaguacaacuccuuccucaagggcaucggcuggauccccaucggcucccucgaggucgagaaggucaagaaggccggcgacgcccucaacgagcgcaaguaccgccagcaccccgacaccgucaaguucaccuccguccccgacuccaugggcaugguccucgcccagcacaacaccaagcagcucuccgaccucaacuacaaggucgagggcgagaagcucaagcacaaguacaccaucgaccccgagcucccccaguucauccaggccaaggucaacgcccucaacauguccgacgcccacuacaaggccgacuggaagaagaccaucgccaagggcuacgaccuccgccccgacgccauccccaucgucgccgccaaguccucccgcaacaucgccuccgacugcaaguacaaggaggccuacgagaaggccaagggcaagcaggucggcuuccucucccuccaggacgaccccaagcucguccacuacaugaacgucgccaagauccaguccgaccgcgaguacaagaagggcuacgaggccuccaagaccaaguaccacaccccccucgacauggucuccgucaccgccgccaagaagucccaggaggucgccaccaacgccaacuaccgccaguccuaccaccacuacacccuccuccccgacgcccucaacgucgagcacucccgcaacgccaugcagauccaguccgacaaccucuacaaguccgacuucaccaacuggaugaagggcaucggcuggguccccaucgagucccucgaggucgagaaggccaagaaggccggcgagauccucuccgagaagaaguaccgccagcaccccgagaagcucaaguucaccuacgccauggacaccauggagcaggcccucaacaaguccaacaagcucaacauggacaagcgccucuacaccgagaaguggaacaaggacaagaccaccauccacgucaugcccgacacccccgacauccuccucucccgcgucaaccagaucaccauguccgacaagcucuacaaggccggcugggaggaggagaagaagaagggcuacgaccuccgccccgacgccaucgccaucaaggccgcccgcgccucccgcgacaucgccuccgacuacaaguacaagaaggccuacgagcaggccaagggcaagcacaucggcuuccgcucccucgaggacgaccccaagcucguccacuucaugcaggucgccaagaugcaguccgaccgcgaguacaagaagggcuacgagaaguccaagaccuccuuccacacccccgucgacaugcucuccgucgucgccgccaagaagucccaggaggucgccaccaacgccaacuaccgcaacgucauccacaccuacaacaugcuccccgacgccauguccuucgagcucgccaagaacaugaugcagauccaguccgacaaccaguacaaggccgacuacgccgacuucaugaagggcaucggcuggcucccccucggcucccucgaggccgagaagaacaagaaggccauggagaucaucuccgagaagaaguaccgccagcaccccgacacccucaaguacuccacccucauggacuccaugaacaugguccucgcccagaacaacgccaagaucaugaacgagcaccucuacaagcaggccugggaggccgacaagaccaagguccacaucaugcccgacaucccccagaucauccucgccaaggccaacgccaucaacauguccgacaagcucuacaagcucucccucgaggaguccaagaagaagggcuacgaccuccgccccgacgccauccccaucaaggccgccaaggccucccgcgacaucgccuccgacuacaaguacaaguacaacuacgagaagggcaagggcaagauggucggcuuccgcucccucgaggacgaccccaagcucguccacuccaugcaggucgccaagaugcaguccgaccgcgaguacaagaagaacuacgagaacaccaagaccuccuaccacacccccgccgacaugcucuccgucaccgccgccaaggacgcccaggccaacaucaccaacaccaacuacaagcaccucauccacaaguacauccuccuccccgacgccaugaacaucgagcucacccgcaacaugaaccgcauccaguccgacaacgaguacaagcaggacuacaacgagugguacaagggccucggcuggucccccgccggcucccucgaggucgagaaggccaagaaggccaccgaguacgccuccgaccagaaguaccgccagcaccccuccaacuuccaguucaagaagcucaccgacuccauggacaugguccucgccaagcagaacgcccacaccaugaacaagcaccucuacaccaucgacuggaacaaggacaagaccaagauccacgucaugcccgacacccccgacauccuccaggccaagcagaaccagacccucuacucccagaagcucuacaagcucggcugggaggaggcccucaagaagggcuacgaccuccccgucgacgccaucuccguccagcucgccaaggccucccgcgacaucgccuccgacuacaaguacaagcagggcuaccgcaagcagcucggccaccacgucggcuuccgcucccuccaggacgaccccaagcucguccucuccaugaacgucgccaagaugcaguccgagcgcgaguacaagaaggacuucgagaaguggaagaccaaguucuccucccccgucgacaugcucggcgucguccucgccaagaagugccaggagcucgucuccgacgucgacuacaagaacuaccuccaccaguggaccugccuccccgaccagaacgacgucguccaggccaagaaggucuacgagcuccaguccgagaaccucuacaaguccgaccucgaguggcuccgcggcaucggcugguccccccucggcucccucgaggccgagaagaacaagcgcgccuccgagaucaucuccgagaagaaguaccgccagccccccgaccgcaacaaguucaccuccauccccgacgccauggacaucguccucgccaagaccaacgccaagaaccgcuccgaccgccucuaccgcgaggccugggacaaggacaagacccagauccacaucaugcccgacacccccgacaucguccucgccaaggccaaccucaucaacaccuccgacaagcucuaccgcaugggcuacgaggagcucaagcgcaagggcuacgaccuccccgucgacgccauccccaucaaggccgccaaggccucccgcgagaucgccuccgaguacaaguacaaggagggcuuccgcaagcagcucggccaccacaucggcgcccgcaacaucgaggacgaccccaagaugaugugguccaugcacgucgccaagauccaguccgaccgcgaguacaagaaggacuucgagaaguggaagaccaaguucuccucccccgucgacaugcucggcgucguccucgccaagaagugccagacccucgucuccgacgucgacuacaagaacuaccuccaccaguggaccugccuccccgaccaguccgacgucauccacgcccgccaggccuacgaccuccaguccgacaaccucuacaaguccgaccuccaguggcucaagggcaucggcuggaugaccuccggcucccucgaggacgagaagaacaagcgcgccacccagauccucuccgaccacgucuaccgccagcaccccgaccaguucaaguucuccucccucauggacuccauccccaugguccucgccaagaacaacgccaucaccaugaaccaccgccucuacaccgaggccugggacaaggacaagaccaccguccacaucaugcccgacacccccgagguccuccucgccaagcagaacaaggucaacuacuccgagaagcucuacaagcucggccucgaggaggccaagcgcaagggcuacgacaugcgcgucgacgccauccccaucaaggccgccaaggccucccgcgacaucgccuccgaguucaaguacaaggagggcuaccgcaagcagcucggccaccacaucggcgcccgcgccauccgcgacgaccccaagaugaugugguccaugcacgucgccaagauccaguccgaccgcgaguacaagaaggacuucgagaaguggaagaccaaguucuccucccccgucgacaugcucggcgucguccucgccaagaagugccagacccucgucuccgacgucgacuacaagaacuaccuccaccaguggaccugccuccccgaccaguccgacgucauccacgcccgccaggccuacgaccuccaguccgacaacauguacaaguccgaccuccaguggaugcgcggcaucggcugggucuccaucggcucccucgacgucgagaagugcaagcgcgccaccgagauccucuccgacaagaucuaccgccagccccccgaccgcuucaaguucaccuccgucaccgacucccucgagcagguccucgccaagaacaacgccaucaccaugaacaagcgccucuacaccgaggccugggacaaggacaagacccagauccacaucaugcccgacacccccgagaucaugcucgcccgcaugaacaagaucaacuacuccgagucccucuacaagcucgccaacgaggaggccaagaagaagggcuacgaccuccgcuccgacgccauccccaucgucgccgccaaggccucccgcgacaucaucuccgacuacaaguacaaggacggcuacugcaagcagcucggccaccacaucggcgcccgcaacaucgaggacgaccccaagaugaugugguccaugcacgucgccaagauccaguccgaccgcgaguacaagaaggacuucgagaaguggaagaccaaguucuccucccccgucgacaugcucggcgucguccucgccaagaagugccagacccucgucuccgacgucgacuacaagaacuaccuccacgaguggaccugccuccccgaccaguccgacgucauccacgcccgccaggccuacgaccuccaguccgacaacaucuacaaguccgaccuccaguggcuccgcggcaucggcuggguccccaucggcuccauggacgucgucaagugcaagcgcgccaccgagauccucuccgacaacaucuaccgccagccccccgacaagcucaaguucaccuccgucaccgacucccucgagcagguccucgccaagaacaacgcccucaacaugaacaagcgccucuacaccgaggccugggacaaggacaagacccagauccacaucaugcccgacacccccgagaucaugcucgcccgccagaacaagaucaacuacuccgagacccucuacaagcucgccaacgaggaggccaagaagaagggcuacgaccuccgcuccgacgccauccccaucgucgccgccaaggccucccgcgacgucaucuccgacuacaaguacaaggacggcuaccgcaagcagcucggccaccacaucggcgcccgcaacaucgaggacgaccccaagaugaugugguccaugcacgucgccaagauccaguccgaccgcgaguacaagaaggacuucgagaaguggaagaccaaguucuccucccccgucgacaugcucggcgucguccucgccaagaagugccagacccucgucuccgacgucgacuacaagaacuaccuccacgaguggaccugccuccccgaccagaacgacgucauccacgcccgccaggccuacgaccuccaguccgacaacaucuacaaguccgaccuccaguggcuccgcggcaucggcuggguccccaucggcuccauggacgucgucaagugcaagcgcgccgccgagauccucuccgacaacaucuaccgccagccccccgacaagcucaaguucaccuccgucaccgacucccucgagcagguccucgccaagaacaacgcccucaacaugaacaagcgccucuacaccgaggccugggacaaggacaagacccagguccacaucaugcccgacacccccgagaucaugcucgcccgccagaacaagaucaacuacuccgagucccucuaccgccaggccauggaggaggccaagaaggagggcuacgaccuccgcuccgacgccauccccaucgucgccgccaaggccucccgcgacaucgccuccgacuacaaguacaaggaggccuaccgcaagcagcucggccaccacaucggcgcccgcgccguccacgacgaccccaagaucauguggucccuccacaucgccaagguccaguccgaccgcgaguacaagaaggacuucgagaaguacaagacccgcuacuccucccccgucgacaugcucggcaucguccucgccaagaagugccagacccucgucuccgacgucgacuacaagcacccccuccacgaguggaucugccuccccgaccagaacgacaucauccacgcccgcaaggccuacgaccuccaguccgacaaccucuacaaguccgaccucgaguggaugaagggcaucggcuggguccccaucgacucccucgaggucguccgcgccaagcgcgccggcgagcuccucuccgacaccaucuaccgccagcgccccgagacccucaaguucaccuccaucaccgacacccccgagcagguccucgccaagaacaacgcccucaacaugaacaagcgccucuacaccgaggccugggacaacgacaagaagaccauccacgucaugcccgacacccccgagaucaugcucgccaagcucaaccgcaucaacuacuccgacaagcucuacaagcucgcccucgaggaguccaagaaggagggcuacgaccuccgccucgacgccauccccauccaggccgccaaggccucccgcgacaucgccuccgacuacaaguacaaggagggcuaccgcaagcagcucggccaccacaucggcgcccgcaacaucaaggacgaccccaagaugaugugguccauccacgucgccaagauccaguccgaccgcgaguacaagaaggaguucgagaaguggaagaccaaguucuccucccccgucgacaugcucggcgucguccucgccaagaagugccagauccucgucuccgacaucgacuacaagcacccccuccacgaguggaccugccuccccgaccagaacgacgucauccaggcccgcaaggccuacgaccuccaguccgacgccaucuacaaguccgaccucgaguggcuccgcggcaucggcuggguccccaucggcuccgucgaggucgagaaggucaagcgcgccggcgagauccucuccgaccgcaaguaccgccagcccgccgaccagcucaaguucaccugcaucaccgacacccccgagaucguccucgccaagaacaacgcccucaccauguccaagcaccucuacaccgaggccugggacgccgacaagaccuccauccacgucaugcccgacacccccgacauccuccucgccaaguccaacuccgccaacaucucccagaagcucuacaccaagggcugggacgaguccaagaugaaggacuacgaccuccgcgccgacgccaucuccaucaaguccgccaaggccucccgcgacaucgccuccgacuacaaguacaaggaggccuacgagaagcagaagggccaccacaucggcgcccaguccaucgaggacgaccccaagaucaugugcgccauccacgccggcaagauccaguccgagcgcgaguacaagaaggaguuccagaaguggaagaccaaguucuccucccccgucgacaugcucuccauccuccucgccaagaagugccagacccucgucaccgacaucgacuaccgcaacuaccuccacgaguggaccugcaugcccgaccagaacgacaucauccaggccaagaaggccuacgaccuccaguccgacuccgucuacaaggccgaccucgaguggcuccgcggcaucggcuggaugcccgagggcuccgucgagaugaaccgcgucaaggucgcccaggaccucgucaacgagcgccucuaccgcacccgccccgaggcccucuccuucaccuccaucgucgacacccccgaggucguccucgccaaggccaacucccuccagaucuccgagaagcucuaccaggaggccuggaacaaggacaaguccaacaucaccauccccuccgacacccccgagaugcuccaggcccacaucaacgcccuccagaucuccaacaagcucuaccagaaggacuggaacgacgccaagcagaagggcuacgacauccgcgccgacgccaucgagaucaagcacgccaaggccucccgcgagaucgccuccgaguacaaguacaaggagggcuaccgcaagcagcucggccaccacaugggcuuccgcacccuccaggacgaccccaaguccgucugggccauccacgccgccaagauccaguccgaccgcgaguacaagaaggccuacgagaaguccaagggcauccacaacaccccccucgacaugauguccaucguccaggccaagaagugccagguccucgucuccgacaucgacuaccgcaacuaccuccaccaguggaccugccuccccgaccagaacgacgucauccaggccaagaaggccuacgaccuccaguccgacaaccucuacaaguccgaccucgaguggcucaagggcaucggcuggcuccccgagggcuccgucgaggucaugcgcgucaagaacgcccagaaccuccucaacgagcgccucuaccgcaucaagcccgaggcccucaaguucaccuccaucgucgacacccccgaggucauccaggccaagaucaacgccguccagaucuccgagccccucuaccgcgacgccugggagaaggagaaggccaacgucaacguccccgccgacaccccccucaugcuccaguccaagaucaacgcccuccagaucuccaacaagcgcuaccagcaggccugggaggacgucaagaugaccggcuacgaccuccgcgccgacgccaucggcauccagcacgccaaggccucccgcgacaucgccuccgacuaccucuacaagaccgccuacgagaagcagaagggccacuacaucggcugccgcuccgccaaggaggaccccaagcucgucugggccgccaacguccucaagaugcagaacgaccgccucuacaagaaggccuacaacgaccacaaggccaagaucuccauccccgucgacauggucuccaucuccgccgccaaggagggccaggcccucgccuccgacgucgacuaccgccacuaccuccaccacugguccugcuuccccgaccagaacgacgucauccaggcccgcaaggccuacgaccuccaguccgacuccgucuacaaggccgaccucgaguggcuccgcggcaucggcuggaugcccgagggcuccgucgagaugaaccgcgucaaggucgcccaggaccucgucaacgagcgccucuaccgcacccgccccgaggcccucuccuucaccuccaucgucgacacccccgaggucguccucgccaaggccaacucccuccagaucuccgagaagcucuaccaggaggccuggaacaaggacaaguccaacaucaccauccccuccgacacccccgagaugcuccaggcccacaucaacgcccuccagaucuccaacaagcucuaccagaaggacuggaacgacaccaagcagaagggcuacgacauccgcgccgacgccaucgagaucaagcacgccaaggccucccgcgagaucgccuccgaguacaaguacaaggagggcuaccgcaagcagcucggccaccacaugggcuuccgcacccuccaggacgaccccaaguccgucugggccauccacgccgccaagauccaguccgaccgcgaguacaagaaggccuacgagaaguccaagggcauccacaacaccccccucgacaugauguccaucguccaggccaagaagugccagguccucgucuccgacaucgacuaccgcaacuaccuccaccaguggaccugccuccccgaccagaacgacgucauccaggccaagaaggccuacgaccuccaguccgacaaccucuacaaguccgaccucgaguggcucaagggcaucggcuggcuccccgagggcuccgucgaggucaugcgcgucaagaacgcccagaaccuccucaacgagcgccucuaccgcaucaagcccgaggcccucaaguucaccuccaucgucgacacccccgaggucauccaggccaagaucaacgccguccagaucuccgagccccucuaccgcaacgccugggagaaggagaaggccaacgucaacguccccgccgacaccccccucaugcuccaguccaagaucaacgcccuccagaucuccaacaagcgcuaccagcaggccugggaggacgucaagaugaccggcuacgaccuccgcgccgacgccaucggcauccagcacgccaaggccucccgcgacaucgccuccgacuaccucuacaagaccgccuacgagaagcagaagggccacuacaucggcugccgcuccgccaaggaggaccccaagcucgucugggccgccaacguccucaagaugcagaacgaccgccucuacaagaaggccuacaacgaccacaaggccaagaucuccauccccgucgacauggucuccaucuccgccgccaaggagggccaggcccucgccuccgacgucgacuaccgccacuaccuccaccacugguccugcuuccccgaccagaacgacgucauccaggcccgcaaggccuacgaccuccaguccgacuccgucuacaaggccgaccucgaguggcuccgcggcaucggcuggaugcccgagggcuccgucgagaugaaccgcgucaaggucgcccaggaccucgucaacgagcgccucuaccgcacccgccccgaggcccucuccuucaccuccaucgucgacacccccgaggucguccucgccaaggccaacucccuccagaucuccgagaagcucuaccaggaggccuggaacaaggacaaguccaacaucaccauccccuccgacacccccgagaugcuccaggcccacaucaacgcccuccagaucuccaacaagcucuaccagaaggacuggaacgacaccaagcagaagggcuacgacauccgcgccgacgccaucgagaucaagcacgccaaggccucccgcgagaucgccuccgaguacaaguacaaggagggcuaccgcaagcagcucggccaccacaugggcuuccgcacccuccaggacgaccccaaguccgucugggccauccacgccgccaagauccaguccgaccgcgaguacaagaaggccuacgagaaguccaagggcauccacaacaccccccucgacaugauguccaucguccaggccaagaagugccagguccucgucuccgacaucgacuaccgcaacuaccuccaccaguggaccugccuccccgaccagaacgacgucauccaggccaagaaggccuacgaccuccaguccgacaaccucuacaaguccgaccucgaguggcucaagggcaucggcuggcuccccgagggcuccgucgaggucaugcgcgucaagaacgcccagaaccuccucaacgagcgccucuaccgcaucaagcccgaggcccucaaguucaccuccaucgucgacacccccgaggucauccaggccaagaucaacgccguccagaucuccgagccccucuaccgcgacgccugggagaaggagaaggccaacgucaacguccccgccgacaccccccucaugcuccaguccaagaucaacgcccuccagaucuccaacaagcgcuaccagcaggccugggaggacgucaagaugaccggcuacgaccuccgcgccgacgccaucggcauccagcacgccaaggccucccgcgacaucgccuccgacuaccucuacaagaccgccuacgagaagcagaagggccacuacaucggcugccgcuccgccaaggaggaccccaagcucgucugggccgccaacguccucaagaugcagaacgaccgccucuacaagaaggccuacaacgaccacaaggccaagaucuccauccccgucgacauggucuccaucuccgccgccaaggagggccaggcccucgccuccgacgucgacuaccgccacuaccuccaccgcugguccugcuuccccgaccagaacgacgucauccaggcccgcaaggccuacgaccuccaguccgacgcccucuacaaggccgaccucgaguggcuccgcggcaucggcuggaugccccagggcucccccgagguccuccgcgucaagaacgcccagaacaucuucugcgacuccgucuaccgcacccccgucgucaaccucaaguacaccuccaucgucgacacccccgaggucguccucgccaaguccaacgccgagaacaucuccauccccaaguaccgcgaggucugggacaaggacaagaccuccauccacaucaugcccgacacccccgagaucaaccucgcccgcgccaacgcccucaacgucuccaacaagcucuaccgcgagggcugggacgagaugaaggccggcugcgacguccgccucgacgccauccccauccaggccgccaaggccucccgcgagaucgccuccgacuacaaguacaagcucgaccacgagaagcagaagggccacuacgucggcacccucaccgcccgcgacgacaacaagauccgcugggcccucaucgccgacaagcuccagaacgagcgcgaguaccgccucgacugggccaaguggaaggccaagauccagucccccgucgacaugcucuccauccuccacuccaagaacucccaggcccucgucuccgacauggacuaccgcaacuaccuccaccaguggaccugcaugcccgaccagaacgacgucauccaggccaagaaggccuacgagcuccaguccgacaacgucuacaaggccgaccucgaguggcuccgcggcaucggcuggaugcccaacgacuccgucuccgucaaccacgccaagcacgccgccgacaucuucuccgagaagaaguaccgcaccaagaucgagacccucaacuucacccccgucgacgaccgcgucgacuacgucaccgccaagcaguccggcgagauccucgacgacaucaaguaccgcaaggacuggaacgccaccaaguccaaguacacccucaccgagaccccccuccuccacaccgcccaggaggccgcccgcauccucgaccaguaccucuacaaggagggcugggagcgccagaaggccaccggcuacauccucccccccgacgccguccccuucguccacgcccaccacugcaacgacguccaguccgagcucaaguacaaggccgagcacgucaagcagaagggccacuacgucggcguccccaccaugcgcgacgaccccaagcucgucugguucgagcacgccggccagauccagaacgagcgccucuacaaggaggacuaccacaagaccaaggccaagaucaacauccccgccgacauggucuccguccucgccgccaagcagggccagacccucgucuccgacaucgacuaccgcaacuaccuccaccaguggaugugccaccccgaccagaacgacgucauccaggcccgcaaggccuacgaccuccaguccgacaacgucuaccgcgccgaccucgaguggcuccgcggcaucggcuggaucccccucgacuccgucgaccacguccgcgucaccaagaaccaggagaugaugucccagaucaaguacaagaagaacgcccucgagaacuaccccaacuuccgcuccgucgucgacccccccgagaucguccucgccaagaucaacuccgucaaccaguccgacgucaaguacaaggagaccuucaacaaggccaagggcaaguacaccuucucccccgacaccccccacaucucccacuccaaggacaugggcaagcucuacuccaccauccucuacaagggcgccugggagggcaccaaggccuacggcuacacccucgacgagcgcuacauccccaucgucggcgccaagcacgccgaccucgucaacuccgagcucaaguacaaggagaccuacgagaagcagaagggccacuaccucgccggcaaggucaucggcgaguuccccggcgucguccacugccucgacuuccagaagaugcgcuccgcccucaacuaccgcaagcacuacgaggacaccaaggccaacguccacauccccaacgacaugaugaaccacguccucgccaagcgcugccaguacauccucuccgaccucgaguaccgccacuacuuccaccaguggaccucccuccucgaggagcccaacgucauccgcguccgcaacgcccaggagauccucuccgacaacgucuacaaggacgaccucaacuggcucaagggcaucggcugcuacgucugggacaccccccagauccuccacgccaagaaguccuacgaccuccagucccagcuccaguacaccgccgccggcaaggagaaccuccagaacuacaaccucgucaccgacaccccccucuacgucaccgccguccaguccggcaucaacgccuccgaggucaaguacaaggagaacuaccaccagaucaaggacaaguacaccaccguccucgagaccgucgacuacgaccgcacccgcaaccucaagaaccucuacuccuccaaccucuacaaggaggccugggaccgcgucaaggccaccuccuacauccuccccuccuccacccucucccucacccacgccaagaaccagaagcaccucgccucccacaucaaguaccgcgaggaguacgagaaguucaaggcccucuacacccucccccgcuccgucgacgacgaccccaacaccgcccgcugccuccgcgucggcaagcucaacaucgaccgccucuaccgcuccgucuacgagaagaacaagaugaagauccacaucguccccgacauggucgagauggucaccgccaaggacucccagaagaaggucuccgagaucgacuaccgccuccgccuccacgaguggaucugccaccccgaccuccaggucaacgaccacguccgcaaggucaccgaccagaucuccgacaucgucuacaaggacgaccucaacuggcucaagggcaucggcugcuacgucugggacacccccgagauccuccacgccaagcacgccuacgaccuccgcgacgacaucaaguacaaggcccacaugcucaagacccgcaacgacuacaagcucgucaccgacacccccgucuacguccaggccgucaaguccggcaagcagcucuccgacgccgucuaccacuacgacuacguccacuccguccgcggcaaggucgcccccaccaccaagaccgucgaccucgaccgcgcccuccacgccuacaagcuccaguccuccaaccucuacaagaccucccuccgcacccuccccaccggcuaccgccuccccggcgacaccccccacuucaagcacaucaaggacacccgcuacauguccuccuacuucaaguacaaggaggccuacgagcacaccaaggccuacggcuacacccucggccccaaggacguccccuucguccacguccgccgcgucaacaacgucaccuccgagcgccucuaccgcgagcucuaccacaagcucaaggacaagauccacaccacccccgacacccccgagauccgccaggucaagaagacccaggaggccgucuccgagcucaucuacaaguccgacuucuucaagaugcagggccacaugaucucccuccccuacaccccccaggucauccacugccgcuacgucggcgacaucaccuccgacaucaaguacaaggaggaccuccagguccucaagggcuucggcugcuuccucuacgacacccccgacaugguccgcucccgccaccuccgcaagcucugguccaacuaccucuacaccgacaaggcccgcaagaugcgcgacaaguacaaggucguccucgacacccccgaguaccgcaagguccaggagcucaagacccaccucuccgagcucgucuaccgcgccgccggcaagaagcagaaguccaucuucaccuccguccccgacacccccgaccuccuccgcgccaagcgcggccagaagcuccagucccaguaccucuacgucgagcucgccaccaaggagcgcccccaccaccacgccggcaaccagaccaccgcccucaagcacgccaaggacgucaaggacauggucuccgagaagaaguacaagauccaguacgagaagaugaaggacaaguacacccccguccccgacacccccauccucauccgcgccaagcgcgccuacuggaacgccuccgaccuccgcuacaaggagaccuuccagaagaccaagggcaaguaccacaccgucaaggacgcccucgacaucgucuaccaccgcaaggucaccgacgacaucuccaagaucaaguacaaggagaacuacaugucccagcucggcaucuggcgcuccauccccgaccgccccgagcacuuccaccaccgcgccgucaccgacaccgucuccgacgucaaguacaaggaggaccucaccuggcucaagggcaucggcugcuacgccuacgacacccccgacuucacccucgccgagaagaacaagacccucuacuccaaguacaaguacaaggaggucuucgagcgcaccaaguccgacuucaaguacgucgccgacucccccaucaaccgccacuucaaguacgccacccagcucaugaacgagaagaaguaccgcgccgacuacgagcagcgcaaggacaaguaccaccucgucgucgacgagccccgccaccuccucgccaagaccgccggcgaccagaucucccagaucaaguaccgcaagaacuacgagaaguccaaggacaaguucaccuccaucgucgacacccccgagcaccuccgcaccaccaaggucaacaagcagaucuccgacauccucuacaagcucgaguacaacaaggccaagccccgcggcuacaccaccauccacgacacccccaugcuccuccacguccgcaaggucaaggacgaggucuccgaccucaaguacaaggaggucuaccagcgcaacaaguccaacugcaccaucgagcccgacgccguccacaucaaggccgccaaggacgccuacaaggucaacaccaaccucgacuacaagaagcaguacgaggccaacaaggcccacuggaaguggacccccgaccgccccgacuuccuccaggccgccaaguccucccuccagcaguccgacuucgaguacaagcucgaccgcgaguuccucaagggcugcaagcucuccgucaccgacgacaagaacaccguccucgcccuccgcaacacccucaucgaguccgaccucaaguacaaggagaagcacgucaaggagcgcggcaccugccacgccguccccgacaccccccagauccuccucgccaagaccgucuccaaccucgucuccgagaacaaguacaaggaccacgucaagaagcaccucgcccagggcuccuacaccacccuccccgagacccgcgacaccguccacgucaaggaggucaccaagcacgucuccgacaccaacuacaagaagaaguucgucaaggagaagggcaaguccaacuacuccaucaugcucgagccccccgaggucaagcacgccauggaggucgccaagaagcaguccgacgucgccuaccgcaaggacgccaaggagaaccuccacuacaccaccgucgccgaccgccccgacaucaagaaggccacccaggccgccaagcaggccuccgaggucgaguaccgcgccaagcaccgcaaggagggcucccacggccucuccaugcucggccgccccgacaucgagauggccaagaaggccgccaagcucuccucccaggucaaguaccgcgagaacuucgacaaggagaagggcaagacccccaaguacaaccccaaggacucccagcucuacaaggucaugaaggacgccaacaaccucgccuccgaggucaaguacaaggccgaccucaagaagcuccacaagcccgucaccgacaugaaggagucccucaucaugaaccacguccucaacaccucccagcucgccuccuccuaccaguacaagaagaaguacgagaaguccaagggccacuaccacaccauccccgacaaccucgagcagcuccaccucaaggaggccaccgagcuccaguccaucgucaaguacaaggagaaguacgagaaggagcgcggcaagcccaugcucgacuucgagacccccaccuacaucaccgccaaggagucccagcagaugcaguccggcaaggaguaccgcaaggacuacgaggaguccaucaagggccgcaaccucaccggccucgaggucacccccgcccuccuccacgucaaguacgccaccaagaucgccuccgagaaggaguaccgcaaggaccucgaggaguccauccgcggcaagggccucaccgagauggaggacacccccgacaugcuccgcgccaagaacgccacccagauccucaacgagaaggaguacaagcgcgaccucgagcucgaggucaagggccgcggccucaacgccauggccaacgagacccccgacuucaugcgcgcccgcaacgccaccgacaucgccucccagaucaaguacaagcaguccgccgagauggagaaggccaacuucaccuccgucgucgacacccccgagaucauccacgcccagcaggucaagaaccucuccucccagaagaaguacaaggaggacgccgagaaguccauguccuacuacgagaccguccucgacacccccgagauccagcgcguccgcgagaaccagaagaacuucucccuccuccaguaccagugcgaccucaagaacuccaagggcaagaucaccgucguccaggacacccccgagauccuccgcgucaaggagaaccagaagaacuucuccuccguccucuacaaggaggacgucucccccggcaccgccaucggcaagacccccgagaugaugcgcgucaagcagacccaggaccacaucuccuccgucaaguacaaggaggccaucggccagggcacccccauccccgaccuccccgaggucaagcgcgucaaggagacccagaagcacaucuccuccgucauguacaaggagaaccucggcaccggcauccccaccaccgucacccccgagaucgagcgcgucaagcgcaaccaggagaacuucuccuccguccucuacaaggagaaccucggcaagggcauccccacccccaucacccccgagauggagcgcgucaagcgcaaccaggagaacuucuccuccauccucuacaaggagaaccucuccaagggcaccccccuccccgucacccccgagauggagcgcgucaagcucaaccaggagaacuucuccuccguccucuacaaggagaacgucggcaagggcauccccauccccaucacccccgagauggagcgcgucaagcacaaccaggagaacuucuccuccguccucuacaaggagaaccucggcaccggcauccccauccccaucacccccgagaugcagcgcgucaagcacaaccaggagaaccucuccuccguccucuacaaggagaacaugggcaagggcaccccccuccccgucacccccgagauggagcgcgucaagcacaaccaggagaacaucuccuccguccucuacaaggagaacaugggcaagggcaccccccuccccgucacccccgagauggagcgcgucaagcacaaccaggagaacaucuccuccguccucuacaaggagaacaugggcaagggcaccccccucgccgucacccccgagauggagcgcgucaagcacaaccaggagaacaucuccuccguccucuacaaggagaacgucggcaaggccaccgccacccccgucacccccgagaugcagcgcgucaagcgcaaccaggagaacaucuccuccguccucuacaaggagaaccucggcaaggccacccccacccccuucacccccgagauggagcgcgucaagcgcaaccaggagaacuucuccuccguccucuacaaggagaacaugcgcaaggccacccccacccccgucacccccgagauggagcgcgccaagcgcaaccaggagaacaucuccuccguccucuacuccgacuccuuccgcaagcagauccagggcaaggccgccuacguccucgacacccccgagaugcgccgcguccgcgagacccagcgccacaucuccaccgucaaguaccacgaggacuucgagaagcacaagggcugcuucacccccgucgucaccgaccccaucaccgagcgcgucaagaagaacaugcaggacuucuccgacaucaacuaccgcggcauccagcgcaaggucgucgagauggagcagaagcgcaacgaccaggaccaggagaccaucaccggccuccgcgucuggcgcaccaaccccggcuccgucuucgacuacgaccccgccgaggacaacauccagucccgcucccuccacaugaucaacguccaggcccagcgccgcucccgcgagcagucccgcuccgccuccgcccucuccaucuccggcggcgaggagaaguccgagcacuccgaggcccccgaccaccaccucuccaccuacuccgacggcggcgucuucgccgucuccaccgccuacaagcacgccaagaccaccgagcucccccagcagcgcuccuccuccgucgccacccagcagaccaccgucuccuccauccccucccaccccuccaccgccggcaagaucuuccgcgccauguacgacuacauggccgccgacgccgacgaggucuccuucaaggacggcgacgccaucaucaacguccaggccaucgacgagggcuggauguacggcaccguccagcgcaccggccgcaccggcaugcuccccgccaacuacgucgaggccaucuga

SEQ ID NO: 46550 - RNA, 3045 nt, Artificial Sequence
  derived and/or modified sequence opt2 from NEBL__Homo_sapiens__NP_006384
augcgcguccccgucuucgaggacaucaaggacgagaccgaggaggagaagaucggcgaggaggagaacgaggaggaccaggucuucuacaagcccgucaucgaggaccucuccauggagcucgcccgcaagugcaccgagcucaucuccgacauccgcuacaaggaggaguucaagaaguccaaggacaagugcaccuucgucaccgacucccccaugcucaaccacgucaagaacaucggcgccuucaucuccgaggccaaguacaagggcaccaucaaggccgaccucuccaacucccucuacaagcgcaugcccgccaccaucgacuccgucuucgccggcgaggucacccagcuccaguccgaggucgccuacaagcagaagcacgacgccgccaagggcuucuccgacuacgcccacaugaaggagccccccgaggucaagcacgccauggaggucaacaagcaccaguccaacaucuccuaccgcaaggacguccaggacacccacaccuacuccgccgagcucgaccgccccgacaucaagauggccacccagaucuccaagaucaucuccaacgccgaguacaagaagggccagggcaucaugaacaaggagcccgccgucaucggccgccccgacuucgagcacgccgucgaggccuccaagcucuccucccagaucaaguacaaggagaaguucgacaacgagaugaaggacaagaagcaccacuacaacccccucgaguccgccuccuuccgccagaaccagcucgccgccacccucgccuccaacgucaaguacaagaaggacauccagaacaugcacgaccccgucuccgaccuccccaaccuccucuuccucgaccacguccucaaggccuccaagaugcucuccggccgcgaguacaagaagcucuucgaggagaacaagggcauguaccacuucgacgccgacgccgucgagcaccuccaccacaagggcaacgccguccuccagucccaggucaaguacaaggaggaguacgagaagaacaagggcaagcccaugcucgaguucgucgagacccccuccuaccaggccuccaaggaggcccagaagaugcaguccgagaaggucuacaaggaggacuucgagaaggagaucaagggccgcuccucccucgaccucgacaagacccccgaguuccuccacgucaaguacaucaccaaccuccuccgcgagaaggaguacaagaaggaccucgagaacgagaucaagggcaagggcauggagcucaacuccgagguccucgacauccagcgcgccaagcgcgccuccgagauggccuccgagaaggaguacaagaaggaccucgaguccaucaucaagggcaagggcaugcaggccggcaccgacacccucgagaugcagcacgccaagaaggccgccgagaucgccuccgagaaggacuacaagcgcgaccucgagaccgagaucaagggcaagggcaugcaggucuccaccgacacccucgacguccagcgcgccaagaaggccuccgagauggccucccagaagcaguacaagaaggaccucgagaacgagaucaagggcaagggcaugcaggucuccauggacauccccgacauccuccgcgccaagcgcaccuccgagaucuacucccagcgcaaguacaaggacgaggccgagaagaugcucuccaacuacuccaccaucgccgacacccccgagauccagcgcaucaagaccacccagcagaacaucuccgccgucuucuacaagaaggaggucggcgccggcaccgccgucaaggacucccccgagaucgagcgcgucaagaagaaccagcagaacaucuccuccgucaaguacaaggaggagaucaagcacgccaccgccaucuccgacccccccgagcucaagcgcgucaaggagaaccagaagaacaucuccaaccuccaguacaaggagcagaacuacaaggccacccccgucuccaugacccccgagaucgagcgcguccgccgcaaccaggagcagcucuccgccgucaaguacaagggcgagcuccagcgcggcaccgccaucuccgacccccccgagcucaagcgcgccaaggagaaccagaagaacaucuccaacgucuacuaccgcggccagcucggccgcgccaccacccucuccgucacccccgagauggagcgcgucaagaagaaccaggagaacaucuccuccgucaaguacacccaggaccacaagcagaugaagggccgccccucccucauccucgacacccccgccaugcgccacgucaaggaggcccagaaccacaucuccauggucaaguaccacgaggacuucgagaagaccaagggccgcggcuucacccccgucgucgacgaccccgucaccgagcgcguccgcaagaacacccaggucgucuccgacgccgccuacaagggcguccacccccacaucgucgagauggaccgccgccccggcaucaucgucgaccucaaggucuggcgcaccgaccccggcuccaucuucgaccucgacccccucgaggacaacauccagucccgcucccuccacaugcucuccgagaaggccucccacuaccgccgccacuggucccgcucccacuccuccuccaccuucggcaccggccucggcgacgaccgcuccgagaucuccgagaucuaccccuccuucuccugcugcuccgaggucacccgccccuccgacgagggcgcccccguccuccccggcgccuaccagcagucccacucccagggcuacggcuacaugcaccagaccuccgucuccuccaugcgcuccaugcagcacucccccaaccuccgcaccuaccgcgccauguacgacuacuccgcccaggacgaggacgaggucuccuuccgcgacggcgacuacaucgucaacguccagcccaucgacgacggcuggauguacggcaccguccagcgcaccggccgcaccggcaugcuccccgccaacuacaucgaguucgucaacuga

SEQ ID NO: 46551 - RNA, 1056 nt, Artificial Sequence
  derived and/or modified sequence opt2 from NECAB1__Homo_sapiens__NP_071746
auggaggacucccaggagaccucccccuccuccaacaacuccuccgaggagcucuccuccgcccuccaccucuccaagggcauguccaucuuccucgacauccuccgccgcgccgacaagaacgacgacggcaagcucuccuucgaggaguucaaggccuacuucgccgacggcguccucuccggcgaggagcuccacgagcucuuccacaccaucgacacccacaacaccaacaaccucgacaccgaggagcucugcgaguacuucucccagcaccucggcgaguacgagaacguccucgccgcccucgaggaccucaaccucuccauccucaaggccaugggcaagaccaagaaggacuaccaggaggccuccaaccucgagcaguucgucacccgcuuccuccucaaggagacccucaaccagcuccagucccuccagaacucccucgagugcgccauggagaccaccgaggagcagacccgccaggagcgccagggccccgccaagcccgagguccucuccauccaguggcccggcaagcgcuccucccgccgcguccagcgccacaacuccuucucccccaacuccccccaguucaacgucuccggccccggccuccucgaggaggacaaccaguggaugacccagaucaaccgccuccagaagcucaucgaccgccucgagaagaaggaccucaagcucgagccccccgaggaggagaucaucgagggcaacaccaagucccacaucaugcucguccagcgccagauguccgucaucgaggaggaccucgaggaguuccagcucgcccucaagcacuacgucgaguccgccuccucccaguccggcugccuccgcaucuccauccagaagcucuccaacgagucccgcuacaugaucuacgaguucugggagaacuccuccgucuggaacucccaccuccagaccaacuacuccaagaccuuccagcgcuccaacgucgacuuccucgagacccccgagcucaccuccaccaugcucguccccgccuccugguggauccucaacaacuga

SEQ ID NO: 46552 - RNA, 1089 nt, Artificial Sequence
  derived and/or modified sequence opt2 from NECAB3__Homo_sapiens__NP_112508
auggccugcgccggccuccucaccgucugccuccuccgcccccccgccccccagccccagccccagaccccccgccacccccagcucgcccccgaccccggccccgccggccacacccucuuccaggacgucuuccgccgcgccgacaagaacgacgacggcaagcucuccuucgaggaguuccagaacuacuucgccgacggcguccucucccucggcgagcuccaggagcucuucuccggcaucgacggccaccucaccgacaaccucgagaccgagaagcucugcgacuacuucuccgagcaccucggcgucuaccgccccguccucgccgcccucgagucccucaaccgcgccguccucgccgccauggacgccaccaagcucgaguacgagcgcgccuccaaggucgaccaguucgucacccgcuuccuccuccgcgagaccgucucccagcuccaggcccuccaguccucccucgagggcgccuccgacacccucgaggcccaggcccacggcuggcgcuccgacgccgaguccgucgaggcccagucccgccucugcggcucccgccgcgccggccgccgcgcccuccgcuccgucucccgcuccuccaccuggucccccggcuccuccgacaccggccgcuccuccgaggccgagaugcaguggcgccuccaggucaaccgccuccaggagcucaucgaccagcucgagugcaaggccccccgccucgagccccuccgcgaggaggaccucgccaagggccccgaccuccacauccucauggcccagcgccagguccaggucgccgaggagggccuccaggacuuccaccgcgcccuccgcugcuacgucgacuucaccggcgcccagucccacugccuccacgucuccgcccagaagaugcucgacggcgccuccuucacccucuacgaguucuggcaggacgaggccuccuggcgccgccaccagcagucccccggcuccaaggccuuccagcgcauccucaucgaccaccuccgcgcccccgacacccucaccaccgucuucuuccccgccuccugguggaucaugaacaacaacuga

SEQ ID NO: 46553 - RNA, 828 nt, Artificial Sequence
  derived and/or modified sequence opt2 from NECAP1__Homo_sapiens__NP_056324
auggccaccgagcucgaguacgaguccguccucugcgucaagcccgacgucuccgucuaccgcauccccccccgcgccuccaaccgcggcuaccgcgccuccgacuggaagcucgaccagcccgacuggaccggccgccuccgcaucaccuccaagggcaagaccgccuacaucaagcucgaggacaaggucuccggcgagcucuucgcccaggcccccgucgagcaguaccccggcaucgccgucgagaccgucaccgacuccucccgcuacuucgucauccgcauccaggacggcaccggccgcuccgccuucaucggcaucggcuucaccgaccgcggcgacgccuucgacuucaacgucucccuccaggaccacuucaagugggucaagcaggaguccgagaucuccaaggagucccaggagauggacgcccgccccaagcucgaccucggcuucaaggagggccagaccaucaagcucugcaucggcaacaucaccaacaagaagggcggcgccuccaagccccgcaccgcccgcggcggcggccucucccuccucccccccccccccggcggcaaggucaccauccccccccccuccuccuccgucgccaucuccaaccacgucacccccccccccauccccaaguccaaccacggcggcuccgacgccgacauccuccucgaccucgacucccccgcccccgucaccacccccgcccccacccccgucuccgucuccaacgaccucuggggcgacuucuccaccgccuccuccuccguccccaaccaggccccccagcccuccaacuggguccaguucuga

SEQ ID NO: 46554 - RNA, 1983 nt, Artificial Sequence
  derived and/or modified sequence opt2 from NEDD1__Homo_sapiens__NP_001128648
augcaggagaaccuccgcuucgccuccuccggcgacgacaucaagaucugggacgccuccuccaugacccucgucgacaaguucaacccccacaccuccccccacggcaucuccuccaucugcugguccuccaacaacaacuuccucgucaccgccuccuccuccggcgacaagaucgucgucuccuccugcaagugcaagcccgucccccuccucgagcucgccgagggccagaagcagaccugcgucaaccucaacuccaccuccauguaccucgucuccggcggccucaacaacaccgucaacaucugggaccucaaguccaagcgcguccaccgcucccucaaggaccacaaggaccaggucaccugcgucaccuacaacuggaacgacugcuacaucgccuccggcucccucuccggcgagaucauccuccacuccgucaccaccaaccucuccuccacccccuucggccacggcuccaaccaguccguccgccaccucaaguacucccucuucaagaagucccuccucggcuccgucuccgacaacggcaucgucacccucugggacgucaacucccagucccccuaccacaacuucgacuccguccacaaggcccccgccuccggcaucugcuucucccccgucaacgagcuccucuucgucaccaucggccucgacaagcgcaucauccucuacgacaccuccuccaagaagcucgucaagacccucgucgccgacaccccccucaccgccgucgacuucaugcccgacggcgccacccucgccaucggcuccucccgcggcaagaucuaccaguacgaccuccgcaugcucaagucccccgucaagaccaucuccgcccacaagaccuccguccagugcaucgccuuccaguacuccaccguccucaccaaguccucccucaacaagggcugcuccaacaagcccaccaccgucaacaagcgcuccgucaacgucaacgccgccuccggcggcguccagaacuccggcaucguccgcgaggcccccgccaccuccaucgccaccguccucccccagcccaugaccuccgccaugggcaagggcaccgucgccguccaggagaaggccggccucccccgcuccaucaacaccgacacccucuccaaggagaccgacuccggcaagaaccaggacuucuccuccuucgacgacaccggcaaguccucccucggcgacauguucucccccauccgcgacgacgccgucgucaacaagggcuccgacgaguccaucggcaagggcgacggcuucgacuuccucccccagcucaacuccgucuuccccccccgcaagaaccccgucaccuccuccaccuccguccuccacuccuccccccucaacgucuucaugggcucccccggcaaggaggagaacgagaaccgcgaccucaccgccgaguccaagaagaucuacaugggcaagcaggaguccaaggacuccuucaagcagcucgccaagcucgucaccuccggcgccgaguccggcaaccucaacaccucccccuccuccaaccagacccgcaacuccgagaaguucgagaagcccgagaacgagaucgaggcccagcucaucugcgagccccccaucaacggcuccuccacccccaaccccaagaucgccuccuccgucaccgccggcgucgccuccucccucuccgagaagaucgccgacuccaucggcaacaaccgccagaacgccccccucaccuccauccagauccgcuucauccagaacaugauccaggagacccucgacgacuuccgcgaggccugccaccgcgacaucgucaaccuccaggucgagaugaucaagcaguuccacaugcagcucaacgagaugcacucccuccucgagcgcuacuccgucaacgagggccucgucgccgagaucgagcgccuccgcgaggagaacaagcgccuccgcgcccacuucuga

SEQ ID NO: 46555 - RNA, 3960 nt, Artificial Sequence
  derived and/or modified sequence opt2 from NEDD4__Homo_sapiens__NP_001271267
auggcccagucccuccgccuccacuucgccgcccgccgcuccaacaccuacccccucuccgagaccuccggcgacgaccucgacucccacguccacaugugcuucaagcgccccacccgcaucuccaccuccaacgucguccagaugaagcucaccccccgccagaccgcccucgccccccucaucaaggagaacguccagucccaggagcgcuccuccguccccuccuccgagaacgucaacaagaaguccuccugccuccagaucucccuccagcccacccgcuacuccggcuaccuccaguccuccaacguccucgccgacuccgacgacgccuccuucaccugcauccucaaggacggcaucuacuccuccgccgucgucgacaacgagcucaacgccgucaacgacggccaccucgucuccucccccgccaucugcuccggcucccucuccaacuucuccaccuccgacaacggcuccuacuccuccaacggcuccgacuucggcuccugcgccuccaucaccuccggcggcuccuacaccaacuccgucaucuccgacuccuccuccuacaccuucccccccuccgacgacaccuuccucggcggcaaccuccccuccgacuccaccuccaaccgcuccguccccaaccgcaacaccacccccugcgagaucuucucccgcuccaccuccaccgaccccuucguccaggacgaccucgagcacggccucgagaucaugaagcuccccgucucccgcaacaccaagaucccccucaagcgcuacuccucccucgucaucuucccccgcucccccuccaccacccgccccaccucccccaccucccucugcacccuccucuccaagggcuccuaccagaccucccaccaguucaucaucucccccuccgagaucgcccacaacgaggacggcaccuccgccaagggcuuccucuccaccgccgucaacggccuccgccucuccaagaccaucugcacccccggcgagguccgcgacauccgcccccuccaccgcaagggcucccuccagaagaagaucguccucuccaacaacaccccccgccagaccgucugcgagaaguccuccgagggcuacuccugcgucuccguccacuucacccagcgcaaggccgccacccucgacugcgagaccaccaacggcgacugcaagcccgagauguccgagaucaagcucaacuccgacuccgaguacaucaagcucaugcaccgcaccuccgccugccuccccuccucccagaacgucgacugccagaucaacaucaacggcgagcucgagcgcccccacucccagaugaacaagaaccacggcauccuccgccgcuccaucucccucggcggcgccuaccccaacaucuccugccucuccucccucaagcacaacugcuccaagggcggccccucccagcuccucaucaaguucgccuccggcaacgagggcaaggucgacaaccucucccgcgacuccaaccgcgacugcaccaacgagcucuccaacuccugcaagacccgcgacgacuuccucggccaggucgacgucccccucuacccccuccccaccgagaacccccgccucgagcgccccuacaccuucaaggacuucguccuccacccccgcucccacaagucccgcgucaagggcuaccuccgccucaagaugaccuaccuccccaagaccuccggcuccgaggacgacaacgccgagcaggccgaggagcucgagcccggcugggucguccucgaccagcccgacgccgccugccaccuccagcagcagcaggagcccuccccccucccccccggcugggaggagcgccaggacauccucggccgcaccuacuacgucaaccacgagucccgccgcacccaguggaagcgccccaccccccaggacaaccucaccgacgccgagaacggcaacauccagcuccaggcccagcgcgccuucaccacccgccgccagaucuccgaggagaccgaguccgucgacaaccgcgaguccuccgagaacugggagaucauccgcgaggacgaggccaccauguacuccaaccaggccuuccccucccccccccccuccuccaaccucgacguccccacccaccucgccgaggagcucaacgcccgccucaccaucuucggcaacuccgccgucucccagcccgccuccuccuccaaccacuccucccgccgcggcucccuccaggccuacaccuucgaggagcagcccacccuccccguccuccuccccaccuccuccggccucccccccggcugggaggagaagcaggacgagcgcggccgcuccuacuacgucgaccacaacucccgcaccaccaccuggaccaagcccaccguccaggccaccgucgagaccucccagcucaccuccucccaguccuccgccggcccccagucccaggccuccaccuccgacuccggccagcaggucacccagcccuccgagaucgagcagggcuuccuccccaagggcugggagguccgccacgcccccaacggccgccccuucuucaucgaccacaacaccaagaccaccaccugggaggacccccgccucaagauccccgcccaccuccgcggcaagaccucccucgacaccuccaacgaccucggcccccucccccccggcugggaggagcgcacccacaccgacggccgcaucuucuacaucaaccacaacaucaagcgcacccagugggaggacccccgccucgagaacgucgccaucaccggccccgccguccccuacucccgcgacuacaagcgcaaguacgaguucuuccgccgcaagcucaagaagcagaacgacauccccaacaaguucgagaugaagcuccgccgcgccaccguccucgaggacuccuaccgccgcaucaugggcgucaagcgcgccgacuuccucaaggcccgccucuggaucgaguucgacggcgagaagggccucgacuacggcggcgucgcccgcgagugguucuuccucaucuccaaggagauguucaaccccuacuacggccucuucgaguacuccgccaccgacaacuacacccuccagaucaaccccaacuccggccucugcaacgaggaccaccucuccuacuucaaguucaucggccgcgucgccggcauggccgucuaccacggcaagcuccucgacggcuucuucauccgccccuucuacaagaugaugcuccacaagcccaucacccuccacgacauggaguccgucgacuccgaguacuacaacucccuccgcuggauccucgagaacgaccccaccgagcucgaccuccgcuucaucaucgacgaggagcucuucggccagacccaccagcacgagcucaagaacggcggcuccgagaucgucgucaccaacaagaacaagaaggaguacaucuaccucgucauccaguggcgcuucgucaaccgcauccagaagcagauggccgccuucaaggagggcuucuucgagcucaucccccaggaccucaucaagaucuucgacgagaacgagcucgagcuccucaugugcggccucggcgacgucgacgucaacgacuggcgcgagcacaccaaguacaagaacggcuacuccgccaaccaccaggucauccagugguucuggaaggccguccucaugauggacuccgagaagcgcauccgccuccuccaguucgucaccggcaccucccgcguccccaugaacggcuucgccgagcucuacggcuccaacggcccccaguccuucaccgucgagcaguggggcacccccgagaagcucccccgcgcccacaccugcuucaaccgccucgaccucccccccuacgaguccuucgaggagcucugggacaagcuccagauggccaucgagaacacccagggcuucgacggcgucgacuga

SEQ ID NO: 46556 - RNA, 2928 nt, Artificial Sequence
  derived and/or modified sequence opt2 from NEDD4L__Homo_sapiens__NP_001138439
auggccaccggccucggcgagcccgucuacggccucuccgaggacgagggcgagucccgcauccuccgcgucaaggucgucuccggcaucgaccucgccaagaaggacaucuucggcgccuccgaccccuacgucaagcucucccucuacgucgccgacgagaaccgcgagcucgcccucguccagaccaagaccaucaagaagacccucaaccccaaguggaacgaggaguucuacuuccgcgucaaccccuccaaccaccgccuccucuucgaggucuucgacgagaaccgccucacccgcgacgacuuccucggccaggucgacgucccccucucccaccuccccaccgaggaccccaccauggagcgccccuacaccuucaaggacuuccuccuccgcccccgcucccacaagucccgcgucaagggcuuccuccgccucaagauggccuacaugcccaagaacggcggccaggacgaggagaacuccgaccagcgcgacgacauggagcacggcugggaggucgucgacuccaacgacuccgccucccagcaccaggaggagcuccccccccccccccucccccccggcugggaggagaaggucgacaaccucggccgcaccuacuacgucaaccacaacaaccgcaccacccaguggcaccgccccucccucauggacgucuccuccgaguccgacaacaacauccgccagaucaaccaggaggccgcccaccgccgcuuccgcucccgccgccacaucuccgaggaccucgagcccgagcccuccgagggcggcgacguccccgagcccugggagaccaucuccgaggaggucaacaucgccggcgacucccucggccucgcccucccccccccccccgccucccccggcucccgcaccuccccccaggagcucuccgaggagcucucccgccgccuccagaucacccccgacuccaacggcgagcaguucuccucccucauccagcgcgagcccuccucccgccuccgcuccugcuccgucaccgacgccgucgccgagcagggccaccuccccccccccuccgcccccgccggccgcgcccgcuccuccaccgucaccggcggcgaggagcccacccccuccgucgccuacguccacaccacccccggccuccccuccggcugggaggagcgcaaggacgccaagggccgcaccuacuacgucaaccacaacaaccgcaccaccaccuggacccgccccaucaugcagcucgccgaggacggcgccuccggcuccgccaccaacuccaacaaccaccucaucgagccccagauccgccgcccccgcucccucuccucccccaccgucacccucuccgccccccucgagggcgccaaggacucccccguccgccgcgccgucaaggacacccucuccaacccccaguccccccagcccucccccuacaacucccccaagccccagcacaaggucacccaguccuuccucccccccggcugggagaugcgcaucgcccccaacggccgccccuucuucaucgaccacaacaccaagaccaccaccugggaggacccccgccucaaguuccccguccacaugcgcuccaagaccucccucaaccccaacgaccucggcccccucccccccggcugggaggagcgcauccaccucgacggccgcaccuucuacaucgaccacaacuccaagaucacccagugggaggacccccgccuccagaaccccgccaucaccggccccgccguccccuacucccgcgaguucaagcagaaguacgacuacuuccgcaagaagcucaagaagcccgccgacauccccaaccgcuucgagaugaagcuccaccgcaacaacaucuucgaggaguccuaccgccgcaucauguccgucaagcgccccgacguccucaaggcccgccucuggaucgaguucgaguccgagaagggccucgacuacggcggcgucgcccgcgagugguucuuccuccucuccaaggagauguucaaccccuacuacggccucuucgaguacuccgccaccgacaacuacacccuccagaucaaccccaacuccggccucugcaacgaggaccaccucuccuacuucaccuucaucggccgcgucgccggccucgccgucuuccacggcaagcuccucgacggcuucuucauccgccccuucuacaagaugaugcucggcaagcagaucacccucaacgacauggaguccgucgacuccgaguacuacaacucccucaaguggauccucgagaacgaccccaccgagcucgaccucauguucugcaucgacgaggagaacuucggccagaccuaccaggucgaccucaagcccaacggcuccgagaucauggucaccaacgagaacaagcgcgaguacaucgaccucgucauccaguggcgcuucgucaaccgcguccagaagcagaugaacgccuuccucgagggcuucaccgagcuccuccccaucgaccucaucaagaucuucgacgagaacgagcucgagcuccucaugugcggccucggcgacgucgacgucaacgacuggcgccagcacuccaucuacaagaacggcuacugccccaaccaccccgucauccagugguucuggaaggccguccuccucauggacgccgagaagcgcauccgccuccuccaguucgucaccggcaccucccgcguccccaugaacggcuucgccgagcucuacggcuccaacggcccccagcucuucaccaucgagcaguggggcucccccgagaagcucccccgcgcccacaccugcuucaaccgccucgaccucccccccuacgagaccuucgaggaccuccgcgagaagcuccucauggccgucgagaacgcccagggcuucgagggcgucgacuga

SEQ ID NO: 46557 - RNA, 246 nt, Artificial Sequence
  derived and/or modified sequence opt2 from NEDD8__Homo_sapiens__NP_006147
augcucaucaaggucaagacccucaccggcaaggagaucgagaucgacaucgagcccaccgacaaggucgagcgcaucaaggagcgcgucgaggagaaggagggcauccccccccagcagcagcgccucaucuacuccggcaagcagaugaacgacgagaagaccgccgccgacuacaagauccucggcggcuccguccuccaccucguccucgcccuccgcggcggcggcggccuccgccaguga

SEQ ID NO: 46558 - RNA, 2505 nt, Artificial Sequence
  derived and/or modified sequence opt2 from NEDD9__Homo_sapiens__NP_001135865
auguggacccgcaaccucauggcccgcgcccucuacgacaacguccccgagugcgccgaggagcucgccuuccgcaagggcgacauccucaccgucaucgagcagaacaccggcggccucgagggcugguggcucugcucccuccacggccgccagggcaucguccccggcaaccgcgucaagcuccucaucggccccaugcaggagaccgccuccucccacgagcagcccgccuccggccucaugcagcagaccuucggccagcagaagcucuaccagguccccaacccccaggccgccccccgcgacaccaucuaccaggucccccccuccuaccagaaccagggcaucuaccagguccccaccggccacggcacccaggagcaggaggucuaccaggucccccccuccguccagcgcuccaucggcggcaccuccggcccccacgucggcaagaaggucaucacccccguccgcaccggccacggcuacgucuacgaguaccccucccgcuaccagaaggacgucuacgacaucccccccucccacaccacccagggcgucuacgacaucccccccuccuccgccaagggccccgucuucuccguccccgucggcgagaucaagccccagggcgucuacgacaucccccccaccaagggcgucuacgccaucccccccuccgccugccgcgacgaggccggccuccgcgagaaggacuacgacuuccccccccccaugcgccaggccggccgccccgaccuccgccccgagggcgucuacgacaucccccccaccugcaccaagcccgccggcaaggaccuccacgucaaguacaacugcgacauccccggcgccgccgagcccgucgcccgccgccaccagucccucucccccaaccacccccccccccagcucggccaguccgucggcucccagaacgacgccuacgacgucccccgcggcguccaguuccucgagccccccgccgagaccuccgagaaggccaacccccaggagcgcgacggcgucuacgacgucccccuccacaacccccccgacgccaagggcucccgcgaccucgucgacggcaucaaccgccucuccuucuccuccaccggcuccacccgcuccaacauguccaccuccuccaccuccuccaaggaguccucccucuccgccucccccgcccaggacaagcgccucuuccucgaccccgacaccgccaucgagcgccuccagcgccuccagcaggcccucgagaugggcgucuccucccucauggcccucgucaccaccgacuggcgcugcuacggcuacauggagcgccacaucaacgagauccgcaccgccgucgacaaggucgagcucuuccucaaggaguaccuccacuucgucaagggcgccgucgccaacgccgccugccuccccgagcucauccuccacaacaagaugaagcgcgagcuccagcgcgucgaggacucccaccagauccucucccagaccucccacgaccucaacgagugcuccuggucccucaacauccucgccaucaacaagccccagaacaagugcgacgaccucgaccgcuucgucauggucgccaagaccguccccgacgacgccaagcagcucaccaccaccaucaacaccaacgccgaggcccucuuccgccccggccccggcucccuccaccucaagaacggccccgaguccaucaugaacuccaccgaguacccccacggcggcucccagggccagcuccuccaccccggcgaccacaaggcccaggcccacaacaaggcccucccccccggccucuccaaggagcaggcccccgacugcuccuccuccgacggcuccgagcgcuccuggauggacgacuacgacuacguccaccuccagggcaaggaggaguucgagcgccagcagaaggagcuccucgagaaggagaacaucaugaagcagaacaagaugcagcucgagcaccaccagcucucccaguuccagcuccucgagcaggagaucaccaagcccgucgagaacgacaucuccaaguggaagcccucccagucccuccccaccaccaacuccggcgucuccgcccaggaccgccagcuccucugcuucuacuacgaccagugcgagacccacuucaucucccuccucaacgccaucgacgcccucuucuccugcgucuccuccgcccagcccccccgcaucuucgucgcccacuccaaguucgucauccucuccgcccacaagcucgucuucaucggcgacacccucacccgccaggucaccgcccaggacauccgcaacaaggucaugaacuccuccaaccagcucugcgagcagcucaagaccaucgucauggccaccaagauggccgcccuccacuaccccuccaccaccgcccuccaggagaugguccaccaggucaccgaccucucccgcaacgcccagcucuucaagcgcucccuccucgagauggccaccuucuga

SEQ ID NO: 46559 - RNA, 3063 nt, Artificial Sequence
  derived and/or modified sequence opt2 from NEFH__Homo_sapiens__NP_066554
augauguccuucggcggcgccgacgcccuccucggcgcccccuucgccccccuccacggcggcggcucccuccacuacgcccucgcccgcaagggcggcgccggcggcacccgcuccgccgccggcuccuccuccggcuuccacuccuggacccgcaccuccgucuccuccgucuccgccucccccucccgcuuccgcggcgccggcgccgccuccuccaccgacucccucgacacccucuccaacggccccgagggcugcauggucgccgucgccaccucccgcuccgagaaggagcagcuccaggcccucaacgaccgcuucgccggcuacaucgacaagguccgccagcucgaggcccacaaccgcucccucgagggcgaggccgccgcccuccgccagcagcaggccggccgcuccgccaugggcgagcucuacgagcgcgagguccgcgagaugcgcggcgccguccuccgccucggcgccgcccgcggccagcuccgccucgagcaggagcaccuccucgaggacaucgcccacguccgccagcgccucgacgacgaggcccgccagcgcgaggaggccgaggccgccgcccgcgcccucgcccgcuucgcccaggaggccgaggccgcccgcgucgaccuccagaagaaggcccaggcccuccaggaggagugcggcuaccuccgccgccaccaccaggaggaggucggcgagcuccucggccagauccagggcuccggcgccgcccaggcccagaugcaggccgagacccgcgacgcccucaagugcgacgucaccuccgcccuccgcgagauccgcgcccagcucgagggccacgccguccaguccacccuccaguccgaggagugguuccgcguccgccucgaccgccucuccgaggccgccaaggucaacaccgacgccaugcgcuccgcccaggaggagaucaccgaguaccgccgccagcuccaggcccgcaccaccgagcucgaggcccucaaguccaccaaggacucccucgagcgccagcgcuccgagcucgaggaccgccaccaggccgacaucgccuccuaccaggaggccauccagcagcucgacgccgagcuccgcaacaccaagugggagauggccgcccagcuccgcgaguaccaggaccuccucaacgucaagauggcccucgacaucgagaucgccgccuaccgcaagcuccucgagggcgaggagugccgcaucggcuucggccccauccccuucucccuccccgagggccuccccaagauccccuccgucuccacccacaucaaggucaaguccgaggagaagaucaaggucgucgagaaguccgagaaggagaccgucaucgucgaggagcagaccgaggagacccaggucaccgaggaggucaccgaggaggaggagaaggaggccaaggaggaggagggcaaggaggaggagggcggcgaggaggaggaggccgagggcggcgaggaggagaccaaguccccccccgccgaggaggccgccucccccgagaaggaggccaagucccccgucaaggaggaggccaagucccccgccgaggccaagucccccgagaaggaggaggccaagucccccgccgaggucaagucccccgagaaggccaagucccccgccaaggaggaggccaaguccccccccgaggccaagucccccgagaaggaggaggccaagucccccgccgaggucaagucccccgagaaggccaagucccccgccaaggaggaggccaagucccccgccgaggccaagucccccgagaaggccaagucccccgucaaggaggaggccaagucccccgccgaggccaagucccccgucaaggaggaggccaagucccccgccgaggucaagucccccgagaaggccaagucccccaccaaggaggaggccaagucccccgagaaggccaagucccccgagaaggaggaggccaagucccccgagaaggccaagucccccgucaaggccgaggccaagucccccgagaaggccaagucccccgucaaggccgaggccaagucccccgagaaggccaagucccccgucaaggaggaggccaagucccccgagaaggccaagucccccgucaaggaggaggccaagucccccgagaaggccaagucccccgucaaggaggaggccaagacccccgagaaggccaagucccccgucaaggaggaggccaagucccccgagaaggccaagucccccgagaaggccaagacccucgacgucaagucccccgaggccaagacccccgccaaggaggaggcccgcucccccgccgacaaguuccccgagaaggccaagucccccgucaaggaggaggucaagucccccgagaaggccaaguccccccucaaggaggacgccaaggcccccgagaaggagauccccaagaaggaggaggucaagucccccgucaaggaggaggagaagccccaggaggucaaggucaaggagccccccaagaaggccgaggaggagaaggcccccgccacccccaagaccgaggagaagaaggacuccaagaaggaggaggcccccaagaaggaggcccccaagcccaaggucgaggagaagaaggagcccgccgucgagaagcccaaggaguccaaggucgaggccaagaaggaggaggccgaggacaagaagaagguccccacccccgagaaggaggcccccgccaaggucgaggucaaggaggacgccaagcccaaggagaagaccgaggucgccaagaaggagcccgacgacgccaaggccaaggagcccuccaagcccgccgagaagaaggaggccgcccccgagaagaaggacaccaaggaggagaaggccaagaagcccgaggagaagcccaagaccgaggccaaggccaaggaggacgacaagacccucuccaaggagcccuccaagcccaaggccgagaaggccgagaaguccuccuccaccgaccagaaggacuccaagccccccgagaaggccaccgaggacaaggccgccaagggcaaguga

SEQ ID NO: 46560 - RNA, 1623 nt, Artificial Sequence
  derived and/or modified sequence opt2 from NEFM__Homo_sapiens__NP_001099011
auggcccgccaccuccgcgaguaccaggaccuccucaacgucaagauggcccucgacaucgagaucgccgccuaccgcaagcuccucgagggcgaggagacccgcuucuccaccuucgccggcuccaucaccggcccccucuacacccaccgcccccccaucaccaucuccuccaagauccagaagcccaaggucgaggcccccaagcucaagguccagcacaaguucgucgaggagaucaucgaggagaccaaggucgaggacgagaaguccgagauggaggaggcccucaccgccaucaccgaggagcucgccgucuccaugaaggaggagaagaaggaggccgccgaggagaaggaggaggagcccgaggccgaggaggaggaggucgccgccaagaagucccccgucaaggccaccgcccccgaggucaaggaggaggagggcgagaaggaggaggaggagggccaggaggaggaggaggaggaggacgagggcgccaaguccgaccaggccgaggagggcggcuccgagaaggagggcuccuccgagaaggaggagggcgagcaggaggagggcgagaccgaggccgaggccgagggcgaggaggccgaggccaaggaggagaagaaggucgaggagaaguccgaggaggucgccaccaaggaggagcucgucgccgacgccaaggucgagaagcccgagaaggccaagucccccguccccaagucccccgucgaggagaagggcaagucccccguccccaagucccccgucgaggagaagggcaagucccccguccccaagucccccgucgaggagaagggcaagucccccguccccaagucccccgucgaggagaagggcaagucccccgucuccaagucccccgucgaggagaaggccaagucccccguccccaagucccccgucgaggaggccaaguccaaggccgaggucggcaagggcgagcagaaggaggaggaggagaaggaggucaaggaggcccccaaggaggagaaggucgagaagaaggaggagaagcccaaggacguccccgagaagaagaaggccgagucccccgucaaggaggaggccgucgccgaggucgucaccaucaccaaguccgucaagguccaccucgagaaggagaccaaggaggagggcaagccccuccagcaggagaaggagaaggagaaggccggcggcgagggcggcuccgaggaggagggcuccgacaagggcgccaagggcucccgcaaggaggacaucgccgucaacggcgaggucgagggcaaggaggaggucgagcaggagaccaaggagaagggcuccggccgcgaggaggagaagggcgucgucaccaacggccucgaccucucccccgccgacgagaagaagggcggcgacaaguccgaggagaaggucgucgucaccaagaccgucgagaagaucaccuccgagggcggcgacggcgccaccaaguacaucaccaaguccgucaccgucacccagaaggucgaggagcacgaggagaccuucgaggagaagcucgucuccaccaagaaggucgagaaggucaccucccacgccaucgucaaggaggucacccaguccgacuga

SEQ ID NO: 46561 - RNA, 1431 nt, Artificial Sequence
  derived and/or modified sequence opt2 from NEIL1__Homo_sapiens__NP_001243481
augggccgcaccggcccccgcgccccccuccuccccaagacccgcaucuggucccucaccuucucccgcaagaccucccccgucggcgcccgccccggcgccgccccccgcugcggcggcggcaagguccgcgccuccgccgucgccaagugcccccucccccucaaggcccaccuccgccuccgcuuccgcaccgcccgcggccagcgccaggucgccaagcagggcggccgccgcacccucccccccucccuccgcaugcccgagggccccgagcuccaccucgccucccaguucgucaacgaggccugccgcgcccucgucuucggcggcugcgucgagaaguccuccgucucccgcaaccccgagguccccuucgaguccuccgccuaccgcaucuccgccuccgcccgcggcaaggagcuccgccucauccucuccccccuccccggcgcccagccccagcaggagccccucgcccucgucuuccgcuucggcauguccggcuccuuccagcucgucccccgcgaggagcucccccgccacgcccaccuccgcuucuacaccgccccccccggcccccgccucgcccucugcuucgucgacauccgccgcuucggccgcugggaccucggcggcaaguggcagcccggccgcggccccugcguccuccaggaguaccagcaguuccgcgagaacguccuccgcaaccucgccgacaaggccuucgaccgccccaucugcgaggcccuccucgaccagcgcuucuucaacggcaucggcaacuaccuccgcgccgagauccucuaccgccucaagaucccccccuucgagaaggcccgcuccguccucgaggcccuccagcagcaccgccccucccccgagcucacccucucccagaagauccgcaccaagcuccagaaccccgaccuccucgagcucugccacuccguccccaaggaggucguccagcucggcggcaagggcuacggcuccgaguccggcgaggaggacuucgccgccuuccgcgccuggcuccgcugcuacggcaugcccggcauguccucccuccaggaccgccacggccgcaccaucugguuccagggcgaccccggcccccucgcccccaagggccgcaagucccgcaagaagaaguccaaggccacccagcucucccccgaggaccgcgucgaggacgcccucccccccuccaaggcccccucccgcacccgccgcgccaagcgcgaccuccccaagcgcaccgccacccagcgccccgagggcaccucccuccagcaggaccccgaggcccccaccguccccaagaagggccgccgcaagggccgccaggccgccuccggccacugccgcccccgcaaggucaaggccgacauccccucccucgagcccgagggcaccuccgccuccuga

SEQ ID NO: 46562 - RNA, 816 nt, Artificial Sequence
  derived and/or modified sequence opt2 from NEIL2__Homo_sapiens__NP_001129219
augggcccccccggcuccucccccacccccgagcccccccagaaggagguccagaaggagggcgccgccgaccccaagcaggucggcgagcccuccggccagaagacccucgacggcuccucccgcuccgccgagcucgucccccagggcgaggacgacuccgaguaccucgagcgcgacgcccccgccggcgacgccggccgcuggcuccgcgucuccuucggccucuucggcuccgucugggucaacgacuucucccgcgccaagaaggccaacaagcgcggcgacuggcgcgaccccuccccccgccucguccuccacuucggcggcggcggcuuccucgccuucuacaacugccagcucuccugguccuccucccccgucgucacccccaccugcgacauccucuccgagaaguuccaccgcggccaggcccucgaggcccucggccaggcccagcccgucugcuacacccuccucgaccagcgcuacuucuccggccucggcaacaucaucaagaacgaggcccucuaccgcgccggcauccacccccucucccucggcuccguccucuccgccucccgccgcgagguccucgucgaccacgucgucgaguucuccaccgccuggcuccagggcaaguuccagggccgcccccagcacacccaggucuaccagaaggagcagugccccgccggccaccaggucaugaaggaggccuucggccccgaggacggccuccagcgccucaccugguggugcccccagugccagccccagcucuccgaggagcccgagcagugccaguucuccuga

SEQ ID NO: 46563 - RNA, 1818 nt, Artificial Sequence
  derived and/or modified sequence opt2 from NEIL3__Homo_sapiens__NP_060718
auggucgagggccccggcugcacccucaacggcgagaagauccgcgcccgcguccuccccggccaggccgucaccggcguccgcggcuccgcccuccgcucccuccagggccgcgcccuccgccucgccgccuccaccgucgucgucuccccccaggccgccgcccucaacaacgacuccucccagaacguccucucccucuucaacggcuacgucuacuccggcgucgagacccucggcaaggagcucuucauguacuucggccccaaggcccuccgcauccacuucggcaugaagggcuucaucaugaucaacccccucgaguacaaguacaagaacggcgccucccccguccucgagguccagcucaccaaggaccucaucugcuucuucgacuccuccgucgagcuccgcaacuccauggagucccagcagcgcauccgcaugaugaaggagcucgacgucugcucccccgaguucuccuuccuccgcgccgaguccgaggucaagaagcagaagggccgcaugcucggcgacguccucauggaccagaacguccuccccggcgucggcaacaucaucaagaacgaggcccucuucgacuccggccuccaccccgccgucaaggucugccagcucaccgacgagcagauccaccaccucaugaagaugauccgcgacuucuccauccucuucuaccgcugccgcaaggccggccucgcccucuccaagcacuacaaggucuacaagcgccccaacugcggccagugccacugccgcaucaccgucugccgcuucggcgacaacaaccgcaugaccuacuucugcccccacugccagaaggagaacccccagcacgucgacaucugcaagcuccccacccgcaacaccaucaucuccuggaccuccucccgcgucgaccacgucauggacuccgucgcccgcaaguccgaggagcacuggaccugcgucgucugcacccucaucaacaagcccuccuccaaggccugcgacgccugccucaccucccgccccaucgacuccguccucaaguccgaggagaacuccaccgucuucucccaccucaugaaguaccccugcaacaccuucggcaagccccacaccgaggucaagaucaaccgcaagaccgccuucggcaccaccacccucguccucaccgacuucuccaacaaguccuccacccucgagcgcaagaccaagcagaaccagauccucgacgaggaguuccagaacuccccccccgccuccgucugccucaacgacauccagcaccccuccaagaagaccaccaacgacaucacccagcccuccuccaaggucaacaucucccccaccaucuccuccgaguccaagcucuucucccccgcccacaagaagcccaagaccgcccaguacuccucccccgagcucaaguccugcaaccccggcuacuccaacuccgagcuccagaucaacaugaccgacggcccccgcacccucaaccccgacuccccccgcugcuccaagcacaaccgccucugcauccuccgcgucguccgcaaggacggcgagaacaagggccgccaguucuacgccugcccccucccccgcgaggcccagugcggcuucuucgagugggccgaccucuccuuccccuucugcaaccacggcaagcgcuccaccaugaagaccguccucaagaucggccccaacaacggcaagaacuucuucgucugcccccucggcaaggagaagcagugcaacuucuuccagugggccgagaacggccccggcaucaagaucauccccggcugcuga

SEQ ID NO: 46564 - RNA, 1425 nt, Artificial Sequence
  derived and/or modified sequence opt2 from NEK10__Homo_sapiens__NP_001026911
augguccccguccagcccgccgagccccccgagguccucaaguccgagcccuacggcgagaaggccgacgucugggccgucggcugcauccucuaccagauggccacccucuccccccccuucuacuccaccaacaugcucucccucgccaccaagaucgucgaggccgucuacgagcccguccccgagggcaucuacuccgagaaggucaccgacaccaucucccgcugccucacccccgacgccgaggcccgccccgacaucgucgaggucuccuccaugaucuccgacgucaugaugaaguaccucgacaaccucuccaccucccagcucucccucgagaagaagcucgagcgcgagcgccgccgcacccagcgcuacuucauggaggccaaccgcaacaccgucaccugccaccacgagcucgccguccucucccacgagaccuucgagaaggccucccucuccuccuccuccuccggcgccgccucccucaaguccgagcucuccgaguccgccgaccucccccccgagggcuuccaggccuccuacggcaaggacgaggaccgcgccugcgacgagauccucuccgacgacaacuucaaccucgagaacgccgagaaggacaccuacuccgaggucgacgacgagcucgacaucuccgacaacuccuccuccuccuccuccuccccccucaaggaguccaccuucaacauccucaagcgcuccuucuccgccuccggcggcgagcgccagucccagacccgcgacuucaccggcggcaccggcucccgcccccgccccgcccuccucccccucgaccuccuccucaagguccccccccacaugcuccgcgcccacaucaaggagaucgaggccgagcucgucaccggcuggcagucccacucccuccccgccgucauccuccgcaaccucaaggaccacgccuccgccggcaucgccgucucccagcgcaagguccgccagaucuccgaccccauccagcagauccucauccagcuccacaagaucaucuacaucacccagcucccccccgcccuccaccacaaccucaagcgccgcgucaucgagcgcuucaagaagucccucuucucccagcaguccaaccccugcaaccucaaguccgagaucaagaagcucucccagggcucccccgagcccaucgagcccaacuucuucaccgccgacuaccaccuccuccaccgcuccuccggcggcaacucccucucccccaacgaccccaccggccuccccaccuccaucgagcucgaggagggcaucaccuacgagcagaugcagaccgucaucgaggagguccucgaggaguccggcuacuacaacuucaccuccaaccgcuaccacuccuaccccuggggcaccaagaaccaccccaccaagcgcuga

SEQ ID NO: 46565 - RNA, 1800 nt, Artificial Sequence
  derived and/or modified sequence opt2 from NEK11__Homo_sapiens__NP_001139475
augcucaaguuccaggaggccgccaagugcgucuccggcuccaccgccaucuccaccuaccccaagacccucaucgcccgccgcuacguccuccagcagaagcucggcuccggcuccuucggcaccgucuaccucgucuccgacaagaaggccaagcgcggcgaggagcucaagguccucaaggagaucuccgucggcgagcucaaccccaacgagaccguccaggccaaccucgaggcccagcuccucuccaagcucgaccaccccgccaucgucaaguuccacgccuccuucgucgagcaggacaacuucugcaucaucaccgaguacugcgagggccgcgaccucgacgacaagauccaggaguacaagcaggccggcaagaucuuccccgagaaccagaucaucgagugguucauccagcuccuccucggcgucgacuacaugcacgagcgccgcauccuccaccgcgaccucaaguccaagaacgucuuccucaagaacaaccuccucaagaucggcgacuucggcgucucccgccuccucaugggcuccugcgaccucgccaccacccucaccggcaccccccacuacaugucccccgaggcccucaagcaccagggcuacgacaccaaguccgacaucuggucccucgccugcauccucuacgagaugugcugcaugaaccacgccuucgccggcuccaacuuccucuccaucguccucaagaucgucgagggcgacacccccucccuccccgagcgcuaccccaaggagcucaacgccaucauggaguccaugcucaacaagaaccccucccuccgccccuccgccaucgagauccucaagauccccuaccucgacgagcagcuccagaaccucaugugccgcuacuccgagaugacccucgaggacaagaaccucgacugccagaaggaggccgcccacaucaucaacgccaugcagaagcgcauccaccuccagacccuccgcgcccucuccgagguccagaagaugaccccccgcgagcgcaugcgccuccgcaagcuccaggccgccgacgagaaggcccgcaagcucaagaagaucgucgaggagaaguacgaggagaacuccaagcgcaugcaggagcuccgcucccgcaacuuccagcagcucuccgucgacguccuccacgagaagacccaccucaagggcauggaggagaaggaggagcagcccgagggccgccucuccugcuccccccaggacgaggacgaggagcgcuggcagggccgcgaggaggaguccgacgagcccacccucgagaaccuccccgagucccagcccauccccuccauggaccuccacgagcucgaguccaucgucgaggacgccaccuccgaccucggcuaccacgagauccccgaggacccccucgucgccgaggaguacuacgccgacgccuucgacuccuacugcgaggaguccgacgaggaggaggaggagaucgcccucgagcgccccgagaaggagauccgcaacgagggcucccagcccgccuaccgcaccaaccagcaggacuccgacaucgaggcccucgcccgcugccucgagaacguccucggcugcaccucccucgaccagcccugccgcuccuggggccagaaguaccucaagcgcuccaucaucaccucccgcgagcagggcauccgcaugcucgccaagcagcgcuccgccuccgucuggaagaaguggugccucaagcccgccaccguccucaaguggaccuccuccugcacccucaaguccuccugcuga

SEQ ID NO: 46566 - RNA, 3861 nt, Artificial Sequence
  derived and/or modified sequence opt2 from NEK1__Homo_sapiens__NP_001186326
auggagaaguacguccgccuccagaagaucggcgagggcuccuucggcaaggccauccucgucaaguccaccgaggacggccgccaguacgucaucaaggagaucaacaucucccgcauguccuccaaggagcgcgaggagucccgccgcgaggucgccguccucgccaacaugaagcaccccaacaucguccaguaccgcgaguccuucgaggagaacggcucccucuacaucgucauggacuacugcgagggcggcgaccucuucaagcgcaucaacgcccagaagggcguccucuuccaggaggaccagauccucgacugguucguccagaucugccucgcccucaagcacguccacgaccgcaagauccuccaccgcgacaucaagucccagaacaucuuccucaccaaggacggcaccguccagcucggcgacuucggcaucgcccgcguccucaacuccaccgucgagcucgcccgcaccugcaucggcacccccuacuaccucucccccgagaucugcgagaacaagcccuacaacaacaaguccgacaucugggcccucggcugcguccucuacgagcucugcacccucaagcacgccuucgaggccggcuccaugaagaaccucguccucaagaucaucuccggcuccuucccccccgucucccuccacuacuccuacgaccuccgcucccucgucucccagcucuucaagcgcaacccccgcgaccgccccuccgucaacuccauccucgagaagggcuucaucgccaagcgcaucgagaaguuccucuccccccagcucaucgccgaggaguucugccucaagaccuucuccaaguucggcucccagcccauccccgccaagcgccccgccuccggccagaacuccaucuccgucaugcccgcccagaagaucaccaagcccgccgccaaguacggcaucccccucgccuacaagaaguacggcgacaagaagcuccacgagaagaagccccuccagaagcacaagcaggcccaccagacccccgagaagcgcgucaacaccggcgaggagcgccgcaagaucuccgaggaggccgcccgcaagcgccgccucgaguucaucgagaaggagaagaagcagaaggaccagaucaucucccucaugaaggccgagcagaugaagcgccaggagaaggagcgccucgagcgcaucaaccgcgcccgcgagcagggcuggcgcaacguccucuccgccggcggcuccggcgaggucaaggcccccuuccucggcuccggcggcaccaucgcccccuccuccuucuccucccgcggccaguacgagcacuaccacgccaucuucgaccagaugcagcagcagcgcgccgaggacaacgaggccaaguggaagcgcgagaucuacggccgcggccuccccgagcgcggcauccuccccggcguccgccccggcuuccccuacggcgccgccggccaccaccacuuccccgacgccgacgacauccgcaagacccucaagcgccucaaggccgucuccaagcaggccaacgccaaccgccagaagggccagcucgccgucgagcgcgccaagcaggucgaggaguuccuccagcgcaagcgcgaggccaugcagaacaaggcccgcgccgagggccacaugggcauccuccagaaccucgccgccauguacggcggccgccccuccuccucccgcggcggcaagccccgcaacaaggaggaggaggucuaccucgcccgccuccgccagauccgccuccagaacuucaacgagcgccagcagaucaaggccaagcuccgcggcgagaagaaggaggccaaccacuccgagggccaggagggcuccgaggaggccgacaugcgccgcaagaagaucgagucccucaaggcccacgccaacgcccgcgccgccguccucaaggagcagcucgagcgcaagcgcaaggaggccuacgagcgcgagaagaaggucugggaggagcaccucgucgccaagggcgucaaguccuccgacgucucccccccccucggccagcacgagaccggcggcucccccuccaagcagcagaugcgcuccgucaucuccgucaccuccgcccucaaggaggucggcgucgacuccucccucaccgacacccgcgagaccuccgaggagaugcagaagaccaacaacgccaucuccuccaagcgcgagauccuccgccgccucaacgagaaccucaaggcccaggaggacgagaagggcaagcagaaccucuccgacaccuucgagaucaacguccacgaggacgccaaggagcacgagaaggagaaguccgucuccuccgaccgcaagaagugggaggccggcggccagcucgucaucccccucgacgagcucacccucgacaccuccuucuccaccaccgagcgccacaccgucggcgaggucaucaagcucggccccaacggcuccccccgccgcgccuggggcaagucccccaccgacuccguccucaagauccucggcgaggccgagcuccagcuccagaccgagcuccucgagaacaccaccauccgcuccgagaucucccccgagggcgagaaguacaagccccucaucaccggcgagaagaagguccagugcaucucccacgagaucaaccccuccgccaucgucgacucccccgucgagaccaagucccccgaguucuccgaggccuccccccagaugucccucaagcucgagggcaaccucgaggagcccgacgaccucgagaccgagauccuccaggagcccuccggcaccaacaaggacgagucccuccccugcaccaucaccgacgucuggaucuccgaggagaaggagaccaaggagacccaguccgccgaccgcaucaccauccaggagaacgaggucuccgaggacggcgucuccuccaccgucgaccagcucuccgacauccacaucgagcccggcaccaacgacucccagcacuccaagugcgacgucgacaaguccguccagcccgagcccuucuuccacaaggucguccacuccgagcaccucaaccucgucccccagguccaguccguccagugcucccccgaggaguccuucgccuuccgcucccacucccaccucccccccaagaacaagaacaagaacucccuccucaucggccucuccaccggccucuucgacgccaacaaccccaagaugcuccgcaccugcucccuccccgaccucuccaagcucuuccgcacccucauggacguccccaccgucggcgacguccgccaggacaaccucgagaucgacgagaucgaggacgagaacaucaaggagggccccuccgacuccgaggacaucgucuucgaggagaccgacaccgaccuccaggagcuccaggccuccauggagcagcuccuccgcgagcagcccggcgaggaguacuccgaggaggaggaguccguccucaagaacuccgacgucgagcccaccgccaacggcaccgacgucgccgacgaggacgacaaccccuccuccgaguccgcccucaacgaggaguggcacuccgacaacuccgacggcgagaucgccuccgagugcgagugcgacuccgucuucaaccaccucgaggagcuccgccuccaccucgagcaggagaugggcuucgagaaguucuucgaggucuacgagaagaucaaggccauccacgaggacgaggacgagaacaucgagaucugcuccaagaucguccagaacauccucggcaacgagcaccagcaccucuacgccaagauccuccaccucgucauggccgacggcgccuaccaggaggacaacgacgaguga

SEQ ID NO: 46567 - RNA, 1155 nt, Artificial Sequence
  derived and/or modified sequence opt2 from NEK2__Homo_sapiens__NP_001191112
augcccucccgcgccgaggacuacgagguccucuacaccaucggcaccggcuccuacggccgcugccagaagauccgccgcaaguccgacggcaagauccucgucuggaaggagcucgacuacggcuccaugaccgaggccgagaagcagaugcucgucuccgaggucaaccuccuccgcgagcucaagcaccccaacaucguccgcuacuacgaccgcaucaucgaccgcaccaacaccacccucuacaucgucauggaguacugcgagggcggcgaccucgccuccgucaucaccaagggcaccaaggagcgccaguaccucgacgaggaguucguccuccgcgucaugacccagcucacccucgcccucaaggagugccaccgccgcuccgacggcggccacaccguccuccaccgcgaccucaagcccgccaacgucuuccucgacggcaagcagaacgucaagcucggcgacuucggccucgcccgcauccucaaccacgacaccuccuucgccaagaccuucgucggcacccccuacuacaugucccccgagcagaugaaccgcauguccuacaacgagaaguccgacaucuggucccucggcugccuccucuacgagcucugcgcccucaugccccccuucaccgccuucucccagaaggagcucgccggcaagauccgcgagggcaaguuccgccgcauccccuaccgcuacuccgacgagcucaacgagaucaucacccgcaugcucaaccucaaggacuaccaccgccccuccgucgaggagauccucgagaacccccucaucgccgaccucgucgccgacgagcagcgccgcaaccucgagcgccgcggccgccagcucggcgagcccgagaagucccaggacuccucccccguccucuccgagcucaagcucaaggagauccagcuccaggagcgcgagcgcgcccucaaggcccgcgaggagcgccucgagcagaaggagcaggagcucugcguccgcgagcgccucgccgaggacaagcucgcccgcgccgagaaccuccucaagaacuacucccuccucaaggagcgcaaguuccucucccucgccuccaaccccggcaugcgcaucaaccucgucaaccgcuccuggugcuacaaguga

SEQ ID NO: 46568 - RNA, 1521 nt, Artificial Sequence
  derived and/or modified sequence opt2 from NEK3__Homo_sapiens__NP_002489
auggacgacuacaugguccuccgcaugaucggcgagggcuccuucggccgcgcccuccucguccagcacgaguccuccaaccagauguucgccaugaaggagauccgccuccccaaguccuucuccaacacccagaacucccgcaaggaggccguccuccucgccaagaugaagcaccccaacaucgucgccuucaaggaguccuucgaggccgagggccaccucuacaucgucauggaguacugcgacggcggcgaccucaugcagaagaucaagcagcagaagggcaagcucuuccccgaggacaugauccucaacugguucacccagaugugccucggcgucaaccacauccacaagaagcgcguccuccaccgcgacaucaaguccaagaacaucuuccucacccagaacggcaaggucaagcucggcgacuucggcuccgcccgccuccucuccaaccccauggccuucgccugcaccuacgucggcacccccuacuacgucccccccgagaucugggagaaccuccccuacaacaacaaguccgacaucuggucccucggcugcauccucuacgagcucugcacccucaagcaccccuuccaggccaacuccuggaagaaccucauccucaaggucugccagggcugcaucuccccccuccccucccacuacuccuacgagcuccaguuccucgucaagcagauguucaagcgcaaccccucccaccgccccuccgccaccacccuccucucccgcggcaucgucgcccgccucguccagaagugccucccccccgagaucaucauggaguacggcgaggagguccucgaggagaucaagaacuccaagcacaacaccccccgcaagaagaccaaccccucccgcauccgcaucgcccucggcaacgaggccuccaccguccaggaggaggagcaggaccgcaagggcucccacaccgaccucgaguccaucaacgagaaccucgucgaguccgcccuccgccgcgucaaccgcgaggagaagggcaacaaguccguccaccuccgcaaggccuccucccccaaccuccaccgccgccagugggagaagaacguccccaacaccgcccucaccgcccucgagaacgccuccauccucaccuccucccucaccgccgaggacgaccgcggcggcuccgucaucaaguacuccaagaacaccacccgcaagcaguggcucaaggagacccccgacacccuccucaacauccucaagaacgccgaccucucccucgccuuccagaccuacaccaucuaccgccccggcuccgagggcuuccucaagggcccccucuccgaggagaccgaggccuccgacuccgucgacggcggccacgacuccgucauccucgaccccgagcgccucgagcccggccucgacgaggaggacaccgacuucgaggaggaggacgacaaccccgacugggucuccgagcucaagaagcgcgccggcuggcagggccucugcgaccgcuga

SEQ ID NO: 46569 - RNA, 2259 nt, Artificial Sequence
  derived and/or modified sequence opt2 from NEK4__Homo_sapiens__NP_001180462
augccccucgccgccuacugcuaccuccgcgucgucggcaagggcuccuacggcgaggucacccucgucaagcaccgccgcgacggcaagcaguaccuccacgagaagcacauccuccaccgcgaccucaagacccagaacgucuuccucacccgcaccaacaucaucaaggucggcgaccucggcaucgcccgcguccucgagaaccacugcgacauggccuccacccucaucggcacccccuacuacaugucccccgagcucuucuccaacaagcccuacaacuacaaguccgacgucugggcccucggcugcugcgucuacgagauggccacccucaagcacgccuucaacgccaaggacaugaacucccucgucuaccgcaucaucgagggcaagcucccccccaugccccgcgacuacucccccgagcucgccgagcucauccgcaccaugcucuccaagcgccccgaggagcgccccuccguccgcuccauccuccgccagcccuacaucaagcgccagaucuccuucuuccucgaggccaccaagaucaagaccuccaagaacaacaucaagaacggcgacucccaguccaagcccuucgccaccgucgucuccggcgaggccgaguccaaccacgaggucauccacccccagccccucuccuccgagggcucccagaccuacaucaugggcgagggcaagugccucucccaggagaagccccgcgccuccggccuccucaagucccccgccucccucaaggcccacaccugcaagcaggaccucuccaacaccaccgagcucgccaccaucuccuccgucaacaucgacauccuccccgccaagggccgcgacuccgucuccgacggcuucguccaggagaaccagccccgcuaccucgacgccuccaacgagcucggcggcaucugcuccaucucccaggucgaggaggagaugcuccaggacaacaccaaguccuccgcccagcccgagaaccucauccccaugugguccuccgacaucgucaccggcgagaagaacgagcccgucaagccccuccagccccucaucaaggagcagaagcccaaggaccagucccucgcccucucccccaagcucgagugcuccggcaccauccucgcccacuccaaccuccgccuccucggcuccuccgacucccccgccuccgccucccgcgucgccggcaucaccggcgucugccaccacgcccaggaccaggucgccggcgagugcaucaucgagaagcagggccgcauccaccccgaccuccagccccacaacuccggcuccgagcccucccucucccgccagcgccgccagaagcgccgcgagcagaccgagcaccgcggcgagaagcgccagguccgccgcgaccucuucgccuuccaggagucccccccccgcuuccuccccucccaccccaucgucggcaaggucgacgucaccuccacccagaaggaggccgagaaccagcgccgcgucgucaccggcuccgucuccuccucccgcuccuccgagauguccuccuccaaggaccgcccccucuccgcccgcgagcgccgccgccucaagcagucccaggaggagauguccuccuccggccccuccguccgcaaggccucccucuccgucgccggccccggcaagccccaggaggaggaccagccccuccccgcccgccgccucuccuccgacugcuccgucacccaggagcgcaagcagauccacugccucuccgaggacgagcucuccuccuccaccuccuccaccgacaaguccgacggcgacuacggcgagggcaagggccagaccaacgagaucaacgcccucguccagcucaugacccagacccucaagcucgacuccaaggaguccugcgaggacguccccgucgccaaccccgucuccgaguucaagcuccaccgcaaguaccgcgacacccucauccuccacggcaaggucgccgaggaggccgaggagauccacuucaaggagcuccccuccgccaucaugcccggcuccgagaagauccgccgccucgucgagguccuccgcaccgacgucauccgcggccucggcguccagcuccucgagcaggucuacgaccuccucgaggaggaggacgaguucgaccgcgagguccgccuccgcgagcacaugggcgagaaguacaccaccuacuccgucaaggcccgccagcucaaguucuucgaggagaacaugaacuucuga

SEQ ID NO: 46570 - RNA, 1044 nt, Artificial Sequence
  derived and/or modified sequence opt2 from NEK6__Homo_sapiens__NP_001138473
augccccgccgcgaggucugcugggaggccgcccacuuccgccaggaggagcagucccucccccgcccccgcguccgcgcccucguccgccucgccugccgcauggccggccagcccggccacaugccccacggcggcuccuccaacaaccucugccacacccucggccccguccacccccccgacccccagcgccaccccaacacccucuccuuccgcugcucccucgccgacuuccagaucgagaagaagaucggccgcggccaguucuccgaggucuacaaggccaccugccuccucgaccgcaagaccgucgcccucaagaagguccagaucuucgagaugauggacgccaaggcccgccaggacugcgucaaggagaucggccuccucaagcagcucaaccaccccaacaucaucaaguaccucgacuccuucaucgaggacaacgagcucaacaucguccucgagcucgccgacgccggcgaccucucccagaugaucaaguacuucaagaagcagaagcgccucauccccgagcgcaccgucuggaaguacuucguccagcucugcuccgccgucgagcacaugcacucccgccgcgucaugcaccgcgacaucaagcccgccaacgucuucaucaccgccaccggcgucgucaagcucggcgaccucggccucggccgcuucuucuccuccgagaccaccgccgcccacucccucgucggcacccccuacuacaugucccccgagcgcauccacgagaacggcuacaacuucaaguccgacaucuggucccucggcugccuccucuacgagauggccgcccuccagucccccuucuacggcgacaagaugaaccucuucucccucugccagaagaucgagcagugcgacuaccccccccuccccggcgagcacuacuccgagaagcuccgcgagcucgucuccaugugcaucugccccgacccccaccagcgccccgacaucggcuacguccaccaggucgccaagcagaugcacaucuggauguccuccaccuga

SEQ ID NO: 46571 - RNA, 909 nt, Artificial Sequence
  derived and/or modified sequence opt2 from NEK7__Homo_sapiens__NP_598001
auggacgagcagucccagggcaugcagggcccccccgucccccaguuccagccccagaaggcccuccgccccgacaugggcuacaacacccucgccaacuuccgcaucgagaagaagaucggccgcggccaguucuccgaggucuaccgcgccgccugccuccucgacggcguccccgucgcccucaagaagguccagaucuucgaccucauggacgccaaggcccgcgccgacugcaucaaggagaucgaccuccucaagcagcucaaccaccccaacgucaucaaguacuacgccuccuucaucgaggacaacgagcucaacaucguccucgagcucgccgacgccggcgaccucucccgcaugaucaagcacuucaagaagcagaagcgccucauccccgagcgcaccgucuggaaguacuucguccagcucugcuccgcccucgagcacaugcacucccgccgcgucaugcaccgcgacaucaagcccgccaacgucuucaucaccgccaccggcgucgucaagcucggcgaccucggccucggccgcuucuucuccuccaagaccaccgccgcccacucccucgucggcacccccuacuacaugucccccgagcgcauccacgagaacggcuacaacuucaaguccgacaucuggucccucggcugccuccucuacgagauggccgcccuccagucccccuucuacggcgacaagaugaaccucuacucccucugcaagaagaucgagcagugcgacuaccccccccuccccuccgaccacuacuccgaggagcuccgccagcucgucaacaugugcaucaaccccgaccccgagaagcgccccgacgucaccuacgucuacgacgucgccaagcgcaugcacgccugcaccgccuccuccuga

SEQ ID NO: 46572 - RNA, 2079 nt, Artificial Sequence
  derived and/or modified sequence opt2 from NEK8__Homo_sapiens__NP_835464
auggagaaguacgagcgcauccgcgucgucggccgcggcgccuucggcaucguccaccucugccuccgcaaggccgaccagaagcucgucaucaucaagcagauccccgucgagcagaugaccaaggaggagcgccaggccgcccagaacgagugccagguccucaagcuccucaaccaccccaacgucaucgaguacuacgagaacuuccucgaggacaaggcccucaugaucgccauggaguacgcccccggcggcacccucgccgaguucauccagaagcgcugcaacucccuccucgaggaggagaccauccuccacuucuucguccagauccuccucgcccuccaccacguccacacccaccucauccuccaccgcgaccucaagacccagaacauccuccucgacaagcaccgcauggucgucaagaucggcgacuucggcaucuccaagauccucuccuccaaguccaaggccuacaccgucgucggcacccccugcuacaucucccccgagcucugcgagggcaagcccuacaaccagaaguccgacaucugggcccucggcugcguccucuacgagcucgccucccucaagcgcgccuucgaggccgccaaccuccccgcccucguccucaagaucauguccggcaccuucgcccccaucuccgaccgcuacucccccgagcuccgccagcucguccucucccuccucucccucgagcccgcccagcgccccccccucucccacaucauggcccagccccucugcauccgcgcccuccucaaccuccacaccgacgucggcuccguccgcaugcgccgcgccgagaaguccgucgcccccuccaacaccggcucccgcaccaccuccguccgcugccgcggcaucccccgcggccccguccgccccgccaucccccccccccucuccuccgucuacgccuggggcggcggccucggcaccccccuccgccuccccaugcucaacaccgaggucguccaggucgccgccggccgcacccagaaggccggcgucacccgcuccggccgccucauccucugggaggcccccccccucggcgccggcggcggcucccuccuccccggcgccgucgagcagccccagccccaguucaucucccgcuuccucgagggccaguccggcgucaccaucaagcacgucgccugcggcgacuucuucaccgccugccucaccgaccgcggcaucaucaugaccuucggcuccggcuccaacggcugccucggccacggcucccucaccgacaucucccagcccaccaucgucgaggcccuccucggcuacgagaugguccaggucgccugcggcgccucccacguccucgcccucuccaccgagcgcgagcucuucgccuggggccgcggcgacuccggccgccucggccucggcacccgcgagucccacuccugcccccagcagguccccaugccccccggccaggaggcccagcgcgucgucugcggcaucgacuccuccaugauccucaccguccccggccaggcccucgccugcggcuccaaccgcuucaacaagcucggccucgaccaccucucccucggcgaggagcccgucccccaccagcaggucgaggaggcccucuccuucacccuccucggcuccgccccccucgaccaggagccccuccucuccaucgaccucggcaccgcccacuccgccgccgucaccgccuccggcgacugcuacaccuucggcuccaaccagcacggccagcucggcaccaacacccgccgcggcucccgcgcccccugcaagguccagggccucgagggcaucaagauggccauggucgccugcggcgacgccuucaccgucgccaucggcgccgaguccgaggucuacuccuggggcaagggcgcccgcggccgccucggccgccgcgacgaggacgccggccucccccgccccguccagcucgacgagacccaccccuacaccgucaccuccgucuccugcugccacggcaacacccuccucgccguccgcuccgucaccgacgagcccgucccccccuga

SEQ ID NO: 46573 - RNA, 2940 nt, Artificial Sequence
  derived and/or modified sequence opt2 from NEK9__Homo_sapiens__NP_149107
auguccguccucggcgaguacgagcgccacugcgacuccaucaacuccgacuucggcuccgaguccggcggcugcggcgacuccucccccggccccuccgccucccagggcccccgcgccggcggcggcgccgccgagcaggaggagcuccacuacauccccauccgcguccucggccgcggcgccuucggcgaggccacccucuaccgccgcaccgaggacgacucccucgucgucuggaaggaggucgaccucacccgccucuccgagaaggagcgccgcgacgcccucaacgagaucgucauccucgcccuccuccagcacgacaacaucaucgccuacuacaaccacuucauggacaacaccacccuccucaucgagcucgaguacugcaacggcggcaaccucuacgacaagauccuccgccagaaggacaagcucuucgaggaggagauggucgucugguaccucuuccagaucgucuccgccgucuccugcauccacaaggccggcauccuccaccgcgacaucaagacccucaacaucuuccucaccaaggccaaccucaucaagcucggcgacuacggccucgccaagaagcucaacuccgaguacuccauggccgagacccucgucggcacccccuacuacaugucccccgagcucugccagggcgucaaguacaacuucaaguccgacaucugggccgucggcugcgucaucuucgagcuccucacccucaagcgcaccuucgacgccaccaacccccucaaccucugcgucaagaucguccagggcauccgcgccauggaggucgacuccucccaguacucccucgagcucauccagaugguccacuccugccucgaccaggaccccgagcagcgccccaccgccgacgagcuccucgaccgcccccuccuccgcaagcgccgccgcgagauggaggagaaggucacccuccucaacgcccccaccaagcgcccccgcuccuccaccgucaccgaggcccccaucgccgucgucaccucccgcaccuccgaggucuacgucuggggcggcggcaaguccaccccccagaagcucgacgucaucaaguccggcugcuccgcccgccaggucugcgccggcaacacccacuucgccgucgucaccgucgagaaggagcucuacaccugggucaacaugcagggcggcaccaagcuccacggccagcucggccacggcgacaaggccuccuaccgccagcccaagcacgucgagaagcuccagggcaaggccauccgccaggucuccugcggcgacgacuucaccgucugcgucaccgacgagggccagcucuacgccuucggcuccgacuacuacggcugcaugggcgucgacaaggucgccggccccgagguccucgagcccaugcagcucaacuucuuccucuccaaccccgucgagcaggucuccugcggcgacaaccacgucgucguccucacccgcaacaaggaggucuacuccuggggcugcggcgaguacggccgccucggccucgacuccgaggaggacuacuacaccccccagaaggucgacguccccaaggcccucaucaucgucgccguccagugcggcugcgacggcaccuuccuccucacccaguccggcaagguccucgccugcggccucaacgaguucaacaagcucggccucaaccagugcauguccggcaucaucaaccacgaggccuaccacgagguccccuacaccaccuccuucacccucgccaagcagcucuccuucuacaagauccgcaccaucgcccccggcaagacccacaccgccgccaucgacgagcgcggccgccuccucaccuucggcugcaacaagugcggccagcucggcgucggcaacuacaagaagcgccucggcaucaaccuccucggcggcccccucggcggcaagcaggucauccgcgucuccugcggcgacgaguucaccaucgccgccaccgacgacaaccacaucuucgccuggggcaacggcggcaacggccgccucgccaugacccccaccgagcgcccccacggcuccgacaucugcaccuccuggccccgccccaucuucggcucccuccaccacguccccgaccucuccugccgcggcuggcacaccauccucaucgucgagaagguccucaacuccaagaccauccgcuccaacuccuccggccucuccaucggcaccgucuuccaguccuccucccccggcggcggcggcggcggcggcggcggcgaggaggaggacucccagcaggaguccgagacccccgaccccuccggcggcuuccgcggcaccauggaggccgaccgcggcauggagggccucaucucccccaccgaggccaugggcaacuccaacggcgccuccuccuccugccccggcuggcuccgcaaggagcucgagaacgccgaguucauccccaugcccgacucccccuccccccucuccgccgccuucuccgaguccgagaaggacacccuccccuacgaggagcuccagggccucaaggucgccuccgaggccccccucgagcacaagccccaggucgaggccuccuccccccgccucaaccccgccgucaccugcgccggcaagggcaccccccucaccccccccgccugcgccugcuccucccuccaggucgaggucgagcgccuccagggccucguccucaagugccucgccgagcagcagaagcuccagcaggagaaccuccagaucuucacccagcuccagaagcucaacaagaagcucgagggcggccagcaggucggcaugcacuccaagggcacccagaccgccaaggaggagauggagauggaccccaagcccgaccucgacuccgacuccuggugccuccucggcaccgacuccugccgccccucccucuga

SEQ ID NO: 46574 - RNA, 1620 nt, Artificial Sequence
  derived and/or modified sequence opt2 from NELFA__Homo_sapiens__NP_005654
augcccggccagcgccgcgcccucucccccaagauggccuccaugcgcgaguccgacaccggccucuggcuccacaacaagcucggcgccaccgacgagcucugggccccccccuccaucgccucccuccucaccgccgccgucaucgacaacauccgccucugcuuccacggccucuccuccgccgucaagcucaagcuccuccucggcacccuccaccucccccgccgcaccgucgacgagaugaagggcgcccucauggagaucauccagcucgccucccucgacuccgaccccuggguccucauggucgccgacauccucaaguccuuccccgacaccggcucccucaaccucgagcucgaggagcagaaccccaacguccaggacauccucggcgagcuccgcgagaaggucggcgagugcgaggccuccgccaugcucccccucgagugccaguaccucaacaagaacgcccucaccacccucgccggcccccucaccccccccgucaagcacuuccagcucaagcgcaagcccaaguccgccacccuccgcgccgagcuccuccagaaguccaccgagaccgcccagcagcucaagcgcuccgccggcguccccuuccacgccaagggccgcggccuccuccgcaagauggacaccaccaccccccucaagggcauccccaagcaggcccccuuccgcucccccaccgcccccuccgucuucucccccaccggcaaccgcacccccaucccccccucccgcacccuccuccgcaaggagcgcggcgucaagcuccucgacaucuccgagcucgacauggucggcgccggccgcgaggccaagcgccgccgcaagacccucgacgccgaggucgucgagaagcccgccaaggaggagaccgucgucgagaacgccacccccgacuacgccgccggccucgucuccacccagaagcucggcucccucaacaacgagcccgcccuccccuccaccuccuaccuccccuccacccccuccgucguccccgccuccuccuacauccccuccuccgagaccccccccgcccccuccucccgcgaggccucccgcccccccgaggagcccuccgcccccucccccacccuccccgcccaguucaagcagcgcgcccccauguacaacuccggccucucccccgccacccccacccccgccgcccccaccuccccccucacccccaccaccccccccgccgucgcccccaccacccagaccccccccgucgccauggucgccccccagacccaggcccccgcccagcagcagcccaagaagaaccucucccucacccgcgagcagauguucgccgcccaggagauguucaagaccgccaacaaggucacccgccccgagaaggcccucauccucggcuucauggccggcucccgcgagaaccccugccaggagcagggcgacgucauccagaucaagcucuccgagcacaccgaggaccuccccaaggccgacggccagggcuccaccaccaugcucgucgacaccgucuucgagaugaacuacgccaccggccaguggacccgcuucaagaaguacaagcccaugaccaacgucuccuga

SEQ ID NO: 46575 - RNA, 1887 nt, Artificial Sequence
  derived and/or modified sequence opt2 from NELFB__Homo_sapiens__NP_056271
auggccgagcucgagggcgccggcgagcgcggcuccggcggcccccgcggccccgccgagcgcgccuccggcgucuccgccgccgcccccggcgagcgcgccggcgacggcgcccccucccgcgccgucgccggcgccuccgccauguucgccggccuccaggaccucggcgucgccaacggcgaggaccucaaggagacccucaccaacugcaccgagccccucaaggccaucgagcaguuccagaccgagaacggcguccuccuccccucccuccaguccgcccuccccuuccucgaccuccacggcaccccccgccucgaguuccaccaguccgucuucgacgagcuccgcgacaagcuccucgagcgcgucuccgccaucgccuccgagggcaaggccgaggagcgcuacaagaagcucgaggaccuccucgagaaguccuucucccucgucaagaugcccucccuccagcccgucgucaugugcgucaugaagcaccuccccaagguccccgagaagaagcucaagcucgucauggccgacaaggagcucuaccgcgccugcgccgucgaggucaagcgccagaucuggcaggacaaccaggcccucuucggcgacgaggucuccccccuccucaagcaguacauccucgagaaggaguccgcccucuucuccaccgagcucuccguccuccacaacuucuucucccccucccccaagacccgccgccagggcgaggucguccagcgccucacccgcauggucggcaagaacgucaagcucuacgacaugguccuccaguuccuccgcacccucuuccuccgcacccgcaacguccacuacugcacccuccgcgccgagcuccucaugucccuccacgaccucgacgucggcgagaucugcaccgucgaccccugccacaaguucaccuggugccucgacgccugcauccgcgagcgcuucgucgacuccaagcgcgcccgcgagcuccagggcuuccucgacggcgucaagaagggccaggagcagguccucggcgaccucuccaugauccucugcgaccccuucgccaucaacacccucgcccucuccaccguccgccaccuccaggagcucgucggccaggagacccucccccgcgacucccccgaccuccuccuccuccuccgccuccucgcccucggccagggcgccugggacaugaucgacucccaggucuucaaggagcccaagauggaggucgagcucaucacccgcuuccuccccaugcucauguccuuccucgucgacgacuacaccuucaacgucgaccagaagcuccccgccgaggagaaggcccccgucuccuaccccaacacccuccccgaguccuucaccaaguuccuccaggagcagcgcauggccugcgaggucggccucuacuacguccuccacaucaccaagcagcgcaacaagaacgcccuccuccgccuccuccccggccucgucgagaccuucggcgaccucgccuucggcgacaucuuccuccaccuccucaccggcaaccucgcccuccucgccgacgaguucgcccucgaggacuucugcuccucccucuucgacggcuucuuccucaccgccuccccccgcaaggagaacguccaccgccacgcccuccgccuccucauccaccuccacccccgcgucgcccccuccaagcucgaggcccuccagaaggcccucgagcccaccggccaguccggcgaggccgucaaggagcucuacucccagcucggcgagaagcucgagcagcucgaccaccgcaagcccucccccgcccaggccgccgagacccccgcccucgagcucccccuccccuccguccccgcccccgccccccucuga

SEQ ID NO: 46576 - RNA, 1800 nt, Artificial Sequence
  derived and/or modified sequence opt2 from NELFCD__Homo_sapiens__NP_945327
augcgccgcgcccgcucccgcgagggcauggccggcgccguccccggcgccaucauggacgaggacuacuacggcuccgccgccgaguggggcgacgaggccgacggcggccagcaggaggacgacuccggcgagggcgaggacgacgccgagguccagcaggagugccuccacaaguucuccacccgcgacuacaucauggagcccuccaucuucaacacccucaagcgcuacuuccaggccggcggcucccccgagaacgucauccagcuccucuccgagaacuacaccgccgucgcccagaccgucaaccuccucgccgaguggcucauccagaccggcgucgagcccguccagguccaggagaccgucgagaaccaccucaagucccuccucaucaagcacuucgacccccgcaaggccgacuccaucuucaccgaggagggcgagacccccgccuggcucgagcagaugaucgcccacaccaccuggcgcgaccucuucuacaagcucgccgaggcccaccccgacugccucaugcucaacuucaccgucaagcucaucuccgacgccggcuaccagggcgagaucaccuccgucuccaccgccugccagcagcucgaggucuucucccgcguccuccgcaccucccucgccaccauccucgacggcggcgaggagaaccucgagaagaaccuccccgaguucgccaagauggucugccacggcgagcacaccuaccucuucgcccaggccaugauguccguccucgcccaggaggagcagggcggcuccgccguccgccgcaucgcccaggagguccagcgcuucgcccaggagaagggccacgacgccucccagaucacccucgcccucggcaccgccgccuccuacccccgcgccugccaggcccucggcgccaugcucuccaagggcgcccucaaccccgccgacaucaccguccucuucaagauguucaccuccauggaccccccccccgucgagcucauccgcguccccgccuuccucgaccucuucaugcagucccucuucaagcccggcgcccgcaucaaccaggaccacaagcacaaguacauccacauccucgccuacgccgccuccgucgucgagaccuggaagaagaacaagcgcgucuccaucaacaaggacgagcucaaguccaccuccaaggccgucgagaccguccacaaccucugcugcaacgagaacaagggcgccuccgagcucgucgccgagcucuccacccucuaccagugcauccgcuuccccgucgucgccaugggcguccucaagugggucgacuggaccgucuccgagccccgcuacuuccagcuccagaccgaccacacccccguccaccucgcccuccucgacgagaucuccaccugccaccagcuccuccacccccagguccuccagcuccucgucaagcucuucgagaccgagcacucccagcucgacgucauggagcagcucgagcucaagaagacccuccucgaccgcaugguccaccuccucucccgcggcuacguccuccccgucgucuccuacauccgcaagugccucgagaagcucgacaccgacaucucccucauccgcuacuucgucaccgagguccucgacgucaucgccccccccuacaccuccgacuucguccagcucuuccuccccauccucgagaacgacuccaucgccggcaccaucaagaccgagggcgagcacgaccccgucaccgaguucaucgcccacugcaaguccaacuucaucauggucaacuga

SEQ ID NO: 46577 - RNA, 1143 nt, Artificial Sequence
  derived and/or modified sequence opt2 from NELFE__Homo_sapiens__NP_002895
augcucgucaucccccccggccucuccgaggaggaggaggcccuccagaagaaguucaacaagcucaagaagaagaagaaggcccuccucgcccucaagaagcaguccuccuccuccaccaccucccagggcggcgucaagcgcucccucuccgagcagcccgucauggacaccgccaccgccaccgagcaggccaagcagcucgucaaguccggcgccaucuccgccaucaaggccgagaccaagaacuccggcuucaagcgcucccgcacccucgagggcaagcucaaggaccccgagaagggccccguccccaccuuccagcccuuccagcgcuccaucuccgccgacgacgaccuccaggaguccucccgccgcccccagcgcaagucccucuacgaguccuucgucuccuccuccgaccgccuccgcgagcucggccccgacggcgaggaggccgagggccccggcgccggcgacggccccccccgcuccuucgacuggggcuacgaggagcgcuccggcgcccacuccuccgccucccccccccgcucccgcucccgcgaccgcucccacgagcgcaaccgcgaccgcgaccgcgaccgcgagcgcgaccgcgaccgcgaccgcgaccgcgaccgcgagcgcgaccgcgaccgcgaccgcgaccgcgaccgcgaccgcgagcgcgaccgcgaccgcgagcgcgaccgcgaccgcgaccgcgagggccccuuccgccgcuccgacuccuuccccgagcgccgcgccccccgcaagggcaacacccucuacgucuacggcgaggacaugacccccacccuccuccgcggcgccuucucccccuucggcaacaucaucgaccucuccauggaccccccccgcaacugcgccuucgucaccuacgagaagauggaguccgccgaccaggccgucgccgagcucaacggcacccaggucgaguccguccagcucaaggucaacaucgcccgcaagcagcccaugcucgacgccgccaccggcaaguccgucuggggcucccucgccguccagaacucccccaagggcugccaccgcgacaagcgcacccagaucgucuacuccgacgacgucuacaaggagaaccucgucgacggcuucuga

SEQ ID NO: 46578 - RNA, 2262 nt, Artificial Sequence
  derived and/or modified sequence opt2 from NELL1__Homo_sapiens__NP_001275643
augcccauggaccucauccucgucgucugguucugcgucugcaccgcccgcaccgucgucggcuucggcauggaccccgaccuccagauggacaucgucaccgagcucgaccucgucaacaccacccucggcgucgcccaggucuccggcaugcacaacgccuccaaggccuuccucuuccaggacaucgagcgcgagauccacgccgccccccacgucuccgagaagcucauccagcucuuccgcaacaaguccgaguucaccauccucgccaccguccagcagaagcccuccaccuccggcgucauccucuccauccgcgagcucgagcaccgcaucuacgagcgcgucaucgacccccccgacaccaaccucccccccggcaucaaccucuggcucggccagcgcaaccagaagcacggccucuucaagggcaucauccaggacggcaagaucaucuucaugcccaacggcuacaucacccagugccccaaccucaaccacaccugccccaccugcuccgacuuccucucccucguccagggcaucauggaccuccaggagcuccucgccaagaugaccgccaagcucaacuacgccgagacccgccucucccagcucgagaacugccacugcgagaagaccugccaggucuccggccuccucuaccgcgaccaggacuccugggucgacggcgaccacugccgcaacugcaccugcaaguccggcgccgucgagugccgccgcauguccugccccccccucaacugcucccccgacucccuccccguccacaucgccggccagugcugcaaggucugccgccccaagugcaucuacggcggcaagguccucgccgagggccagcgcauccucaccaaguccugccgcgagugccgcggcggcguccucgucaagaucaccgagaugugccccccccucaacugcuccgagaaggaccacauccuccccgagaaccagugcugccgcgucugccgcggccacaacuucugcgccgagggccccaagugcggcgagaacuccgagugcaagaacuggaacaccaaggccaccugcgagugcaaguccggcuacaucuccguccagggcgacuccgccuacugcgaggacaucgacgagugcgccgccaagaugcacuacugccacgccaacaccgucugcgucaaccuccccggccucuaccgcugcgacugcguccccggcuacauccgcgucgacgacuucuccugcaccgagcacgacgagugcggcuccggccagcacaacugcgacgagaacgccaucugcaccaacaccguccagggccacuccugcaccugcaagcccggcuacgucggcaacggcaccaucugccgcgccuucugcgaggagggcugccgcuacggcggcaccugcgucgcccccaacaagugcgucugccccuccggcuucaccggcucccacugcgagaaggacaucgacgagugcuccgagggcaucaucgagugccacaaccacucccgcugcgucaaccuccccggcugguaccacugcgagugccgcuccggcuuccacgacgacggcaccuacucccucuccggcgaguccugcaucgacaucgacgagugcgcccuccgcacccacaccugcuggaacgacuccgccugcaucaaccucgccggcggcuucgacugccucugccccuccggccccuccugcuccggcgacugcccccacgagggcggccucaagcacaacggccaggucuggacccucaaggaggaccgcugcuccgucugcuccugcaaggacggcaagaucuucugccgccgcaccgccugcgacugccagaaccccuccgccgaccucuucugcugccccgagugcgacacccgcgucaccucccagugccucgaccagaacggccacaagcucuaccgcuccggcgacaacuggacccacuccugccagcagugccgcugccucgagggcgaggucgacugcuggccccucaccugccccaaccucuccugcgaguacaccgccauccucgagggcgagugcugcccccgcugcgucuccgaccccugccucgccgacaacaucaccuacgacauccgcaagaccugccucgacuccuacggcgucucccgccucuccggcuccgucuggaccauggccggcucccccugcaccaccugcaagugcaagaacggccgcgucugcugcuccgucgacuucgagugccuccagaacaacuga

SEQ ID NO: 46579 - RNA, 2601 nt, Artificial Sequence
  derived and/or modified sequence opt2 from NELL2__Homo_sapiens__NP_001138579
augggcuuccccccccuccucaagggccaggccuccgccacccgcuccucccucgccuccugcuccugggucgucuucuuccucuccugccucucccgccacgcccccgagaucgagggcggccgccgcuggaccgagcucauccgcaccauggagucccgcguccuccuccgcaccuucugccucaucuucggccucggcgccgucuggggccucggcgucgaccccucccuccagaucgacguccucaccgagcucgagcucggcgaguccaccaccggcguccgccagguccccggccuccacaacggcaccaaggccuuccucuuccaggacaccccccgcuccaucaaggccuccaccgccaccgccgagcaguucuuccagaagcuccgcaacaagcacgaguucaccauccucgucacccucaagcagacccaccucaacuccggcgucauccucuccauccaccaccucgaccaccgcuaccucgagcucgaguccuccggccaccgcaacgagguccgccuccacuaccgcuccggcucccaccgcccccacaccgaggucuuccccuacauccucgccgacgacaaguggcacaagcucucccucgccaucuccgccucccaccucauccuccacaucgacugcaacaagaucuacgagcgcgucgucgagaagcccuccaccgaccucccccucggcaccaccuucuggcucggccagcgcaacaacgcccacggcuacuucaagggcaucaugcaggacguccagcuccucgucaugccccagggcuucaucgcccagugccccgaccucaaccgcaccugccccaccugcaacgacuuccacggccucguccagaagaucauggagcuccaggacauccucgccaagaccuccgccaagcucucccgcgccgagcagcgcaugaaccgccucgaccagugcuacugcgagcgcaccugcaccaugaagggcaccaccuaccgcgaguucgaguccuggaucgacggcugcaagaacugcaccugccucaacggcaccauccagugcgagacccucaucugccccaaccccgacugcccccucaaguccgcccucgccuacgucgacggcaagugcugcaaggagugcaaguccaucugccaguuccagggccgcaccuacuucgagggcgagcgcaacaccgucuacuccuccuccggcgucugcguccucuacgagugcaaggaccagaccaugaagcucgucgaguccuccggcugccccgcccucgacugccccgagucccaccagaucacccucucccacuccugcugcaaggucugcaagggcuacgacuucugcuccgagcgccacaacugcauggagaacuccaucugccgcaaccucaacgaccgcgccgucugcuccugccgcgacggcuuccgcgcccuccgcgaggacaacgccuacugcgaggacaucgacgagugcgccgagggccgccacuacugccgcgagaacaccaugugcgucaacacccccggcuccuucaugugcaucugcaagaccggcuacauccgcaucgacgacuacuccugcaccgagcacgacgagugcaucaccaaccagcacaacugcgacgagaacgcccucugcuucaacaccgucggcggccacaacugcgucugcaagcccggcuacaccggcaacggcaccaccugcaaggccuucugcaaggacggcugccgcaacggcggcgccugcaucgccgccaacgucugcgccugcccccagggcuucaccggccccuccugcgagaccgacaucgacgagugcuccgacggcuucguccagugcgacucccgcgccaacugcaucaaccuccccggcugguaccacugcgagugccgcgacggcuaccacgacaacggcauguucucccccuccggcgaguccugcgaggacaucgacgagugcggcaccggccgccacuccugcgccaacgacaccaucugcuucaaccucgacggcggcuacgacugccgcugcccccacggcaagaacugcaccggcgacugcauccacgacggcaaggucaagcacaacggccagaucuggguccucgagaacgaccgcugcuccgucugcuccugccagaacggcuucgucaugugccgccgcauggucugcgacugcgagaaccccaccgucgaccucuucugcugccccgagugcgacccccgccucuccucccagugccuccaccagaacggcgagacccucuacaacuccggcgacaccuggguccagaacugccagcagugccgcugccuccagggcgaggucgacugcuggccccuccccugccccgacgucgagugcgaguucuccauccuccccgagaacgagugcugcccccgcugcgucaccgaccccugccaggccgacaccauccgcaacgacaucaccaagaccugccucgacgagaugaacgucguccgcuucaccggcuccuccuggaucaagcacggcaccgagugcacccucugccagugcaagaacggccacaucugcugcuccgucgacccccagugccuccaggagcucuga

SEQ ID NO: 46580 - RNA, 3168 nt, Artificial Sequence
  derived and/or modified sequence opt2 from NEMF__Homo_sapiens__NP_001288661
augaagucccgcuucuccaccaucgaccuccgcgccguccucgccgagcucaacgccucccuccucggcaugcgcgucaacaacgucuacgacgucgacaacaagaccuaccucauccgccuccagaagcccgacuucaaggccacccuccuccucgaguccggcauccgcauccacaccaccgaguucgaguggcccaagaacaugaugcccuccuccuucgccaugaagugccgcaagcaccucaagucccgccgccucgucuccgccaagcagcucggcgucgaccgcaucgucgacuuccaguucggcuccgacgaggccgccuaccaccucaucaucgagcucuacgaccgcggcaacaucguccucaccgacuacgaguacgucauccucaacauccuccgcuuccgcaccgacgaggccgacgacgucaaguucgccguccgcgagcgcuacccccucgaccacgcccgcgccgccgagccccuccucacccucgagcgccucaccgagaucgucgccuccgcccccaagggcgagcuccucaagcgcguccucaacccccuccuccccuacggccccgcccucaucgagcacugccuccucgagaacggcuucuccggcaacgucaaggucgacgagaagcucgagaccaaggacaucgagaagguccucgucucccuccagaaggccgaggacuacaugaagaccaccuccaacuucuccggcaagggcuacaucauccagaagcgcgagaucaagcccugccucgaggccgacaagcccgucgaggacauccucaccuacgaggaguuccaccccuuccucuucucccagcacucccagugccccuacaucgaguucgaguccuucgacaaggccgucgacgaguucuacuccaagaucgagggccagaagaucgaccucaaggcccuccagcaggagaagcaggcccucaagaagcucgacaacguccgcaaggaccacgagaaccgccucgaggcccuccagcaggcccaggagaucgacaagcucaagggcgagcucaucgagaugaaccuccagaucgucgaccgcgccauccaggucguccgcuccgcccucgccaaccagaucgacuggaccgagaucggccucaucgucaaggaggcccaggcccagggcgaccccgucgccuccgccaucaaggagcucaagcuccagaccaaccacgucaccaugcuccuccgcaaccccuaccuccucuccgaggaggaggacgacgacgucgacggcgacgucaacgucgagaagaacgagaccgagccccccaagggcaagaagaagaagcagaagaacaagcagcuccagaagccccagaagaacaagccccuccucgucgacgucgaccucucccucuccgccuacgccaacgccaagaaguacuacgaccacaagcgcuacgccgccaagaagacccagaagaccgucgaggccgccgagaaggccuucaaguccgccgagaagaagaccaagcagacccucaaggagguccagaccgucaccuccauccagaaggcccgcaaggucuacugguucgagaaguuccucugguucaucuccuccgagaacuaccucaucaucggcggccgcgaccagcagcagaacgagaucaucgucaagcgcuaccucacccccggcgagcccauccccccccgcacccucaccgaggccggcaccauggcccucugcuacuccgccgccugggacgcccgcgucaucaccuccgccuggugggucuaccaccaccaggucuccaagaccgcccccaccggcgaguaccucaccaccggcuccuucaugauccgcggcaagaagaacuuccucccccccuccuaccucaugaugggcuucuccuuccucuucaaggucgacgaguccugcgucuggcgccaccagggcgagcgcaagguccgcguccaggacgaggacauggagacccucgccuccugcaccuccgagcucaucuccgaggagauggagcagcucgacggcggcgacaccuccuccgacgaggacaaggaggagcacgagacccccgucgaggucgagcucaugacccaggucgaccaggaggacaucacccuccaguccggccgcgacgagcucaacgaggagcucauccaggaggaguccuccgaggacgagggcgaguacgaggagguccgcaaggaccaggacuccgucggcgagaugaaggacgagggcgaggagacccucaacuaccccgacaccaccaucgaccucucccaccuccagccccagcgcuccauccagaagcucgccuccaaggaggaguccuccaacuccuccgacuccaagucccagucccgccgccaccucuccgccaaggagcgccgcgagaugaagaagaagaagcuccccuccgacuccggcgaccucgaggcccucgagggcaaggacaaggagaaggaguccaccguccacaucgagacccaccagaacaccuccaagaacgucgccgccguccagcccaugaagcgcggccagaaguccaagaugaagaagaugaaggagaaguacaaggaccaggacgaggaggaccgcgagcucaucaugaagcuccucggcuccgccggcuccaacaaggaggagaagggcaagaagggcaagaagggcaagaccaaggacgagcccgucaagaagcagccccagaagccccgcggcggccagcgcgucuccgacaacaucaagaaggagacccccuuccucgaggucaucacccacgagcuccaggacuucgccgucgacgacccccacgacgacaaggaggagcaggaccucgaccagcagggcaacgaggagaaccucuucgacucccucaccggccagccccaccccgaggacguccuccucuucgccauccccaucugcgcccccuacaccaccaugaccaacuacaaguacaaggucaagcucacccccggcguccagaagaagggcaaggccgccaagaccgcccucaacuccuucaugcacuccaaggaggccaccgcccgcgagaaggaccucuuccgcuccgucaaggacaccgaccucucccgcaacauccccggcaaggucaaggucuccgcccccaaccuccucaacgucaagcgcaaguga

SEQ ID NO: 46581 - RNA, 4227 nt, Artificial Sequence
  derived and/or modified sequence opt2 from NEO1__Homo_sapiens__NP_001166094
auggccgccgagcgcggcgcccgccgccuccucuccacccccuccuucuggcucuacugccuccuccuccucggccgccgcgcccccggcgccgccgccgcccgcuccggcuccgccccccagucccccggcgccuccauccgcaccuucacccccuucuacuuccucgucgagcccgucgacacccucuccguccgcggcuccuccgucauccucaacugcuccgccuacuccgagcccucccccaagaucgaguggaagaaggacggcaccuuccucaaccucgucuccgacgaccgccgccagcuccuccccgacggcucccucuucaucuccaacgucguccacuccaagcacaacaagcccgacgagggcuacuaccagugcgucgccaccgucgagucccucggcaccaucaucucccgcaccgccaagcucaucgucgccggccucccccgcuucaccucccagcccgagcccuccuccgucuacgccggcaacaacgccauccucaacugcgaggucaacgccgaccucguccccuucguccgcugggagcagaaccgccagccccuccuccucgacgaccgcgucaucaagcuccccuccggcaugcucgucaucuccaacgccaccgagggcgacggcggccucuaccgcugcgucgucgaguccggcggcccccccaaguacuccgacgaggucgagcucaagguccuccccgaccccgaggucaucuccgaccucgucuuccucaagcagcccuccccccucguccgcgucaucggccaggacgucguccuccccugcgucgccuccggccuccccacccccaccaucaaguggaugaagaacgaggaggcccucgacaccgaguccuccgagcgccucguccuccucgccggcggcucccucgagaucuccgacgucaccgaggacgacgccggcaccuacuucugcaucgccgacaacggcaacgagaccaucgaggcccaggccgagcucaccguccaggcccagcccgaguuccucaagcagcccaccaacaucuacgcccacgaguccauggacaucgucuucgagugcgaggucaccggcaagcccacccccaccgucaagugggucaagaacggcgacauggucauccccuccgacuacuucaagaucgucaaggagcacaaccuccagguccucggccucgucaaguccgacgagggcuucuaccagugcaucgccgagaacgacgucggcaacgcccaggccggcgcccagcucaucauccucgagcacgcccccgccaccaccggcccccuccccuccgccccccgcgacgucgucgccucccucgucuccacccgcuucaucaagcucaccuggcgcacccccgccuccgacccccacggcgacaaccucaccuacuccgucuucuacaccaaggagggcaucgcccgcgagcgcgucgagaacaccucccaccccggcgagaugcaggucaccauccagaaccucaugcccgccaccgucuacaucuuccgcgucauggcccagaacaagcacggcuccggcgaguccuccgccccccuccgcgucgagacccagcccgagguccagcuccccggccccgcccccaaccuccgcgccuacgccgccucccccaccuccaucaccgucaccugggagacccccgucuccggcaacggcgagauccagaacuacaagcucuacuacauggagaagggcaccgacaaggagcaggacgucgacgucuccucccacuccuacaccaucaacggccucaagaaguacaccgaguacuccuuccgcgucgucgccuacaacaagcacggccccggcgucuccacccccgacgucgccguccgcacccucuccgacguccccuccgccgccccccagaaccucucccucgagguccgcaacuccaaguccaucaugauccacuggcagccccccgcccccgccacccagaacggccagaucaccggcuacaagauccgcuaccgcaaggccucccgcaaguccgacgucaccgagacccucgucuccggcacccagcucucccagcucaucgagggccucgaccgcggcaccgaguacaacuuccgcgucgccgcccucaccaucaacggcaccggccccgccaccgacuggcucuccgccgagaccuucgaguccgaccucgacgagacccgcguccccgagguccccuccucccuccacguccgcccccucgucaccuccaucgucgucuccuggaccccccccgagaaccagaacaucgucguccgcggcuacgccaucggcuacggcaucggcuccccccacgcccagaccaucaaggucgacuacaagcagcgcuacuacaccaucgagaaccucgaccccuccucccacuacgucaucacccucaaggccuucaacaacgucggcgagggcaucccccucuacgaguccgccgucacccgcccccacaccgacaccuccgaggucgaccucuucgucaucaacgcccccuacacccccguccccgaccccacccccaugaugccccccgucggcguccaggccuccauccucucccacgacaccauccgcaucaccugggccgacaacucccuccccaagcaccagaagaucaccgacucccgcuacuacaccguccgcuggaagaccaacauccccgccaacaccaaguacaagaacgccaacgccaccacccucuccuaccucgucaccggccucaagcccaacacccucuacgaguucuccgucauggucaccaagggccgccgcuccuccaccugguccaugaccgcccacggcaccaccuucgagcucguccccaccuccccccccaaggacgucaccgucgucuccaaggagggcaagcccaagaccaucaucgucaacuggcagccccccuccgaggccaacggcaagaucaccggcuacaucaucuacuacuccaccgacgucaacgccgagauccacgacugggucaucgagcccgucgucggcaaccgccucacccaccagauccaggagcucacccucgacacccccuacuacuucaagauccaggcccgcaacuccaagggcaugggccccauguccgaggccguccaguuccgcacccccaaggccgacuccuccgacaagaugcccaacgaccaggccuccggcuccggcggcaagggcucccgccuccccgaccucggcuccgacuacaagccccccauguccggcuccaacuccccccacggcucccccaccuccccccucgacuccaacaugcuccucgucaucaucgucuccgucggcgucaucaccaucgucgucgucgucaucaucgccgucuucugcacccgccgcaccaccucccaccagaagaagaagcgcgccgccugcaaguccgucaacggcucccacaaguacaagggcaacuccaaggacgucaagccccccgaccucuggauccaccacgagcgccucgagcucaagcccaucgacaagucccccgaccccaaccccaucaugaccgacacccccaucccccgcaacucccaggacaucacccccgucgacaacuccauggacuccaacauccaccagcgccgcaacuccuaccgcggccacgaguccgaggacuccauguccacccucgccggccgccgcggcaugcgccccaagaugaugaugcccuucgacucccagcccccccagcaguccguccgcaacacccccuccaccgacaccaugcccgccuccuccucccagaccugcugcaccgaccaccaggaccccgagggcgccaccuccuccuccuaccucgccuccucccaggaggaggacuccggccagucccuccccaccgcccacguccgccccucccacccccucaaguccuucgccguccccgccauccccccccccggcccccccaccuacgaccccgcccuccccuccaccccccuccucucccagcaggcccucaaccaccacauccacuccgucaagaccgccuccaucggcacccucggccgcucccgcccccccaugcccgucgucguccccuccgcccccgagguccaggagaccacccgcaugcucgaggacuccgaguccuccuacgagcccgacgagcucaccaaggagauggcccaccucgagggccucaugaaggaccucaacgccaucaccaccgccuga

SEQ ID NO: 46582 - RNA, 4866 nt, Artificial Sequence
  derived and/or modified sequence opt2 from NES__Homo_sapiens__NP_006608
auggagggcugcaugggcgaggaguccuuccagaugugggagcucaaccgccgccucgaggccuaccucgcccgcgucaaggcccucgaggagcagaacgagcuccucuccgccgagcucggcggccuccgcgcccaguccgccgacaccuccuggcgcgcccacgccgacgacgagcucgccgcccuccgcgcccucgucgaccagcgcuggcgcgagaagcacgccgccgaggucgcccgcgacaaccucgccgaggagcucgagggcgucgccggccgcugccagcagcuccgccucgcccgcgagcgcaccaccgaggaggucgcccgcaaccgccgcgccgucgaggccgagaagugcgcccgcgccuggcucuccucccaggucgccgagcucgagcgcgagcucgaggcccuccgcgucgcccacgaggaggagcgcgucggccucaacgcccaggccgccugcgccccccgcugccccgcccccccccgcggcccccccgcccccgcccccgaggucgaggagcucgcccgccgccucggcgaggccuggcgcggcgccguccgcggcuaccaggagcgcgucgcccacauggagaccucccucggccaggcccgcgagcgccucggccgcgccguccagggcgcccgcgagggccgccucgagcuccagcagcuccaggccgagcgcggcggccuccucgagcgccgcgccgcccucgagcagcgccucgagggccgcuggcaggagcgccuccgcgccaccgagaaguuccagcucgccgucgaggcccucgagcaggagaagcagggccuccagucccagaucgcccagguccucgagggccgccagcagcucgcccaccucaagaugucccucucccucgaggucgccaccuaccgcacccuccucgaggccgagaacucccgccuccagacccccggcggcggcuccaagaccucccucuccuuccaggaccccaagcucgagcuccaguucccccgcacccccgagggccgccgccucggcucccuccuccccguccucucccccaccucccuccccuccccccuccccgccacccucgagacccccguccccgccuuccucaagaaccaggaguuccuccaggcccgcacccccacccucgccuccacccccaucccccccaccccccaggcccccucccccgccgucgacgccgagauccgcgcccaggacgccccccucucccuccuccagacccagggcggccgcaagcaggcccccgagccccuccgcgccgaggcccgcgucgccauccccgccuccguccuccccggccccgaggagcccggcggccagcgccaggaggccuccaccggccagucccccgaggaccacgccucccucgcccccccccucucccccgaccacuccucccucgaggccaaggacggcgaguccggcggcucccgcgucuucuccaucugccgcggcgagggcgagggccagaucuggggccucgucgagaaggagaccgccaucgagggcaaggucgucuccucccuccagcaggagaucugggaggaggaggaccucaaccgcaaggagauccaggacucccaggucccccucgagaaggagacccucaagucccucggcgaggagauccaggagucccucaagacccucgagaaccagucccacgagacccucgagcgcgagaaccaggagugcccccgcucccucgaggaggaccucgagacccucaagucccucgagaaggagaacaaggagcuccucaaggacgucgaggucguccgcccccucgagaaggaggccgucggccagcucaagcccaccggcaaggaggacacccagacccuccagucccuccagaaggagaaccaggagcucaugaagucccucgagggcaaccucgagaccuuccucuuccccggcaccgagaaccaggagcucgucuccucccuccaggagaaccucgagucccucaccgcccucgagaaggagaaccaggagccccuccgcucccccgaggucggcgacgaggaggcccuccgcccccucaccaaggagaaccaggagccccuccgcucccucgaggacgagaacaaggaggccuuccgcucccucgagaaggagaaccaggagccccucaagacccucgaggaggaggaccaguccaucguccgcccccucgagaccgagaaccacaagucccuccgcucccucgaggagcaggaccaggagacccuccgcacccucgagaaggagacccagcagcgccgccgcucccucggcgagcaggaccagaugacccuccgcccccccgagaaggucgaccucgagccccucaagucccucgaccaggagaucgcccgcccccucgagaacgagaaccaggaguuccucaagucccucaaggaggaguccgucgaggccgucaagucccucgagaccgagauccucgagucccucaaguccgccggccaggagaaccucgagacccucaagucccccgagacccaggccccccucuggacccccgaggagaucaaccagggcgccaugaacccccucgagaaggagauccaggagccccucgaguccgucgaggucaaccaggagaccuuccgccuccucgaggaggagaaccaggagucccuccgcucccucggcgccuggaaccucgagaaccuccgcucccccgaggaggucgacaaggagucccagcgcaaccucgaggaggaggagaaccucggcaagggcgaguaccaggagucccuccgcucccucgaggaggagggccaggagcucccccaguccgccgacguccagcgcugggaggacaccgucgagaaggaccaggagcucgcccaggaguccccccccggcauggccggcgucgagaacgaggacgaggccgagcucaaccuccgcgagcaggacggcuucaccggcaaggaggaggucgucgagcagggcgagcucaacgccaccgaggaggucuggauccccggcgagggccaccccgagucccccgagcccaaggagcagcgcggccucgucgagggcgccuccgucaagggcggcgccgagggccuccaggaccccgagggccagucccagcaggucggcgcccccggccuccaggccccccagggccuccccgaggccaucgagccccucgucgaggacgacgucgcccccggcggcgaccaggccucccccgaggucaugcucggcuccgagcccgccaugggcgaguccgccgccggcgccgagcccggccccggccagggcgucggcggccucggcgaccccggccaccucacccgcgaggaggucauggagcccccccucgaggaggagucccucgaggccaagcgcguccagggccucgagggcccccgcaaggaccucgaggaggccggcggccucggcaccgaguucuccgagcuccccggcaagucccgcgaccccugggagcccccccgcgagggccgcgaggaguccgaggccgaggccccccgcggcgccgaggaggccuuccccgccgagacccucggccacaccggcuccgacgcccccucccccuggccccucggcuccgaggaggccgaggaggacgucccccccguccucgucucccccucccccaccuacacccccauccucgaggacgcccccggcccccagccccaggccgagggcucccaggaggccuccuggggcguccagggccgcgccgaggcccucggcaaggucgaguccgagcaggaggagcucggcuccggcgagauccccgagggcccccaggaggagggcgaggagucccgcgaggaguccgaggaggacgagcucggcgagacccuccccgacuccaccccccucggcuucuaccuccgcucccccaccuccccccgcugggaccccaccggcgagcagcgcccccccccccagggcgagaccggcaaggagggcugggaccccgccguccucgccuccgagggccucgaggccccccccuccgagaaggaggagggcgaggagggcgaggaggagugcggccgcgacuccgaccucuccgaggaguucgaggaccucggcaccgaggcccccuuccuccccggcguccccggcgaggucgccgagccccucggccaggucccccagcuccuccucgaccccgccgccugggaccgcgacggcgaguccgacggcuucgccgacgaggaggaguccggcgaggagggcgaggaggaccaggaggagggccgcgagcccggcgccggccgcuggggccccggcuccuccgucggcucccuccaggcccucuccuccucccagcgcggcgaguuccucgaguccgacuccgucuccgucuccguccccugggacgacucccuccgcggcgccgucgccggcgcccccaagaccgcccucgagaccgagucccaggacuccgccgagcccuccggcuccgaggaggaguccgaccccgucucccucgagcgcgaggacaagguccccggcccccucgagauccccuccggcauggaggacgccggccccggcgccgacaucaucggcgucaacggccagggccccaaccucgagggcaagucccagcacgucaacggcggcgucaugaacggccucgagcaguccgaggaggucggccagggcaugccccucgucuccgagggcgaccgcggcucccccuuccaggaggaggagggcuccgcccucaagaccuccugggccggcgcccccguccaccucggccagggccaguuccucaaguucacccagcgcgagggcgaccgcgaguccugguccuccggcgaggacuga

SEQ ID NO: 46583 - RNA, 1791 nt, Artificial Sequence
  derived and/or modified sequence opt2 from NET1__Homo_sapiens__NP_001040625
auggagcccgagcucgccgcccagaagcagccccgcccccgccgccgcucccgccgcgccuccggccucuccaccgagggcgccaccggccccuccgccgacaccuccggcuccgagcucgacggccgcugcucccuccgccgcggcuccuccuucaccuuccucacccccggccccaacugggacuucacccucaagcgcaagcgccgcgagaaggacgacgacgucgucucccucuccucccucgaccucaaggagcccuccaacaagcgcguccgcccccucgcccgcgucaccucccucgccaaccucaucucccccguccgcaacggcgccguccgccgcuucggccagaccauccaguccuucacccuccgcggcgaccaccgcucccccgccuccgcccagaaguucuccucccgcuccaccguccccacccccgccaagcgccgcuccuccgcccucugguccgagaugcucgacaucaccaugaaggagucccucaccacccgcgagauccgccgccaggaggccaucuacgagaugucccgcggcgagcaggaccucaucgaggaccucaagcucgcccgcaaggccuaccacgaccccaugcucaagcucuccaucauguccgaggaggagcucacccacaucuucggcgaccucgacuccuacaucccccuccacgaggaccuccucacccgcaucggcgaggccaccaagcccgacggcaccgucgagcagaucggccacauccucgucuccuggcucccccgccucaacgccuaccgcggcuacugcuccaaccagcucgccgccaaggcccuccucgaccagaagaagcaggacccccgcguccaggacuuccuccagcgcugccucgagucccccuucucccgcaagcucgaccucugguccuuccucgacaucccccgcucccgccucgucaaguacccccuccuccucaaggagauccucaagcacacccccaaggagcaccccgacguccagcuccucgaggacgccauccucaucauccagggcguccucuccgacaucaaccucaagaagggcgaguccgagugccaguacuacaucgacaagcucgaguaccucgacgagaagcagcgcgacccccgcaucgaggccuccaagguccuccucugccacggcgagcuccgcuccaaguccggccacaagcucuacaucuuccucuuccaggacauccucguccucacccgccccgucacccgcaacgagcgccacuccuaccaggucuaccgccagcccauccccguccaggagcucguccucgaggaccuccaggacggcgacguccgcaugggcggcuccuuccgcggcgccuucuccaacuccgagaaggccaagaacaucuuccgcauccgcuuccacgaccccucccccgcccagucccacacccuccaggccaacgacgucuuccacaagcagcagugguucaacugcauccgcgccgccaucgcccccuuccaguccgccggcuccccccccgagcuccagggccuccccgagcuccacgaggagugcgagggcaaccaccccuccgcccgcaagcucaccgcccagcgccgcgccuccaccgucuccuccgucacccaggucgaggucgacgagaacgccuaccgcugcggcuccggcaugcagauggccgaggacuccaagucccucaagacccaccagacccagcccggcauccgccgcgcccgcgacaaggcccucuccggcggcaagcgcaaggagacccucgucuga

SEQ ID NO: 46584 - RNA, 471 nt, Artificial Sequence
  derived and/or modified sequence opt2 from NETO1__Homo_sapiens__NP_620552
augcucgccgagcccuuccccaaggucgucgccucccucaucauccuccaccucuccggcgccaccaagaagggcaccgagaagcagaccaccuccgagacccagaaguccguccagugcggcaccuggaccaagcacgccgagggcggcaucuucaccucccccaacuaccccuccaaguacccccccgaccgcgagugcaucuacaucaucgaggccgccccccgccagugcaucgagcucuacuucgacgagaaguacuccaucgagcccuccugggagugcaaguucgaccacaucgagguccgcgacggccccuucggcuucucccccaucaucggccgcuucugcggccagcagaacccccccgucaucaaguccuccggccgcuuccucuggaucaaguucuucgccgacggcgagcucgaguccaugggcuucuccgcccgcuacaacuucacccccgaguga

SEQ ID NO: 46585 - RNA, 1578 nt, Artificial Sequence
  derived and/or modified sequence opt2 from NETO2__Homo_sapiens__NP_060562
auggcccucgagcgccucugcuccguccucaagguccuccucaucaccguccucgucgucgagggcaucgccgucgcccagaagacccaggacggccagaacaucggcaucaagcacauccccgccacccagugcggcaucuggguccgcaccuccaacggcggccacuucgccucccccaacuaccccgacuccuacccccccaacaaggagugcaucuacauccucgaggccgccccccgccagcgcaucgagcucaccuucgacgagcacuacuacaucgagcccuccuucgagugccgcuucgaccaccucgagguccgcgacggccccuucggcuucuccccccucaucgaccgcuacugcggcgucaagucccccccccucauccgcuccaccggccgcuucauguggaucaaguucuccuccgacgaggagcucgagggccucggcuuccgcgccaaguacuccuucauccccgaccccgacuucaccuaccucggcggcauccucaaccccauccccgacugccaguucgagcucuccggcgccgacggcaucguccgcuccucccaggucgagcaggaggagaagaccaagcccggccaggccgucgacugcaucuggaccaucaaggccacccccaaggccaagaucuaccuccgcuuccucgacuaccagauggagcacuccaacgagugcaagcgcaacuucgucgccgucuacgacggcuccuccuccaucgagaaccucaaggccaaguucugcuccaccgucgccaacgacgucaugcucaagaccggcaucggcgucauccgcaugugggccgacgagggcucccgccucucccgcuuccgcaugcucuucaccuccuucgucgagccccccugcaccuccuccaccuucuucugccacuccaacaugugcaucaacaacucccucgucugcaacggcguccagaacugcgccuaccccugggacgagaaccacugcaaggagaagaagaaggccggcgucuucgagcagaucaccaagacccacggcaccaucaucggcaucaccuccggcaucguccucguccuccucaucaucuccauccucguccaggucaagcagccccgcaagaaggucauggccugcaagaccgccuucaacaagaccggcuuccaggaggucuucgaccccccccacuacgagcucuucucccuccgcgacaaggagaucuccgccgaccucgccgaccucuccgaggagcucgacaacuaccagaagaugcgccgcuccuccaccgccucccgcugcauccacgaccaccacugcggcucccaggccuccuccgucaagcagucccgcaccaaccucuccuccauggagcuccccuuccgcaacgacuucgcccagccccagcccaugaagaccuucaacuccaccuucaagaaguccuccuacaccuucaagcagggccacgagugccccgagcaggcccucgaggaccgcgucauggaggagauccccugcgagaucuacguccgcggccgcgaggacuccgcccaggccuccaucuccaucgacuucuga

SEQ ID NO: 46586 - RNA, 1248 nt, Artificial Sequence
  derived and/or modified sequence opt2 from NEU1__Homo_sapiens__NP_000425
augaccggcgagcgccccuccaccgcccuccccgaccgccgcuggggcccccgcauccucggcuucuggggcggcugccgcgucugggucuucgccgccaucuuccuccuccucucccucgccgccuccugguccaaggccgagaacgacuucggccucguccagccccucgucaccauggagcagcuccucugggucuccggccgccagaucggcuccgucgacaccuuccgcaucccccucaucaccgccaccccccgcggcacccuccucgccuucgccgaggcccgcaagauguccuccuccgacgagggcgccaaguucaucgcccuccgccgcuccauggaccagggcuccaccuggucccccaccgccuucaucgucaacgacggcgacguccccgacggccucaaccucggcgccgucgucuccgacgucgagaccggcgucgucuuccucuucuacucccucugcgcccacaaggccggcugccaggucgccuccaccaugcucgucugguccaaggacgacggcgucuccugguccaccccccgcaaccucucccucgacaucggcaccgaggucuucgcccccggccccggcuccggcauccagaagcagcgcgagccccgcaagggccgccucaucgucugcggccacggcacccucgagcgcgacggcgucuucugccuccucuccgacgaccacggcgccuccuggcgcuacggcuccggcgucuccggcauccccuacggccagcccaagcaggagaacgacuucaaccccgacgagugccagcccuacgagcuccccgacggcuccgucgucaucaacgcccgcaaccagaacaacuaccacugccacugccgcaucguccuccgcuccuacgacgccugcgacacccuccgcccccgcgacgucaccuucgaccccgagcucgucgaccccgucgucgccgccggcgccgucgucaccuccuccggcaucgucuucuucuccaaccccgcccaccccgaguuccgcgucaaccucacccuccgcugguccuucuccaacggcaccuccuggcgcaaggagaccguccagcucuggcccggccccuccggcuacuccucccucgccacccucgagggcuccauggacggcgaggagcaggccccccagcucuacguccucuacgagaagggccgcaaccacuacaccgaguccaucuccgucgccaagaucuccgucuacggcacccucuga

SEQ ID NO: 46587 - RNA, 1386 nt, Artificial Sequence
  derived and/or modified sequence opt2 from NEU3__Homo_sapiens__NP_006647
augcgccccgccgaccuccccccccgccccauggaggagucccccgccuccuccuccgcccccaccgagaccgaggagcccggcuccuccgccgaggucauggaggaggucaccaccugcuccuucaacuccccccucuuccgccaggaggacgaccgcggcaucaccuaccgcauccccgcccuccucuacaucccccccacccacaccuuccucgccuucgccgagaagcgcuccacccgccgcgacgaggacgcccuccaccucguccuccgccgcggccuccgcaucggccagcucguccaguggggcccccucaagccccucauggaggccacccuccccggccaccgcaccaugaaccccugccccgucugggagcagaaguccggcugcgucuuccucuucuucaucugcguccgcggccacgucaccgagcgccagcagaucgucuccggccgcaacgccgcccgccucugcuucaucuacucccaggacgccggcugcuccugguccgagguccgcgaccucaccgaggaggucaucggcuccgagcucaagcacugggccaccuucgccgucggccccggccacggcauccagcuccaguccggccgccucgucauccccgccuacaccuacuacauccccuccugguucuucugcuuccagcuccccugcaagacccgcccccacucccucaugaucuacuccgacgaccucggcgucaccuggcaccacggccgccucauccgccccauggucaccgucgagugcgaggucgccgaggucaccggccgcgccggccaccccguccucuacugcuccgcccgcacccccaaccgcugccgcgccgaggcccucuccaccgaccacggcgagggcuuccagcgccucgcccucucccgccagcucugcgagcccccccacggcugccagggcuccgucgucuccuuccgcccccucgagaucccccaccgcugccaggacuccuccuccaaggacgcccccaccauccagcaguccucccccggcuccucccuccgccucgaggaggaggccggcacccccuccgaguccuggcuccucuacucccaccccaccucccgcaagcagcgcgucgaccucggcaucuaccucaaccagaccccccucgaggccgccugcuggucccgccccuggauccuccacugcggccccugcggcuacuccgaccucgccgcccucgaggaggagggccucuucggcugccucuucgagugcggcaccaagcaggagugcgagcagaucgccuuccgccucuucacccaccgcgagauccucucccaccuccagggcgacugcaccucccccggccgcaaccccucccaguucaaguccaacuga

SEQ ID NO: 46588 - RNA, 1725 nt, Artificial Sequence
  derived and/or modified sequence opt2 from NEURL1__Homo_sapiens__NP_004201
augggcaacaacuucuccuccauccccucccucccccgcggcaaccccucccgcgccccccgcggccacccccagaaccucaaggacuccaucggcggccccuuccccgucaccucccaccgcugccaccacaagcagaagcacugccccgccguccuccccuccggcggccuccccgccaccccccuccucuuccacccccacaccaagggcucccagauccucauggaccucucccacaaggccgucaagcgccaggccuccuucugcaacgccaucaccuucuccaaccgccccguccucaucuacgagcagguccgccucaagaucaccaagaagcagugcugcugguccggcgcccuccgccucggcuucaccuccaaggaccccucccgcauccaccccgacucccuccccaaguacgccugccccgaccucgucucccaguccggcuucugggccaaggcccuccccgaggaguucgccaacgagggcaacaucaucgccuucugggucgacaagaagggccgcgucuuccaccgcaucaacgacuccgccgucaugcucuucuucuccggcguccgcaccgccgacccccucugggcccucgucgacgucuacggccucacccgcggcguccagcuccucgacuccgagcucguccuccccgacugccuccgcccccgcuccuucaccgcccuccgccgccccucccuccgccgcgaggccgacgacgcccgccucuccgucucccucugcgaccucaacguccccggcgccgacggcgacgaggccgcccccgccgccggcugccccaucccccagaacucccucaacucccagcacucccgcgcccuccccgcccagcucgacggcgaccuccgcuuccacgcccuccgcgccggcgcccacguccgcauccucgacgagcagaccgucgcccgcgucgagcacggccgcgacgagcgcgcccucgucuucaccucccgccccguccgcgucgccgagaccaucuucgucaaggucacccgcuccggcggcgcccgccccggcgcccucuccuucggcgucaccaccugcgaccccggcacccuccgccccgccgaccuccccuucucccccgaggcccucgucgaccgcaaggaguucugggccgucugccgcguccccggcccccuccacuccggcgacauccucggccucgucgucaacgccgacggcgagcuccaccucucccacaacggcgccgccgccggcaugcagcucugcgucgacgccucccagccccucuggaugcucuucggccuccacggcaccaucacccagauccgcauccucggcuccaccauccucgccgagcgcggcauccccucccuccccugcucccccgccuccacccccaccucccccuccgcccucggcucccgccucuccgacccccuccucuccaccugcuccuccggcccccucggcuccuccgccggcggcaccgcccccaacucccccgucucccuccccgagucccccgucacccccggccucggccagugguccgacgagugcaccaucugcuacgagcacgccgucgacaccgucaucuacaccugcggccacaugugccucugcuacgccugcggccuccgccucaagaaggcccuccacgccugcugccccaucugccgccgccccaucaaggacaucaucaagaccuaccgcuccuccuga

SEQ ID NO: 46589 - RNA, 858 nt, Artificial Sequence
  derived and/or modified sequence opt2 from NEURL2__Homo_sapiens__NP_542787
auggccgccgccuccgagcccgucgacuccggcgcccucuggggccucgagcgccccgagcccccccccacccgcuuccaccgcguccacggcgccaacauccgcgucgaccccuccggcacccgcgccacccgcgucgaguccuucgcccacggcgucugcuucucccgcgagccccucgcccccggccaggucuuccucgucgagaucgaggagaaggagcucggcuggugcggccaccuccgccucggccucaccgcccucgaccccgccucccucgcccccguccccgaguucucccuccccgaccucgucaaccucggccacaccugggucuucgccaucacccgccaccacaaccgcgucccccgcgagggccgccccgaggccgaggccgccgcccccucccgcccccccacccuccucgucgagcccuaccuccgcaucgagcaguuccgcaucccccgcgaccgccucgucggccgcucccgccccggccucuacucccaccuccucgaccagcucuacgagcucaacguccucccccccaccgcccgccgcucccgccucggcguccucuucugcccccgccccgacggcaccgccgacaugcacaucaucaucaacggcgaggacaugggccccuccgcccgcggccuccccgccgcccagccccucuacgccgucgucgacgucuucgccuccaccaaguccguccgccucguccagcucgaguacggccuccccucccuccagacccucugccgccucgucauccagcgcuccaugguccaccgccucgccaucgacggccuccaccuccccaaggagcucaaggacuucugcaaguacgaguga

SEQ ID NO: 46590 - RNA, 1071 nt, Artificial Sequence
  derived and/or modified sequence opt2 from NEUROD1__Homo_sapiens__NP_002491
augaccaaguccuacuccgaguccggccucaugggcgagccccagccccagggcccccccuccuggaccgacgagugccucuccucccaggacgaggagcacgaggccgacaagaaggaggacgaccucgaggccaugaacgccgaggaggacucccuccgcaacggcggcgaggaggaggacgaggacgaggaccucgaggaggaggaggaggaggaggaggaggacgacgaccagaagcccaagcgccgcggccccaagaagaagaagaugaccaaggcccgccucgagcgcuucaagcuccgccgcaugaaggccaacgcccgcgagcgcaaccgcaugcacggccucaacgccgcccucgacaaccuccgcaaggucguccccugcuacuccaagacccagaagcucuccaagaucgagacccuccgccucgccaagaacuacaucugggcccucuccgagauccuccgcuccggcaagucccccgaccucgucuccuucguccagacccucugcaagggccucucccagcccaccaccaaccucgucgccggcugccuccagcucaacccccgcaccuuccuccccgagcagaaccaggacaugcccccccaccuccccaccgccuccgccuccuuccccguccaccccuacuccuaccagucccccggccuccccuccccccccuacggcaccauggacuccucccacgucuuccacgucaagccccccccccacgccuacuccgccgcccucgagcccuucuucgaguccccccucaccgacugcaccucccccuccuucgacggcccccucucccccccccucuccaucaacggcaacuucuccuucaagcacgagcccuccgccgaguucgagaagaacuacgccuucaccaugcacuaccccgccgccacccucgccggcgcccagucccacggcuccaucuucuccggcaccgccgccccccgcugcgagauccccaucgacaacaucauguccuucgacucccacucccaccacgagcgcgucauguccgcccagcucaacgccaucuuccacgacuga

SEQ ID NO: 46591 - RNA, 1173 nt, Artificial Sequence
  derived and/or modified sequence opt2 from NEUROD2__Homo_sapiens__XP_005257466
augaugccccccucccucggcaccaugcucacccgccucuucuccgagcccggccuccucuccgacguccccaaguucgccuccuggggcgacggcgaggacgacgagccccgcuccgacaagggcgacgccccccccccccccccccccgcccccggccccggcgcccccggccccgcccgcgccgccaagcccgucccccuccgcggcgaggagggcaccgaggccacccucgccgaggucaaggaggagggcgagcucggcggcgaggaggaggaggaggaggaggaggaggagggccucgacgaggccgagggcgagcgccccaagaagcgcggccccaagaagcgcaagaugaccaaggcccgccucgagcgcuccaagcuccgccgccagaaggccaacgcccgcgagcgcaaccgcaugcacgaccucaacgccgcccucgacaaccuccgcaaggucguccccugcuacuccaagacccagaagcucuccaagaucgagacccuccgccucgccaagaacuacaucugggcccucuccgagauccuccgcuccggcaagcgccccgaccucgucuccuacguccagacccucugcaagggccucucccagcccaccaccaaccucgucgccggcugccuccagcucaacucccgcaacuuccucaccgagcagggcgccgacggcgccggccgcuuccacggcuccggcggccccuucgccaugcaccccuaccccuaccccugcucccgccucgccggcgcccagugccaggccgccggcggccucggcggcggcgccgcccacgcccuccgcacccacggcuacugcgccgccuacgagacccucuacgccgccgccggcggcggcggcgccucccccgacuacaacuccuccgaguacgagggcccccucucccccccccucugccucaacggcaacuucucccucaagcaggacuccucccccgaccacgagaaguccuaccacuacuccaugcacuacuccgcccuccccggcucccgccccaccggccacggccucgucuucggcuccuccgccguccgcggcggcguccacuccgagaaccuccucuccuacgacaugcaccuccaccacgaccgcggccccauguacgaggagcucaacgccuucuuccacaacuga

SEQ ID NO: 46592 - RNA, 996 nt, Artificial Sequence
  derived and/or modified sequence opt2 from NEUROD4__Homo_sapiens__NP_067014
auguccaagaccuucgucaaguccaaggagaugggcgagcucgucaacacccccuccuggauggacaagggccucggcucccagaacgaggucaaggaggaggagucccgccccggcaccuacggcaugcucuccucccucaccgaggagcacgacuccaucgaggaggaggaggaggaggaggaggacggcgagaagcccaagcgccgcggccccaagaagaagaagaugaccaaggcccgccucgagcgcuuccgcgcccgccgcgucaaggccaacgcccgcgagcgcacccgcaugcacggccucaacgacgcccucgacaaccuccgccgcgucaugcccugcuacuccaagacccagaagcucuccaagaucgagacccuccgccucgcccgcaacuacaucugggcccucuccgagguccucgagaccggccagacccccgagggcaagggcuucgucgagaugcucugcaagggccucucccagcccaccuccaaccucgucgccggcugccuccagcucggcccccaguccguccuccucgagaagcacgaggacaagucccccaucugcgacuccgccaucuccguccacaacuucaacuaccagucccccggccuccccuccccccccuacggccacauggagacccaccuccuccaccucaagccccaggucuucaagucccucggcgaguccuccuucggcucccaccuccccgacugcuccaccccccccuacgagggcccccucacccccccccucuccaucuccggcaacuucucccucaagcaggacggcucccccgaccucgagaaguccuacuccuucaugccccacuaccccuccuccucccucuccuccggccacguccacuccacccccuuccaggccggcaccccccgcuacgacguccccaucgacauguccuacgacuccuacccccaccacggcaucggcacccagcucaacaccgucuucaccgaguga

SEQ ID NO: 46593 - RNA, 1014 nt, Artificial Sequence
  derived and/or modified sequence opt2 from NEUROD6__Homo_sapiens__NP_073565
augcucacccuccccuucgacgaguccgucgucaugcccgagucccagaugugccgcaaguucucccgcgagugcgaggaccagaagcagaucaagaagcccgaguccuucuccaagcagaucguccuccgcggcaaguccaucaagcgcgcccccggcgaggagaccgagaaggaggaggaggaggaggaccgcgaggaggaggacgagaacggccucccccgccgccgcggccuccgcaagaagaagaccaccaagcuccgccucgagcgcgucaaguuccgccgccaggaggccaacgcccgcgagcgcaaccgcaugcacggccucaacgacgcccucgacaaccuccgcaaggucguccccugcuacuccaagacccagaagcucuccaagaucgagacccuccgccucgccaagaacuacaucugggcccucuccgagauccuccgcaucggcaagcgccccgaccuccucaccuucguccagaaccucugcaagggccucucccagcccaccaccaaccucgucgccggcugccuccagcucaacgcccgcuccuuccucaugggccagggcggcgaggccgcccaccacacccgcucccccuacuccaccuucuacccccccuaccacucccccgagcucaccaccccccccggccacggcacccucgacaacuccaaguccaugaagcccuacaacuacugcuccgccuacgaguccuucuacgaguccaccucccccgagugcgccuccccccaguucgagggcccccucucccccccccccaucaacuacaacggcaucuucucccucaagcaggaggagacccucgacuacggcaagaacuacaacuacggcaugcacuacugcgccguccccccccgcggcccccucggccagggcgccauguuccgccuccccaccgacucccacuuccccuacgaccuccaccuccgcucccagucccucaccaugcaggacgagcucaacgccgucuuccacaacuga

SEQ ID NO: 46594 - RNA, 714 nt, Artificial Sequence
  derived and/or modified sequence opt2 from NEUROG1__Homo_sapiens__NP_006152
augcccgcccgccucgagaccugcaucuccgaccucgacugcgccuccuccuccggcuccgaccucuccggcuuccucaccgacgaggaggacugcgcccgccuccagcaggccgccuccgccuccggcccccccgcccccgcccgccgcggcgcccccaacaucucccgcgccuccgagguccccggcgcccaggacgacgagcaggagcgccgccgccgccgcggccgcacccgcguccgcuccgaggcccuccuccacucccuccgccgcucccgccgcgucaaggccaacgaccgcgagcgcaaccgcaugcacaaccucaacgccgcccucgacgcccuccgcuccguccuccccuccuuccccgacgacaccaagcucaccaagaucgagacccuccgcuucgccuacaacuacaucugggcccucgccgagacccuccgccucgccgaccagggccuccccggcggcggcgcccgcgagcgccuccuccccccccagugcguccccugccuccccggcccccccucccccgccuccgacgccgaguccuggggcuccggcgccgccgccgccuccccccucuccgaccccuccucccccgccgccuccgaggacuucaccuaccgccccggcgaccccgucuucuccuuccccucccuccccaaggaccuccuccacaccacccccugcuucauccccuaccacuga

SEQ ID NO: 46595 - RNA, 819 nt, Artificial Sequence
  derived and/or modified sequence opt2 from NEUROG2__Homo_sapiens__NP_076924
auguucgucaaguccgagacccucgagcucaaggaggaggaggacguccucguccuccucggcuccgccucccccgcccucgccgcccucaccccccucuccuccuccgccgacgaggaggaggaggaggagcccggcgccuccggcggcgcccgccgccagcgcggcgccgaggccggccagggcgcccgcggcggcgucgccgccggcgccgagggcugccgccccgcccgccuccucggccucguccacgacugcaagcgccgccccucccgcgcccgcgccgucucccgcggcgccaagaccgccgagaccguccagcgcaucaagaagacccgccgccucaaggccaacaaccgcgagcgcaaccgcaugcacaaccucaacgccgcccucgacgcccuccgcgagguccuccccaccuuccccgaggacgccaagcucaccaagaucgagacccuccgcuucgcccacaacuacaucugggcccucaccgagacccuccgccucgccgaccacugcggcggcggcggcggcggccuccccggcgcccucuucuccgaggccguccuccucucccccggcggcgccuccgccgcccucuccuccuccggcgacucccccucccccgccuccaccugguccugcaccaacucccccgcccccuccuccuccgucuccuccaacuccaccucccccuacuccugcacccucucccccgccucccccgccggcuccgacauggacuacuggcagccccccccccccgacaagcaccgcuacgccccccaccuccccaucgcccgcgacugcaucuga

SEQ ID NO: 46596 - RNA, 645 nt, Artificial Sequence
  derived and/or modified sequence opt2 from NEUROG3__Homo_sapiens__NP_066279
augaccccccagcccuccggcgcccccaccguccaggucacccgcgagaccgagcgcuccuucccccgcgccuccgaggacgaggucaccugccccaccuccgccccccccucccccacccgcacccgcggcaacugcgccgaggccgaggagggcggcugccgcggcgccccccgcaagcuccgcgcccgccgcggcggccgcucccgccccaaguccgagcucgcccucuccaagcagcgccgcucccgccgcaagaaggccaacgaccgcgagcgcaaccgcaugcacaaccucaacuccgcccucgacgcccuccgcggcguccuccccaccuuccccgacgacgccaagcucaccaagaucgagacccuccgcuucgcccacaacuacaucugggcccucacccagacccuccgcaucgccgaccacucccucuacgcccucgagccccccgccccccacugcggcgagcucggcucccccggcggcucccccggcgacuggggcucccucuacucccccgucucccaggccggcucccucucccccgccgccucccucgaggagcgccccggccuccucggcgccaccuucuccgccugccucucccccggcucccucgccuucuccgacuuccucuga

SEQ ID NO: 46597 - RNA, 8457 nt, Artificial Sequence
  derived and/or modified sequence opt2 from NF1__Homo_sapiens__NP_000258
auggccgcccaccgccccgucgaguggguccaggccgucgucucccgcuucgacgagcagcuccccaucaagaccggccagcagaacacccacaccaaggucuccaccgagcacaacaaggagugccucaucaacaucuccaaguacaaguucucccucgucaucuccggccucaccaccauccucaagaacgucaacaacaugcgcaucuucggcgaggccgccgagaagaaccucuaccucucccagcucaucauccucgacacccucgagaagugccucgccggccagcccaaggacaccaugcgccucgacgagaccaugcucgucaagcagcuccuccccgagaucugccacuuccuccacaccugccgcgagggcaaccagcacgccgccgagcuccgcaacuccgccuccggcguccucuucucccucuccugcaacaacuucaacgccgucuucucccgcaucuccacccgccuccaggagcucaccgucugcuccgaggacaacgucgacguccacgacaucgagcuccuccaguacaucaacgucgacugcgccaagcucaagcgccuccucaaggagaccgccuucaaguucaaggcccucaagaaggucgcccagcucgccgucaucaacucccucgagaaggccuucuggaacugggucgagaacuaccccgacgaguucaccaagcucuaccagaucccccagaccgacauggccgagugcgccgagaagcucuucgaccucgucgacggcuucgccgaguccaccaagcgcaaggccgccgucuggccccuccagaucauccuccucauccucugccccgagaucauccaggacaucuccaaggacgucgucgacgagaacaacaugaacaagaagcucuuccucgacucccuccgcaaggcccucgccggccacggcggcucccgccagcucaccgaguccgccgccaucgccugcgucaagcucugcaaggccuccaccuacaucaacugggaggacaacuccgucaucuuccuccucguccaguccauggucgucgaccucaagaaccuccucuucaaccccuccaagcccuucucccgcggcucccagcccgccgacgucgaccucaugaucgacugccucgucuccugcuuccgcaucuccccccacaacaaccagcacuucaagaucugccucgcccagaacucccccuccaccuuccacuacguccucgucaacucccuccaccgcaucaucaccaacuccgcccucgacugguggcccaagaucgacgccgucuacugccacuccgucgagcuccgcaacauguucggcgagacccuccacaaggccguccagggcugcggcgcccaccccgccauccgcauggcccccucccucaccuucaaggagaaggucaccucccucaaguucaaggagaagcccaccgaccucgagacccgcuccuacaaguaccuccuccucuccauggucaagcucauccacgccgaccccaagcuccuccucugcaacccccgcaagcagggccccgagacccagggcuccaccgccgagcucaucaccggccucguccagcucgucccccagucccacaugcccgagaucgcccaggaggccauggaggcccuccucguccuccaccagcucgacuccaucgaccucuggaaccccgacgcccccgucgagaccuucugggagaucuccucccagaugcucuucuacaucugcaagaagcucaccucccaccagaugcucuccuccaccgagauccucaaguggcuccgcgagauccucaucugccgcaacaaguuccuccucaagaacaagcaggccgaccgcuccuccugccacuuccuccucuucuacggcgucggcugcgacauccccuccuccggcaacaccucccagauguccauggaccacgaggagcuccuccgcacccccggcgccucccuccgcaagggcaagggcaacuccuccauggacuccgccgccggcugcuccggcaccccccccaucugccgccaggcccagaccaagcucgaggucgcccucuacauguuccucuggaaccccgacaccgaggccguccucgucgccauguccugcuuccgccaccucugcgaggaggccgacauccgcugcggcgucgacgaggucuccguccacaaccuccuccccaacuacaacaccuucauggaguucgccuccgucuccaacaugauguccaccggccgcgccgcccuccagaagcgcgucauggcccuccuccgccgcaucgagcaccccaccgccggcaacaccgaggccugggaggacacccacgccaagugggagcaggccaccaagcucauccucaacuaccccaaggccaagauggaggacggccaggccgccgagucccuccacaagaccaucgucaagcgccgcaugucccacgucuccggcggcggcuccaucgaccucuccgacaccgacucccuccaggaguggaucaacaugaccggcuuccucugcgcccucggcggcgucugccuccagcagcgcuccaacuccggccucgccaccuacuccccccccaugggccccgucuccgagcgcaagggcuccaugaucuccgucauguccuccgagggcaacgccgacacccccgucuccaaguucauggaccgccuccucucccucauggucugcaaccacgagaaggucggccuccagauccgcaccaacgucaaggaccucgucggccucgagcucucccccgcccucuaccccaugcucuucaacaagcucaagaacaccaucuccaaguucuucgacucccagggccagguccuccucaccgacaccaacacccaguucgucgagcagaccaucgccaucaugaagaaccuccucgacaaccacaccgagggcuccuccgagcaccucggccaggccuccaucgagaccaugaugcucaaccucguccgcuacguccgcguccucggcaacaugguccacgccauccagaucaagaccaagcucugccagcucgucgaggucaugauggcccgccgcgacgaccucuccuucugccaggagaugaaguuccgcaacaagauggucgaguaccucaccgacugggucaugggcaccuccaaccaggccgccgacgacgacgucaagugccucacccgcgaccucgaccaggccuccauggaggccgucgucucccuccucgccggccucccccuccagcccgaggagggcgacggcgucgagcucauggaggccaagucccagcucuuccucaaguacuucacccucuucaugaaccuccucaacgacugcuccgaggucgaggacgaguccgcccagaccggcggccgcaagcgcggcaugucccgccgccucgccucccuccgccacugcaccguccucgccauguccaaccuccucaacgccaacgucgacuccggccucaugcacuccaucggccucggcuaccacaaggaccuccagacccgcgccaccuucauggagguccucaccaagauccuccagcagggcaccgaguucgacacccucgccgagaccguccucgccgaccgcuucgagcgccucgucgagcucgucaccaugaugggcgaccagggcgagcuccccaucgccauggcccucgccaacgucguccccugcucccagugggacgagcucgcccgcguccucgucacccucuucgacucccgccaccuccucuaccagcuccucuggaacauguucuccaaggaggucgagcucgccgacuccaugcagacccucuuccgcggcaacucccucgccuccaagaucaugaccuucugcuucaaggucuacggcgccaccuaccuccagaagcuccucgacccccuccuccgcaucgucaucaccuccuccgacuggcagcacgucuccuucgaggucgaccccacccgccucgagcccuccgagucccucgaggagaaccagcgcaaccuccuccagaugaccgagaaguucuuccacgccaucaucuccuccuccuccgaguuccccccccagcuccgcuccgucugccacugccucuaccaggucgucucccagcgcuucccccagaacuccaucggcgccgucggcuccgccauguuccuccgcuucaucaaccccgccaucgucucccccuacgaggccggcauccucgacaagaagccccccccccgcaucgagcgcggccucaagcucauguccaagauccuccaguccaucgccaaccacguccucuucaccaaggaggagcacaugcgccccuucaacgacuucgucaaguccaacuucgacgccgcccgccgcuucuuccucgacaucgccuccgacugccccaccuccgacgccgucaaccacucccucuccuucaucuccgacggcaacguccucgcccuccaccgccuccucuggaacaaccaggagaagaucggccaguaccucuccuccaaccgcgaccacaaggccgucggccgccgccccuucgacaagauggccacccuccucgccuaccucggcccccccgagcacaagcccgucgccgacacccacugguccucccucaaccucaccuccuccaaguucgaggaguucaugacccgccaccagguccacgagaaggaggaguucaaggcccucaagacccucuccaucuucuaccaggccggcaccuccaaggccggcaaccccaucuucuacuacgucgcccgccgcuucaagaccggccagaucaacggcgaccuccucaucuaccacguccuccucacccucaagcccuacuacgccaagcccuacgagaucgucgucgaccucacccacaccggccccuccaaccgcuucaagaccgacuuccucuccaagugguucgucgucuuccccggcuucgccuacgacaacgucuccgccgucuacaucuacaacugcaacuccuggguccgcgaguacaccaaguaccacgagcgccuccucaccggccucaagggcuccaagcgccucgucuucaucgacugccccggcaagcucgccgagcacaucgagcacgagcagcagaagcuccccgccgccacccucgcccucgaggaggaccucaaggucuuccacaacgcccucaagcucgcccacaaggacaccaaggucuccaucaaggucggcuccaccgccguccaggucaccuccgccgagcgcaccaagguccucggccaguccgucuuccucaacgacaucuacuacgccuccgagaucgaggagaucugccucgucgacgagaaccaguucacccucaccaucgccaaccagggcaccccccucaccuucaugcaccaggagugcgaggccaucguccaguccaucauccacauccgcacccgcugggagcucucccagcccgacuccaucccccagcacaccaagauccgccccaaggacguccccggcacccuccucaacaucgcccuccucaaccucggcuccuccgaccccucccuccgcuccgccgccuacaaccuccucugcgcccucaccugcaccuucaaccucaagaucgagggccagcuccucgagaccuccggccucugcauccccgccaacaacacccucuucaucgucuccaucuccaagacccucgccgccaacgagccccaccucacccucgaguuccucgaggagugcaucuccggcuucuccaaguccuccaucgagcucaagcaccucugccucgaguacaugacccccuggcucuccaaccucguccgcuucugcaagcacaacgacgacgccaagcgccagcgcgucaccgccauccucgacaagcucaucaccaugaccaucaacgagaagcagauguaccccuccauccaggccaagaucuggggcucccucggccagaucaccgaccuccucgacgucguccucgacuccuucaucaagaccuccgccaccggcggccucggcuccaucaaggccgaggucauggccgacaccgccgucgcccucgccuccggcaacgucaagcucgucuccuccaaggucaucggccgcaugugcaagaucaucgacaagaccugccucucccccacccccacccucgagcagcaccucaugugggacgacaucgccauccucgcccgcuacaugcucaugcucuccuucaacaacucccucgacgucgccgcccaccuccccuaccucuuccacgucgucaccuuccucgucgccaccggcccccucucccuccgcgccuccacccacggccucgucaucaacaucauccacucccucugcaccugcucccagcuccacuucuccgaggagaccaagcagguccuccgccucucccucaccgaguucucccuccccaaguucuaccuccucuucggcaucuccaaggucaaguccgccgccgucaucgccuuccgcuccuccuaccgcgaccgcuccuucucccccggcuccuacgagcgcgagaccuucgcccucaccucccucgagaccgucaccgaggcccuccucgagaucauggaggccugcaugcgcgacauccccaccugcaaguggcucgaccaguggaccgagcucgcccagcgcuucgccuuccaguacaaccccucccuccagccccgcgcccucgucgucuucggcugcaucuccaagcgcgucucccacggccagaucaagcagaucauccgcauccucuccaaggcccucgaguccugccucaagggccccgacaccuacaacucccagguccucaucgaggccaccgucaucgcccucaccaagcuccagccccuccucaacaaggacuccccccuccacaaggcccucuucugggucgccgucgccguccuccagcucgacgaggucaaccucuacuccgccggcaccgcccuccucgagcagaaccuccacacccucgacucccuccgcaucuucaacgacaagucccccgaggaggucuucauggccauccgcaacccccucgaguggcacugcaagcagauggaccacuucgucggccucaacuucaacuccaacuucaacuucgcccucgucggccaccuccucaagggcuaccgccaccccucccccgccaucgucgcccgcaccguccgcauccuccacacccuccucacccucgucaacaagcaccgcaacugcgacaaguucgaggucaacacccaguccgucgccuaccucgccgcccuccucaccgucuccgaggagguccgcucccgcugcucccucaagcaccgcaagucccuccuccucaccgacaucuccauggagaacguccccauggacaccuaccccauccaccacggcgaccccuccuaccgcacccucaaggagacccagcccugguccucccccaagggcuccgagggcuaccucgccgccaccuaccccaccgucggccagaccuccccccgcgcccgcaaguccaugucccucgacaugggccagcccucccaggccaacaccaagaagcuccucggcacccgcaaguccuucgaccaccucaucuccgacaccaaggcccccaagcgccaggagauggaguccggcaucaccaccccccccaagaugcgccgcgucgccgagaccgacuacgagauggagacccagcgcaucuccuccucccagcagcacccccaccuccgcaaggucuccgucuccgaguccaacguccuccucgacgaggagguccucaccgaccccaagauccaggcccuccuccucaccguccucgccacccucgucaaguacaccaccgacgaguucgaccagcgcauccucuacgaguaccucgccgaggccuccgucgucuuccccaaggucuuccccgucguccacaaccuccucgacuccaagaucaacacccuccucucccucugccaggaccccaaccuccucaaccccauccacggcaucguccaguccgucgucuaccacgaggagucccccccccaguaccagaccuccuaccuccaguccuucggcuucaacggccucuggcgcuucgccggccccuucuccaagcagacccagauccccgacuacgccgagcucaucgucaaguuccucgacgcccucaucgacaccuaccuccccggcaucgacgaggagaccuccgaggagucccuccucacccccaccucccccuacccccccgcccuccagucccagcucuccaucaccgccaaccucaaccucuccaacuccaugaccucccucgccaccucccagcacucccccggcaucgacaaggagaacgucgagcucucccccaccaccggccacugcaacuccggccgcacccgccacggcuccgccucccagguccagaagcagcgcuccgccggcuccuucaagcgcaacuccaucaagaagaucgucuga

SEQ ID NO: 46598 - RNA, 1788 nt, Artificial Sequence
  derived and/or modified sequence opt2 from NF2__Homo_sapiens__NP_000259
auggccggcgccaucgccucccgcauguccuucuccucccucaagcgcaagcagcccaagaccuucaccguccgcaucgucaccauggacgccgagauggaguucaacugcgagaugaaguggaagggcaaggaccucuucgaccucgucugccgcacccucggccuccgcgagaccugguucuucggccuccaguacaccaucaaggacaccgucgccuggcucaagauggacaagaagguccucgaccacgacgucuccaaggaggagcccgucaccuuccacuuccucgccaaguucuaccccgagaacgccgaggaggagcucguccaggagaucacccagcaccucuucuuccuccaggucaagaagcagauccucgacgagaagaucuacugcccccccgaggccuccguccuccucgccuccuacgccguccaggccaaguacggcgacuacgaccccuccguccacaagcgcggcuuccucgcccaggaggagcuccuccccaagcgcgucaucaaccucuaccagaugacccccgagaugugggaggagcgcaucaccgccugguacgccgagcaccgcggccgcgcccgcgacgaggccgagauggaguaccucaagaucgcccaggaccucgagauguacggcgucaacuacuucgccauccgcaacaagaagggcaccgagcuccuccucggcgucgacgcccucggccuccacaucuacgaccccgagaaccgccucacccccaagaucuccuuccccuggaacgagauccgcaacaucuccuacuccgacaaggaguucaccaucaagccccucgacaagaagaucgacgucuucaaguucaacuccuccaagcuccgcgucaacaagcucauccuccagcucugcaucggcaaccacgaccucuucaugcgccgccgcaaggccgacucccucgagguccagcagaugaaggcccaggcccgcgaggagaaggcccgcaagcagauggagcgccagcgccucgcccgcgagaagcagaugcgcgaggaggccgagcgcacccgcgacgagcucgagcgccgccuccuccagaugaaggaggaggccaccauggccaacgaggcccucaugcgcuccgaggagaccgccgaccuccucgccgagaaggcccagaucaccgaggaggaggccaagcuccucgcccagaaggccgccgaggccgagcaggagaugcagcgcaucaaggccaccgccauccgcaccgaggaggagaagcgccucauggagcagaagguccucgaggccgagguccucgcccucaagauggccgaggaguccgagcgccgcgccaaggaggccgaccagcucaagcaggaccuccaggaggcccgcgaggccgagcgccgcgccaagcagaagcuccucgagaucgccaccaagcccaccuacccccccaugaaccccauccccgccccccucccccccgacauccccuccuucaaccucaucggcgacucccucuccuucgacuucaaggacaccgacaugaagcgccucuccauggagaucgagaaggagaaggucgaguacauggagaaguccaagcaccuccaggagcagcucaacgagcucaagaccgagaucgaggcccucaagcucaaggagcgcgagaccgcccucgacauccuccacaacgagaacuccgaccgcggcggcuccuccaagcacaacaccaucaagaagcucacccuccaguccgccaagucccgcgucgccuucuucgaggagcucuga

SEQ ID NO: 46599 - RNA, 813 nt, Artificial Sequence
  derived and/or modified sequence opt2 from NFAM1__Homo_sapiens__NP_666017
auggagaaccagcccguccgcuggcgcgcccuccccggccucccccgcccccccggccuccccgccgcccccuggcuccuccucggcguccuccuccuccccggcacccuccgccucgccggcggccaguccgucacccacaccggccuccccaucauggccucccucgccaacaccgccaucuccuucuccugccgcaucaccuaccccuacaccccccaguucaaggucuucaccgucuccuacuuccacgaggaccuccagggccagcgcucccccaagaagcccaccaacugccaccccggccucggcaccgagaaccagucccacacccucgacugccaggucacccucguccuccccggcgccuccgccaccggcaccuacuacugcuccguccacuggccccacuccaccguccgcggcuccggcaccuucauccucguccgcgacgccggcuaccgcgagcccccccaguccccccagaagcuccuccucuucggcuucaccggccuccucuccguccucuccgucgucggcaccgcccuccuccucuggaacaagaagcgcaugcgcggccccggcaaggaccccacccgcaagugccccgacccccgcuccgccuccucccccaagcagcaccccuccgaguccgucuacaccgcccuccagcgccgcgagaccgaggucuacgccugcaucgagaacgaggacggcuccucccccaccgccaagcaguccccccucucccaggagcgcccccaccgcuucgaggacgacggcgagcucaaccucgucuacgagaaccucuga

SEQ ID NO: 46600 - RNA, 3723 nt, Artificial Sequence
  derived and/or modified sequence opt2 from NFASC__Homo_sapiens__NP_001005388
auggcccgccagccccccccccccuggguccacgccgccuuccuccucugccuccucucccucggcggcgccaucgagauccccauggaccccuccauccagaacgagcucacccagccccccaccaucaccaagcaguccgccaaggaccacaucgucgacccccgcgacaacauccucaucgagugcgaggccaagggcaaccccgcccccuccuuccacuggacccgcaacucccgcuucuucaacaucgccaaggacccccgcgucuccaugcgccgccgcuccggcacccucgucaucgacuuccgcuccggcggccgccccgaggaguacgagggcgaguaccagugcuucgcccgcaacaaguucggcaccgcccucuccaaccgcauccgccuccaggucuccaaguccccccucuggcccaaggagaaccucgaccccgucgucguccaggagggcgccccccucacccuccagugcaaccccccccccggccuccccucccccgucaucuucuggauguccuccuccauggagcccaucacccaggacaagcgcgucucccagggccacaacggcgaccucuacuucuccaacgucaugcuccaggacaugcagaccgacuacuccugcaacgcccgcuuccacuucacccacaccauccagcagaagaaccccuucacccucaagguccucaccacccgcggcgucgccgagcgcacccccuccuucauguacccccagggcaccgccuccucccagaugguccuccgcggcauggaccuccuccucgagugcaucgccuccggcguccccacccccgacaucgccugguacaagaagggcggcgaccuccccuccgacaaggccaaguucgagaacuucaacaaggcccuccgcaucaccaacgucuccgaggaggacuccggcgaguacuucugccucgccuccaacaagaugggcuccauccgccacaccaucuccguccgcgucaaggccgcccccuacuggcucgacgagcccaagaaccucauccucgcccccggcgaggacggccgccucgucugccgcgccaacggcaaccccaagcccaccguccaguggauggucaacggcgagccccuccaguccgccccccccaaccccaaccgcgaggucgccggcgacaccaucaucuuccgcgacacccagaucuccucccgcgccgucuaccagugcaacaccuccaacgagcacggcuaccuccucgccaacgccuucgucuccguccucgacguccccccccgcaugcucuccccccgcaaccagcucauccgcgucauccucuacaaccgcacccgccucgacugccccuucuucggcucccccauccccacccuccgcugguucaagaacggccagggcuccaaccucgacggcggcaacuaccacgucuacgagaacggcucccucgagaucaagaugauccgcaaggaggaccagggcaucuacaccugcgucgccaccaacauccucggcaaggccgagaaccagguccgccucgaggucaaggaccccacccgcaucuaccgcaugcccgaggaccaggucgcccgccgcggcaccaccguccagcucgagugccgcgucaagcacgaccccucccucaagcucaccgucuccuggcucaaggacgacgagccccucuacaucggcaaccgcaugaagaaggaggacgacucccucaccaucuucggcgucgccgagcgcgaccagggcuccuacaccugcgucgccuccaccgagcucgaccaggaccucgccaaggccuaccucaccguccucgccgaccaggccacccccaccaaccgccucgccgcccuccccaagggccgccccgaccgcccccgcgaccucgagcucaccgaccucgccgagcgcuccguccgccucaccuggauccccggcgacgccaacaacucccccaucaccgacuacgucguccaguucgaggaggaccaguuccagcccggcgucuggcacgaccacuccaaguaccccggcuccgucaacuccgccguccuccgccucucccccuacgucaacuaccaguuccgcgucaucgccaucaacgaggucggcuccucccaccccucccuccccuccgagcgcuaccgcaccuccggcgccccccccgaguccaaccccggcgacgucaagggcgagggcacccgcaagaacaacauggagaucaccuggacccccaugaacgccaccuccgccuucggccccaaccuccgcuacaucgucaaguggcgccgccgcgagacccgcgaggccuggaacaacgucaccgucuggggcucccgcuacgucgucggccagacccccgucuacguccccuacgagauccgcguccaggccgagaacgacuucggcaagggccccgagcccgaguccgucaucggcuacuccggcgaggaccuccccuccgccccccgccgcuuccgcguccgccagcccaaccucgagaccaucaaccucgagugggaccaccccgagcaccccaacggcaucaugaucggcuacacccucaaguacgucgccuucaacggcaccaaggucggcaagcagaucgucgagaacuucucccccaaccagaccaaguucaccguccagcgcaccgaccccgucucccgcuaccgcuucacccucuccgcccgcacccaggucggcuccggcgaggccgucaccgaggagucccccgccccccccaacgaggccacccccaccgccgccccccccacccucccccccaccaccgucggcgccaccggcgccgucuccuccaccgacgccaccgccaucgccgccaccaccgaggccaccaccguccccaucauccccaccgucgcccccaccaccaucgccaccaccaccaccgucgccaccaccaccaccaccaccgccgccgccaccaccaccaccgaguccccccccaccaccaccuccggcaccaagauccacgaguccgcccccgacgagcaguccaucuggaacgucaccguccuccccaacuccaagugggccaacaucaccuggaagcacaacuucggccccggcaccgacuucgucgucgaguacaucgacuccaaccacaccaagaagaccguccccgucaaggcccaggcccagcccauccagcucaccgaccucuaccccggcaugaccuacacccuccgcgucuacucccgcgacaacgagggcaucuccuccaccgucaucaccuucaugaccuccaccgccuacaccaacaaccaggccgacaucgccacccagggcugguucaucggccucaugugcgccaucgcccuccucguccucauccuccucaucgucugcuucaucaagcgcucccgcggcggcaaguaccccguccgcgagaagaaggacgucccccucggccccgaggaccccaaggaggaggacggcuccuucgacuacuccgacgaggacaacaagccccuccagggcucccagaccucccucgacggcaccaucaagcagcaggaguccgacgacucccucgucgacuacggcgagggcggcgagggccaguucaacgaggacggcuccuucaucggccaguacaccgucaagaaggacaaggaggagaccgagggcaacgaguccuccgaggccaccucccccgucaacgccaucuacucccucgccuga

SEQ ID NO: 46601 - RNA, 4647 nt, Artificial Sequence
  derived and/or modified sequence opt2 from NFAT5__Homo_sapiens__NP_001106649
augcccuccgacuucaucucccuccucuccgccgaccucgaccucgagucccccaagucccucuacucccgcgacucccucaagcuccaccccucccagaacuuccaccgcgccggccuccucgaggaguccgucuacgaccuccuccccaaggagcuccagcucccccccucccgcgagaccuccgucgccuccaugucccagaccuccggcggcgaggccggcucccccccccccgccgucgucgccgccgacgccuccuccgcccccuccuccuccuccaugggcggcgccugcuccuccuucaccaccuccuccucccccaccaucuacuccaccuccgucaccgacuccaaggccaugcaggucgaguccugcuccuccgccgucggcgucuccaaccgcggcgucuccgagaagcagcucaccuccaacaccguccagcagcaccccuccacccccaagcgccacaccguccucuacaucucccccccccccgaggaccuccucgacaacucccgcauguccugccaggacgagggcugcggccucgaguccgagcaguccugcuccauguggauggaggacucccccuccaacuucuccaacauguccaccuccuccuacaacgacaacaccgaggucccccgcaagucccgcaagcgcaaccccaagcagcgccccggcgucaagcgccgcgacugcgaggaguccaacauggacaucuucgacgccgacuccgccaaggccccccacuacguccucucccagcucaccaccgacaacaagggcaacuccaaggccggcaacggcacccucgagaaccagaagggcaccggcgucaagaagucccccaugcucugcggccaguaccccgucaaguccgagggcaaggagcucaagaucgucguccagcccgagacccagcaccgcgcccgcuaccucaccgagggcucccgcggcuccgucaaggaccgcacccagcagggcuuccccaccgucaagcucgagggccacaacgagcccgucguccuccaggucuucgucggcaacgacuccggccgcgucaagccccacggcuucuaccaggccugccgcgucaccggccgcaacaccacccccugcaaggaggucgacaucgagggcaccaccgucaucgaggucggccucgaccccuccaacaacaugacccucgccgucgacugcgucggcauccucaagcuccgcaacgccgacgucgaggcccgcaucggcaucgccggcuccaagaagaaguccacccgcgcccgccucgucuuccgcgucaacaucaugcgcaaggacggcuccacccucacccuccagacccccuccucccccauccucugcacccagcccgccggcguccccgagauccucaagaagucccuccacuccugcuccgucaagggcgaggaggaggucuuccucaucggcaagaacuuccucaagggcaccaaggucaucuuccaggagaacgucuccgacgagaacuccuggaaguccgaggccgagaucgacauggagcucuuccaccagaaccaccucaucgucaaggucccccccuaccacgaccagcacaucacccuccccgucuccgucggcaucuacgucgucaccaacgccggccgcucccacgacguccagcccuucaccuacacccccgaccccgccgccggcgcccucaacgucaacgucaagaaggagaucuccucccccgcccgccccugcuccuucgaggaggccaugaaggccaugaagaccaccggcugcaaccucgacaaggucaacaucauccccaacgcccucaugaccccccucauccccuccuccaugaucaaguccgaggacgucacccccauggaggucaccgccgagaagcgcuccuccaccaucuucaagaccaccaaguccgucggcuccacccagcagacccucgagaacaucuccaacaucgccggcaacggcuccuucuccucccccuccuccucccaccuccccuccgagaacgagaagcagcagcagauccagcccaaggccuacaaccccgagacccucaccaccauccagacccaggacaucucccagcccggcaccuuccccgccgucuccgccuccucccagcuccccaacuccgacgcccuccuccagcaggccacccaguuccagacccgcgagacccagucccgcgagauccuccaguccgacggcaccgucgucaaccucucccagcucaccgaggccucccagcagcagcagcaguccccccuccaggagcaggcccagacccuccagcagcagaucuccuccaacaucuuccccucccccaacuccgucucccagcuccagaacaccauccagcagcuccaggccggcuccuucaccggcuccaccgccuccggcuccuccggcuccgucgaccucguccagcagguccucgaggcccagcagcagcucuccuccguccucuucuccgcccccgacggcaacgagaacguccaggagcagcucuccgccgacaucuuccagcaggucucccagauccaguccggcgucucccccggcauguucuccuccaccgagcccaccguccacacccgccccgacaaccuccuccccggccgcgccgaguccguccacccccaguccgagaacacccucuccaaccagcagcagcagcagcagcagcagcagcaggucauggaguccuccgccgccauggucauggagaugcagcaguccaucugccaggccgccgcccagauccaguccgagcucuuccccuccaccgccuccgccaacggcaaccuccagcagucccccgucuaccagcagaccucccacaugauguccgcccucuccaccaacgaggacaugcagaugcagugcgagcucuucuccuccccccccgccgucuccggcaacgagaccuccaccaccaccacccagcaggucgccacccccggcaccaccauguuccagaccuccuccuccggcgacggcgaggagaccggcacccaggccaagcagauccagaacuccgucuuccagaccaugguccagaugcagcacuccggcgacaaccagccccaggucaaccucuucuccuccaccaaguccaugauguccguccagaacuccggcacccagcagcagggcaacggccucuuccagcagggcaacgagaugaugucccuccaguccggcaacuuccuccagcaguccucccacucccaggcccagcucuuccacccccagaaccccaucgccgacgcccagaaccucucccaggagacccagggcucccucuuccacucccccaaccccaucguccacucccagaccuccaccaccuccuccgagcagaugcagccccccauguuccacucccaguccaccaucgccguccuccagggcuccuccgucccccaggaccagcaguccaccaacaucuuccucucccagucccccaugaacaaccuccagaccaacaccgucgcccaggaggccuucuucgccgcccccaacuccaucuccccccuccaguccaccuccaacuccgagcagcaggccgccuuccagcagcaggcccccaucucccacauccagacccccaugcucucccaggagcaggcccagcccccccagcagggccucuuccagccccaggucgcccucggcucccucccccccaaccccaugccccagucccagcagggcaccauguuccagucccagcacuccaucgucgccaugcaguccaacucccccucccaggagcagcagcagcagcagcagcagcagcagcagcagcagcagcagcagcagcaguccauccucuucuccaaccagaacaccauggccaccauggccucccccaagcagcccccccccaacaugaucuucaaccccaaccagaaccccauggccaaccaggagcagcagaaccaguccaucuuccaccagcaguccaacauggcccccaugaaccaggagcagcagcccaugcaguuccagucccaguccaccgucuccucccuccagaaccccggccccacccaguccgaguccucccagaccccccucuuccacuccuccccccagauccagcucguccagggcucccccuccucccaggagcagcaggucacccucuuccucucccccgccuccauguccgcccuccagaccuccaucaaccagcaggacaugcagcaguccccccucuacuccccccagaacaacaugcccggcauccagggcgccaccuccuccccccagccccaggccacccucuuccacaacaccgccggcggcaccaugaaccagcuccagaacucccccggcuccucccagcagaccuccggcauguuccucuucggcauccagaacaacugcucccagcuccucaccuccggccccgccacccuccccgaccagcucauggccaucucccagcccggccagccccagaacgagggccagccccccgucaccacccuccucucccagcagaugcccgagaacuccccccucgccuccuccaucaacaccaaccagaacaucgagaagaucgaccuccucgucucccuccagaaccagggcaacaaccucaccggcuccuucuga

SEQ ID NO: 46602 - RNA, 2832 nt, Artificial Sequence
  derived and/or modified sequence opt2 from NFATC1__Homo_sapiens__NP_001265598
augcccuccaccuccuuccccguccccuccaaguucccccucggccccgccgccgccgucuucggccgcggcgagacccucggccccgccccccgcgccggcggcaccaugaaguccgccgaggaggagcacuacggcuacgccuccuccaacgucucccccgcccucccccuccccaccgcccacuccacccuccccgcccccugccacaaccuccagaccuccacccccggcaucaucccccccgccgaccaccccuccggcuacggcgccgcccucgacggcggccccgccggcuacuuccucuccuccggccacacccgccccgacggcgcccccgcccucgaguccccccgcaucgagaucaccuccugccucggccucuaccacaacaacaaccaguucuuccacgacgucgaggucgaggacguccuccccuccuccaagcgcucccccuccaccgccacccucucccuccccucccucgaggccuaccgcgaccccuccugccucucccccgccuccucccucuccucccgcuccugcaacuccgaggccuccuccuacgaguccaacuacuccuaccccuacgccuccccccagaccucccccuggcagucccccugcgucucccccaagaccaccgaccccgaggagggcuucccccgcggccucggcgccugcacccuccucggcuccccccgccacucccccuccaccuccccccgcgccuccgucaccgaggaguccuggcucggcgcccgcuccucccgccccgccucccccugcaacaagcgcaaguacucccucaacggccgccagccccccuacuccccccaccacucccccacccccuccccccacggcuccccccgcgucuccgucaccgacgacuccuggcucggcaacaccacccaguacaccuccuccgccaucgucgccgccaucaacgcccucaccaccgacuccucccucgaccucggcgacggcguccccgucaagucccgcaagaccacccucgagcagccccccuccgucgcccucaaggucgagcccgucggcgaggaccucggcuccccccccccccccgccgacuucgcccccgaggacuacuccuccuuccagcacauccgcaagggcggcuucugcgaccaguaccucgccgucccccagcaccccuaccagugggccaagcccaagccccucucccccaccuccuacaugucccccacccuccccgcccucgacuggcagcuccccucccacuccggccccuacgagcuccgcaucgagguccagcccaagucccaccaccgcgcccacuacgagaccgagggcucccgcggcgccgucaaggccuccgccggcggccaccccaucguccagcuccacggcuaccucgagaacgagccccucaugcuccagcucuucaucggcaccgccgacgaccgccuccuccgcccccacgccuucuaccagguccaccgcaucaccggcaagaccgucuccaccaccucccacgaggccauccucuccaacaccaagguccucgagaucccccuccuccccgagaacuccaugcgcgccgucaucgacugcgccggcauccucaagcuccgcaacuccgacaucgagcuccgcaagggcgagaccgacaucggccgcaagaacacccgcguccgccucgucuuccgcguccacgucccccagcccuccggccgcacccucucccuccaggucgccuccaaccccaucgagugcucccagcgcuccgcccaggagcucccccucgucgagaagcaguccaccgacuccuaccccgucgucggcggcaagaagaugguccucuccggccacaacuuccuccaggacuccaaggucaucuucgucgagaaggcccccgacggccaccacgucugggagauggaggccaagaccgaccgcgaccucugcaagcccaacucccucgucgucgagaucccccccuuccgcaaccagcgcaucaccucccccguccacgucuccuucuacgucugcaacggcaagcgcaagcgcucccaguaccagcgcuucaccuaccuccccgccaacguccccaucaucaagaccgagcccaccgacgacuacgagcccgcccccaccugcggccccgucucccagggccucuccccccucccccgccccuacuacucccagcagcucgccaugccccccgaccccuccuccugccucgucgccggcuucccccccugcccccagcgcuccacccucaugcccgccgcccccggcgucucccccaagcuccacgaccucucccccgccgccuacaccaagggcgucgccucccccggccacugccaccucggccucccccagcccgccggcgaggcccccgccguccaggacgucccccgccccgucgccacccaccccggcucccccggccagcccccccccgcccuccucccccagcaggucuccgccccccccuccuccuccugcccccccggccucgagcacucccucugccccuccucccccucccccccccucccccccgccacccaggagcccaccugccuccagcccugcucccccgccugcccccccgccaccggccgcccccagcaccuccccuccaccguccgccgcgacgagucccccaccgccggcccccgccuccuccccgagguccacgaggacggcucccccaaccucgcccccauccccgucaccgucaagcgcgagcccgaggagcucgaccagcucuaccucgacgacgucaacgagaucauccgcaacgaccucuccuccaccuccacccacuccuga

SEQ ID NO: 46603 - RNA, 2706 nt, Artificial Sequence
  derived and/or modified sequence opt2 from NFATC2__Homo_sapiens__NP_001129493
augcagcgcgaggccgccuuccgccucggccacugccacccccuccgcaucaugggcuccgucgaccaggaggagcccaacgcccacaaggucgccuccccccccuccggccccgccuaccccgacgacguccucgacuacggccucaagcccuacuccccccucgccucccucuccggcgagccccccggccgcuucggcgagcccgaccgcgucggcccccagaaguuccucuccgccgccaagcccgccggcgccuccggccucuccccccgcaucgagaucacccccucccacgagcucauccaggccgucggcccccuccgcaugcgcgacgccggccuccucgucgagcagcccccccucgccggcgucgccgccuccccccgcuucacccuccccguccccggcuucgagggcuaccgcgagccccucugccucucccccgccuccuccggcuccuccgccuccuucaucuccgacaccuucucccccuacaccucccccugcgucucccccaacaacggcggccccgacgaccucugcccccaguuccagaacauccccgcccacuacuccccccgcaccucccccaucauguccccccgcaccucccucgccgaggacuccugccucggccgccacucccccgucccccgccccgccucccgcuccuccucccccggcgccaagcgccgccacuccugcgccgaggcccucgucgcccucccccccggcgccuccccccagcgcucccgcucccccuccccccagcccuccucccacgucgccccccaggaccacggcucccccgccggcuacccccccgucgccggcuccgccgucaucauggacgcccucaacucccucgccaccgacucccccugcggcaucccccccaagauguggaagaccucccccgaccccucccccgucuccgccgcccccuccaaggccggccucccccgccacaucuaccccgccgucgaguuccucggccccugcgagcagggcgagcgccgcaacuccgcccccgaguccauccuccucgucccccccaccuggcccaagccccucguccccgccauccccaucugcuccauccccgucaccgccucccuccccccccucgaguggccccucuccucccaguccggcuccuacgagcuccgcaucgagguccagcccaagccccaccaccgcgcccacuacgagaccgagggcucccgcggcgccgucaaggcccccaccggcggccaccccgucguccagcuccacggcuacauggagaacaagccccucggccuccagaucuucaucggcaccgccgacgagcgcauccucaagccccacgccuucuaccagguccaccgcaucaccggcaagaccgucaccaccaccuccuacgagaagaucgucggcaacaccaagguccucgagaucccccucgagcccaagaacaacaugcgcgccaccaucgacugcgccggcauccucaagcuccgcaacgccgacaucgagcuccgcaagggcgagaccgacaucggccgcaagaacacccgcguccgccucgucuuccgcguccacauccccgaguccuccggccgcaucgucucccuccagaccgccuccaaccccaucgagugcucccagcgcuccgcccacgagcuccccauggucgagcgccaggacaccgacuccugccucgucuacggcggccagcagaugauccucaccggccagaacuucaccuccgaguccaaggucgucuucaccgagaagaccaccgacggccagcagaucugggagauggaggccaccgucgacaaggacaagucccagcccaacaugcucuucgucgagauccccgaguaccgcaacaagcacauccgcacccccgucaaggucaacuucuacgucaucaacggcaagcgcaagcgcucccagccccagcacuucaccuaccaccccguccccgccaucaagaccgagcccaccgacgaguacgaccccacccucaucugcucccccacccacggcggccucggcucccagcccuacuacccccagcaccccauggucgccgagucccccuccugccucgucgccaccauggcccccugccagcaguuccgcaccggccucuccucccccgacgcccgcuaccagcagcagaaccccgccgccguccucuaccagcgcuccaagucccucucccccucccuccucggcuaccagcagcccgcccucauggccgccccccucucccucgccgacgcccaccgcuccguccucguccacgccggcucccagggccaguccuccgcccuccuccaccccucccccaccaaccagcaggccucccccgucauccacuacucccccaccaaccagcagcuccgcugcggcucccaccaggaguuccagcacaucauguacugcgagaacuucgcccccggcaccacccgccccggccccccccccgucucccagggccagcgccucucccccggcuccuaccccaccgucauccagcagcagaacgccaccucccagcgcgccgccaagaacggcccccccgucuccgaccagaaggagguccuccccgccggcgucaccaucaagcaggagcagaaccucgaccagaccuaccucgacgacgagcucaucgacacccaccucuccuggauccagaacauccucuga

SEQ ID NO: 46604 - RNA, 3207 nt, Artificial Sequence
  derived and/or modified sequence opt2 from NFATC3__Homo_sapiens__NP_004546
augaccaccgccaacugcggcgcccacgacgagcucgacuucaagcucgucuucggcgaggacggcgcccccgccccccccccccccggcucccgccccgccgaccucgagcccgacgacugcgccuccaucuacaucuucaacgucgaccccccccccuccacccucaccaccccccucugccucccccaccacggccuccccucccacuccuccguccucucccccuccuuccagcuccagucccacaagaacuacgagggcaccugcgagauccccgaguccaaguacuccccccucggcggccccaagcccuucgagugccccuccauccagaucaccuccaucucccccaacugccaccaggagcucgacgcccacgaggacgaccuccagaucaacgaccccgagcgcgaguuccucgagcgccccucccgcgaccaccucuaccucccccucgagcccuccuaccgcgaguccucccucucccccucccccgccuccuccaucuccucccgcuccugguucuccgacgccuccuccugcgagucccucucccacaucuacgacgacgucgacuccgagcucaacgaggccgccgcccgcuucacccucggcuccccccucaccucccccggcggcucccccggcggcugccccggcgaggagaccuggcaccagcaguacggccucggccacucccucuccccccgccagucccccugccacuccccccgcuccuccgucaccgacgagaacuggcucuccccccgccccgccuccggccccuccucccgccccaccucccccugcggcaagcgccgccacuccuccgccgaggucugcuacgccggcucccucuccccccaccacucccccguccccucccccggccacuccccccgcggcuccgucaccgaggacaccuggcucaacgccuccguccacggcggcuccggccucggccccgccgucuuccccuuccaguacugcgucgagaccgacaucccccucaagacccgcaagaccuccgaggaccaggccgccauccuccccggcaagcucgagcucugcuccgacgaccagggcucccucucccccgcccgcgagaccuccaucgacgacggccucggcucccaguacccccucaagaaggacuccugcggcgaccaguuccucuccguccccucccccuucaccugguccaagcccaagcccggccacacccccaucuuccgcaccuccucccuccccccccucgacuggccccuccccgcccacuucggccagugcgagcucaagaucgagguccagcccaagacccaccaccgcgcccacuacgagaccgagggcucccgcggcgccgucaaggccuccaccggcggccaccccgucgucaagcuccucggcuacaacgagaagcccaucaaccuccagauguucaucggcaccgccgacgaccgcuaccuccgcccccacgccuucuaccagguccaccgcaucaccggcaagaccgucgccaccgccucccaggagaucaucaucgccuccaccaagguccucgagaucccccuccuccccgagaacaacauguccgccuccaucgacugcgccggcauccucaagcuccgcaacuccgacaucgagcuccgcaagggcgagaccgacaucggccgcaagaacacccgcguccgccucgucuuccgcguccacaucccccagcccuccggcaagguccucucccuccagaucgccuccauccccgucgagugcucccagcgcuccgcccaggagcucccccacaucgagaaguacuccaucaacuccugcuccgucaacggcggccacgagauggucgucaccggcuccaacuuccuccccgaguccaagaucaucuuccucgagaagggccaggacggccgcccccagugggaggucgagggcaagaucauccgcgagaagugccagggcgcccacaucguccucgaggucccccccuaccacaaccccgccgucaccgccgccguccagguccacuucuaccucugcaacggcaagcgcaagaagucccagucccagcgcuucaccuacacccccguccucaugaagcaggagcaccgcgaggagaucgaccucuccuccguccccucccuccccgucccccaccccgcccagacccagcgccccuccuccgacuccggcugcucccacgacuccguccucuccggccagcgcucccucaucugcuccaucccccagaccuacgccuccauggucaccuccucccaccucccccagcuccagugccgcgacgaguccgucuccaaggagcagcacaugauccccucccccaucguccaccagcccuuccaggucacccccaccccccccgucggcuccuccuaccagcccaugcagaccaacgucgucuacaacggccccaccugccuccccaucaacgccgccuccucccaggaguucgacuccguccucuuccagcaggacgccacccucuccggccucgucaaccucggcugccagccccucuccuccauccccuuccacuccuccaacuccggcuccaccggccaccuccucgcccacaccccccacuccguccacacccucccccaccuccaguccaugggcuaccacugcuccaacaccggccagcgcucccucuccucccccgucgccgaccagaucaccggccagcccuccucccagcuccagcccaucaccuacggccccucccacuccggcuccgccaccaccgccucccccgccgccucccacccccucgccuccuccccccucuccggcccccccuccccccagcuccagcccaugcccuaccagucccccuccuccggcaccgccuccucccccucccccgccacccgcaugcacuccggccagcacuccacccaggcccaguccaccggccagggcggccucuccgcccccuccucccucaucugccacucccucugcgaccccgccuccuucccccccgacggcgccaccgucuccaucaagcccgagcccgaggaccgcgagcccaacuucgccaccaucggccuccaggacaucacccucgacgacgaccaguucaucuccgaccucgagcaccagcccuccggcuccgccgagaaguggcccaaccacuccguccucuccugccccgcccccuucuggcgcaucuga

SEQ ID NO: 46605 - RNA, 2895 nt, Artificial Sequence
  derived and/or modified sequence opt2 from NFATC4__Homo_sapiens__NP_001129494
augaucaccacccuccccucccuccuccccgccucccucgccuccaucucccaccgcgucaccaaccuccccuccaacucccucucccacaaccccggccucuccaagcccgacuuccccggcaacuccucccccggccuccccuccuccuccucccccggccgcgaccucggcgcccccgccggcuccaugggcgccgccuccugcgaggacgaggagcucgaguucaagcucgucuucggcgaggagaaggaggcccccccccucggcgccggcggccucggcgaggagcucgacuccgaggacgccccccccugcugccgccucgcccucggcgagcccccccccuacggcgccgcccccaucggcaucccccgccccccccccccccgccccggcaugcacuccccccccccccgccccgcccccucccccggcaccugggagucccagcccgcccgcuccguccgccucggcggccccggcggcggcgccggcggcgccggcggcggccgcguccucgagugccccuccauccgcaucaccuccaucucccccacccccgagccccccgccgcccucgaggacaaccccgacgccuggggcgacggcuccccccgcgacuaccccccccccgagggcuucggcggcuaccgcgaggccggcggccagggcggcggcgccuucuucucccccucccccggcuccuccucccucuccuccugguccuucuucuccgacgccuccgacgaggccgcccucuacgccgccugcgacgaggucgaguccgagcucaacgaggccgccucccgcuucggccucggcuccccccuccccuccccccgcgccuccccccgccccuggacccccgaggaccccuggucccucuacggccccucccccggcggccgcggccccgaggacuccuggcuccuccucuccgcccccggccccacccccgccuccccccgccccgccucccccugcggcaagcgccgcuacuccuccuccggcacccccuccuccgccucccccgcccucucccgccgcggcucccucggcgaggagggcuccgagcccccccccccccccccccucccccucgcccgcgaccccggcucccccggccccuucgacuacgucggcgccccccccgccgaguccaucccccagaagacccgccgcaccuccuccgagcaggccgucgcccucccccgcuccgaggagcccgccuccugcaacggcaagcucccccucggcgccgaggaguccgucgccccccccggcggcucccgcaaggaggucgccggcauggacuaccucgccguccccuccccccucgccugguccaaggcccgcaucggcggccacucccccaucuuccgcaccuccgcccuccccccccucgacuggccccuccccucccaguacgagcagcucgagcuccgcaucgagguccagccccgcgcccaccaccgcgcccacuacgagaccgagggcucccgcggcgccgucaaggccgcccccggcggccaccccgucgucaagcuccucggcuacuccgagaagccccucacccuccagauguucaucggcaccgccgacgagcgcaaccuccgcccccacgccuucuaccagguccaccgcaucaccggcaagauggucgccaccgccuccuacgaggccgucgucuccggcaccaagguccucgagaugacccuccuccccgagaacaacauggccgccaacaucgacugcgccggcauccucaagcuccgcaacuccgacaucgagcuccgcaagggcgagaccgacaucggccgcaagaacacccgcguccgccucgucuuccgcguccacgucccccagggcggcggcaaggucgucuccguccaggccgccuccguccccaucgagugcucccagcgcuccgcccaggagcucccccaggucgaggccuacucccccuccgccugcuccguccgcggcggcgaggagcucguccucaccggcuccaacuuccuccccgacuccaaggucgucuucaucgagcgcggccccgacggcaagcuccagugggaggaggaggccaccgucaaccgccuccaguccaacgaggucacccucacccucaccguccccgaguacuccaacaagcgcgucucccgccccguccaggucuacuucuacgucuccaacggccgccgcaagcgcucccccacccaguccuuccgcuuccuccccgucaucugcaaggaggagccccuccccgacuccucccuccgcggcuuccccuccgccuccgccacccccuucggcaccgacauggacuucucccccccccgcccccccuaccccuccuacccccacgaggaccccgccugcgagacccccuaccucuccgagggcuucggcuacggcaugcccccccucuacccccagaccggccccccccccuccuaccgccccggccuccgcauguuccccgagacccgcggcaccaccggcugcgcccagccccccgccgucuccuuccucccccgccccuuccccuccgaccccuacggcggccgcggcuccuccuucucccucggccuccccuucuccccccccgcccccuuccgcccccccccccuccccgccucccccccccucgagggccccuuccccucccaguccgacguccacccccuccccgccgagggcuacaacaaggucggccccggcuacggccccggcgagggcgcccccgagcaggagaagucccgcggcggcuacuccuccggcuuccgcgacuccguccccauccagggcaucacccucgaggagggcggcugcggcaccggcggcugcgagugcgagugcguccaggagaucgcccuccacgucugcuga

SEQ ID NO: 46606 - RNA, 1122 nt, Artificial Sequence
  derived and/or modified sequence opt2 from NFE2__Homo_sapiens__XP_005268963
augucccccugccccccccagcagucccgcaaccgcgucauccagcucuccaccuccgagcucggcgagauggagcucaccuggcaggagaucauguccaucaccgagcuccagggccucaacgcccccuccgagcccuccuucgagccccaggcccccgcccccuaccucggcccccccccccccaccaccuacugccccugcuccauccaccccgacuccggcuucccccucccccccccccccuacgagcuccccgccuccaccucccacguccccgacccccccuacuccuacggcaacauggccauccccgucuccaagccccucucccucuccggccuccucuccgagccccuccaggacccccucgcccuccucgacaucggccuccccgccggcccccccaagccccaggaggaccccgaguccgacuccggccucucccucaacuacuccgacgccgagucccucgagcucgagggcaccgaggccggccgccgccgcuccgaguacgucgagauguaccccgucgaguaccccuacucccucaugcccaacucccucgcccacuccaacuacacccuccccgccgccgagaccccccucgcccucgagcccuccuccggccccguccgcgccaagcccaccgcccgcggcgaggccggcucccgcgacgagcgccgcgcccucgccaugaagauccccuuccccaccgacaagaucgucaaccuccccgucgacgacuucaacgagcuccucgcccgcuacccccucaccgagucccagcucgcccucguccgcgacauccgccgccgcggcaagaacaaggucgccgcccagaacugccgcaagcgcaagcucgagaccaucguccagcucgagcgcgagcucgagcgccucaccaacgagcgcgagcgccuccuccgcgcccgcggcgaggccgaccgcacccucgaggucaugcgccagcagcucaccgagcucuaccgcgacaucuuccagcaccuccgcgacgaguccggcaacuccuacucccccgaggaguacgcccuccagcaggccgccgacggcaccaucuuccucgucccccgcggcaccaagauggaggccaccgacuga

SEQ ID NO: 46607 - RNA, 2319 nt, Artificial Sequence
  derived and/or modified sequence opt2 from NFE2L1__Homo_sapiens__NP_003195
augcucucccucaagaaguaccucaccgagggccuccuccaguucaccauccuccucucccucaucggcguccgcgucgacgucgacaccuaccucaccucccagcuccccccccuccgcgagaucauccucggccccuccuccgccuacacccagacccaguuccacaaccuccgcaacacccucgacggcuacggcauccaccccaaguccaucgaccucgacaacuacuucaccgcccgccgccuccucucccagguccgcgcccucgaccgcuuccagguccccaccaccgaggucaacgccuggcucguccaccgcgaccccgagggcuccgucuccggcucccagcccaacuccggccucgcccucgaguccuccuccggccuccaggacgucaccggccccgacaacggcguccgcgaguccgagaccgagcagggcuucggcgaggaccucgaggaccucggcgccgucgccccccccgucuccggcgaccucaccaaggaggacaucgaccucaucgacauccucuggcgccaggacaucgaccucggcgccggccgcgaggucuucgacuacucccaccgccagaaggagcaggacgucgagaaggagcuccgcgacggcggcgagcaggacaccugggccggcgagggcgccgaggcccucgcccgcaaccuccucgucgacggcgagaccggcgaguccuuccccgcccagguccccuccggcgaggaccagaccgcccucucccucgaggagugccuccgccuccucgaggccaccugccccuucggcgagaacgccgaguuccccgccgacaucuccuccaucaccgaggccguccccuccgaguccgagccccccgcccuccagaacaaccuccucuccccccuccucaccggcaccgagucccccuucgaccucgagcagcaguggcaggaccucauguccaucauggagaugcaggccauggaggucaacaccuccgccuccgagauccucuacuccgccccccccggcgacccccucuccaccaacuacucccucgcccccaacacccccaucaaccagaacgucucccuccaccaggccucccucggcggcugcucccaggacuuccuccucuucucccccgaggucgagucccuccccgucgccuccuccuccacccuccucccccucgcccccuccaacuccaccucccucaacuccaccuucggcuccaccaaccucaccggccucuucuuccccccccagcucaacggcaccgccaacgacaccgccggccccgagcuccccgacccccucggcggccuccucgacgaggccaugcucgacgagaucucccucauggaccucgccaucgaggagggcuucaaccccguccaggccucccagcucgaggaggaguucgacuccgacuccggccucucccucgacuccucccacucccccuccucccucuccuccuccgagggcuccuccuccuccuccuccuccuccuccuccuccuccuccuccgccuccuccuccgccuccuccuccuucuccgaggagggcgccgucggcuacuccuccgacuccgagacccucgaccucgaggaggccgagggcgccgucggcuaccagcccgaguacuccaaguucugccgcauguccuaccaggaccccgcccagcucuccugccuccccuaccucgagcacgucggccacaaccacaccuacaacauggcccccuccgcccucgacuccgccgaccuccccccccccuccgcccucaagaagggcuccaaggagaagcaggccgacuuccucgacaagcagaugucccgcgacgagcaccgcgcccgcgccaugaagauccccuucaccaacgacaagaucaucaaccuccccgucgaggaguucaacgagcuccucuccaaguaccagcucuccgaggcccagcucucccucauccgcgacauccgccgccgcggcaagaacaagauggccgcccagaacugccgcaagcgcaagcucgacaccauccucaaccucgagcgcgacgucgaggaccuccagcgcgacaaggcccgccuccuccgcgagaaggucgaguuccuccgcucccuccgccagaugaagcagaagguccagucccucuaccaggaggucuucggccgccuccgcgacgagaacggccgccccuacucccccucccaguacgcccuccaguacgccggcgacggcuccguccuccucaucccccgcaccauggccgaccagcaggcccgccgccaggagcgcaagcccaaggaccgccgcaaguga

SEQ ID NO: 46608 - RNA, 1770 nt, Artificial Sequence
  derived and/or modified sequence opt2 from NFE2L2__Homo_sapiens__NP_001138884
auggaccucaucgacauccucuggcgccaggacaucgaccucggcgucucccgcgaggucuucgacuucucccagcgccgcaaggaguacgagcucgagaagcagaagaagcucgagaaggagcgccaggagcagcuccagaaggagcaggagaaggccuucuucgcccagcuccagcucgacgaggagaccggcgaguuccuccccauccagcccgcccagcacauccaguccgagaccuccggcuccgccaacuacucccaggucgcccacauccccaaguccgacgcccucuacuucgacgacugcaugcagcuccucgcccagaccuuccccuucgucgacgacaacgaggucuccuccgccaccuuccagucccucguccccgacauccccggccacaucgagucccccgucuucaucgccaccaaccaggcccagucccccgagaccuccgucgcccaggucgcccccgucgaccucgacggcaugcagcaggacaucgagcaggucugggaggagcuccucuccauccccgagcuccagugccucaacaucgagaacgacaagcucgucgagaccaccaugguccccucccccgaggccaagcucaccgaggucgacaacuaccacuucuacuccuccauccccuccauggagaaggaggucggcaacugcuccccccacuuccucaacgccuucgaggacuccuucuccuccauccucuccaccgaggaccccaaccagcucaccgucaacucccucaacuccgacgccaccgucaacaccgacuucggcgacgaguucuacuccgccuucaucgccgagcccuccaucuccaacuccaugcccucccccgccacccucucccacucccucuccgagcuccucaacggccccaucgacgucuccgaccucucccucugcaaggccuucaaccagaaccaccccgaguccaccgccgaguucaacgacuccgacuccggcaucucccucaacaccucccccuccgucgccucccccgagcacuccgucgaguccuccuccuacggcgacacccuccucggccucuccgacuccgaggucgaggagcucgacuccgcccccggcuccgucaagcagaacggccccaagacccccguccacuccuccggcgacaugguccagccccucucccccucccagggccaguccacccacguccacgacgcccagugcgagaacacccccgagaaggagcuccccgucucccccggccaccgcaagacccccuucaccaaggacaagcacuccucccgccucgaggcccaccucacccgcgacgagcuccgcgccaaggcccuccacauccccuuccccgucgagaagaucaucaaccuccccgucgucgacuucaacgagaugauguccaaggagcaguucaacgaggcccagcucgcccucauccgcgacauccgccgccgcggcaagaacaaggucgccgcccagaacugccgcaagcgcaagcucgagaacaucgucgagcucgagcaggaccucgaccaccucaaggacgagaaggagaagcuccucaaggagaagggcgagaacgacaagucccuccaccuccucaagaagcagcucuccacccucuaccucgaggucuucuccaugcuccgcgacgaggacggcaagcccuacucccccuccgaguacucccuccagcagacccgcgacggcaacgucuuccucguccccaaguccaagaagcccgacgucaagaagaacuga

SEQ ID NO: 46609 - RNA, 2085 nt, Artificial Sequence
  derived and/or modified sequence opt2 from NFE2L3__Homo_sapiens__NP_004280
augaagcaccucaagcgcuggugguccgccggcggcggccuccuccaccucacccuccuccucucccucgccggccuccgcgucgaccucgaccucuaccuccuccuccccccccccacccuccuccaggacgagcuccucuuccucggcggccccgccuccuccgccuacgcccucucccccuucuccgccuccggcggcuggggccgcgccggccaccuccaccccaagggccgcgagcucgaccccgccgccccccccgagggccagcuccuccgcgagguccgcgcccucggcguccccuucgucccccgcaccuccgucgacgccuggcucguccacuccgucgccgccggcuccgccgacgaggcccacggccuccucggcgccgccgccgccuccuccaccggcggcgccggcgccuccgucgacggcggcucccaggccguccagggcggcggcggcgacccccgcgccgcccgcuccggcccccucgacgccggcgaggaggagaaggcccccgccgagcccaccgcccagguccccgacgccggcggcugcgccuccgaggagaacggcguccuccgcgagaagcacgaggccgucgaccacuccucccagcacgaggagaacgaggagcgcgucuccgcccagaaggagaacucccuccagcagaacgacgacgacgagaacaagaucgccgagaagcccgacugggaggccgagaagaccaccgagucccgcaacgagcgccaccucaacggcaccgacaccuccuucucccucgaggaccucuuccagcuccucuccucccagcccgagaacucccucgagggcaucucccucggcgacaucccccuccccggcuccaucuccgacggcaugaacuccuccgcccacuaccacgucaacuucucccaggccaucucccaggacgucaaccuccacgaggccauccuccucugccccaacaacaccuuccgccgcgaccccaccgcccgcaccucccagucccaggagcccuuccuccagcucaacucccacaccaccaaccccgagcagacccuccccggcaccaaccucaccggcuuccucucccccgucgacaaccacaugcgcaaccucaccucccaggaccuccucuacgaccucgacaucaacaucuucgacgagaucaaccucaugucccucgccaccgaggacaacuucgaccccaucgacgucucccagcucuucgacgagcccgacuccgacuccggccucucccucgacuccucccacaacaacaccuccgucaucaaguccaacuccucccacuccgucugcgacgagggcgccaucggcuacugcaccgaccacgaguccuccucccaccacgaccucgagggcgccgucggcggcuacuaccccgagcccuccaagcucugccaccucgaccaguccgacuccgacuuccacggcgaccucaccuuccagcacgucuuccacaaccacaccuaccaccuccagcccaccgcccccgaguccaccuccgagcccuuccccuggcccggcaagucccagaagauccgcucccgcuaccucgaggacaccgaccgcaaccucucccgcgacgagcagcgcgccaaggcccuccacauccccuucuccgucgacgagaucgucggcaugcccgucgacuccuucaacuccaugcucucccgcuacuaccucaccgaccuccaggucucccucauccgcgacauccgccgccgcggcaagaacaaggucgccgcccagaacugccgcaagcgcaagcucgacaucauccucaaccucgaggacgacgucugcaaccuccaggccaagaaggagacccucaagcgcgagcaggcccagugcaacaaggccaucaacaucaugaagcagaagcuccacgaccucuaccacgacaucuucucccgccuccgcgacgaccagggccgccccgucaaccccaaccacuacgcccuccagugcacccacgacggcuccauccucaucguccccaaggagcucgucgccuccggccacaagaaggagacccagaagggcaagcgcaaguga

SEQ ID NO: 46610 - RNA, 1551 nt, Artificial Sequence
  derived and/or modified sequence opt2 from NFIA__Homo_sapiens__XP_011539817
auguacuccccccucugccucacccaggacgaguuccaccccuucaucgaggcccuccucccccacguccgcgccuucgccuacaccugguucaaccuccaggcccgcaagcgcaaguacuucaagaagcacgagaagcgcauguccaaggaggaggagcgcgccgucaaggacgagcuccucuccgagaagcccgaggucaagcagaagugggccucccgccuccucgccaagcuccgcaaggacauccgccccgaguaccgcgaggacuucguccucaccgucaccggcaagaagccccccugcugcguccucuccaaccccgaccagaagggcaagaugcgccgcaucgacugccuccgccaggccgacaaggucuggcgccucgaccucgucauggucauccucuucaagggcaucccccucgaguccaccgacggcgagcgccucgucaaguccccccagugcuccaaccccggccucugcguccagccccaccacaucggcgucuccgucaaggagcucgaccucuaccucgccuacuucguccacgccgccgacuccucccaguccgagucccccucccagcccuccgacgccgacaucaaggaccagcccgagaacggccaccucggcuuccaggacuccuucgucaccuccggcgucuucuccgucaccgagcucguccgcgucucccagacccccaucgccgccggcaccggccccaacuucucccucuccgaccucgaguccuccuccuacuacuccaugucccccggcgccaugcgccgcucccuccccuccaccuccuccaccuccuccaccaagcgccucaaguccgucgaggacgagauggacucccccggcgaggagcccuucuacaccggccagggccgcucccccggcuccggcucccaguccuccggcuggcacgaggucgagcccggcaugcccucccccaccacccucaagaaguccgagaaguccggcuucuccucccccucccccucccagaccuccucccucggcaccgccuucacccagcaccaccgccccgucaucaccggcccccgcgaguucaagauggcccccuccauccucggcucccccuucuggaaggucuacuccgccuccccccacgccacccccuccacccuccacuuccccaccucccccaucauccagcagcccggccccuacuucucccaccccgccauccgcuaccacccccaggagacccucaaggaguucguccagcucgucugccccgacgccggccagcaggccggccaggucggcuuccucaaccccaacggcuccucccagggcaagguccacaaccccuuccuccccacccccaugcuccccccccccccccccccccccauggcccgccccgucccccuccccguccccgacaccaagccccccaccaccuccaccgagggcggcgccgccucccccaccucccccauccucguccccggcaucaaggucgccgccucccaccacccccccgaccgcccccccgaccccuucuccacccucuga

SEQ ID NO: 46611 - RNA, 1485 nt, Artificial Sequence
  derived and/or modified sequence opt2 from NFIB__Homo_sapiens__NP_001177666
augauguacucccccaucugccucacccaggacgaguuccaccccuucaucgaggcccuccucccccacguccgcgccaucgccuacaccugguucaaccuccaggcccgcaagcgcaaguacuucaagaagcacgagaagcgcauguccaaggacgaggagcgcgccgucaaggacgagcuccucuccgagaagcccgagaucaagcagaagugggccucccgccuccucgccaagcuccgcaaggacauccgccaggaguaccgcgaggacuucguccucaccgucaccggcaagaagcaccccugcugcguccucuccaaccccgaccagaagggcaagauccgccgcaucgacugccuccgccaggccgacaaggucuggcgccucgaccucgucauggucauccucuucaagggcaucccccucgaguccaccgacggcgagcgccucaugaaguccccccacugcaccaaccccgcccucugcguccagccccaccacaucaccgucuccgucaaggagcucgaccucuuccucgccuacuacguccaggagcaggacuccggccaguccggcucccccucccacaacgaccccgccaagaacccccccggcuaccucgaggacuccuucgucaaguccggcgucuucaacgucuccgagcucguccgcgucucccgcacccccaucacccagggcaccggcgucaacuuccccaucggcgagauccccucccagcccuacuaccacgacaugaacuccggcgucaaccuccagcgcucccucuccuccccccccuccuccaagcgccccaagaccaucuccaucgacgagaacauggagcccucccccaccggcgacuucuaccccucccccuccucccccgccgccggcucccgcaccuggcacgagcgcgaccaggacauguccucccccaccaccaugaagaagcccgagaagccccucuucuccuccgccuccccccaggacuccuccccccgccucuccaccuucccccagcaccaccaccccggcauccccggcgucgcccacuccgucaucuccacccgcaccccccccccccccuccccccuccccuuccccacccaggccauccucccccccgcccccuccuccuacuucucccaccccaccauccgcuaccccccccaccucaacccccaggacacccucaagaacuacguccccuccuacgaccccuccuccccccagaccucccagcccaacggcuccggccaggucgucggcaagguccccggccacuucacccccguccucgcccccuccccccaccccuccgccguccgccccgucacccucuccaugaccgacaccaagcccaucaccaccuccaccgaggccuacaccgccuccggcaccucccaggccaaccgcuacgucggccucuccccccgcgaccccuccuuccuccaccagcagcaguccugguaccucggcuga

SEQ ID NO: 46612 - RNA, 1527 nt, Artificial Sequence
  derived and/or modified sequence opt2 from NFIC__Homo_sapiens__NP_001231931
auguacuccuccccccucugccucacccaggacgaguuccaccccuucaucgaggcccuccucccccacguccgcgccuucgccuacaccugguucaaccuccaggcccgcaagcgcaaguacuucaagaagcacgagaagcgcauguccaaggacgaggagcgcgccgucaaggacgagcuccucggcgagaagcccgaggucaagcagaagugggccucccgccuccucgccaagcuccgcaaggacauccgccccgagugccgcgaggacuucguccucuccaucaccggcaagaaggcccccggcugcguccucuccaaccccgaccagaagggcaagaugcgccgcaucgacugccuccgccaggccgacaaggucuggcgccucgaccucgucauggucauccucuucaagggcaucccccucgaguccaccgacggcgagcgccucgucaaggccgcccagugcggccaccccguccucugcguccagccccaccacaucggcgucgccgucaaggagcucgaccucuaccucgccuacuucguccgcgagcgcgacgccgagcaguccggcuccccccgcaccggcaugggcuccgaccaggaggacuccaagcccaucacccucgacaccaccgacuuccaggaguccuucgucaccuccggcgucuucuccgucaccgagcucauccaggucucccgcacccccgucgucaccggcaccggccccaacuucucccucggcgagcuccagggccaccucgccuacgaccucaaccccgccuccaccggccuccgccgcacccuccccuccaccuccuccuccggcuccaagcgccacaaguccggcuccauggaggaggacgucgacaccucccccggcggcgacuacuacaccucccccuccucccccaccuccuccucccgcaacuggaccgaggacauggagggcggcaucuccucccccgucaagaagaccgagauggacaagucccccuucaacucccccuccccccaggacuccccccgccucuccuccuucacccagcaccaccgccccgucaucgccguccacuccggcaucgcccgcuccccccaccccuccuccgcccuccacuuccccaccaccuccauccucccccagaccgccuccaccuacuucccccacaccgccauccgcuaccccccccaccucaacccccaggacccccucaaggaccucgucucccucgccugcgaccccgccucccagcagcccggcccccucaacggcuccggccagcucaagaugcccucccacugccucuccgcccagaugcucgccccccccccccccggccucccccgccucgcccucccccccgccaccaagcccgccaccaccuccgagggcggcgccaccucccccaccucccccuccuacuccccccccgacaccucccccgccaaccgcuccuucgucggccucggcccccgcgaccccgccggcaucuaccaggcccaguccugguaccucggcuga

SEQ ID NO: 46613 - RNA, 1389 nt, Artificial Sequence
  derived and/or modified sequence opt2 from NFIL3__Homo_sapiens__NP_001276929
augcagcuccgcaagaugcagaccgucaagaaggagcaggccucccucgacgccuccuccaacgucgacaagaugaugguccucaacuccgcccucaccgaggucuccgaggacuccaccaccggcgaggagcuccuccucuccgagggcuccgucggcaagaacaaguccuccgccugccgccgcaagcgcgaguucauccccgacgagaagaaggacgccauguacugggagaagcgccgcaagaacaacgaggccgccaagcgcucccgcgagaagcgccgccucaacgaccucguccucgagaacaagcucaucgcccucggcgaggagaacgccacccucaaggccgagcuccucucccucaagcucaaguucggccucaucuccuccaccgccuacgcccaggagauccagaagcucuccaacuccaccgccgucuacuuccaggacuaccagaccuccaaguccaacgucuccuccuucgucgacgagcacgagcccuccauggucuccuccuccugcaucuccgucaucaagcacuccccccaguccucccucuccgacgucuccgaggucuccuccgucgagcacacccaggaguccuccguccagggcuccugccgcucccccgagaacaaguuccagaucaucaagcaggagcccauggagcucgaguccuacacccgcgagccccgcgacgaccgcggcuccuacaccgccuccaucuaccagaacuacaugggcaacuccuucuccggcuacucccacucccccccccuccuccaggucaaccgcuccuccuccaacuccccccgcaccuccgagaccgacgacggcgucgucggcaaguccuccgacggcgaggacgagcagcagguccccaagggccccauccacucccccgucgagcucaagcacguccacgccaccgucgucaagguccccgaggucaacuccuccgcccucccccacaagcuccgcaucaaggccaaggccaugcagaucaaggucgaggccuucgacaacgaguucgaggccacccagaagcucuccucccccaucgacaugaccuccaagcgccacuucgagcucgagaagcacuccgcccccuccaugguccacuccucccucacccccuucuccguccaggucaccaacauccaggacuggucccucaaguccgagcacuggcaccagaaggagcucuccggcaagacccagaacuccuucaagaccggcgucgucgagaugaaggacuccggcuacaaggucuccgaccccgagaaccucuaccucaagcagggcaucgccaaccucuccgccgaggucgucucccucaagcgccucaucgccacccagcccaucuccgccuccgacuccggcuga

SEQ ID NO: 46614 - RNA, 1533 nt, Artificial Sequence
  derived and/or modified sequence opt2 from NFIX__Homo_sapiens__NP_001257972
auggagauguccugggcccgccagucccucgccggcauccccgccgccugcgacgaguuccaccccuucaucgaggcccuccucccccacguccgcgccuucuccuacaccugguucaaccuccaggcccgcaagcgcaaguacuucaagaagcacgagaagcgcauguccaaggacgaggagcgcgccgucaaggacgagcuccucggcgagaagcccgagaucaagcagaagugggccucccgccuccucgccaagcuccgcaaggacauccgccccgaguuccgcgaggacuucguccucaccaucaccggcaagaagccccccugcugcguccucuccaaccccgaccagaagggcaagauccgccgcaucgacugccuccgccaggccgacaaggucuggcgccucgaccucgucauggucauccucuucaagggcaucccccucgaguccaccgacggcgagcgccucuacaaguccccccagugcuccaaccccggccucugcguccagccccaccacaucggcgucaccaucaaggagcucgaccucuaccucgccuacuucguccacacccccgaguccggccaguccgacuccuccaaccagcagggcgacgccgacaucaagccccuccccaacggccaccucuccuuccaggacugcuucgucaccuccggcgucuggaacgucaccgagcucguccgcgucucccagacccccgucgccaccgccuccggccccaacuucucccucgccgaccucgagucccccuccuacuacaacaucaaccaggucacccucggccgccgcuccaucaccuccccccccuccaccuccaccaccaagcgccccaaguccaucgacgacuccgagauggagucccccgucgacgacgucuucuaccccggcaccggccgcucccccgccgccggcuccucccaguccuccggcuggcccaacgacgucgacgccggccccgccucccucaagaaguccggcaagcucgacuucugcuccgcccucuccucccagggcuccuccccccgcauggccuucacccaccacccccuccccguccucgccggcguccgccccggcuccccccgcgccaccgccuccgcccuccacuuccccuccaccuccaucauccagcaguccucccccuacuucacccaccccaccauccgcuaccaccaccaccacggccaggacucccucaaggaguucguccaguucgucugcuccgacggcuccggccaggccaccggccagcccaacggcuccggccagggcaagguccccggcuccuuccuccuccccccccccccccccgucgcccgccccgucccccuccccaugcccgacuccaaguccaccuccaccgcccccgacggcgccgcccucaccccccccucccccuccuucgccaccaccggcgccuccuccgccaaccgcuucgucuccaucggcccccgcgacggcaacuuccucaacaucccccagcagucccaguccugguuccucuga

SEQ ID NO: 46615 - RNA, 2907 nt, Artificial Sequence
  derived and/or modified sequence opt2 from NFKB1__Homo_sapiens__NP_001158884
auggccgaggacgaccccuaccucggccgccccgagcagauguuccaccucgaccccucccucacccacaccaucuucaaccccgaggucuuccagccccagauggcccuccccaccgacggccccuaccuccagauccucgagcagcccaagcagcgcggcuuccgcuuccgcuacgucugcgagggccccucccacggcggccuccccggcgccuccuccgagaagaacaagaaguccuacccccaggucaagaucugcaacuacgucggccccgccaaggucaucguccagcucgucaccaacggcaagaacauccaccuccacgcccacucccucgucggcaagcacugcgaggacggcaucugcaccgucaccgccggccccaaggacauggucgucggcuucgccaaccucggcauccuccacgucaccaagaagaaggucuucgagacccucgaggcccgcaugaccgaggccugcauccgcggcuacaaccccggccuccucguccaccccgaccucgccuaccuccaggccgagggcggcggcgaccgccagcucggcgaccgcgagaaggagcucauccgccaggccgcccuccagcagaccaaggagauggaccucuccgucguccgccucauguucaccgccuuccuccccgacuccaccggcuccuucacccgccgccucgagcccgucgucuccgacgccaucuacgacuccaaggcccccaacgccuccaaccucaagaucguccgcauggaccgcaccgccggcugcgucaccggcggcgaggagaucuaccuccucugcgacaagguccagaaggacgacauccagauccgcuucuacgaggaggaggagaacggcggcgucugggagggcuucggcgacuucucccccaccgacguccaccgccaguucgccaucgucuucaagacccccaaguacaaggacaucaacaucaccaagcccgccuccgucuucguccagcuccgccgcaaguccgaccucgagaccuccgagcccaagcccuuccucuacuaccccgagaucaaggacaaggaggagguccagcgcaagcgccagaagcucaugcccaacuucuccgacuccuucggcggcggcuccggcgccggcgccggcggcggcggcauguucggcuccggcggcggcggcggcggcaccggcuccaccggccccggcuacuccuucccccacuacggcuuccccaccuacggcggcaucaccuuccaccccggcaccaccaaguccaacgccggcaugaagcacggcaccauggacaccgaguccaagaaggaccccgagggcugcgacaaguccgacgacaagaacaccgucaaccucuucggcaaggucaucgagaccaccgagcaggaccaggagcccuccgaggccaccgucggcaacggcgaggucacccucaccuacgccaccggcaccaaggaggaguccgccggcguccaggacaaccucuuccucgagaaggccaugcagcucgccaagcgccacgccaacgcccucuucgacuacgccgucaccggcgacgucaagaugcuccucgccguccagcgccaccucaccgccguccaggacgagaacggcgacuccguccuccaccucgccaucauccaccuccacucccagcucguccgcgaccuccucgaggucaccuccggccucaucuccgacgacaucaucaacaugcgcaacgaccucuaccagaccccccuccaccucgccgucaucaccaagcaggaggacgucgucgaggaccuccuccgcgccggcgccgaccucucccuccucgaccgccucggcaacuccguccuccaccucgccgccaaggagggccacgacaagguccucuccauccuccucaagcacaagaaggccgcccuccuccucgaccaccccaacggcgacggccucaacgccauccaccucgccaugauguccaacucccuccccugccuccuccuccucgucgccgccggcgccgacgucaacgcccaggagcagaaguccggccgcaccgcccuccaccucgccgucgagcacgacaacaucucccucgccggcugccuccuccucgagggcgacgcccacgucgacuccaccaccuacgacggcaccaccccccuccacaucgccgccggccgcggcuccacccgccucgccgcccuccucaaggccgccggcgccgacccccucgucgagaacuucgagccccucuacgaccucgacgacuccugggagaacgccggcgaggacgagggcgucguccccggcaccaccccccucgacauggccaccuccuggcaggucuucgacauccucaacggcaagcccuacgagcccgaguucaccuccgacgaccuccucgcccagggcgacaugaagcagcucgccgaggacgucaagcuccagcucuacaagcuccucgagauccccgaccccgacaagaacugggccacccucgcccagaagcucggccucggcauccucaacaacgccuuccgccucucccccgcccccuccaagacccucauggacaacuacgaggucuccggcggcaccguccgcgagcucgucgaggcccuccgccagaugggcuacaccgaggccaucgaggucauccaggccgccuccucccccgucaagaccaccucccaggcccacucccucccccucucccccgccuccacccgccagcagaucgacgagcuccgcgacuccgacuccgucugcgacuccggcgucgagaccuccuuccgcaagcucuccuucaccgagucccucaccuccggcgccucccuccucacccucaacaagaugccccacgacuacggccaggagggcccccucgagggcaagaucuga

SEQ ID NO: 46616 - RNA, 2700 nt, Artificial Sequence
  derived and/or modified sequence opt2 from NFKB2__Homo_sapiens__NP_002493
auggaguccugcuacaaccccggccucgacggcaucaucgaguacgacgacuucaagcucaacuccuccaucgucgagcccaaggagcccgcccccgagaccgccgacggccccuaccucgucaucgucgagcagcccaagcagcgcggcuuccgcuuccgcuacggcugcgagggccccucccacggcggccuccccggcgccuccuccgagaagggccgcaagaccuaccccaccgucaagaucugcaacuacgagggccccgccaagaucgaggucgaccucgucacccacuccgaccccccccgcgcccacgcccacucccucgucggcaagcagugcuccgagcucggcaucugcgccgucuccgucggccccaaggacaugaccgcccaguucaacaaccucggcguccuccacgucaccaagaagaacaugaugggcaccaugauccagaagcuccagcgccagcgccuccgcucccgcccccagggccucaccgaggccgagcagcgcgagcucgagcaggaggccaaggagcucaagaaggucauggaccucuccaucguccgccuccgcuucuccgccuuccuccgcgccuccgacggcuccuucucccucccccucaagcccgucaucucccagcccauccacgacuccaagucccccggcgccuccaaccucaagaucucccgcauggacaagaccgccggcuccguccgcggcggcgacgaggucuaccuccucugcgacaagguccagaaggacgacaucgagguccgcuucuacgaggacgacgagaacggcuggcaggccuucggcgacuucucccccaccgacguccacaagcaguacgccaucgucuuccgcaccccccccuaccacaagaugaagaucgagcgccccgucaccgucuuccuccagcucaagcgcaagcgcggcggcgacgucuccgacuccaagcaguucaccuacuacccccucgucgaggacaaggaggagguccagcgcaagcgccgcaaggcccuccccaccuucucccagcccuucggcggcggcucccacaugggcggcggcuccggcggcgccgccggcggcuacggcggcgccggcggcggcggcucccucggcuucuuccccuccucccucgccuacucccccuaccaguccggcgccggccccaugggcugcuaccccggcggcggcggcggcgcccagauggccgccaccguccccucccgcgacuccggcgaggaggccgccgagcccuccgcccccucccgcaccccccagugcgagccccaggcccccgagaugcuccagcgcgcccgcgaguacaacgcccgccucuucggccucgcccagcgcuccgcccgcgcccuccucgacuacggcgucaccgccgacgcccgcgcccuccucgccggccagcgccaccuccucaccgcccaggacgagaacggcgacaccccccuccaccucgccaucauccacggccagaccuccgucaucgagcagaucgucuacgucauccaccacgcccaggaccucggcgucgucaaccucaccaaccaccuccaccagaccccccuccaccucgccgucaucaccggccagaccuccgucgucuccuuccuccuccgcgucggcgccgaccccgcccuccucgaccgccacggcgacuccgccaugcaccucgcccuccgcgccggcgccggcgcccccgagcuccuccgcgcccuccuccaguccggcgcccccgccgucccccagcuccuccacaugcccgacuucgagggccucuaccccguccaccucgccguccgcgcccgcucccccgagugccucgaccuccucgucgacuccggcgccgaggucgaggccaccgagcgccagggcggccgcaccgcccuccaccucgccaccgagauggaggagcucggccucgucacccaccucgucaccaagcuccgcgccaacgucaacgcccgcaccuucgccggcaacaccccccuccaccucgccgccggccucggcuaccccacccucacccgccuccuccucaaggccggcgccgacauccacgccgagaacgaggagccccucugcccccuccccuccccccccaccuccgacuccgacuccgacuccgagggccccgagaaggacacccgcuccuccuuccgcggccacaccccccucgaccucaccugcuccaccaaggucaagacccuccuccucaacgccgcccagaacaccauggagcccccccucaccccccccucccccgccggccccggccucucccucggcgacaccgcccuccagaaccucgagcagcuccucgacggccccgaggcccagggcuccugggccgagcucgccgagcgccucggccuccgcucccucgucgacaccuaccgccagaccaccucccccuccggcucccuccuccgcuccuacgagcucgccggcggcgaccucgccggccuccucgaggcccucuccgacaugggccucgaggagggcguccgccuccuccgcggccccgagacccgcgacaagcuccccuccaccgaggucaaggaggacuccgccuacggcucccaguccgucgagcaggaggccgagaagcucggccccccccccgagccccccggcggccucugccacggccacccccagccccagguccacuga

SEQ ID NO: 46617 - RNA, 954 nt, Artificial Sequence
  derived and/or modified sequence opt2 from NFKBIA__Homo_sapiens__NP_065390
auguuccaggccgccgagcgcccccaggagugggccauggagggcccccgcgacggccucaagaaggagcgccuccucgacgaccgccacgacuccggccucgacuccaugaaggacgaggaguacgagcagauggucaaggagcuccaggagauccgccucgagccccaggaggucccccgcggcuccgagcccuggaagcagcagcucaccgaggacggcgacuccuuccuccaccucgccaucauccacgaggagaaggcccucaccauggaggucauccgccaggucaagggcgaccucgccuuccucaacuuccagaacaaccuccagcagaccccccuccaccucgccgucaucaccaaccagcccgagaucgccgaggcccuccucggcgccggcugcgaccccgagcuccgcgacuuccgcggcaacaccccccuccaccucgccugcgagcagggcugccucgccuccgucggcguccucacccaguccugcaccaccccccaccuccacuccauccucaaggccaccaacuacaacggccacaccugccuccaccucgccuccauccacggcuaccucggcaucgucgagcuccucgucucccucggcgccgacgucaacgcccaggagcccugcaacggccgcaccgcccuccaccucgccgucgaccuccagaaccccgaccucgucucccuccuccucaagugcggcgccgacgucaaccgcgucaccuaccagggcuacucccccuaccagcucaccuggggccgccccuccacccgcauccagcagcagcucggccagcucacccucgagaaccuccagaugcuccccgaguccgaggacgaggaguccuacgacaccgaguccgaguucaccgaguucaccgaggacgagcuccccuacgacgacugcgucuucggcggccagcgccucacccucuga

SEQ ID NO: 46618 - RNA, 1071 nt, Artificial Sequence
  derived and/or modified sequence opt2 from NFKBIB__Homo_sapiens__NP_002494
auggccggcgucgccugccucggcaaggccgccgacgccgacgaguggugcgacuccggccucggcucccucggccccgacgccgccgcccccggcggccccggccucggcgccgagcucggccccggccucuccugggccccccucgucuucggcuacgucaccgaggacggcgacaccgcccuccaccucgccgucauccaccagcacgagcccuuccucgacuuccuccucggcuucuccgccggcaccgaguacauggaccuccagaacgaccucggccagaccgcccuccaccucgccgccauccucggcgagaccuccaccgucgagaagcucuacgccgccggcgccggccucugcgucgccgagcgccgcggccacaccgcccuccaccucgccugccgcgucggcgcccacgccugcgcccgcgcccuccuccagccccgcccccgccgcccccgcgaggcccccgacaccuaccucgcccagggccccgaccgcacccccgacaccaaccacacccccgucgcccucuaccccgacuccgaccucgagaaggaggaggaggaguccgaggaggacuggaagcuccagcucgaggccgagaacuacgagggccacaccccccuccacgucgccgucauccacaaggacgucgagaugguccgccuccuccgcgacgccggcgccgaccucgacaagcccgagcccaccugcggccgcuccccccuccaccucgccgucgaggcccaggccgccgacguccucgagcuccuccuccgcgccggcgccaaccccgccgcccgcauguacggcggccgcaccccccucggcuccgccaugcuccgccccaaccccauccucgcccgccuccuccgcgcccacggcgcccccgagcccgagggcgaggacgagaaguccggccccugcuccuccuccuccgacuccgacuccggcgacgagggcgacgaguacgacgacaucgucguccacuccucccgcucccagacccgccucccccccacccccgccuccaagccccuccccgacgacccccgccccgucuga

SEQ ID NO: 46619 - RNA, 1503 nt, Artificial Sequence
  derived and/or modified sequence opt2 from NFKBIE__Homo_sapiens__NP_004547
augaaccagcgccgcuccgagucccgccccggcaaccaccgccuccaggccuacgccgagcccggcaagggcgacuccggcggcgccggcccccucuccggcuccgcccgccgcggccgcggcggcggcggcgccauccgcguccgccgccccugcugguccggcggcgccggccgcggcggcggccccgccugggccguccgccuccccaccgucaccgccggcuggaccuggcccgcccuccgcacccucuccucccuccgcgccggccccuccgagccccacucccccggccgccgccccccccgcgccggccgcccccucugccaggccgacccccagcccggcaaggccgcccgccgcucccucgagcccgaccccgcccagaccggcccccgccccgcccgcgccgccggcauguccgaggcccgcaagggccccgacgaggccgaggagucccaguacgacuccggcaucgagucccuccgcucccuccgcucccuccccgaguccaccuccgcccccgccuccggccccuccgacggcuccccccagcccugcacccacccccccggccccgucaaggagccccaggagaaggaggacgccgacggcgagcgcgccgacuccaccuacggcuccuccucccucaccuacacccucucccuccucggcggccccgaggccgaggaccccgccccccgccucccccucccccacgucggcgcccucuccccccagcagcucgaggcccucaccuacaucuccgaggacggcgacacccucguccaccucgccgucauccacgaggcccccgccguccuccucugcugccucgcccuccucccccaggagguccucgacauccagaacaaccucuaccagaccgcccuccaccucgccguccaccucgaccagcccggcgccguccgcgcccucguccucaagggcgccucccgcgcccuccaggaccgccacggcgacaccgcccuccacgucgccugccagcgccagcaccucgccugcgcccgcugccuccucgagggccgccccgagcccggccgcggcaccucccacucccucgaccuccagcuccagaacuggcagggccucgccugccuccacaucgccacccuccagaagaaccagccccucauggagcuccuccuccgcaacggcgccgacaucgacguccaggagggcaccuccggcaagaccgcccuccaccucgccgucgagacccaggagcgcggccucguccaguuccuccuccaggccggcgcccaggucgacgcccgcaugcucaacggcugcaccccccuccaccucgccgccggccgcggccucaugggcaucuccuccacccucugcaaggccggcgccgacucccuccuccgcaacgucgaggacgagaccccccaggaccucaccgaggagucccucguccuccuccccuucgacgaccucaagaucuccggcaagcuccuccucugcaccgacuga

SEQ ID NO: 46620 - RNA, 1101 nt, Artificial Sequence
  derived and/or modified sequence opt2 from NFKBIL1__Homo_sapiens__NP_001138433
auguccaaccccuccccccagguccccgaggaggaggccuccaccuccgucugccgccccaaguccuccauggccuccaccucccgccgccagcgccgcgagcgccgcuuccgccgcuaccucuccgccggccgccucguccgcgcccaggcccuccuccagcgccaccccggccucgacgucgacgccggccagccccccccccuccaccgcgccugcgcccgccacgacgcccccgcccucugccuccuccuccgccucggcgccgaccccgcccaccaggaccgccacggcgacaccgcccuccacgccgccgcccgccagggccccgacgccuacaccgacuucuuccucccccuccucucccgcugccccuccgccaugggcaucaagaacaaggacggcgagacccccggccagauccucggcuggggcccccccugggacuccgccgaggaggaggaggaggacgacgccuccaaggagcgcgaguggcgccagaagcuccagggcgacgccucccacgagacccaggagcccgaguccuucuccgccugguccgaccgccucgcccgcgagcacgcccagaagugccagcagcagcagcgcgaggccgagggcucccgccgccccccccgcgccgagggcuccucccaguccuggcgccagcaggaggaggagcagcgccucuuccgcgagcgcgcccgcgccaaggaggaggagcuccgcgagucccgcgcccgccgcgcccaggaggcccucggcgaccgcgagcccaagcccacccgcgccggcccccgcgaggagcacccccgcggcgccggccgcggcucccucuggcgcuucggcgacguccccuggcccugccccggcggcggcgaccccgaggccauggccgccgcccucgucgcccgcggccccccccucgaggagcagggcgcccuccgccgcuaccuccgcguccagcagguccgcuggcaccccgaccgcuuccuccagcgcuuccgcucccagaucgagaccugggagcucggccgcgucaugggcgccgucaccgcccucucccaggcccucaaccgccacgccgaggcccucaaguga

SEQ ID NO: 46621 - RNA, 1857 nt, Artificial Sequence
  derived and/or modified sequence opt2 from NFKBIZ__Homo_sapiens__NP_001005474
augggcgucggccgccagcagcgcggccccuuccagggcguccgcgucaagaacuccgucaaggagcuccuccuccacauccgcucccacaagcagaaggccuccggccaggccgucgacgacuucaagacccagggcgucaacaucgagcaguuccgcgagcucaagaacaccgucuccuacuccggcaagcgcaagggccccgacucccucuccgacggccccgccugcaagcgccccgcccuccuccacucccaguuccucacccccccccagacccccacccccggcgaguccauggaggacguccaccucaacgagcccaagcaggaguccuccgccgaccuccuccagaacaucaucaacaucaagaacgagugcucccccgucucccucaacaccguccaggucuccuggcucaaccccgucgucgucccccaguccucccccgccgagcagugccaggacuuccacggcggccaggucuucucccccccccagaagugccagcccuuccagguccgcggcucccagcagaugaucgaccaggccucccucuaccaguacuccccccagaaccagcacgucgagcagcagccccacuacacccacaagcccacccucgaguacucccccuuccccauccccccccagucccccgccuacgagcccaaccucuucgacggccccgagucccaguucugccccaaccagucccucgucucccuccucggcgaccagcgcgaguccgagaacaucgccaaccccaugcagaccuccuccuccguccagcagcagaacgacgcccaccuccacuccuucuccaugaugcccuccuccgccugcgaggccauggucggccacgagauggccuccgacuccuccaacaccucccuccccuucuccaacaugggcaaccccaugaacaccacccagcucggcaagucccucuuccaguggcaggucgagcaggaggaguccaagcucgccaacaucucccaggaccaguuccucuccaaggacgccgacggcgacaccuuccuccacaucgccgucgcccagggccgccgcgcccucuccuacguccucgcccgcaagaugaacgcccuccacaugcucgacaucaaggagcacaacggccaguccgccuuccaggucgccgucgccgccaaccagcaccucaucguccaggaccucgucaacaucggcgcccaggucaacaccaccgacugcuggggccgcaccccccuccacgucugcgccgagaagggccacucccagguccuccaggccauccagaagggcgccgucggcuccaaccaguucgucgaccucgaggccaccaacuacgacggccucaccccccuccacugcgccgucaucgcccacaacgccgucguccacgagcuccagcgcaaccagcagccccacucccccgagguccaggagcuccuccucaagaacaagucccucgucgacaccaucaagugccucauccagaugggcgccgccgucgaggccaaggaccgcaaguccggccgcaccgcccuccaccucgccgccgaggaggccaaccucgagcucauccgccucuuccucgagcuccccuccugccucuccuucgucaacgccaaggccuacaacggcaacaccgcccuccacgucgccgccucccuccaguaccgccucacccagcucgacgccguccgccuccucaugcgcaagggcgccgaccccuccacccgcaaccucgagaacgagcagcccguccaccucguccccgacggccccgucggcgagcagauccgccgcauccucaagggcaaguccauccagcagcgcgccccccccuacuga

SEQ ID NO: 46622 - RNA, 3900 nt, Artificial Sequence
  derived and/or modified sequence opt2 from NFRKB__Homo_sapiens__NP_001137307
auggacucccucgaccacaugcucaccgacccccucgagcucggccccugcggcgacggccacggcacccgcaucauggaggacugccuccucggcggcacccgcgucucccuccccgaggaccuccucgaggaccccgagaucuucuucgacgucgucucccucuccaccuggcaggagguccucuccgacucccagcgcgagcaccuccagcaguuccucccccaguuccccgaggacuccgccgagcagcagaacgagcucauccucgcccucuucuccggcgagaacuuccgcuucggcaacccccuccacaucgcccagaagcucuuccgcgacggccacuucaaccccgaggucgucaaguaccgccagcucugcuucaagucccaguacaagcgcuaccucaacucccagcagcaguacuuccaccgccuccucaagcagauccucgccucccgcuccgaccuccucgagauggcccgccgcuccggccccgcccuccccuuccgccagaagcgccccucccccucccgcacccccgaggagcgcgaguggcgcacccagcagcgcuaccucaagguccuccgcgaggucaaggaggagugcggcgacaccgcccucuccuccgacgaggaggaccucuccuccuggcuccccuccucccccgcccgcucccccucccccgccgucccccuccgcgucguccccacccucuccaccaccgacaugaagaccgccgacaaggucgagcucggcgacuccgaccucaagaucaugcucaagaagcaccacgagaagcgcaagcaccagcccgaccaccccgaccuccucaccggcgaccucacccucaacgacaucaugacccgcgucaacgccggccgcaagggcucccucgccgcccucuacgaccucgccguccucaagaagaaggucaaggagaaggaggagaagaagaagaagaagaucaagaccaucaaguccgaggccgaggaccucgccgagccccucuccuccaccgagggcgucgccccccucucccaggcccccuccccccucgccauccccgccaucaaggaggagccccucgaggaccucaagcccugccucggcaucaacgagaucuccuccuccuucuucucccuccuccucgagauccuccuccucgagucccaggccucccuccccaugcucgaggagcgcguccucgacuggcaguccucccccgccuccucccucaacuccugguucuccgccgcccccaacugggccgagcucguccuccccgcccuccaguaccucgccggcgagucccgcgccguccccuccuccuucucccccuucgucgaguucaaggagaagacccagcaguggaagcuccucggccagucccaggacaacgagaaggagcucgccgcccucuuccagcucuggcucgagaccaaggaccaggccuucugcaagcaggagaacgaggacuccuccgacgccaccacccccgucccccgcguccgcaccgacuacgucguccgccccuccaccggcgaggagaagcgcgucuuccaggagcaggagcgcuaccgcuacucccagccccacaaggccuucaccuuccgcaugcacggcuucgaguccgucgucggccccgucaagggcgucuucgacaaggagaccucccucaacaaggcccgcgagcacucccuccuccgcuccgaccgccccgccuacgucaccauccucucccucguccgcgacgccgccgcccgccuccccaacggcgagggcacccgcgccgagaucugcgagcuccucaaggacucccaguuccucgcccccgacgucaccuccacccaggucaacaccgucgucuccggcgcccucgaccgccuccacuacgagaaggaccccugcgucaaguacgacaucggccgcaagcucuggaucuaccuccaccgcgaccgcuccgaggaggaguucgagcgcauccaccaggcccaggccgccgccgccaaggcccgcaaggcccuccagcagaagcccaagccccccuccaaggucaaguccuccuccaaggaguccuccaucaagguccucuccuccggccccuccgagcagucccagaugucccucuccgacuccuccaugccccccacccccgucacccccgucacccccaccacccccgcccuccccgccauccccaucucccccccccccgucuccgccgucaacaaguccggccccuccaccgucuccgagcccgccaaguccuccuccggcguccuccucgucuccucccccaccaugccccaccucggcaccaugcucucccccgccuccucccagaccgcccccuccucccaggccgccgcccgcgucgucucccacuccggcuccgccggccucucccagguccgcgucgucgcccagcccucccuccccgccgucccccagcaguccggcggccccgcccagacccucccccagaugcccgccggcccccagauccgcguccccgccaccgccacccagaccaaggucgucccccagaccgucauggccaccguccccgucaaggcccagaccaccgccgccaccguccagcgccccggccccggccagaccggccucaccgucaccucccuccccgccaccgccucccccgucuccaagcccgccaccuccucccccggcaccuccgcccccuccgccuccaccgccgccgucauccagaacgucaccggccagaacaucaucaagcaggucgccaucaccggccagcucggcgucaagccccagaccggcaacuccaucccccucaccgccaccaacuuccgcauccagggcaaggacguccuccgccucccccccuccuccaucaccaccgacgccaagggccagaccguccuccgcaucacccccgacaugauggccacccucgccaagucccaggucaccaccgucaagcucacccaggaccucuucggcaccggcggcaacaccaccggcaagggcaucuccgccacccuccacgucaccuccaaccccguccacgccgccgacucccccgccaaggccuccuccgccuccgcccccuccuccacccccaccggcaccaccgucgucaaggucacccccgaccucaagcccaccgaggccuccuccuccgccuuccgccucaugcccgcccucggcgucuccgucgccgaccagaagggcaaguccaccgucgccuccuccgaggccaagcccgccgccaccauccgcaucguccagggccucggcgucaugccccccaaggccggccagaccaucaccgucgccacccacgccaagcagggcgccuccgucgccuccggcuccggcaccguccacaccuccgccgucucccuccccuccaugaacgccgccgucuccaagaccgucgccgucgccuccggcgccgccuccacccccaucuccaucuccaccggcgcccccaccguccgccagguccccgucuccaccaccgucgucuccaccucccaggccggcaagcuccccacccgcaucaccgucccccucuccgucaucucccagcccaugaagggcaaguccgucgucaccgcccccaucaucaagggcaaccucggcgccaaccucuccggccucggccgcaacaucauccucaccaccaugcccgccggcaccaagcucaucgccggcaacaagcccgucuccuuccucaccgcccagcagcuccagcagcuccagcagcagggccaggccacccagguccgcauccagaccguccccgccucccaccuccagcagggcaccgccuccggcuccuccaaggccgucuccaccgucgucgucaccaccgcccccucccccaagcaggcccccgagcagcaguga

SEQ ID NO: 46623 - RNA, 1221 nt, Artificial Sequence
  derived and/or modified sequence opt2 from NFS1__Homo_sapiens__NP_001185918
augcuccuccgcgccgccuggcgccgcgccgccgucgccgucaccgccgcccccggccccaagcccgccgcccccacccgcggccuccgccuccgcgucggcgaccgcgccccccaguccgccguccccgccgacaccgccgccgcccccgaggucggccccguccuccgcccccucuacauggacguccaggccaccaccccccucgacccccgcguccucgacgccaugcuccccuaccucaucaacuacuacggcaacccccacucccgcacccacgccuacggcugggaguccgaggccgccauggagcgcgcccgccagcaggucgccucccucaucggcgccgacccccgcgagaucaucuucaccuccggcgccaccgaguccaacaacaucgccaucaaggagcucgaggccgccauccagcccgacaccucccucgucuccgucaugaccgucaacaacgagaucggcgucaagcagcccaucgccgagaucggccgcaucugcuccucccgcaaggucuacuuccacaccgacgccgcccaggccgucggcaagaucccccucgacgucaacgacaugaagaucgaccucauguccaucuccggccacaagaucuacggccccaagggcgucggcgccaucuacauccgccgccgcccccgcguccgcgucgaggcccuccaguccggcggcggccaggagcgcggcaugcgcuccggcaccguccccaccccccucgucgucggccucggcgccgccugcgaggucgcccagcaggagauggaguacgaccacaagcgcaucuccaagcucuccgagcgccucauccagaacaucaugaagucccuccccgacgucgucaugaacggcgaccccaagcaccacuaccccggcugcaucaaccucuccuucgccuacgucgagggcgagucccuccucauggcccucaaggacgucgcccucuccuccggcuccgccugcaccuccgccucccucgagcccuccuacguccuccgcgccaucggcaccgacgaggaccucgcccacuccuccauccgcuucggcaucggccgcuucaccaccgaggaggaggucgacuacaccgucgagaagugcauccagcacgucaagcgccuccgcgagauguccccccucugggagaugguccaggacggcaucgaccucaaguccaucaaguggacccagcacuga

SEQ ID NO: 46624 - RNA, 765 nt, Artificial Sequence
  derived and/or modified sequence opt2 from NFU1__Homo_sapiens__NP_001002755
auggccgccaccgcccgccgcggcuggggcgccgccgccgucgccgccggccuccgccgccgcuucugccacaugcucaagaaccccuacaccaucaagaagcagccccuccaccaguucguccagcgcccccucuucccccuccccgccgccuucuaccaccccguccgcuacauguucauccagacccaggacacccccaaccccaacucccucaaguucauccccggcaagcccguccucgagacccgcaccauggacuuccccacccccgccgccgccuuccgcuccccccucgcccgccagcucuuccgcaucgagggcgucaaguccgucuucuucggccccgacuucaucaccgucaccaaggagaacgaggagcucgacuggaaccuccucaagcccgacaucuacgccaccaucauggacuucuucgccuccggccucccccucgucaccgaggagacccccuccggcgaggccggcuccgaggaggacgacgaggucgucgccaugaucaaggagcuccucgacacccgcauccgccccaccguccaggaggacggcggcgacgucaucuacaagggcuucgaggacggcaucguccagcucaagcuccagggcuccugcaccuccugccccuccuccaucaucacccucaagaacggcauccagaacaugcuccaguucuacauccccgaggucgagggcgucgagcaggucauggacgacgaguccgacgagaaggaggccaacucccccuga

SEQ ID NO: 46625 - RNA, 1044 nt, Artificial Sequence
  derived and/or modified sequence opt2 from NFYA__Homo_sapiens__NP_002496
auggagcaguacaccgccaacuccaacuccuccaccgagcagaucgucguccaggccggccagauccagcagcagcagcagggcggcgucaccgccguccagcuccagaccgaggcccaggucgccuccgccuccggccagcagguccagacccuccaggucguccagggccagccccucaugguccaggucuccggcggccagcucaucaccuccaccggccagcccaucaugguccaggccguccccggcggccagggccagaccaucaugcagguccccgucuccggcacccagggccuccagcagauccagcucgucccccccggccagauccagauccagggcggccaggccguccagguccagggccagcagggccagacccagcagaucaucauccagcagccccagaccgccgucaccgccggccagacccagacccagcagcagaucgccguccagggccagcaggucgcccagaccgccgagggccagaccaucgucuaccagcccgucaacgccgacggcaccauccuccagcaggucaccguccccgucuccggcaugaucaccauccccgccgccucccucgccggcgcccagaucguccagaccggcgccaacaccaacaccaccuccuccggccagggcaccgucaccgucacccuccccgucgccggcaacgucgucaacuccggcggcauggucaugaugguccccggcgccggcuccguccccgccauccagcgcaucccccuccccggcgccgagaugcucgaggaggagccccucuacgucaacgccaagcaguaccaccgcauccucaagcgccgccaggcccgcgccaagcucgaggccgagggcaagauccccaaggagcgccgcaaguaccuccacgagucccgccaccgccacgccauggcccgcaagcgcggcgagggcggccgcuucuucucccccaaggagaaggacuccccccacaugcaggaccccaaccaggccgacgaggaggccaugacccagaucauccgcgucuccuga

SEQ ID NO: 46626 - RNA, 624 nt, Artificial Sequence
  derived and/or modified sequence opt2 from NFYB__Homo_sapiens__NP_006157
augaccauggacggcgacuccuccaccaccgacgccucccagcucggcaucuccgccgacuacaucggcggcucccacuacgucauccagccccacgacgacaccgaggacuccaugaacgaccacgaggacaccaacggcuccaaggaguccuuccgcgagcaggacaucuaccuccccaucgccaacgucgcccgcaucaugaagaacgccaucccccagaccggcaagaucgccaaggacgccaaggagugcguccaggagugcgucuccgaguucaucuccuucaucaccuccgaggccuccgagcgcugccaccaggagaagcgcaagaccaucaacggcgaggacauccucuucgccauguccacccucggcuucgacuccuacgucgagccccucaagcucuaccuccagaaguuccgcgaggccaugaagggcgagaagggcaucggcggcgccgucaccgccaccgacggccucuccgaggagcucaccgaggaggccuucaccaaccagcuccccgccggccucaucaccaccgacggccagcagcagaacgucauggucuacaccaccuccuaccagcagaucuccggcguccagcagauccaguucuccuga

SEQ ID NO: 46627 - RNA, 1284 nt, Artificial Sequence
  derived and/or modified sequence opt2 from NFYC__Homo_sapiens__XP_011539819
auguccaccgagggcggcuucggcggcaccuccuccuccgacgcccagcagucccuccaguccuucuggccccgcgucauggaggagauccgcaaccucaccgucaaggacuuccgcguccaggagcucccccucgcccgcaucaagaagaucaugaagcucgacgaggacgucaagaugaucuccgccgaggcccccguccucuucgccaaggccgcccagaucuucaucaccgagcucacccuccgcgccuggauccacaccgaggacaacaagcgccgcacccuccagcgcaacgacaucgccauggccaucaccaaguucgaccaguucgacuuccucaucgacaucgucccccgcgacgagcucaagccccccaagcgccaggaggagguccgccaguccgucacccccgccgagcccguccaguacuacuucacccucgcccagcagcccaccgccguccagguccagggccagcagcagggccagcagaccaccuccuccaccaccaccauccagcccggccagaucaucaucgcccagccccagcagggccagaccacccccgucaccaugcaggucggcgagggccagcagguccagaucguccaggcccagccccagggccaggcccagcaggcccaguccggcaccggccagaccaugcaggucaugcagcagaucaucaccaacaccggcgagauccagcagauccccguccagcucaacgccggccagcuccaguacauccgccucgcccagcccgucuccggcacccaggucguccagggccagauccagacccucgccaccaacgcccagcagggccagcgcaacgccucccagggcaagccccgccgcugccucaaggagacccuccagaucacccagaccgagguccagcagggccagcagcaguucucccaguucaccgacggccagcgcaacuccguccagcaggcccgcgucuccgagcucaccggcgaggccgagccccgcgaggucaaggccaccggcaacuccacccccugcaccuccucccuccccaccacccacccccccucccaccgcgccggcgccuccugcgucugcugcucccagccccagcaguccuccaccucccccccccccuccgacgcccuccagugggucgucgucgagcagcucuaccagauccagcaggucaccaugcccgccggccaggaccucgcccagcccauguucauccaguccgccaaccagcccuccgacggccaggccccccaggucaccggcgacuga

SEQ ID NO: 46628 - RNA, 456 nt, Artificial Sequence
  derived and/or modified sequence opt2 from NGB__Homo_sapiens__NP_067080
auggagcgccccgagcccgagcucauccgccaguccuggcgcgccgucucccgcuccccccucgagcacggcaccguccucuucgcccgccucuucgcccucgagcccgaccuccucccccucuuccaguacaacugccgccaguucuccucccccgaggacugccucuccucccccgaguuccucgaccacauccgcaaggucaugcucgucaucgacgccgccgucaccaacgucgaggaccucuccucccucgaggaguaccucgccucccucggccgcaagcaccgcgccgucggcgucaagcucuccuccuucuccaccgucggcgagucccuccucuacaugcucgagaagugccucggccccgccuucacccccgccacccgcgccgccuggucccagcucuacggcgccgucguccaggccaugucccgcggcugggacggcgaguga

SEQ ID NO: 46629 - RNA, 948 nt, Artificial Sequence
  derived and/or modified sequence opt2 from NGDN__Homo_sapiens__NP_001036100
auggccgcccucggcguccucgaguccgaccuccccuccgccgucacccuccucaagaaccuccaggagcaggucauggccgucaccgcccaggucaagucccucacccagaagguccaggccggcgccuaccccaccgagaagggccucuccuuccucgaggucaaggaccagcuccuccucauguaccucauggaccucacccaccucauccucgacaaggccuccggcggcucccuccagggccacgacgccguccuccgccucgucgagauccgcaccguccucgagaagcuccgcccccucgaccagaagcucaaguaccagaucgacaagcucaucaagaccgccgucaccggcucccucuccgagaacgacccccuccgcuucaagccccaccccuccaacaugauguccaagcucuccuccgaggacgaggaggaggacgaggccgaggacgaccaguccgaggccuccggcaagaaguccgucaagggcgucuccaagaaguacguccccccccgccucguccccguccacuacgacgagaccgaggccgagcgcgagaagaagcgccucgagcgcgccaagcgccgcgcccucuccuccuccgucauccgcgagcucaaggagcaguacuccgacgcccccgaggagauccgcgacgcccgccacccccacgucacccgccagucccaggaggaccagcaccgcaucaacuacgaggaguccaugaugguccgccucuccgucuccaagcgcgagaagggccgccgcaagcgcgccaacgucauguccucccagcuccacucccucacccacuucuccgacaucuccgcccucaccggcggcaccguccaccucgacgaggaccagaaccccaucaagaagcgcaagaagaucccccagaagggccgcaagaagaagggcuuccgccgccgccgcuga

SEQ ID NO: 46630 - RNA, 1857 nt, Artificial Sequence
  derived and/or modified sequence opt2 from NGEF__Homo_sapiens__NP_001107562
auggagcuccucgccgccgccuucuccgccgccugcgccgucgaccacgacuccuccaccuccgaguccgacgcccgcgacuccgccgccggccaccuccccggcuccgaguccuccuccacccccggcaacggcgccacccccgaggaguggcccgcccucgccgacucccccaccacccucaccgaggcccuccgcaugauccaccccauccccgccgacuccuggcgcaaccucaucgagcagaucggccuccucuaccaggaguaccgcgacaaguccacccuccaggagaucgagacccgccgccagcaggacgccgagaucgaggacaacaccaacggcucccccgccuccgaggacacccccgaggaggaggaggaggaggaggaggaggaggagcccgccuccccccccgagcgcaagacccucccccagaucugccuccucuccaacccccacucccgcuucaaccucuggcaggaccuccccgagauccgcuccuccggcguccucgagauccuccagcccgaggagaucaagcuccaggaggccauguucgagcucgucaccuccgaggccuccuacuacaagucccucaaccuccucgucucccacuucauggagaacgagcgcauccgcaagauccuccaccccuccgaggcccacauccucuucuccaacguccucgacguccucgccgucuccgagcgcuuccuccucgagcucgagcaccgcauggaggagaacaucgucaucuccgacgucugcgacaucgucuaccgcuacgccgccgaccacuucuccgucuacaucaccuacgucuccaaccagaccuaccaggagcgcaccuacaagcagcuccuccaggagaaggccgccuuccgcgagcucaucgcccagcucgagcucgaccccaagugccgcggccuccccuucuccuccuuccucauccuccccuuccagcgcaucacccgccucaagcuccucguccagaacauccucaagcgcgucgaggagcgcuccgagcgcgagugcaccgcccucgacgcccacaaggagcucgagauggucgucaaggccugcaacgagggcguccgcaagaugucccgcaccgagcagaugaucuccauccagaagaagauggaguucaagaucaaguccguccccaucaucucccacucccgcuggcuccucaagcagggcgagcuccagcagauguccggccccaagaccucccgcacccuccgcaccaagaagcucuuccacgagaucuaccucuuccucuucaacgaccuccucgucaucugccgccagauccccggcgacaaguaccaggucuucgacuccgccccccgcggccuccuccgcgucgaggagcucgaggaccagggccagacccucgccaacgucuucauccuccgccuccucgagaacgccgacgaccgcgaggccaccuacaugcucaaggccuccucccaguccgagaugaagcgcuggaugaccucccucgcccccaaccgccgcaccaaguucgucuccuucaccucccgccuccucgacugcccccagguccagugcguccaccccuacgucgcccagcagcccgacgagcucacccucgagcucgccgacauccucaacauccucgacaagaccgacgacggcuggaucuucggcgagcgccuccacgaccaggagcgcggcugguuccccuccuccaugaccgaggagauccucaaccccaagauccgcucccagaaccucaaggagugcuuccgcguccacaagauggacgacccccagcgcucccagaacaaggaccgccgcaagcucggcucccgcaaccgccaguga

SEQ ID NO: 46631 - RNA, 891 nt, Artificial Sequence
  derived and/or modified sequence opt2 from NGF__Homo_sapiens__XP_011539820
auggccuccuccaacggccacuucaacgagguccucgccuccggccgcgccguccagggcgccggcuggcacgccggccccaagcucuccuccgccuccggccccaacaacuccuucaccaagggcgccgccuucuaccccggccacaccgagguccacuccgucauguccaugcucuucuacacccucaucaccgccuuccucaucggcauccaggccgagccccacuccgaguccaacguccccgccggccacaccaucccccaggcccacuggaccaagcuccagcacucccucgacaccgcccuccgccgcgcccgcuccgcccccgccgccgccaucgccgcccgcgucgccggccagacccgcaacaucaccgucgacccccgccucuucaagaagcgccgccuccgcuccccccgcguccucuucuccacccagcccccccgcgaggccgccgacacccaggaccucgacuucgaggucggcggcgccgcccccuucaaccgcacccaccgcuccaagcgcuccuccucccaccccaucuuccaccgcggcgaguucuccgucugcgacuccgucuccgucugggucggcgacaagaccaccgccaccgacaucaagggcaaggaggucaugguccucggcgaggucaacaucaacaacuccgucuucaagcaguacuucuucgagaccaagugccgcgaccccaaccccgucgacuccggcugccgcggcaucgacuccaagcacuggaacuccuacugcaccaccacccacaccuucgucaaggcccucaccauggacggcaagcaggccgccuggcgcuucauccgcaucgacaccgccugcgucugcguccucucccgcaaggccguccgccgcgccuga

SEQ ID NO: 46632 - RNA, 576 nt, Artificial Sequence
  derived and/or modified sequence opt2 from NGFRAP1__Homo_sapiens__NP_001269603
auggccgucgccggcggcggcaagggcgagauccuccuccacuggccccccaagcucggcggcgagcucggcggcgacgcccgccccucccgcgaccccgagcuccaguccgacgccgccuucggcgccgucgucacccgcgucuggcuccccgccccccgcugccccgagcucggcggccucgccuucggccccggcaaguccggcgccgagaagcagcccgagaagaagaaccucaucauggccaacauccaccaggagaacgaggagauggagcagcccaugcagaacggcgaggaggaccgcccccucggcggcggcgagggccaccagcccgccggcaaccgccgcggccaggcccgccgccucgcccccaacuuccgcugggccauccccaaccgccagaucaacgacggcaugggcggcgacggcgacgacauggagaucuucauggaggagaugcgcgagauccgccgcaagcuccgcgagcuccagcuccgcaacugccuccgcauccucaugggcgagcucuccaaccaccacgaccaccacgacgaguucugccucaugcccuga

SEQ ID NO: 46633 - RNA, 1284 nt, Artificial Sequence
  derived and/or modified sequence opt2 from NGFR__Homo_sapiens__NP_002498
augggcgccggcgccaccggccgcgccauggacggcccccgccuccuccuccuccuccuccucggcgucucccucggcggcgccaaggaggccugccccaccggccucuacacccacuccggcgagugcugcaaggccugcaaccucggcgagggcgucgcccagcccugcggcgccaaccagaccgucugcgagcccugccucgacuccgucaccuucuccgacgucgucuccgccaccgagcccugcaagcccugcaccgagugcgucggccuccaguccauguccgcccccugcgucgaggccgacgacgccgucugccgcugcgccuacggcuacuaccaggacgagaccaccggccgcugcgaggccugccgcgucugcgaggccggcuccggccucgucuucuccugccaggacaagcagaacaccgucugcgaggagugccccgacggcaccuacuccgacgaggccaaccacgucgaccccugccuccccugcaccgucugcgaggacaccgagcgccagcuccgcgagugcacccgcugggccgacgccgagugcgaggagauccccggccgcuggaucacccgcuccaccccccccgagggcuccgacuccaccgcccccuccacccaggagcccgaggccccccccgagcaggaccucaucgccuccaccgucgccggcgucgucaccaccgucaugggcuccucccagcccgucgucacccgcggcaccaccgacaaccucauccccgucuacugcuccauccucgccgccgucgucgucggccucgucgccuacaucgccuucaagcgcuggaacuccugcaagcagaacaagcagggcgccaacucccgccccgucaaccagacccccccccccgagggcgagaagcuccacuccgacuccggcaucuccgucgacucccagucccuccacgaccagcagccccacacccagaccgccuccggccaggcccucaagggcgacggcggccucuacuccucccucccccccgccaagcgcgaggaggucgagaagcuccucaacggcuccgccggcgacaccuggcgccaccucgccggcgagcucggcuaccagcccgagcacaucgacuccuucacccacgaggccugccccguccgcgcccuccucgccuccugggccacccaggacuccgccacccucgacgcccuccucgccgcccuccgccgcauccagcgcgccgaccucgucgagucccucugcuccgaguccaccgccaccucccccgucuga

SEQ ID NO: 46634 - RNA, 1911 nt, Artificial Sequence
  derived and/or modified sequence opt2 from NGLY1__Homo_sapiens__NP_001138765
auggccgccgccgcccucggcuccuccuccggcuccgccucccccgccgucgccgagcucugccagaacacccccgagaccuuccucgaggccuccaagcuccuccucaccuacgccgacaacauccuccgcaaccccaacgacgagaaguaccgcuccauccgcaucggcaacaccgccuucuccacccgccuccuccccguccgcggcgccgucgagugccucuucgagaugggcuucgaggagggcgagacccaccucaucuuccccaagaaggccuccgucgagcagcuccagaagauccgcgaccucaucgccaucgagcgcuccucccgccucgacggcuccaacaagucccacaaggucaaguccucccagcagcccgccgccuccacccagcuccccaccacccccuccuccaaccccuccggccucaaccagcacacccgcaaccgccagggccaguccuccgacccccccuccgccuccaccgucgccgccgacuccgccauccucgagguccuccaguccaacauccagcacguccucgucuacgagaaccccgcccuccaggagaaggcccucgccugcauccccguccaggagcucaagcgcaagucccaggagaagcucucccgcgcccgcaagcucgacaagggcaucaacaucuccgacgaggacuuccuccuccucgagcuccuccacugguucaaggaggaguucuuccacugggucaacaacguccucugcuccaagugcggcggccagacccgcucccgcgaccgcucccuccuccccuccgacgacgagcucaaguggggcgccaaggaggucgaggaccacuacugcgacgccugccaguucuccaaccgcuucccccgcuacaacaaccccgagaagcuccucgagacccgcugcggccgcugcggcgagugggccaacugcuucacccucugcugccgcgccgucggcuucgaggcccgcuacgucugggacuacaccgagcuccagcgcacccucucccucaagcucaccacccucaaggagaucggcaagaccuuccuccgcaucuccaagcgccagaagcucauccaggucgucgacgucaccuggcgcuacuccugcaagcacgaggaggucaucgcccgccgcaccaaggucaaggaggcccuccuccgcgacaccaucaacggccucaacaagcagcgccagcucuuccucuccgagaaccgccgcaaggagcuccuccagcgcaucaucgucgagcucgucgaguucaucucccccaagacccccaagcccggcgagcucggcggccgcaucuccggcuccgucgccuggcgcgucgcccgcggcgagaugggccuccagcgcaaggagacccucuucauccccugcgagaacgagaagaucuccaagcagcuccaccucugcuacaacaucgucaaggaccgcuacguccgcgucuccaacaacaaccagaccaucuccggcugggagaacggcgucuggaagauggaguccaucuuccgcaaggucgagaccgacuggcacauggucuaccucgcccgcaaggagggcuccuccuucgccuacaucuccuggaaguucgagugcggcuccgucggccucaaggucgacuccaucuccauccgcaccuccucccagaccuuccagaccggcaccgucgaguggaagcuccgcuccgacaccgcccaggucgagcucaccggcgacaacucccuccacuccuacgccgacuucuccggcgccaccgaggucauccucgaggccgagcucucccgcggcgacggcgacgucgccuggcagcacacccagcucuuccgccagucccucaacgaccacgaggagaacugccucgagaucaucaucaaguucuccgaccucuga

SEQ ID NO: 46635 - RNA, 900 nt, Artificial Sequence
  derived and/or modified sequence opt2 from NHEJ1__Homo_sapiens__NP_079058
auggaggagcucgagcagggccuccucaugcagcccugggccuggcuccagcucgccgagaacucccuccucgccaaggucuucaucaccaagcagggcuacgcccuccucgucuccgaccuccagcaggucuggcacgagcaggucgacaccuccgucgucucccagcgcgccaaggagcucaacaagcgccucaccgccccccccgccgccuuccucugccaccucgacaaccuccuccgcccccuccucaaggacgccgcccaccccuccgaggccaccuucuccugcgacugcgucgccgacgcccucauccuccgcguccgcuccgagcucuccggccuccccuucuacuggaacuuccacugcaugcucgccucccccucccucgucucccagcaccucauccgcccccucaugggcaugucccucgcccuccagugccagguccgcgagcucgccacccuccuccacaugaaggaccucgagauccaggacuaccaggaguccggcgccacccucauccgcgaccgccucaagaccgagcccuucgaggagaacuccuuccucgagcaguucaugaucgagaagcuccccgaggccugcuccaucggcgacggcaagcccuucgucaugaaccuccaggaccucuacauggccgucaccacccaggagguccaggucggccagaagcaccagggcgccggcgacccccacaccuccaacuccgccucccuccagggcaucgacucccagugcgucaaccagcccgagcagcucgucuccuccgcccccacccucuccgcccccgagaaggaguccaccggcaccuccggcccccuccagcgcccccagcucuccaaggucaagcgcaagaagccccgcggccucuucuccuga

SEQ ID NO: 46636 - RNA, 402 nt, Artificial Sequence
  derived and/or modified sequence opt2 from NHLH1__Homo_sapiens__NP_005589
augaugcucaacuccgacaccauggagcucgaccucccccccacccacuccgagaccgaguccggcuucuccgacugcggcggcggcgccggccccgacggcgccggccccggcggccccggcggcggccaggcccgcggccccgagcccggcgagcccggccgcaaggaccuccagcaccucucccgcgaggagcgccgccgccgccgccgcgccaccgccaaguaccgcaccgcccacgccacccgcgagcgcauccgcgucgaggccuucaaccucgccuucgccgagcuccgcaagcuccuccccacccucccccccgacaagaagcucuccaagaucgagauccuccgccucgccaucugcuacaucuccuaccucaaccacguccucgacgucuga

SEQ ID NO: 46637 - RNA, 1188 nt, Artificial Sequence
  derived and/or modified sequence opt2 from NHLRC1__Homo_sapiens__NP_940988
auggccgccgaggccuccgaguccggccccgcccuccacgagcucaugcgcgaggccgagaucucccuccucgagugcaaggucugcuucgagaaguucggccaccgccagcagcgccgcccccgcaaccucuccugcggccacgucgucugccucgccugcgucgccgcccucgcccacccccgcacccucgcccucgagugccccuucugccgccgcgccugccgcggcugcgacaccuccgacugccuccccguccuccaccucaucgagcuccucggcuccgcccuccgccagucccccgccgcccaccgcgccgcccccuccgcccccggcgcccucaccugccaccacaccuucggcggcuggggcacccucgucaaccccaccggccucgcccucugccccaagaccggccgcgucgucgucguccacgacggccgccgccgcgucaagaucuucgacuccggcggcggcugcgcccaccaguucggcgagaagggcgacgccgcccaggacauccgcuaccccgucgacgucaccaucaccaacgacugccacgucgucgucaccgacgccggcgaccgcuccaucaaggucuucgacuucuucggccagaucaagcucgucaucggcggccaguucucccuccccuggggcgucgagaccaccccccagaacggcaucgucgucaccgacgccgaggccggcucccuccaccuccucgacgucgacuucgccgagggcguccuccgccgcaccgagcgccuccaggcccaccucugcaacccccgcggcgucgccgucuccuggcucaccggcgccaucgccguccucgagcacccccucgcccucggcaccggcgucugcuccacccgcgucaaggucuucuccuccuccaugcagcucgucggccaggucgacaccuucggccucucccucuacuuccccuccaagaucaccgccuccgccgucaccuucgaccaccagggcaacgucaucgucgccgacaccuccggccccgccauccucugccucggcaagcccgaggaguuccccguccccaagcccauggucacccacggccucucccaccccgucgcccucaccuucaccaaggagaacucccuccucguccucgacaccgccucccacuccaucaaggucuacaaggucgacuggggcuga

SEQ ID NO: 46638 - RNA, 1044 nt, Artificial Sequence
  derived and/or modified sequence opt2 from NHLRC3__Homo_sapiens__NP_001012772
auggcccgcuucugggucugcgucgccggcgccggcuucuuccucgccuuccucguccuccacucccgcuucugcggcucccccguccuccgcaacuucaccuucgccgucuccuggcgcaccgagaagauccucuaccgccucgacgucggcuggcccaagcaccccgaguacuucaccggcaccaccuucugcgucgccgucgacucccucaacggccucgucuacaucggccagcgcggcgacaacauccccaagauccucgucuucaccgaggacggcuacuuccuccgcgccuggaacuacaccgucgacaccccccacggcaucuucgccgccuccacccucuacgagcaguccgucuggaucaccgacgucggcuccggcuucuucggccacaccgucaagaaguacuccuccuucggcgaccucguccagguccucggcacccccggcaagaagggcaccucccucaacccccuccaguucgacaaccccgccgagcucuacgucgaggacaccggcgacaucuacaucgucgacggcgacggcggccucaacaaccgccucaucaagcucucccaggacuucaugauccucuggcuccacggcgagaacggcaccggccccgccaaguucaacaucccccacuccgucacccucgacuccgccggccgcgucugggucgccgaccgcggcaacaagcgcauccaggucuucgacaaggacaccggcgaguggcucggcgccuggaacaacugcuucaccgaggagggccccuccuccguccgcuucacccccgacggcaaguaccucaucgucgcccagcucaaccucucccgccucuccgucgucgccgccccccccgucggcuccaucggcgagugcuccgucaucuccaccauccagcucgccgaccagguccucccccaccuccucgaggucgaccgcaagaccggcgccgucuacgucgccgagaucggcgccaagcagguccagaaguacgucccccucaacuccuacguccccuccuucggcuccuga

SEQ ID NO: 46639 - RNA, 273 nt, Artificial Sequence
  derived and/or modified sequence opt2 from NHP2__Homo_sapiens__NP_001030005
augaccaagaucaaggccgaccccgacggccccgaggcccaggccgaggccugcuccggcgagcgcaccuaccaggagcuccucgucaaccagaaccccaucgcccagccccucgccucccgccgccucacccgcaagcucuacaagugcaucaagaaggccgucaagcagaagcagauccgccgcggcgucaaggagguccagaaguucgucaacaagggcgagaagggcaccuggguccagccccaggcccccuccgccccccccgucuga

SEQ ID NO: 46640 - RNA, 387 nt, Artificial Sequence
  derived and/or modified sequence opt2 from NHP2L1__Homo_sapiens__NP_004999
augaccgaggccgacgucaaccccaaggccuacccccucgccgacgcccaccucaccaagaagcuccucgaccucguccagcaguccugcaacuacaagcagcuccgcaagggcgccaacgaggccaccaagacccucaaccgcggcaucuccgaguucaucgucauggccgccgacgccgagccccucgagaucauccuccaccucccccuccucugcgaggacaagaacguccccuacgucuucguccgcuccaagcaggcccucggccgcgccugcggcgucucccgccccgucaucgccugcuccgucaccaucaaggagggcucccagcucaagcagcagauccaguccauccagcaguccaucgagcgccuccucgucuga

SEQ ID NO: 46641 - RNA, 4425 nt, Artificial Sequence
  derived and/or modified sequence opt2 from NHS__Homo_sapiens__NP_001129496
auggcccucgccugcugcaugcccaagaacgccgccgucuccaaccucgacaucgaguccaagcucuccgucuacuaccgcgcccccuggcaccagcagcgcaacaucuuccuccccgccacccgcccccccugcgucgaggagcuccaccgccacgcccgccagucccuccaggcccuccgccgcgagcaccgcucccgcuccgaccgccgcgagcagcgcgccgccgccccccucuccaucgccgcccccccccuccccgccuacccccccgcccacucccagcgccgccgcgaguucaaggaccgccacuuccucaccuucaacuccacccgcucccccucccccaccgagugcugccacaugacccccuggucccgcaagucccacccccccgaggacgaggacaccgacgucaugcucggccagcgccccaagaaccccauccacaacauccccuccacccucgacaagcagaccaacugguccaaggcccucccccuccccacccccgaggagaagaugaagcaggacgcccaggucaucuccuccugcaucauccccaucaacgucaccggcgucggcuucgaccgcgaggccuccauccgcugcucccucguccacucccaguccguccuccagcgccgccgcaagcuccgccgccgcaagaccaucuccggcaucccccgccgcguccagcaggagaucgacuccgacgagucccccgucgcccgcgagcgcaacgucaucguccacaccaaccccgaccccuccaacaccgucaaccgcaucuccggcacccgcgacuccgagugccagaccgaggacauccucaucgccgcccccucccgccgccgcauccgcgcccagcgcggccaguccaucgccgccucccucucccacuccgccggcaacaucuccgcccucgccgacaagggcgacaccauguucacccccgccgucuccucccgcacccgcucccgcucccucccccgcgagggcaaccgcggcggcgacgccgagcccaaggucggcgccaagcccuccgccuacgaggagggcgaguccuucgucggcgaccacgagcgcacccccaacgacuucuccgaggcccccuccucccccuccgcccaggaccaccagcccacccucggccucgccugcucccagcaccuccacuccccccagcacaagcucuccgagcgcggccgcucccgccucucccgcauggccgccgacuccggcuccugcgacaucuccuccaacuccgacaccuucggcucccccauccacugcaucuccaccgccggcguccuccucuccucccacauggaccagaaggacgaccaccaguccuccuccggcaacugguccggcuccuccuccaccugccccucccagaccuccgagaccaucccccccgccgccucccccccccucaccggcuccucccacugcgacuccgagcucucccucaacaccgccccccacgccaacgaggacgccuccgucuucgucaccgagcaguacaacgaccaccucgacaagguccgcggccaccgcgccaacuccuucaccuccaccgucgccgaccuccucgacgaccccaacaacuccaacaccuccgacuccgaguggaacuaccuccaccaccaccacgacgccuccugccgccaggacuucucccccgagcgccccaaggccgacucccucggcugccccuccuucaccuccauggccaccuacgacuccuuccucgagaagucccccuccgacaaggccgacaccuccucccacuucuccgucgacaccgagggcuacuacaccuccaugcacuucgacugcggccucaagggcaacaaguccuacgucugccacuacgccgcccucggccccgagaacggccagggcgucggcgccucccccggccuccccgacugcgccuggcaggacuaccucgaccacaagcgccagggccgccccuccaucuccuuccgcaagcccaaggccaagcccaccccccccaagcgcuccuccucccuccgcaaguccgacggcaacgccgacaucuccgagaagaaggagcccaagaucuccuccggccagcaccucccccacuccucccgcgagaugaagcucccccucgacuucgccaacacccccucccgcauggagaacgccaaccuccccaccaagcaggagcccuccuggaucaaccaguccgagcagggcaucaaggagccccagcucgacgccuccgacaucccccccuucaaggacgaggucgccgaguccacccacuacgccgaccucuggcuccucaacgaccucaagaccaacgaccccuaccgcucccucuccaacuccuccaccgccaccggcaccaccgucaucgagugcaucaagucccccgaguccuccgagucccagaccucccaguccgagucccgcgccaccacccccucccuccccuccgucgacaacgaguucaagcucgccucccccgagaagcucgccggccucgccucccccuccuccggcuacuccucccaguccgagacccccaccuccuccuuccccaccgccuucuucuccggcccccucucccccggcggcuccaagcgcaagcccaagguccccgagcgcaaguccucccuccagcagcccucccucaaggacggcaccaucucccucuccaaggaccucgagcuccccaucaucccccccacccaccucgaccucuccgcccuccacaacguccucaacaagcccuuccaccaccgccacccccuccacgucuucacccacaacaagcagaacaccgucggcgagacccuccgcuccaaccccccccccucccucgccaucacccccaccauccucaaguccgucaaccuccgcuccaucaacaaguccgaggaggucaagcagaaggaggagaacaacaccgaccuccccuaccucgaggaguccacccucaccaccgccgcccucucccccuccaagauccgcccccacaccgccaacaaguccgucucccgccaguacuccaccgaggacaccauccucuccuuccucgacuccuccgccgucgagaugggccccgacaagcuccaccucgagaagaacuccaccuucgacgucaagaaccgcugcgaccccgagaccaucaccuccgccggcuccucccuccucgacuccaacgucaccaaggaccagguccgcaccgagaccgagcccauccccgagaacacccccaccaagaacugcgccuuccccaccgagggcuuccagcgcgucuccgccgcccgccccaacgaccucgacggcaagaucauccaguacggccccggccccgacgagacccucgagcagguccagaaggcccccuccgccggccucgaggaggucgcccagcccgaguccgucgacgucaucaccucccaguccgacucccccacccgcgccaccgacgucuccaaccaguucaagcaccaguucgucaugucccgccaccacgacaagguccccggcaccaucuccuacgaguccgagaucaccuccgucaacuccuuccccgagaagugcuccaagcaggagaacaucgccuccggcaucuccgccaaguccgccuccgacaacuccaaggccgaggagacccagggcaacgucgacgaggccucccucaaggaguccucccccuccgacgacuccaucaucuccccccucuccgaggacucccaggccgaggccgagggcgucuucgucucccccaacaagccccgcaccaccgaggaccucuucgccgucauccaccgcuccaagcgcaagguccucggccgcaaggacuccggcgacauguccguccgcuccaagucccgcgccccccucuccuccuccuccuccuccgccuccuccaucaccucccccuccuccaacgucaccacccccaacucccagcgcucccccggccucaucuaccgcaacgccaagaaguccaacaccuccaacgaggaguucaagcuccuccuccucaagaagggcucccgcuccgacuccuccuaccgcauguccgccaccgagauccucaagucccccauccuccccaagccccccggcgagcucaccgccgaguccccccaguccaccgacgacgcccaccagggcucccagggcgccgaggcccucuccccccucucccccugcuccccccgcgucaacgccgagggcuucuccuccaaguccuucgccaccuccgccuccgcccgcgucggccgcucccgcgccccccccgccgccuccuccucccgcuacuccguccgcugccgccucuacaacacccccaugcaggccaucuccgagggcgagaccgagaacuccgacggcuccccccacgacgaccgcuccucccaguccuccaccuga

SEQ ID NO: 46642 - RNA, 4821 nt, Artificial Sequence
  derived and/or modified sequence opt2 from NHSL1__Homo_sapiens__NP_001137532
auggucgucuucaucaacgccaagaucaagucccucaucaagcucuucaagaagaagaccgucuccaaccucgacgaggagucccgcuggaccguccacuacaccgcccccuggcaccagcaggagaacgucuuccuccccaccacccgcccccccugcgucgaggaccuccaccgccaggccaagcucaaccucaaguccguccuccgcgagugcgacaagcuccgccacgacggcuaccgcuccucccaguacuacucccagggccccaccuucgccgccaacgccucccccuucugcgacgacuaccaggacgaggacgaggagaccgaccagaagugcucccucuccuccuccgaggaggagcgcuucaucuccauccgccgccccaagacccccgccuccuccgacuucuccgaccucaacacccagaccaacuggaccaagucccucccccuccccacccccgaggagaagaugcgccagcaggcccagaccguccaggccgacgucguccccaucaacaucaccggcgagaacuucgaccgccaggccucccuccgccgcucccucaucuacaccgacacccucguccgccgccccaagaaggucaagcgccgcaagaccaucaccggcguccccgacaacauccagaaggagcucgccuccggcaccggccaggacgacgccgacggccacuccgucuacacccccgaccacuacuccacccucggccgcuucaacuccugccgcuccgccggccagcgcuccgagacccgcgacuccuccugccagaccgaggacgucaaggucgucccccccuccaugcgccgcauccgcgcccagaagggccagggcaucgccgcccagaugggccacuucuccggcuccuccggcaacauguccguccucuccgacuccgccggcaucgucuuccccucccgccucgacuccgacgccggcuuccacucccucccccgcuccggcgcccgcgccaacauccagucccucgagccccgccucggcgcccucggccccgccggcgacaugaacggcaccuuccucuaccagcgcggccacccccaggccgacgagaaccucggccaccucggcggcgccuccggcaccggcacccuccuccgccccaagucccaggagcuccgccacuucgaguccgagaacaucaugucccccgccugcgucgucuccccccacgccaccuacuccaccuccaucauccccaacgccacccucuccuccuccuccgaggucaucgccauccccaccgcccaguccgccggccagcgcgaguccaaguccuccggcuccucccacgcccgcaucaagucccgcgaccaccucaucucccgccacgccgucaagggcgacccccagucccccggccgccacuggaacgagggccacgccaccauccucucccaggaccucgacccccacucccccggcgagcccgcccuccucucccucugcgacuccgccgucccccucaacgcccccgccaaccgcgagaacggcucccaggccaugcccuacaacugccgcaacaaccucgccuuccccgcccacccccaggacgucgacggcaaguccgaguccuccuacuccggcggcggcggccacuccuccuccgagcccugggaguacaaguccuccggcaacggccgcgccuccccccucaagccccaccucgccacccccggcuacuccacccccaccuccaacauguccuccugcucccucgaccagaccuccaacaaggaggacgccggcucccucuacuccgaggaccacgacggcuacugcgccuccguccacaccgacuccggccacggcuccggcaaccucugcaacuccuccgacggcuucggcaacccccgccacuccgucaucaacgucuucgucggccgcgcccagaagaaccagggcgaccgcuccaacuaccaggacaagucccucucccgcaacaucucccucaagaaggccaagaagcccccccucccccccucccgcaccgacucccuccgccgcauccccaagaaguccucccagugcaacggccagguccucaacgagucccucaucgccacccuccagcacucccuccagcucucccuccccggcaaguccggcuccucccccucccagucccccugcuccgaccucgaggagcccuggcucccccgcucccgcucccaguccaccgucuccgccggcuccuccaugaccuccgccaccacccccaacgucuacucccucugcggcgccacccccucccaguccgacaccuccuccgucaaguccgaguacaccgaccccuggggcuacuacaucgacuacaccggcaugcaggaggaccccggcaaccccgccggcggcugcuccaccuccuccggcguccccaccggcaacggccccguccgccacguccaggagggcucccgcgccaccaugccccagguccccggcggcuccgucaagcccaagaucaugucccccgagaagucccaccgcgucaucucccccuccuccggcuacuccucccaguccaacacccccaccgcccucacccccguccccgucuuccucaaguccgucucccccgccaacggcaagggcaagcccaagcccaagguccccgagcgcaaguccucccucaucuccuccgucuccaucuccuccuccuccaccucccucuccuccuccaccuccaccgagggcuccggcaccaugaagaagcucgaccccgccgucggcuccccccccgcccccccccccccccccguccccuccccccccuuccccugccccgccgaccgcucccccuuccuccccccccccccccccgucaccgacugcucccagggcuccccccucccccacucccccgucuuccccccccccccccccgaggcccucauccccuucugcuccccccccgacuggugccucucccccccccgccccgcccucucccccauccuccccgacucccccgucucccucccccucccccccccccuccuccccuccuccgagcccccccccgcccccccccucgaccccaaguucaugaaggacacccgcccccccuucaccaacuccggccagcccgaguccucccgcggcucccuccgcccccccuccaccaaggaggagaccucccgcccccccaugccccucaucaccaccgaggcccuccagaugguccagcuccgccccguccgcaagaacuccggcgccgaggccgcccagcucuccgagcgcaccgcccaggagcagcgcacccccgucgccccccaguaccaccucaagcccuccgccuuccucaagucccgcaacuccaccaacgagauggaguccgagucccagcccgccuccgucaccuccucccuccccacccccgccaaguccuccucccagggcgaccacggcuccgccgccgagcgcggcggccccgucucccgcucccccggcgcccccuccgccggcgaggccgaggcccgccccucccccuccaccaccccccuccccgacuccucccccucccgcaagcccccccccaucuccaagaagcccaagcucuuccucgucgucccccccccccagaaggacuucgccgucgagcccgccgagaacgucuccgaggcccuccgcgccguccccucccccaccaccggcgaggagggcuccguccacucccgcgaggccaaggaguccuccgccgcccaggccggcucccacgccacccaccccggcaccuccguccucgagggcggcgccgccggcuccaugucccccucccgcgucgaggccaacguccccaugguccagcccgacgucucccccgcccccaagcaggaggagcccgccgagaacuccgccgacaccggcggcgacggcgaguccugccucucccagcaggacggcgccgccggcguccccgagaccaacgccgccggcuccuccuccgaggccugcgacuuccucaaggaggacggcaacgacgaggucaugacccccucccgcccccgcaccaccgaggaccucuucgccgccauccaccgcuccaagcgcaagguccucggccgccgcgacuccgacgacgaccacucccgcaaccacucccccuccccccccgucacccccaccggcgccgcccccucccucgccucccccaagcaggucggcuccauccagcgcuccauccgcaaguccuccaccuccuccgacaacuucaaggcccuccuccucaagaagggcucccgcuccgacaccuccgcccgcauguccgccgccgagaugcucaagaacaccgacccccgcuuccagcgcucccgcuccgagcccucccccgacgcccccgagucccccuccuccugcucccccuccaagaaccgccgcgcccaggaggagugggccaagaacgagggccucaugccccgcucccucuccuucuccggcccccgcuacggccgcucccgcaccccccccuccgccgccuccucccgcuacuccaugcgcaaccgcauccaguccucccccaugaccgucaucuccgagggcgagggcgaggccgucgagcccgucgacuccaucgcccgcggcgcccucggcgccgccgagggcugcucccucgacggccucgcccgcgaggagauggacgagggcggccuccucugcggcgagggccccgccgccucccuccagccccaggcccccggccccgucgacggcaccgccuccgccgagggccgcgagcccuccccccagugcggcggcucccucuccgaggaguccuga

SEQ ID NO: 46643 - RNA, 642 nt, Artificial Sequence
  derived and/or modified sequence opt2 from NICN1__Homo_sapiens__NP_115692
augucccgcguccucguccccugccacgucaagggcuccgucgcccuccaggucggcgacguccgcaccucccagggccgccccggcguccucgucaucgacgucaccuuccccuccgucgcccccuucgagcuccaggagaucaccuucaagaacuacuacaccgccuuccucuccauccgcguccgccaguacaccuccgcccacacccccgccaagugggucaccugccuccgcgacuacugccucaugcccgacccccacuccgaggagggcgcccaggaguacgucucccucuucaagcaccagaugcucugcgacauggcccgcaucuccgagcuccgccucauccuccgccagcccuccccccucuggcucuccuucaccgucgaggagcuccagaucuaccagcagggccccaagucccccuccgucaccuuccccaaguggcucucccaccccguccccugcgagcagcccgcccuccuccgcgagggccuccccgaccccucccgcgucuccuccgagguccagcagaugugggcccucaccgagaugauccgcgccucccacaccuccgcccgcaucggccgcuucgacgucgacggcugcuacgaccucaaccuccucuccuacaccuga

SEQ ID NO: 46644 - RNA, 3744 nt, Artificial Sequence
  derived and/or modified sequence opt2 from NID1__Homo_sapiens__NP_002499
augcucgccuccuccucccgcauccgcgccgccuggacccgcgcccuccuccucccccuccuccucgccggccccgucggcugccucucccgccaggagcucuuccccuucggccccggccagggcgaccucgagcucgaggacggcgacgacuucgucucccccgcccucgagcucuccggcgcccuccgcuucuacgaccgcuccgacaucgacgccgucuacgucaccaccaacggcaucaucgccaccuccgagccccccgccaaggagucccaccccggccucuucccccccaccuucggcgccgucgcccccuuccucgccgaccucgacaccaccgacggccucggcaaggucuacuaccgcgaggaccucucccccuccaucacccagcgcgccgccgagugcguccaccgcggcuuccccgagaucuccuuccagcccuccuccgccgucgucgucaccugggaguccgucgcccccuaccagggccccucccgcgaccccgaccagaagggcaagcgcaacaccuuccaggccguccucgccuccuccgacuccuccuccuacgccaucuuccucuaccccgaggacggccuccaguuccacaccaccuucuccaagaaggagaacaaccagguccccgccgucgucgccuucucccagggcuccgucggcuuccucuggaaguccaacggcgccuacaacaucuucgccaacgaccgcgaguccgucgagaaccucgccaaguccuccaacuccggccagcagggcgucugggucuucgagaucggcucccccgccaccaccaacggcgucguccccgccgacgucauccucggcaccgaggacggcgccgaguacgacgacgaggacgaggacuacgaccucgccaccacccgccucggccucgaggacgucggcaccacccccuucuccuacaaggcccuccgccgcggcggcgccgacaccuacuccguccccuccguccucuccccccgccgcgccgccaccgagcgcccccucggcccccccaccgagcgcacccgcuccuuccagcucgccgucgagaccuuccaccagcagcacccccaggucaucgacgucgacgaggucgaggagaccggcgucgucuucuccuacaacaccgacucccgccagaccugcgccaacaaccgccaccagugcuccguccacgccgagugccgcgacuacgccaccggcuucugcugcuccugcgucgccggcuacaccggcaacggccgccagugcgucgccgagggcuccccccagcgcgucaacggcaaggucaagggccgcaucuucgucggcuccucccagguccccaucgucuucgagaacaccgaccuccacuccuacgucgucaugaaccacggccgcuccuacaccgccaucuccaccauccccgagaccgucggcuacucccuccucccccucgcccccgucggcggcaucaucggcuggauguucgccgucgagcaggacggcuucaagaacggcuucuccaucaccggcggcgaguucacccgccaggccgaggucaccuucgucggccaccccggcaaccucgucaucaagcagcgcuucuccggcaucgacgagcacggccaccucaccaucgacaccgagcucgagggccgcgucccccagauccccuucggcuccuccguccacaucgagcccuacaccgagcucuaccacuacuccaccuccgucaucaccuccuccuccacccgcgaguacaccgucaccgagcccgagcgcgacggcgccucccccucccgcaucuacaccuaccaguggcgccagaccaucaccuuccaggagugcguccacgacgacucccgccccgcccuccccuccacccagcagcucuccgucgacuccgucuucguccucuacaaccaggaggagaagauccuccgcuacgcccucuccaacuccaucggccccguccgcgagggcucccccgacgcccuccagaaccccugcuacaucggcacccacggcugcgacaccaacgccgccugccgccccggcccccgcacccaguucaccugcgagugcuccaucggcuuccgcggcgacggccgcaccugcuacgacaucgacgagugcuccgagcagcccuccgucugcggcucccacaccaucugcaacaaccaccccggcaccuuccgcugcgagugcgucgagggcuaccaguucuccgacgagggcaccugcgucgccgucgucgaccagcgccccaucaacuacugcgagaccggccuccacaacugcgacaucccccagcgcgcccagugcaucuacaccggcggcuccuccuacaccugcuccugccuccccggcuucuccggcgacggccaggccugccaggacgucgacgagugccagcccucccgcugccaccccgacgccuucugcuacaacacccccggcuccuucaccugccagugcaagcccggcuaccagggcgacggcuuccgcugcguccccggcgaggucgagaagacccgcugccagcacgagcgcgagcacauccucggcgccgccggcgccaccgacccccagcgccccaucccccccggccucuucguccccgagugcgacgcccacggccacuacgcccccacccagugccacggcuccaccggcuacugcuggugcgucgaccgcgacggccgcgaggucgagggcacccgcacccgccccggcaugaccccccccugccucuccaccgucgccccccccauccaccagggccccgccguccccaccgccgucaucccccucccccccggcacccaccuccucuucgcccagaccggcaagaucgagcgccucccccucgagggcaacaccaugcgcaagaccgaggccaaggccuuccuccacguccccgccaaggucaucaucggccucgccuucgacugcgucgacaagauggucuacuggaccgacaucaccgagcccuccaucggccgcgccucccuccacggcggcgagcccaccaccaucauccgccaggaccucggcucccccgagggcaucgccgucgaccaccucggccgcaacaucuucuggaccgacuccaaccucgaccgcaucgaggucgccaagcucgacggcacccagcgccgcguccucuucgagaccgaccucgucaacccccgcggcaucgucaccgacuccguccgcggcaaccucuacuggaccgacuggaaccgcgacaaccccaagaucgagaccuccuacauggacggcaccaaccgccgcauccucguccaggacgaccucggccuccccaacggccucaccuucgacgccuucuccucccagcucugcugggucgacgccggcaccaaccgcgccgagugccucaaccccucccagcccucccgccgcaaggcccucgagggccuccaguaccccuucgccgucaccuccuacggcaagaaccucuacuucaccgacuggaagaugaacuccgucgucgcccucgaccucgccaucuccaaggagaccgacgccuuccagccccacaagcagacccgccucuacggcaucaccaccgcccucucccagugcccccagggccacaacuacugcuccgucaacaacggcggcugcacccaccucugccucgccacccccggcucccgcaccugccgcugccccgacaacacccucggcgucgacugcaucgagcagaaguga

SEQ ID NO: 46645 - RNA, 4128 nt, Artificial Sequence
  derived and/or modified sequence opt2 from NID2__Homo_sapiens__NP_031387
auggagggcgaccgcgucgccggccgccccguccucuccucccuccccguccuccuccuccucccccuccucaugcuccgcgccgccgcccuccaccccgacgagcucuucccccacggcgaguccuggggcgaccagcuccuccaggagggcgacgacgaguccuccgccgucgucaagcucgccaacccccuccacuucuacgaggcccgcuucuccaaccucuacgucggcaccaacggcaucaucuccacccaggacuucccccgcgagacccaguacgucgacuacgacuuccccaccgacuuccccgccaucgcccccuuccucgccgacaucgacaccucccacggccgcggccgcguccucuaccgcgaggacaccucccccgccguccucggccucgccgcccgcuacguccgcgccggcuucccccgcuccgcccgcuucacccccacccacgccuuccucgccaccugggagcaggucggcgccuacgaggaggucaagcgcggcgcccuccccuccggcgagcucaacaccuuccaggccguccucgccuccgacggcuccgacuccuacgcccucuuccucuaccccgccaacggccuccaguuccucggcacccgccccaaggaguccuacaacguccagcuccagcuccccgcccgcgucggcuucugccgcggcgaggccgacgaccucaaguccgagggccccuacuucucccucaccuccaccgagcaguccgucaagaaccucuaccagcucuccaaccucggcauccccggcgucugggccuuccacaucggcuccaccuccccccucgacaacguccgccccgccgccgucggcgaccucuccgccgcccacuccuccgucccccucggccgcuccuucucccacgccaccgcccucgaguccgacuacaacgaggacaaccucgacuacuacgacgucaacgaggaggaggccgaguaccuccccggcgagcccgaggaggcccucaacggccacuccuccaucgacgucuccuuccaguccaaggucgacaccaagccccucgaggaguccuccacccucgacccccacaccaaggagggcaccucccucggcgaggucggcggccccgaccucaagggccaggucgagcccugggacgagcgcgagacccgcucccccgccccccccgaggucgaccgcgacucccucgcccccuccugggagacccccccccccuaccccgagaacggcuccauccagcccuaccccgacggcggccccguccccuccgagauggacgucccccccgcccaccccgaggaggagaucguccuccgcuccuaccccgccuccggccacaccaccccccucucccgcggcaccuacgaggucggccucgaggacaacaucggcuccaacaccgaggucuucaccuacaacgccgccaacaaggagaccugcgagcacaaccaccgccagugcucccgccacgccuucugcaccgacuacgccaccggcuucugcugccacugccaguccaaguucuacggcaacggcaagcacugccuccccgagggcgccccccaccgcgucaacggcaaggucuccggccaccuccacgucggccacacccccguccacuucaccgacgucgaccuccacgccuacaucgucggcaacgacggccgcgccuacaccgccaucucccacaucccccagcccgccgcccaggcccuccucccccucacccccaucggcggccucuucggcuggcucuucgcccucgagaagcccggcuccgagaacggcuucucccucgccggcgccgccuucacccacgacauggaggucaccuucuaccccggcgaggagaccguccgcaucacccagaccgccgagggccucgaccccgagaacuaccucuccaucaagaccaacauccagggccagguccccuacgucuccgccaacuucaccgcccacaucucccccuacaaggagcucuaccacuacuccgacuccaccgucaccuccaccuccucccgcgacuacucccucaccuucggcgccaucaaccagaccugguccuaccgcauccaccagaacaucaccuaccaggucugccgccacgccccccgccaccccuccuuccccaccacccagcagcucaacgucgaccgcgucuucgcccucuacaacgacgaggagcgcguccuccgcuucgccgucaccaaccagaucggccccgucaaggaggacuccgaccccacccccggcaaccccugcuacgacggcucccacaugugcgacaccaccgcccgcugccaccccggcaccggcgucgacuacaccugcgagugcgccuccggcuaccagggcgacggccgcaacugcgucgacgagaacgagugcgccaccggcuuccaccgcugcggccccaacuccgucugcaucaaccuccccggcuccuaccgcugcgagugccgcuccggcuacgaguucgccgacgaccgccacaccugcauccucaucaccccccccgccaaccccugcgaggacggcucccacaccugcgcccccgccggccaggcccgcugcguccaccacggcggcuccaccuucuccugcgccugccuccccggcuacgccggcgacggccaccagugcaccgacgucgacgagugcuccgagaaccgcugccaccccgccgccaccugcuacaacacccccggcuccuucuccugccgcugccagcccggcuacuacggcgacggcuuccagugcauccccgacuccaccuccucccucacccccugcgagcagcagcagcgccacgcccaggcccaguacgccuaccccggcgcccgcuuccacaucccccagugcgacgagcagggcaacuuccucccccuccagugccacggcuccaccggcuucugcuggugcgucgaccccgacggccacgagguccccggcacccagaccccccccggcuccacccccccccacugcggccccucccccgagcccacccagcgcccccccaccaucugcgagcgcuggcgcgagaaccuccucgagcacuacggcggcaccccccgcgacgaccaguacgucccccagugcgacgaccucggccacuucaucccccuccagugccacggcaaguccgacuucugcuggugcgucgacaaggacggccgcgagguccagggcacccgcucccagcccggcaccacccccgccugcauccccaccgucgccccccccaugguccgccccaccccccgccccgacgucaccccccccuccgucggcaccuuccuccucuacacccagggccagcagaucggcuaccucccccucaacggcacccgccuccagaaggacgccgccaagacccuccucucccuccacggcuccaucaucgucggcaucgacuacgacugccgcgagcgcauggucuacuggaccgacgucgccggccgcaccaucucccgcgccggccucgagcucggcgccgagcccgagaccaucgucaacuccggccucaucucccccgagggccucgccaucgaccacauccgccgcaccauguacuggaccgacuccguccucgacaagaucgaguccgcccuccucgacggcuccgagcgcaagguccucuucuacaccgaccucgucaacccccgcgccaucgccgucgaccccauccgcggcaaccucuacuggaccgacuggaaccgcgaggcccccaagaucgagaccuccucccucgacggcgagaaccgccgcauccucaucaacaccgacaucggccuccccaacggccucaccuucgaccccuucuccaagcuccucugcugggccgacgccggcaccaagaagcucgagugcacccuccccgacggcaccggccgccgcgucauccagaacaaccucaaguaccccuucuccaucgucuccuacgccgaccacuucuaccacaccgacuggcgccgcgacggcgucgucuccgucaacaagcacuccggccaguucaccgacgaguaccuccccgagcagcgcucccaccucuacggcaucaccgccgucuaccccuacugccccaccggccgcaaguga

SEQ ID NO: 46646 - RNA, 1134 nt, Artificial Sequence
  derived and/or modified sequence opt2 from NIF3L1__Homo_sapiens__NP_001129511
augcucuccuccugcguccgccccguccccaccaccguccgcuucgucgacucccucaucugcaacuccucccgcuccuucauggaccucaaggcccuccucuccucccucaacgacuucgccucccucuccuucgccgaguccugggacaacgucggccuccucgucgagcccucccccccccacaccgucaacacccucuuccucaccaacgaccucaccgaggaggucauggaggagguccuccagaagaaggccgaccucauccucuccuaccacccccccaucuuccgccccaugaagcgcaucaccuggaacaccuggaaggagcgccucgucauccgcgcccucgagaaccgcgucggcaucuacuccccccacaccgccuacgacgccgccccccagggcgucaacaacuggcucgccaagggccucggcgccugcaccucccgccccauccaccccuccaaggcccccaacuaccccaccgagggcaaccaccgcgucgaguucaacgucaacuacacccaggaccucgacaaggucauguccgccgucaagggcaucgacggcgucuccgucaccuccuucuccgcccgcaccggcaacgaggagcagacccgcaucaaccucaacugcacccagaaggcccucaugcaggucgucgacuuccucucccgcaacaagcagcucuaccagaagaccgagauccucucccucgagaagccccuccuccuccacaccggcaugggccgccucugcacccucgacgaguccgucucccucgccaccaugaucgaccgcaucaagcgccaccucaagcucucccacauccgccucgcccucggcgucggccgcacccucgagucccaggucaaggucgucgcccucugcgccggcuccggcuccuccguccuccagggcgucgaggccgaccucuaccucaccggcgagaugucccaccacgacacccucgacgccgccucccagggcaucaacgucauccucugcgagcacuccaacaccgagcgcggcuuccucuccgaccuccgcgacaugcucgacucccaccucgagaacaagaucaacaucauccucuccgagaccgaccgcgacccccuccaggucgucuga

SEQ ID NO: 46647 - RNA, 1311 nt, Artificial Sequence
  derived and/or modified sequence opt2 from NIM1K__Homo_sapiens__XP_006714513
augaccgccgucuacaugaacggcggcggccucgucaacccccacuacgcccgcugggaccgccgcgacuccgucgaguccggcugccagaccgaguccuccaaggagggcgaggagggccagccccgccagcucacccccuucgagaagcucacccaggacaugucccaggacgagaaggucguccgcgagaucacccucggcaagcgcaucggcuucuaccgcauccgcggcgagaucggcuccggcaacuucucccaggucaagcucggcauccacucccucaccaaggagaaggucgccaucaagauccucgacaagaccaagcucgaccagaagacccagcgccuccucucccgcgagaucuccuccauggagaagcuccaccaccccaacaucauccgccucuacgaggucgucgagacccucuccaagcuccaccucgucauggaguacgccggcggcggcgagcucuucggcaagaucuccaccgagggcaagcucuccgagcccgaguccaagcucaucuucucccagaucgucuccgccgucaagcacaugcacgagaaccagaucauccaccgcgaccucaaggccgagaacgucuucuacaccuccaacaccugcgucaaggucggcgacuucggcuucuccaccgucuccaagaagggcgagaugcucaacaccuucugcggcuccccccccuacgccgcccccgagcucuuccgcgacgagcacuacaucggcaucuacgucgacaucugggcccucggcguccuccucuacuucauggucaccggcaccaugcccuuccgcgccgagaccgucgccaagcucaagaaguccauccucgagggcaccuacuccguccccccccacgucuccgagcccugccaccgccucauccgcggcguccuccagcagauccccaccgagcgcuacggcaucgacugcaucaugaacgacgaguggaugcagggcguccccuaccccaccccccucgagcccuuccagcucgaccccaagcaccucuccgagaccuccacccucaaggaggaggagaacgaggucaaguccacccucgagcaccucggcaucaccgaggagcacauccgcaacaaccagggccgcgacgcccgcuccuccaucaccggcgucuaccgcaucauccuccaccgcguccagcgcaagaaggcccucgaguccguccccgucaugaugcuccccgaccccaaggagcgcgaccucaagaagggcucccgcgucuaccgcggcauccgccacaccuccaaguucugcuccauccucuga

SEQ ID NO: 46648 - RNA, 4134 nt, Artificial Sequence
  derived and/or modified sequence opt2 from NIN__Homo_sapiens__NP_057434
auggacgaggucgagcaggaccagcacgaggcccgccucaaggagcucuucgacuccuucgacaccaccggcaccggcucccucggccaggaggagcucaccgaccucugccacaugcucucccucgaggaggucgcccccguccuccagcagacccuccuccaggacaaccuccucggccgcguccacuucgaccaguucaaggaggcccucauccucauccucucccgcacccucuccaacgaggagcacuuccaggagcccgacugcucccucgaggcccagcccaaguacguccgcggcggcaagcgcuacggccgccgcucccuccccgaguuccaggaguccgucgaggaguuccccgaggucaccgucaucgagccccucgacgaggaggcccgccccucccacauccccgccggcgacugcuccgagcacuggaagacccagcgcuccgaggaguacgaggccgagggccagcuccgcuucuggaaccccgacgaccucaacgccucccaguccggcuccucccccccccaggacuggaucgaggagaagcuccaggaggucugcgaggaccucggcaucacccgcgacggccaccucaaccgcaagaagcucgucuccaucugcgagcaguacggccuccagaacgucgacggcgagaugcucgaggaggucuuccacaaccucgaccccgacggcaccauguccgucgaggacuucuucuacggccucuucaagaacggcaagucccucacccccuccgccuccacccccuaccgccagcucaagcgccaccucuccaugcaguccuucgacgaguccggccgccgcaccaccaccuccuccgccaugaccuccaccaucggcuuccgcgucuucuccugccucgacgacggcaugggccacgccuccgucgagcgcauccucgacaccuggcaggaggagggcaucgagaacucccaggagauccucaaggcccucgacuucucccucgacggcaacaucaaccucaccgagcucacccucgcccucgagaacgagcuccucgucaccaagaacuccauccaccaggccgcccucgccuccuucaaggccgagauccgccaccuccucgagcgcgucgaccaggucguccgcgagaaggagaagcuccgcuccgaccucgacaaggccgagaagcucaagucccucauggccuccgaggucgacgaccaccacgccgccaucgagcgccgcaacgaguacaaccuccgcaagcucgacgaggaguacaaggagcgcaucgccgcccucaagaacgagcuccgcaaggagcgcgagcagauccuccagcaggccggcaagcagcgccucgagcucgagcaggagaucgagaaggccaagaccgaggagaacuacauccgcgaccgccucgcccucucccucaaggagaacucccgccucgagaacgagcuccucgagaacgccgagaagcucgccgaguacgagaaccucaccaacaagcuccagcgcaaccucgagaacguccucgccgagaaguucggcgaccucgaccccuccuccgccgaguucuuccuccaggaggagcgccucacccagaugcgcaacgaguacgagcgccagugccgcguccuccaggaccaggucgacgagcuccaguccgagcucgaggaguaccgcgcccagggccgcguccuccgccucccccucaagaacucccccuccgaggaggucgaggccaacuccggcggcaucgagcccgagcacggccucggcuccgaggagugcaacccccucaacauguccaucgaggccgagcucgucaucgagcagaugaaggagcagcaccaccgcgacaucugcugccuccgccucgagcucgaggacaagguccgccacuacgagaagcagcucgacgagaccgucgucuccugcaagaaggcccaggagaacaugaagcagcgccacgagaacgagacccacacccucgagaagcagaucuccgaccucaagaacgagaucgccgagcuccagggccaggccgccguccucaaggaggcccaccacgaggccaccugccgccacgaggaggagaagaagcagcuccaggucaagcucgaggaggagaagacccaccuccaggagaagcuccgccuccagcacgagauggagcucaaggcccgccucacccaggcccaggccuccuucgagcgcgagcgcgagggccuccaguccuccgccuggaccgaggagaagguccgcggccucacccaggagcucgagcaguuccaccaggagcagcucaccucccucgucgagaagcacacccucgagaaggaggagcuccgcaaggagcuccucgagaagcaccagcgcgagcuccaggagggccgcuacgaguccgagaagcuccagcaggagaacuccauccuccgcaacgagaucaccacccucaacgaggaggacuccaucuccaaccucaagcucggcacccucaacggcucccaggaggagauguggcagaagaccgagaccgucaagcaggagaacgccgccguccagaagauggucgagaaccucaagaagcagaucuccgagcucaagaucaagaaccagcagcucgaccucgagaacaccgagcucucccagaagaacucccagaaccaggagaagcuccaggagcucaaccagcgccucaccgagaugcucugccagaaggagaaggagcccggcaacuccgcccucgaggagcgcgagcaggagaaguucaaccucaaggaggagcucgagcgcugcaagguccaguccuccacccucgucuccucccucgaggccgagcucuccgaggucaagauccagacccacaucguccagcaggagaaccaccuccucaaggacgagcucgagaagaugaagcagcuccaccgcugccccgaccucuccgacuuccagcagaagaucuccuccguccucuccuacaacgagaagcuccucaaggagaaggaggcccucuccgaggagcucaacuccugcgucgacaagcucgccaaguccucccuccucgagcaccgcaucgccaccaugaagcaggagcagaaguccugggagcaccaguccgccucccucaagucccagcucgucgccucccaggagaagguccagaaccucgaggacaccguccagaacgucaaccuccagaugucccgcaugaaguccgaccuccgcgucacccagcaggagaaggaggcccucaagcaggaggucaugucccuccacaagcagcuccagaacgccggcggcaaguccugggcccccgagaucgccacccaccccuccggccuccacaaccagcagaagcgccucuccugggacaagcucgaccaccucaugaacgaggagcagcagcuccucuggcaggagaacgagcgccuccagaccaugguccagaacaccaaggccgagcucacccacucccgcgagaagguccgccagcucgaguccaaccuccuccccaagcaccagaagcaccucaaccccuccggcaccaugaaccccaccgagcaggagaagcucucccucaagcgcgagugcgaccaguuccagaaggagcagucccccgccaaccgcaaggucucccagaugaacucccucgagcaggagcucgagaccauccaccucgagaacgagggccucaagaagaagcaggucaagcucgacgagcagcucauggagaugcagcaccuccgcuccaccgccacccccucccccuccccccacgccugggaccuccagcuccuccagcagcaggccugccccauggucccccgcgagcaguuccuccagcuccagcgccagcuccuccaggccgagcgcaucaaccagcaccuccaggaggagcucgagaaccgcaccuccgagaccaacaccccccagggcaaccaggagcagcucgucaccgucauggaggagcgcaugaucgaggucgagcagaagcucaagcucgucaagcgccuccuccaggagaaggucaaccagcucaaggagcaggucucccuccccggccaccucugcucccccaccucccacuccuccuucaacuccuccuucaccucccucuacugccacuga

SEQ ID NO: 46649 - RNA, 459 nt, Artificial Sequence
  derived and/or modified sequence opt2 from NINJ1__Homo_sapiens__NP_004139
auggacuccggcaccgaggaguacgagcucaacggcggccucccccccggcacccccggcucccccgacgccucccccgcccgcuggggcuggcgccacggccccaucaacgucaaccacuacgccuccaagaaguccgccgccgaguccaugcucgacaucgcccuccucauggccaacgccucccagcucaaggccgucgucgagcagggccccuccuucgccuucuacgucccccucgucguccucaucuccaucucccucguccuccagaucggcgucggcguccuccucaucuuccucgucaaguacgaccucaacaaccccgccaagcacgccaagcucgacuuccucaacaaccucgccaccggccucgucuucaucaucgucgucgucaacaucuucaucaccgccuucggcguccagaagccccucauggacauggccccccagcaguga

SEQ ID NO: 46650 - RNA, 408 nt, Artificial Sequence
  derived and/or modified sequence opt2 from NINJ2__Homo_sapiens__NP_001281274
augauguacaugcccggcuccuccgacccccgcucccagcccaucaaccucaaccacuacgccaccaagaaguccgucgccgaguccaugcucgacgucgcccucuucauguccaacgccaugcgccucaaggccguccucgagcagggccccuccucccacuacuacaccacccucgucacccucaucucccucucccuccuccuccaggucgucaucggcguccuccucgucgucaucgcccgccucaaccucaacgaggucgagaagcaguggcgccucaaccagcucaacaacgccgccaccauccucgucuucuucaccgucgucaucaacgucuucaucaccgccuucggcgcccacaagaccggcuuccucgccgcccgcgccucccgcaacccccucuga

SEQ ID NO: 46651 - RNA, 4149 nt, Artificial Sequence
  derived and/or modified sequence opt2 from NINL__Homo_sapiens__NP_079452
auggacgaggaggagaaccacuacgucucccagcuccgcgaggucuacuccuccugcgacaccaccggcaccggcuuccucgaccgccaggagcucacccagcucugccucaagcuccaccucgagcagcagcuccccguccuccuccagacccuccucggcaacgaccacuucgcccgcgucaacuucgaggaguucaaggagggcuucgucgccguccucuccuccaacgccggcguccgccccuccgacgaggacuccuccucccucgaguccgccgccuccuccgccaucccccccaaguacgucaacggcuccaagugguacggccgccgcucccgccccgagcucugcgacgccgccaccgaggcccgccgcguccccgagcagcagacccaggccucccucaagucccaccucuggcgcuccgccucccucgaguccgucgagucccccaaguccgacgaggaggccgaguccaccaaggaggcccagaacgagcucuucgaggcccagggccagcuccagaccugggacuccgaggacuucggcuccccccagaaguccugcucccccuccuucgacacccccgagucccagauccgcggcgucugggaggagcucggcgucggcuccuccggccaccucuccgagcaggagcucgccgucgucugccaguccgucggccuccagggccucgagaaggaggagcucgaggaccucuucaacaagcucgaccaggacggcgacggcaaggucucccucgaggaguuccagcucggccucuucucccacgagcccgcccuccuccucgaguccuccacccgcgucaagcccuccaaggccuggucccacuaccagguccccgaggaguccggcugccacaccaccaccaccuccucccucgucucccucugcuccucccuccgccucuucuccuccaucgacgacggcuccggcuucgccuuccccgaccagguccucgccauguggacccaggagggcauccagaacggccgcgagauccuccagucccucgacuucuccgucgacgagaaggucaaccuccucgagcucaccugggcccucgacaacgagcucaugaccgucgacuccgccguccagcaggccgcccucgccugcuaccaccaggagcucuccuaccagcagggccaggucgagcagcucgcccgcgagcgcgacaaggcccgccaggaccucgagcgcgccgagaagcgcaaccucgaguucgucaaggagauggacgacugccacuccacccucgagcagcucaccgagaagaagaucaagcaccucgagcagggcuaccgcgagcgccucucccuccuccgcuccgaggucgaggccgagcgcgagcucuucugggagcaggcccaccgccagcgcgccgcccucgagugggacgucggccgccuccaggccgaggaggccggccuccgcgagaagcucacccucgcccucaaggagaacucccgccuccagaaggagaucgucgaggucgucgagaagcucuccgacuccgagcgccucgcccucaagcuccagaaggaccucgaguucguccucaaggacaagcucgagccccaguccgccgagcuccucgcccaggaggagcgcuucgccgccguccucaaggaguacgagcucaagugccgcgaccuccaggaccgcaacgacgagcuccaggccgagcucgagggccucugggcccgccuccccaagaaccgccacucccccuccuggucccccgacggccgccgccgccagcuccccggccucggccccgccggcaucuccuuccucggcaacuccgcccccgucuccaucgagaccgagcucaugauggagcaggucaaggagcacuaccaggaccuccgcacccagcucgagaccaaggucaacuacuacgagcgcgagaucgccgcccucaagcgcaacuucgagaaggagcgcaaggacauggagcaggcccgccgccgcgaggucuccguccucgagggccagaaggccgaccucgaggagcuccacgagaagucccaggaggucaucuggggccuccaggagcagcuccaggacaccgcccgcggccccgagcccgagcagaugggccucgcccccugcugcacccaggcccucugcggccucgcccuccgccaccacucccaccuccagcagauccgccgcgaggccgaggccgagcucuccggcgagcucuccggccucggcgcccuccccgcccgccgcgaccucacccucgagcucgaggagcccccccagggcccccucccccgcggcucccagcgcuccgagcagcucgagcucgagcgcgcccucaagcuccagcccugcgccuccgagaagcgcgcccagaugugcgucucccucgcccucgaggaggaggagcucgagcucgcccgcggcaagcgcgucgacggccccucccucgaggccgagaugcaggcccuccccaaggacggccucgucgccggcuccggccaggagggcacccgcggccuccucccccuccgccccggcugcggcgagcgcccccucgccuggcucgcccccggcgacggccgcgaguccgaggaggccgccggcgccggcccccgccgccgccaggcccaggacaccgaggccacccagucccccgcccccgcccccgcccccgccucccacggccccuccgagcgcuggucccgcaugcagcccugcggcgucgacggcgacaucguccccaaggagcccgagcccuucggcgccuccgccgccggccucgagcagcccggcgcccgcgagcucccccuccucggcaccgagcgcgacgccucccagacccagccccgcaugugggagcccccccuccgccccgccgccuccugccgcggccaggccgagcgccuccaggccauccaggaggagcgcgcccgcuccuggucccgcggcacccaggagcaggccuccgagcagcaggcccgcgccgagggcgcccucgagcccggcugccacaagcacuccgucgaggucgcccgccgcggcucccuccccucccaccuccagcucgccgacccccagggcuccuggcaggagcagcucgccgcccccgaggagggcgagaccaagaucgcccucgagcgcgagaaggacgacauggagaccaagcuccuccaccucgaggacgucguccgcgcccucgagaagcacgucgaccuccgcgagaacgaccgccucgaguuccaccgccucuccgaggagaacacccuccucaagaacgaccucggccgcguccgccaggagcucgaggccgccgaguccacccacgacgcccagcgcaaggagaucgagguccucaagaaggacaaggagaaggccugcuccgagauggagguccucaaccgccagaaccagaacuacaaggaccagcucucccagcucaacguccgcguccuccagcucggccaggaggccuccacccaccaggcccagaacgaggagcaccgcgucaccauccagaugcucacccagucccucgaggaggucguccgcuccggccagcagcaguccgaccagauccagaagcuccgcgucgagcucgagugccucaaccaggagcaccagucccuccagcuccccugguccgagcucacccagacccucgaggagucccaggaccagguccagggcgcccaccuccgccuccgccaggcccaggcccagcaccuccaggagguccgccucgucccccaggaccgcgucgccgagcuccaccgccuccucucccuccagggcgagcaggcccgccgccgccucgacgcccagcgcgaggagcacgagaagcagcucaaggccaccgaggagcgcgucgaggaggccgagaugauccucaagaacauggagaugcuccuccaggagaaggucgacaagcucaaggagcaguucgagaagaacaccaaguccgaccuccuccucaaggagcucuacgucgagaacgcccaccucguccgcgcccuccaggccaccgaggagaagcagcgcggcgccgagaagcagucccgccuccucgaggagaagguccgcgcccucaacaagcucgucucccgcaucgcccccgccgcccucuccgucuga

SEQ ID NO: 46652 - RNA, 765 nt, Artificial Sequence
  derived and/or modified sequence opt2 from NIPA1__Homo_sapiens__NP_001135747
auggccgucggccagaucggcaacuuccucgccuacaccgccguccccaccguccucgucaccccccucggcgcccucggcguccccuucggcuccauccucgccuccuaccuccucaaggagaagcucaacauccucggcaagcucggcugccuccucuccugcgccggcuccgucguccucaucauccacucccccaaguccgaguccgucaccacccaggccgagcucgaggagaagcucaccaaccccgucuucgucggcuaccucugcaucguccuccucaugcuccuccuccucaucuucuggaucgcccccgcccacggccccaccaacaucauggucuacaucuccaucugcucccuccucggcuccuucaccguccccuccaccaagggcaucggccucgccgcccaggacauccuccacaacaaccccuccucccagcgcgcccucugccucugccucguccuccucgccguccucggcugcuccaucaucguccaguuccgcuacaucaacaaggcccucgagugcuucgacuccuccgucuucggcgccaucuacuacgucgucuucaccacccucguccuccucgccuccgccauccucuuccgcgagugguccaacgucggccucgucgacuuccucggcauggccugcggcuucaccaccgucuccgucggcaucguccucauccaggucuucaaggaguucaacuucaaccucggcgagaugaacaaguccaacaugaagaccgacuga

SEQ ID NO: 46653 - RNA, 1083 nt, Artificial Sequence
  derived and/or modified sequence opt2 from NIPA2__Homo_sapiens__NP_001008892
augucccagggccgcggcaaguacgacuucuacaucggccucggccucgccauguccuccuccaucuucaucggcggcuccuucauccucaagaagaagggccuccuccgccucgcccgcaagggcuccaugcgcgccggccagggcggccacgccuaccucaaggaguggcucuggugggccggccuccucuccaugggcgccggcgaggucgccaacuucgccgccuacgccuucgcccccgccacccucgucaccccccucggcgcccucuccguccucgucuccgccauccucuccuccuacuuccucaacgagcgccucaaccuccacggcaagaucggcugccuccucuccauccucggcuccaccgucauggucauccacgcccccaaggaggaggagaucgagacccucaacgagaugucccacaagcucggcgaccccggcuucgucgucuucgccacccucgucgucaucgucgcccucauccucaucuucgucgucggcccccgccacggccagaccaacauccucgucuacaucaccaucugcuccgucaucggcgccuucuccgucuccugcgucaagggccucggcaucgccaucaaggagcucuucgccggcaagcccguccuccgccacccccucgccuggauccuccuccucucccucaucgucugcgucuccacccagaucaacuaccucaaccgcgcccucgacaucuucaacaccuccaucgucacccccaucuacuacgucuucuucaccaccuccguccucaccugcuccgccauccucuucaaggaguggcaggacaugcccgucgacgacgucaucggcacccucuccggcuucuucaccaucaucgucggcaucuuccuccuccacgccuucaaggacgucuccuucucccucgccucccuccccgucuccuuccgcaaggacgagaaggccaugaacggcaaccucuccaacauguacgagguccucaacaacaacgaggagucccucaccugcggcaucgagcagcacaccggcgagaacgucucccgccgcaacggcaaccucaccgccuucuga

SEQ ID NO: 46654 - RNA, 1179 nt, Artificial Sequence
  derived and/or modified sequence opt2 from NIPAL3__Homo_sapiens__XP_011540110
auggcccccaccggccucaccuucgccuccccccccuccgccguccgcgaggagaaccucaucggcgcccuccucgccaucuucggccaccucgucgucuccaucgcccucaaccuccagaaguacugccacauccgccucgccggcuccaaggacccccgcgccuacuucaagaccaagaccugguggcucggccucuuccucaugcuccucggcgagcucggcgucuucgccuccuacgccuucgccccccucucccucaucgucccccucuccgccgucuccgucaucgccuccgccaucaucggcaucaucuucaucaaggagaaguggaagcccaaggacuuccuccgccgcuacguccucuccuucgucggcugcggccucgccgucgucggcaccuaccuccucgucaccuucgcccccaacucccacgagaagaugaccggcgagaacgucacccgccaccucgucuccuggcccuuccuccucuacaugcucgucgagaucauccucuucugccuccuccucuacuucuacaaggagaagaacgccaacaacaucgucgucauccuccuccucgucgcccuccucggcuccaugaccgucgucaccgucaaggccgucgccggcaugcucguccucuccauccagggcaaccuccagcucgacuaccccaucuucuacgucauguucgucugcauggucgccaccgccgucuaccaggccgccuuccucucccaggccucccagauguacgacuccucccucaucgccuccgucggcuacauccucuccaccaccaucgccaucaccgccggcgccaucuucuaccucgacuucaucggcgaggacguccuccacaucugcauguucgcccucggcugccucaucgccuuccucggcgucuuccucaucacccgcaaccgcaagaagcccauccccuucgagcccuacaucuccauggacgccaugcccggcaugcagaacaugcacgacaagggcaugaccguccagcccgagcucaaggccuccuucuccuacggcgcccucgagaacaacgacaacaucuccgagaucuacgcccccgccacccuccccgucaugcaggaggagcacggcucccgcuccgccuccggcguccccuaccgcguccucgagcacaccaagaaggaguga

SEQ ID NO: 46655 - RNA, 1401 nt, Artificial Sequence
  derived and/or modified sequence opt2 from NIPAL4__Homo_sapiens__NP_001092757
augcccggcgacuccucccccggcacccucccccucugggacgccucccucucccccccccucggccccgaccccggcggcuucucccgcgccucccacgccggcgacaagucccgcccccccgcccccgagcucggcucccccggcgccguccgcccccgcgucggcuccugcgcccccggccccauggagcuccgcgucuccaacaccuccugcgagaacggcucccuccuccaccucuacugcuccucccaggagguccucugccagaucgucaacgaccucucccccgagguccccuccaacgccaccuuccacuccuggcaggagcgcauccgccagaacuacggcuucuacaucggccucggccucgccuuccucuccuccuuccucaucggcuccuccgucauccucaagaagaagggccuccuccgccucgucgccaccggcgccacccgcgccgucgacggcggcuucggcuaccucaaggacgccauguggugggccggcuuccucaccauggccgccggcgaggucgccaacuucggcgccuacgccuucgcccccgccaccgucgucaccccccucggcgcccucuccguccucaucuccgccauccucuccuccuacuuccuccgcgagucccucaaccuccucggcaagcucggcugcgucaucugcgucgccggcuccaccgucauggucauccacgcccccgaggaggagaaggucaccaccaucauggagauggccuccaagaugaaggacaccggcuucaucgucuucgccguccuccuccucgucuccugccucauccucaucuucgucaucgccccccgcuacggccagcgcaacauccucaucuacaucaucaucugcuccgucaucggcgccuucuccgucgccgccgucaagggccucggcaucaccaucaagaacuucuuccagggccuccccgucguccgccacccccuccccuacauccucucccucauccucgcccucucccucuccacccaggucaacuuccucaaccgcgcccucgacaucuucaacaccucccucgucuuccccaucuacuacgucuucuucaccaccgucgucgucaccuccuccaucauccucuucaaggagugguacuccauguccgccgucgacaucgccggcacccucuccggcuucgucaccaucauccucggcgucuucaugcuccacgccuucaaggaccucgacaucuccugcgccucccucccccacaugcacaagaaccccccccccucccccgcccccgagcccaccgucauccgccucgaggacaagaacguccucgucgacaacaucgagcucgccuccaccuccucccccgaggagaagcccaaggucuucaucauccacuccuga

SEQ ID NO: 46656 - RNA, 8094 nt, Artificial Sequence
  derived and/or modified sequence opt2 from NIPBL__Homo_sapiens__NP_056199
augaacggcgacaugccccacguccccaucaccacccucgccggcaucgccucccucaccgaccuccucaaccagcucccccuccccuccccccuccccgccaccaccaccaagucccuccucuucaacgcccgcaucgccgaggaggucaacugccuccucgccugccgcgacgacaaccucgucucccagcucguccacucccucaaccaggucuccaccgaccacaucgagcucaaggacaaccucggcuccgacgaccccgagggcgacauccccguccuccuccaggccguccucgcccgcucccccaacgucuuccgcgagaaguccaugcagaaccgcuacguccaguccggcaugaugaugucccaguacaagcucucccagaacuccaugcacuccucccccgccuccuccaacuaccagcagaccaccaucucccacucccccuccucccgcuucguccccccccagaccuccuccggcaaccgcuucaugccccagcagaacucccccguccccucccccuacgccccccagucccccgccggcuacaugcccuacucccaccccuccuccuacaccacccacccccagaugcagcaggccuccgucuccucccccaucgucgccggcggccuccgcaacauccacgacaacaaggucuccggcccccucuccggcaacuccgccaaccaccacgccgacaacccccgccacggcuccuccgaggacuaccuccacaugguccaccgccucuccuccgacgacggcgacuccuccaccaugcgcaacgccgccuccuucccccuccgcuccccccagcccgucugcucccccgccggcuccgagggcacccccaagggcucccgccccccccucauccuccagucccagucccuccccugcuccuccccccgcgacgucccccccgacauccuccucgacucccccgagcgcaagcagaagaagcagaagaagaugaagcucggcaaggacgagaaggagcaguccgagaaggccgccauguacgacaucaucuccucccccuccaaggacuccaccaagcucacccuccgccucucccgcguccgcuccuccgacauggaccagcaggaggacaugaucuccggcgucgagaacuccaacgucuccgagaacgacauccccuucaacguccaguaccccggccagaccuccaagacccccaucaccccccaggacaucaaccgcccccucaacgccgcccagugccucucccagcaggagcagaccgccuuccuccccgccaaccagguccccguccuccagcagaacaccuccgucgccgccaagcagccccagaccuccgucguccagaaccagcagcagaucucccagcagggccccaucuacgacgaggucgagcucgacgcccucgccgagaucgagcgcaucgagcgcgaguccgccaucgagcgcgagcgcuucuccaaggagguccaggacaaggacaagccccucaagaagcgcaagcaggacuccuacccccaggaggccggcggcgccaccggcggcaaccgccccgccucccaggagaccggcuccaccggcaacggcucccgccccgcccucauggucuccaucgaccuccaccaggccggccgcgucgacucccaggccuccaucacccaggacuccgacuccaucaagaagcccgaggagaucaagcagugcaacgacgcccccgucuccguccuccaggaggacaucgucggcucccucaaguccacccccgagaaccaccccgagacccccaagaagaaguccgaccccgagcucuccaaguccgagaugaagcaguccgagucccgccucgccgaguccaagcccaacgagaaccgccucgucgagaccaaguccuccgagaacaagcucgagaccaaggucgagacccagaccgaggagcucaagcagaacgagucccgcaccaccgagugcaagcagaacgaguccaccaucgucgagcccaagcagaacgagaaccgccucuccgacaccaagcccaacgacaacaagcagaacaacggccgcuccgagaccaccaagucccgccccgagacccccaagcagaagggcgagucccgccccgagacccccaagcagaaguccgacggccaccccgagacccccaagcagaagggcgacggccgccccgagacccccaagcagaagggcgagucccgccccgagacccccaagcagaagaacgagggccgccccgagacccccaagcaccgccacgacaaccgccgcgacuccggcaagcccuccaccgagaagaagcccgaggucuccaagcacaagcaggacaccaaguccgacuccccccgccucaaguccgagcgcgccgaggcccucaagcagcgccccgacggccgcuccgucuccgagucccuccgccgcgaccacgacaacaagcagaaguccgacgaccgcggcgaguccgagcgccaccgcggcgaccagucccgcguccgccgccccgagacccuccgcuccuccucccgcaacgagcacggcaucaaguccgacuccuccaagaccgacaagcucgagcgcaagcaccgccacgaguccggcgacucccgcgagcgccccuccuccggcgagcagaagucccgccccgacuccccccgcgucaagcagggcgacuccaacaagucccgcuccgacaagcucggcuucaagucccccaccuccaaggacgacaagcgcaccgagggcaacaaguccaaggucgacaccaacaaggcccaccccgacaacaaggccgaguuccccuccuaccuccucggcggccgcuccggcgcccucaagaacuucgucauccccaagaucaagcgcgacaaggacggcaacgucacccaggagaccaagaagauggagaugaagggcgagcccaaggacaaggucgagaagaucggccucgucgaggaccucaacaagggcgccaagcccgucgucguccuccagaagcucucccucgacgacguccagaagcucaucaaggaccgcgaggacaagucccgcuccucccucaagcccaucaagaacaagcccuccaaguccaacaagggcuccaucgaccaguccguccucaaggagcucccccccgagcuccucgccgagaucgaguccaccaugccccucugcgagcgcgucaagaugaacaagcgcaagcgcuccaccgucaacgagaagcccaaguacgccgagaucuccuccgacgaggacaacgacuccgacgaggccuucgaguccucccgcaagcgccacaagaaggacgacgacaaggccugggaguacgaggagcgcgaccgccgcuccuccggcgaccaccgccgcuccggccacucccacgagggccgccgcuccuccggcggcggccgcuaccgcaaccgcucccccuccgacuccgacauggaggacuacucccccccccccucccucuccgaggucgcccgcaagaugaagaagaaggagaagcagaagaagcgcaaggccuacgagcccaagcucacccccgaggagaugauggacuccuccaccuucaagcgcuucaccgccuccaucgagaacauccucgacaaccucgaggacauggacuucaccgccuucggcgacgacgacgagaucccccaggagcuccuccucggcaagcaccagcucaacgagcucggcuccgaguccgccaagaucaaggccaugggcaucauggacaagcucuccaccgacaagaccgucaagguccucaacauccucgagaagaacauccaggacggcuccaagcucuccacccuccucaaccacaacaacgacaccgaggaggaggagcgccucuggcgcgaccucaucauggagcgcgucaccaaguccgccgacgccugccucaccaccaucaacaucaugaccucccccaacaugcccaaggccgucuacaucgaggacgucaucgagcgcgucauccaguacaccaaguuccaccuccagaacacccucuacccccaguacgaccccgucuaccgccucgacccccacggcggcggccuccucuccuccaaggccaagcgcgccaagugcuccacccacaagcagcgcgucaucgucaugcucuacaacaaggucugcgacaucgucuccucccucuccgagcuccucgagauccagcuccucaccgacaccaccauccuccaggucuccuccaugggcaucacccccuucuucgucgagaacgucuccgagcuccagcucugcgccaucaagcucgucaccgccgucuucucccgcuacgagaagcaccgccagcucauccucgaggagaucuucaccucccucgcccgccuccccaccuccaagcgcucccuccgcaacuuccgccucaacuccuccgacauggacggcgagcccauguacauccagauggucaccgcccucguccuccagcucauccagugcgucguccaccuccccuccuccgagaaggacuccaacgccgaggaggacuccaacaagaagaucgaccaggacgucgucaucaccaacuccuacgagaccgccaugcgcaccgcccagaacuuccucuccaucuuccucaagaagugcggcuccaagcagggcgaggaggacuaccgcccccucuucgagaacuucguccaggaccuccucuccaccgucaacaagcccgaguggcccgccgccgagcuccuccucucccuccucggccgccuccucguccaccaguucuccaacaaguccaccgagauggcccuccgcgucgccucccucgacuaccucggcaccgucgccgcccgccuccgcaaggacgccgucaccuccaagauggaccagggcuccaucgagcgcauccucaagcaggucuccggcggcgaggacgagauccagcagcuccagaaggcccuccucgacuaccucgacgagaacaccgagaccgaccccucccucgucuucucccgcaaguucuacaucgcccagugguuccgcgacaccacccucgagaccgagaaggccaugaagucccagaaggacgaggaguccuccgagggcacccaccacgccaaggagaucgagaccaccggccagaucaugcaccgcgccgagaaccgcaagaaguuccuccgcuccaucaucaagaccacccccucccaguucuccacccucaagaugaacuccgacaccgucgacuacgacgacgccugccucaucguccgcuaccucgccuccaugcgccccuucgcccaguccuucgacaucuaccucacccagauccuccgcguccucggcgagaacgccaucgccguccgcaccaaggccaugaagugccucuccgaggucgucgccgucgaccccuccauccucgcccgccucgacaugcagcgcggcguccacggccgccucauggacaacuccaccuccguccgcgaggccgccgucgagcuccucggccgcuucguccucugccgcccccagcucgccgagcaguacuacgacaugcucaucgagcgcauccucgacaccggcaucuccguccgcaagcgcgucaucaagauccuccgcgacaucugcaucgagcagcccaccuuccccaagaucaccgagaugugcgucaagaugauccgccgcgucaacgacgaggagggcaucaagaagcucgucaacgagaccuuccagaagcucugguucacccccaccccccacaacgacaaggaggccaugacccgcaagauccucaacaucaccgacgucgucgccgccugccgcgacaccggcuacgacugguucgagcagcuccuccagaaccuccucaaguccgaggaggacuccuccuacaagcccgucaagaaggccugcacccagcucgucgacaaccucgucgagcacauccucaaguacgaggagucccucgccgacuccgacaacaagggcgucaacuccggccgccucgucgccugcaucaccacccucuuccucuucuccaagauccgcccccagcucauggucaagcacgccaugaccaugcagcccuaccucaccaccaagugcuccacccagaacgacuucauggucaucugcaacgucgccaagauccucgagcucgucgucccccucauggagcaccccuccgagaccuuccucgccaccaucgaggaggaccucaugaagcucaucaucaaguacggcaugaccgucguccagcacugcgucuccugccucggcgccgucgucaacaaggucacccagaacuucaaguucgucugggccugcuucaaccgcuacuacggcgccaucuccaagcucaagucccagcaccaggaggaccccaacaacaccucccuccucaccaacaagcccgcccuccuccgcucccucuucaccgucggcgcccucugccgccacuucgacuucgaccucgaggacuucaagggcaacuccaaggucaacaucaaggacaagguccucgagcuccucauguacuucaccaagcacuccgacgaggagguccagaccaaggccaucaucggccucggcuucgccuucauccagcaccccucccucauguucgagcaggaggucaagaaccucuacaacaacauccucuccgacaagaacuccuccgucaaccucaagauccagguccucaagaaccuccagaccuaccuccaggaggaggacacccgcaugcagcaggccgaccgcgacuggaagaaggucgccaagcaggaggaccucaaggagaugggcgacgucuccuccggcauguccuccuccaucaugcagcucuaccucaagcagguccucgaggccuucuuccacacccaguccuccguccgccacuucgcccucaacgucaucgcccucacccucaaccagggccucauccaccccguccagugcguccccuaccucaucgccaugggcaccgaccccgagcccgccaugcgcaacaaggccgaccagcagcucgucgagaucgacaagaaguacgccggcuucauccacaugaaggccgucgccggcaugaagauguccuaccagguccagcaggccaucaacaccugccucaaggaccccguccgcggcuuccgccaggacgaguccuccuccgcccucugcucccaccucuacuccaugauccgcggcaaccgccagcaccgccgcgccuuccucaucucccuccucaaccucuucgacgacaccgccaagaccgacgucaccaugcuccucuacaucgccgacaaccucgccugcuuccccuaccagacccaggaggagccccucuucaucaugcaccacaucgacaucacccucuccgucuccggcuccaaccuccuccaguccuucaaggaguccauggucaaggacaagcgcaaggagcgcaaguccucccccuccaaggagaacgaguccuccgacuccgaggaggaggucucccgcccccgcaagucccgcaagcgcgucgacuccgacuccgacuccgacuccgaggacgacaucaacuccgucaugaagugccuccccgagaacuccgccccccucaucgaguucgccaacgucucccagggcauccuccuccuccucaugcucaagcagcaccucaagaaccucugcggcuucuccgacuccaagauccagaaguacucccccuccgaguccgccaaggucuacgacaaggccaucaaccgcaagaccggcguccacuuccaccccaagcagacccucgacuuccuccgcuccgacauggccaacuccaagaucaccgaggaggucaagcgcuccaucgucaagcaguaccucgacuucaagcuccucauggagcaccucgaccccgacgaggaggaggaggagggcgaggucuccgccuccaccaacgcccgcaacaaggccaucaccucccuccucggcggcggcucccccaagaacaacaccgccgccgagaccgaggacgacgaguccgacggcgaggaccgcggcggcggcaccuccggcguccgccgccgccgcucccagcgcaucucccagcgcaucaccuga

SEQ ID NO: 46657 - RNA, 855 nt, Artificial Sequence
  derived and/or modified sequence opt2 from NIPSNAP1__Homo_sapiens__NP_003625
auggccccccgccucugcuccaucuccgucaccgcccgccgccuccucggcggccccggcccccgcgccggcgacgucgccuccgccgccgccgcccgcuucuacuccaaggacaacgagggcuccugguuccgcucccucuucguccacaaggucgacccccgcaaggacgcccacuccacccuccucuccaagaaggagaccuccaaccucuacaagauccaguuccacaacgucaagcccgaguaccucgacgccuacaacucccucaccgaggccguccuccccaagcuccaccucgacgaggacuaccccugcucccucgucggcaacuggaacaccugguacggcgagcaggaccaggccguccaccucuggcgcuucuccggcggcuaccccgcccucauggacugcaugaacaagcucaagaacaacaaggaguaccucgaguuccgccgcgagcgcucccagaugcuccucucccgccgcaaccagcuccuccucgaguucuccuucuggaacgagccccagccccgcaugggccccaacaucuacgagcuccgcaccuacaagcucaagcccggcaccaugaucgaguggggcaacaacugggcccgcgccaucaaguaccgccaggagaaccaggaggccgucggcggcuucuucucccagaucggcgagcucuacgucguccaccaccucugggccuacaaggaccuccagucccgcgaggagacccgcaacgccgccuggcgcaagcgcggcugggacgagaacgucuacuacaccgucccccucguccgccacauggagucccgcaucaugaucccccucaagaucuccccccuccaguga

SEQ ID NO: 46658 - RNA, 744 nt, Artificial Sequence
  derived and/or modified sequence opt2 from NIPSNAP3B__Homo_sapiens__NP_060846
augcucguccuccgcuccggccucaccaaggcccucgccucccgcacccucgccccccaggucugcuccuccuucgccaccggcccccgccaguacgacggcaccuucuacgaguuccgcaccuacuaccucaagcccuccaacaugaacgccuucauggagaaccucaagaagaacauccaccuccgcaccuccuacuccgagcucgucggcuucugguccgucgaguucggcggccgcaccaacaaggucuuccacaucuggaaguacgacaacuucgcccaccgcgccgagguccgcaaggcccucgccaacugcaaggaguggcaggagcaguccaucauccccaaccucgcccgcaucgacaagcaggagaccgagaucaccuaccucauccccugguccaagcucgagaagccccccaaggagggcgucuacgagcucgccgucuuccagaugaagcccggcggccccgcccucuggggcgacgccuucgagcgcgccaucaacgcccacgucaaccucggcuacaccaaggucgucggcgucuuccacaccgaguacggcgagcucaaccgcguccacguccucugguggaacgaguccgccgacucccgcgccgccggccgccacaagucccacgaggacccccgcgucgucgccgccguccgcgaguccgucaacuaccucgucucccagcagaacaugcuccucauccccgccuccuucuccccccucaaguga

SEQ ID NO: 46659 - RNA, 1752 nt, Artificial Sequence
  derived and/or modified sequence opt2 from NISCH__Homo_sapiens__NP_001263222
auggccaccgcccgcaccuucggccccgagcgcgaggccgagcccgccaaggaggcccgcgucgucggcuccgagcucgucgacaccuacaccgucuacaucauccaggucaccgacggcucccacgaguggaccgucaagcaccgcuacuccgacuuccacgaccuccacgagaagcucgucgccgagcgcaagaucgacaagaaccuccucccccccaagaagaucaucggcaagaacucccgcucccucgucgagaagcgcgagaaggaccucgaggucuaccuccagaagcuccucgccgccuuccccggcgucaccccccgcguccucgcccacuuccuccacuuccacuucuacgagaucaacggcaucaccgccgcccucgccgaggagcucuucgagaagggcgagcagcuccucggcgccggcgaggucuucgccaucggcccccuccagcucuacgccgucaccgagcagcuccagcagggcaagcccaccugcgccuccggcgacgccaagaccgaccucggccacauccucgacuucaccugccgccucaaguaccucaaggucuccggcaccgagggccccuucggcaccuccaacauccaggagcagcuccuccccuucgaccucuccaucuucaagucccuccaccaggucgagaucucccacugcgacgccaagcacauccgcggccucgucgccuccaagcccacccucgccacccucuccguccgcuucuccgccaccuccaugaaggagguccucguccccgaggccuccgaguucgacgagugggagcccgagggcaccacccucgagggccccgucaccgccgucauccccaccuggcaggcccucaccacccucgaccucucccacaacuccaucuccgagaucgacgaguccgucaagcucauccccaagaucgaguuccucgaccucucccacaacggccuccucgucgucgacaaccuccagcaccucuacaaccucguccaccucgaccucuccuacaacaagcucuccucccucgagggccuccacaccaagcucggcaacaucaagacccucaaccucgccggcaaccuccucgagucccucuccggccuccacaagcucuacucccucgucaaccucgaccuccgcgacaaccgcaucgagcagauggaggagguccgcuccaucggcucccuccccugccucgagcacgucucccuccucaacaacccccucuccaucauccccgacuaccgcaccaagguccucgcccaguucggcgagcgcgccuccgaggucugccucgacgacaccgucaccaccgagaaggagcucgacaccgucgagguccucaaggccauccagaaggccaaggaggucaaguccaagcucuccaaccccgagaagaagggcggcgaggacucccgccucuccgccgcccccugcauccgccccuccuccuccccccccaccgucgcccccgccuccgccucccucccccagcccauccucuccaaccagggcaaccgcgucugcauccuccuccucgucgagccccacucccccgccugggcccccuggcucggcuggggcuggggccgcggcgccuccaccugcuuccagcagggccagacccagggcggccagugccuccuccaggccggcccccgcggcggcacccacggccgcggcgccuggcccgacgccuccugcugccuccucggcgaggacucccagcuccucuga

SEQ ID NO: 46660 - RNA, 732 nt, Artificial Sequence
  derived and/or modified sequence opt2 from NIT1__Homo_sapiens__NP_001172021
augcucggcuucaucacccgccccccccaccgcuuccucucccuccucugccccggccuccgcaucccccagcucuccguccucugcgcccagccccgcccccgcgccauggccaucuccuccuccuccugcgagcucccccucgucgccgucugccaggucaccuccacccccgacaagcagcagaacuucaagaccugcgccgagcucguccgcgaggccgcccgccucggcgccugccucgccuuccuccccgaggccuucgacuucaucgcccgcgaccccgccgagacccuccaccucuccgagccccucggcggcaagcuccucgaggaguacacccagcucgcccgcgagugcggccucuggcucucccucggcggcuuccacgagcgcggccaggacugggagcagacccagaagaucuacaacugccacguccuccucaacuccaagggcgccgucgucgccaccuaccgcaagacccaccucugcgacgucgagauccccggccagggccccaugugcgaguccaacuccaccaugcccggccccucccucgagucccccgucuccacccccgccggcaagaucggccucgccgucugcuacgacaugcgcuuccccgagcucucccucgcccucgcccaggccggcgccgagauccucaccuaccccuccgccuucggcuccaucaccggccccgcccacugggagcccgucuccuccuga

SEQ ID NO: 46661 - RNA, 831 nt, Artificial Sequence
  derived and/or modified sequence opt2 from NIT2__Homo_sapiens__NP_064587
augaccuccuuccgccucgcccucauccagcuccagaucuccuccaucaaguccgacaacgucacccgcgccugcuccuucauccgcgaggccgccacccagggcgccaagaucgucucccuccccgagugcuucaacucccccuacggcgccaaguacuuccccgaguacgccgagaagauccccggcgaguccacccagaagcucuccgaggucgccaaggagugcuccaucuaccucaucggcggcuccauccccgaggaggacgccggcaagcucuacaacaccugcgccgucuucggccccgacggcacccuccucgccaaguaccgcaagauccaccucuucgacaucgacguccccggcaagaucaccuuccaggaguccaagacccucucccccggcgacuccuucuccaccuucgacacccccuacugccgcgucggccucggcaucugcuacgacaugcgcuucgccgagcucgcccagaucuacgcccagcgcggcugccagcuccucgucuaccccggcgccuucaaccucaccaccggccccgcccacugggagcuccuccagcgcucccgcgccgucgacaaccaggucuacgucgccaccgccucccccgcccgcgacgacaaggccuccuacgucgccuggggccacuccaccgucgucaaccccuggggcgagguccucgccaaggccggcaccgaggaggccaucgucuacuccgacaucgaccucaagaagcucgccgagauccgccagcagauccccgucuuccgccagaagcgcuccgaccucuacgccgucgagaugaagaagcccuga

SEQ ID NO: 46662 - RNA, 627 nt, Artificial Sequence
  derived and/or modified sequence opt2 from NKAIN2__Homo_sapiens__NP_001035304
augggcuacugcuccggccgcugcacccucaucuucaucugcggcaugcagcucgucugcguccucgagcgccagaucuucgacuuccucggcuaccagugggcccccauccucgccaacuucguccacaucaucaucgucauccucggccucuucggcaccauccaguaccgcccccgcuacaucaccggcuacgccgucuggcucguccucugggucaccuggaacgucuucgucaucugcuucuaccucgaggccggcgaccucuccaaggagaccgaccucauccucaccuucaacaucuccaugcaccgcuccugguggauggagaacggccccggcugcaccgucaccuccgucacccccgcccccgacugggcccccgaggaccaccgcuacaucaccgucuccggcugccuccucgaguaccaguacaucgaggucgcccacuccucccuccagaucguccucgcccucgccggcuucaucuacgccugcuacgucgucaagugcaucaccgaggaggaggacuccuucgacuucaucggcggcuucgacuccuacggcuaccagggcccccagaagaccucccaccuccagcuccagcccauguacauguccaaguga

SEQ ID NO: 46663 - RNA, 657 nt, Artificial Sequence
  derived and/or modified sequence opt2 from NKAIN3__Homo_sapiens__NP_001291462
augggcugcugcaccggccgcugcucccucaucugccucugcgcccuccagcucgucuccgcccucgagcgccagaucuucgacuuccucggcuuccagugggcccccauccucggcaacuuccuccacaucaucgucgucauccucggccucuucggcaccauccaguaccgcccccgcuacaucauggucuacaccgucuggaccgcccucugggucaccuggaacgucuucaucaucugcuucuaccucgaggucggcggccucuccaaggacaccgaccucaugaccuucaacaucuccguccaccgcuccugguggcgcgagcacggccccggcugcguccgccgcguccucccccccuccgcccacggcaugauggacgacuacaccuacgucuccgucaccggcugcaucgucgacuuccaguaccucgaggucauccacuccgccguccagauccuccucucccucgucggcuucgucuacgccugcuacgucaucuccaucuccauggaggaggaggacaccuucgacuucaucggcggccucgacacccacuccuacuaccaggaccacgucgagcucaagcccgucaagcccgucgagaucuccaacgacaucgagcccgagaugcgccuccucaaccucaccuga

SEQ ID NO: 46664 - RNA, 1248 nt, Artificial Sequence
  derived and/or modified sequence opt2 from NKAP__Homo_sapiens__NP_078804
auggcccccgucuccggcucccgcucccccgaccgcgaggccuccggcuccggcggccgccgccgcuccuccuccaagucccccaagcccuccaaguccgcccgcuccccccgcggccgccgcucccgcucccacuccugcucccgcuccggcgaccgcaacggccucacccaccagcucggcggccucucccagggcucccgcaaccaguccuaccgcucccgcucccgcucccgcucccgcgagcgccccuccgccccccgcggcauccccuucgccuccgccuccuccuccgucuacuacggcuccuacucccgccccuacggcuccgacaagcccuggcccucccuccucgacaaggagcgcgaggagucccuccgccagaagcgccucuccgagcgcgagcgcaucggcgagcucggcgcccccgaggucuggggccucucccccaagaaccccgagcccgacuccgacgagcacacccccgucgaggacgaggagcccaagaaguccaccaccuccgccuccaccuccgaggaggagaagaagaagaaguccucccgcuccaaggagcgcuccaagaagcgccgcaagaagaaguccuccaagcgcaagcacaagaaguacuccgaggacuccgacuccgacuccgacuccgagaccgacuccuccgacgaggacaacaagcgccgcgccaagaaggccaagaagaaggagaagaagaagaagcaccgcuccaagaaguacaagaagaagcgcuccaagaagucccgcaaggaguccuccgacuccuccuccaaggagucccaggaggaguuccucgagaaccccuggaaggaccgcaccaaggccgaggagcccuccgaccucaucggccccgaggcccccaagacccucaccucccaggacgacaagccccucaacuacggccacgcccuccuccccggcgagggcgccgccauggccgaguacgucaaggccggcaagcgcaucccccgccgcggcgagaucggccucaccuccgaggagaucgccuccuucgagugcuccggcuacgucauguccggcucccgccaccgccgcauggaggccguccgccuccgcaaggagaaccagaucuacuccgccgacgagaagcgcgcccucgccuccuucaaccaggaggagcgccgcaagcgcgagaacaagauccucgccuccuuccgcgagauggucuaccgcaagaccaagggcaaggacgacaaguga

SEQ ID NO: 46665 - RNA, 1413 nt, Artificial Sequence
  derived and/or modified sequence opt2 from NKD1__Homo_sapiens__NP_149110
augggcaagcuccacuccaagcccgccgccgucugcaagcgccgcgagucccccgagggcgacuccuucgccgucuccgccgccugggcccgcaagggcaucgaggaguggaucggccgccagcgcugccccggcggcgucuccggcccccgccagcuccgccucgccggcaccaucggccgcuccacccgcgagcucgucggcgacguccuccgcgacacccucuccgaggaggaggaggacgacuuccgccucgaggucgcccucccccccgagaagaccgacggccucggcuccggcgacgagaagaagauggagcgcgucuccgagcccugccccggcuccaagaagcagcucaaguucgaggagcuccagugcgacgucuccauggaggaggacucccgccaggaguggaccuucacccucuacgacuucgacaacaacggcaaggucacccgcgaggacaucaccucccuccuccacaccaucuacgaggucgucgacuccuccgucaaccacucccccaccuccuccaagaugcuccgcgucaagcucaccgucgcccccgacggcucccaguccaagcgcuccguccucgucaaccaggccgaccuccaguccgcccgcccccgcgccgagaccaagcccaccgaggaccuccgcuccugggagaagaagcagcgcgccccccuccgcuuccagggcgacucccgccucgagcaguccggcugcuaccaccacugcgucgacgagaacaucgagcgccgcaaccacuaccucgaccucgccggcaucgagaacuacaccucccaguucggccccggcucccccuccgucgcccagaaguccgagcuccccccccgcaccuccaaccccacccgcucccgcucccacgagcccgaggccauccacaucccccaccgcaagccccagggcgucgaccccgccuccuuccacuuccucgacacccccaucgccaaggucuccgagcuccagcagcgccuccgcggcacccaggacggcuccaagcacuucguccgcucccccaaggcccagggcaaguccgucggcgucggccacgucgcccgcggcgcccgcaacaagcccccccucggccccgccauccccgccgucucccccuccgcccaccucgccgccucccccgcccuccuccccucccucgccccccucggccacaagaagcacaagcaccgcgccaaggagucccagcagggcugccgcggccuccaggccccccucgccuccggcggccccguccucggccgcgagcaccuccgcgagcuccccgcccucgucgucuacgagucccaggccggccagcccguccagcgccacgagcaccaccaccaccacgagcaccaccaccacuaccaccacuucuaccagaccuga

SEQ ID NO: 46666 - RNA, 936 nt, Artificial Sequence
  derived and/or modified sequence opt2 from NKD2__Homo_sapiens__NP_001258011
augggcaagcuccaguccaagcacgccgccgccgcccgcaagcgccgcgagucccccgagggcgacuccuucgucgccuccgccuacgccuccggccgcaagggcgccgaggaggccgagcgccgcgcccgcgacaagcaggagcuccccaacggcgaccccaaggagggccccuuccgcgaggaccagugcccccuccaggucgcccuccccgccgagaaggccgagggccgcgagcaccccggccagcuccucuccgccgacgacggcgagcgcgccgccaaccgcgagggcccccgcggccccggcggccagcgccucaacaucgacgcccuccagugcgacgucuccgucgaggaggacgaccgccaggaguggaccuucacccucuacgacuucgacaacugcggcaaggucacccgcgaggacauguccucccucaugcacaccaucuacgaggucgucgacgccuccgucaaccacuccuccggcuccuccaagacccuccgcgucaagcucaccgucucccccgagcccuccuccaagcgcaaggagggcccccccgccggccaggaccgcgagcccacccgcugccgcauggagggcgagcucgccgaggagccccgcgucgccgaccgccgccucuccgcccacguccgccgccccuccaccgacccccagcccugcuccgagcgcggccccuacugcgucgacgagaacaccgagcgccgcaaccacuaccucgaccucgccggcaucgagaacuacaccucccgcuucggccccggcucccagcucugcgagaagcgcuccuccgccccccgcacccacuccggcgacaaggcccgcggcgucggccucugccgcgagcucuggucccaggccggccacccccaguggcccggccccuuccccuccggccucgucgccgucuga

SEQ ID NO: 46667 - RNA, 498 nt, Artificial Sequence
  derived and/or modified sequence opt2 from NKG7__Homo_sapiens__NP_005592
auggagcucugccgcucccucgcccuccucggcggcucccucggccucauguucugccucaucgcccucuccaccgacuucugguucgaggccgucggccccacccacuccgcccacuccggccucuggcccaccggccacggcgacaucaucuccggcuacauccacgucacccagaccuucuccaucauggccguccucugggcccucgucuccgucuccuuccucguccucuccugcuuccccucccucuucccccccggccacggcccccucgucuccaccaccgccgccuucgccgccgccaucuccauggucgucgccauggccgucuacaccuccgagcgcugggaccagcccccccacccccagauccagaccuucuucuccugguccuucuaccucggcugggucuccgccauccuccuccucugcaccggcgcccucucccucggcgcccacugcggcggcccccgccccggcuacgagacccucuga

SEQ ID NO: 46668 - RNA, 579 nt, Artificial Sequence
  derived and/or modified sequence opt2 from NKIRAS1__Homo_sapiens__NP_065078
augggcaagggcugcaaggucgucgucugcggccuccucuccgucggcaagaccgccauccucgagcagcuccucuacggcaaccacaccaucggcauggaggacugcgagaccauggaggacgucuacauggccuccgucgagaccgaccgcggcgucaaggagcagcuccaccucuacgacacccgcggccuccaggagggcgucgagcuccccaagcacuacuucuccuucgccgacggcuucguccucgucuacuccgucaacaaccucgaguccuuccagcgcgucgagcuccucaagaaggagaucgacaaguucaaggacaagaaggaggucgccaucgucguccucggcaacaagaucgaccucuccgagcagcgccaggucgacgccgaggucgcccagcagugggccaaguccgagaagguccgccucugggaggucaccgucaccgaccgcaagacccucaucgagcccuucacccuccucgccuccaagcucucccagccccaguccaaguccuccuucccccuccccggccgcaagaacaagggcaacuccaacuccgagaacuga

SEQ ID NO: 46669 - RNA, 408 nt, Artificial Sequence
  derived and/or modified sequence opt2 from NKIRAS2__Homo_sapiens__NP_001138400
augggcaaguccugcaaggucgucgucugcggccaggccuccgucggcaagaccuccauccucgagcagcuccucuacggcaaccacgucgucggcuccgagaugaucgagacccaggaggacaucuacgucggcuccaucgagaccgaccgcggcguccgcgagcaggucaccaucgucguccucggcaacaagugcgaccuccaggagcagcgccgcgucgaccccgacgucgcccagcacugggccaaguccgagaaggucaagcucugggaggucuccgucgccgaccgccgcucccuccucgagcccuucgucuaccucgccuccaagaugacccagccccaguccaaguccgccuucccccucucccgcaagaacaagggcuccggcucccucgacggcuga

SEQ ID NO: 46670 - RNA, 2118 nt, Artificial Sequence
  derived and/or modified sequence opt2 from NKRF__Homo_sapiens__NP_001166958
augggcuucaugcucccccucaucuuccgcuacuccccccgccucauggagaagauccuccagauggccgagggcaucgacaucggcgagaugcccuccuacgaccucguccucuccaagcccuccaagggccagaagcgccaccucuccaccugcgacggccagaacccccccaagaagcaggccggcuccaaguuccacgcccgcccccgcuucgagcccguccacuucgucgccuccuccuccaaggacgagcgccaggaggaccccuacggcccccagaccaaggaggucaacgagcagacccacuucgccuccaugccccgcgacaucuaccaggacuacacccaggacuccuucuccauccaggacggcaacucccaguacugcgacuccuccggcuucauccucaccaaggaccagcccgucaccgccaacauguacuucgacuccggcaaccccgcccccuccaccaccucccagcaggccaacucccaguccacccccgagcccucccccucccagaccuuccccgaguccgucgucgccgagaagcaguacuucaucgagaagcucaccgccaccaucuggaagaaccucuccaaccccgagaugaccuccggcuccgacaagaucaacuacaccuacaugcucacccgcugcauccaggccugcaagaccaaccccgaguacaucuacgccccccucaaggagaucccccccgccgacauccccaagaacaagaagcuccucaccgacggcuacgccugcgagguccgcugccagaacaucuaccucaccaccggcuacgccggcuccaagaacggcucccgcgaccgcgccaccgagcucgccgucaagcuccuccagaagcgcaucgagguccgcgucguccgccgcaaguucaagcacaccuucggcgaggaccucgucgucugccagaucggcauguccuccuacgaguucccccccgcccucaagccccccgaggaccucgucguccucggcaaggacgccuccggccagcccaucuucaacgccuccgccaagcacuggaccaacuucgucaucaccgagaacgccaacgacgccaucggcauccucaacaacuccgccuccuucaacaagauguccaucgaguacaaguacgagaugaugcccaaccgcaccuggcgcugccgcgucuuccuccaggaccacugccucgccgagggcuacggcaccaagaagaccuccaagcacgccgccgccgacgaggcccucaagauccuccagaagacccagcccaccuaccccuccgucaaguccucccagugccacaccggcuccuccccccgcggcuccggcaagaagaaggacaucaaggaccucgucgucuacgagaacuccuccaaccccgucugcacccucaacgacaccgcccaguucaaccgcaugaccgucgaguacgucuacgagcgcaugaccggccuccgcuggaagugcaaggucauccucgaguccgaggucaucgccgaggccgucggcgucaagaagaccgucaaguacgaggccgccggcgaggccgucaagacccucaagaagacccagcccaccgucaucaacaaccucaagaagggcgccgucgaggacgucaucucccgcaacgagauccagggccgcuccgccgaggaggccuacaagcagcagaucaaggaggacaacaucggcaaccagcuccuccgcaagaugggcuggaccggcggcggccucggcaaguccggcgagggcauccgcgagcccaucuccgucaaggagcagcacaagcgcgagggccucggccucgacgucgagcgcgucaacaagaucgccaagcgcgacaucgagcagaucauccgcaacuacgcccgcuccgagucccacaccgaccucaccuucucccgcgagcucaccaacgacgagcgcaagcagauccaccagaucgcccagaaguacggccucaaguccaagucccacggcgucggccacgaccgcuaccucgucgucggccgcaagcgccgcaaggaggaccuccucgaccagcucaagcaggagggccaggucggccacuacgagcucgucaugccccaggccaacuga

SEQ ID NO: 46671 - RNA, 4389 nt, Artificial Sequence
  derived and/or modified sequence opt2 from NKTR__Homo_sapiens__NP_005376
augggcgcccaggaccgcccccagugccacuucgacaucgagaucaaccgcgagcccgucggccgcaucauguuccagcucuucuccgacaucugccccaagaccugcaagaacuuccucugccucugcuccggcgagaagggccucggcaagaccaccggcaagaagcucugcuacaagggcuccaccuuccaccgcgucgucaagaacuucaugauccagggcggcgacuucuccgagggcaacggcaagggcggcgaguccaucuacggcggcuacuucaaggacgagaacuucauccucaagcacgaccgcgccuuccuccucuccauggccaaccgcggcaagcacaccaacggcucccaguucuucaucaccaccaagcccgccccccaccucgacggcguccacgucgucuucggccucgucaucuccggcuucgaggucaucgagcagaucgagaaccucaagaccgacgccgccucccgccccuacgccgacguccgcgucaucgacugcggcguccucgccaccaaguccaucaaggacgucuucgagaagaagcgcaagaagcccacccacuccgagggcuccgacuccuccuccaacuccuccuccuccuccgaguccuccuccgaguccgagcucgagcacgagcgcucccgccgccgcaagcacaagcgccgccccaaggucaagcgcuccaagaagcgccgcaaggaggccuccuccuccgaggagccccgcaacaagcacgccaugaaccccaagggccacuccgagcgcuccgacaccaacgagaagcgcuccgucgacuccuccgccaagcgcgagaagcccgucguccgccccgaggagaucccccccguccccgagaaccgcuuccuccuccgccgcgacaugcccgucgucaccgccgagcccgagcccaagauccccgacgucgcccccaucgucuccgaccagaagcccuccgucuccaaguccggccgcaagaucaagggccgcggcaccauccgcuaccacacccccccccgcucccgcuccugcuccgaguccgacgacgacgacuccuccgagacccccccccacuggaaggaggagaugcagcgccuccgcgccuaccgcccccccuccggcgagaagugguccaagggcgacaagcucuccgaccccugcuccucccgcugggacgagcgcucccucucccagcgcucccgcuccugguccuacaacggcuacuacuccgaccucuccaccgcccgccacuccggccaccacaagaagcgccgcaaggagaagaaggucaagcacaagaagaagggcaagaagcagaagcacugccgccgccacaagcagaccaagaagcgccgcauccucauccccuccgacaucgaguccuccaaguccuccacccgccgcaugaaguccuccugcgaccgcgagcgcuccucccgcuccuccucccucuccucccaccacuccuccaagcgcgacugguccaaguccgacaaggacguccaguccucccucacccacuccucccgcgacuccuaccgcuccaagucccacucccaguccuacucccgcggcuccucccgcucccgcaccgccuccaaguccuccucccacucccgcucccgcuccaagucccgcuccuccuccaaguccggccaccgcaagcgcgccuccaaguccccccgcaagaccgccucccagcucuccgagaacaagcccgucaagaccgagccccuccgcgccaccauggcccagaacgagaacgucgucguccagcccgucgucgccgagaacauccccgucaucccccucuccgacucccccccccccucccgcuggaagcccggccagaagcccuggaagcccuccuacgagcgcauccaggagaugaaggccaagaccacccaccuccuccccauccaguccaccuacucccucgccaacaucaaggagaccggcuccuccuccuccuaccacaagcgcgagaagaacuccgaguccgaccaguccaccuacuccaaguacuccgaccgcuccuccgaguccuccccccgcucccgcucccgcuccucccgcucccgcuccuacucccgcuccuacacccgcucccgcucccucgccuccucccacucccgcucccgcucccccuccucccgcucccacucccgcaacaaguacuccgaccacucccagugcucccgcuccuccuccuacaccuccaucuccuccgacgacggccgccgcgccaagcgccgccuccgcuccuccggcaagaagaacuccgucucccacaagaagcacuccuccuccuccgagaagacccuccacuccaaguacgucaagggccgcgaccgcuccuccugcguccgcaaguacuccgagucccgcuccucccucgacuacuccuccgacuccgagcaguccuccguccaggccacccaguccgcccaggagaaggagaagcagggccagauggagcgcacccacaacaagcaggagaagaaccgcggcgaggagaaguccaaguccgagcgcgagugcccccacuccaagaagcgcacccucaaggagaaccucuccgaccaccuccgcaacggcuccaagcccaagcgcaagaacuacgccggcuccaagugggacuccgaguccaacuccgagcgcgacgucaccaagaacuccaagaacgacucccaccccuccuccgacaaggaggagggcgaggccaccuccgacuccgaguccgaggucuccgagauccacaucaaggucaagcccaccaccaaguccuccaccaacaccucccuccccgacgacaacggcgccuggaaguccuccaagcagcgcaccuccaccuccgacuccgagggcuccugcuccaacuccgagaacaaccgcggcaagccccagaagcacaagcacggcuccaaggagaaccucaagcgcgagcacaccaagaaggucaaggagaagcucaagggcaagaaggacaagaagcacaaggcccccaagcgcaagcaggccuuccacuggcagcccccccucgaguucggcgaggaggaggaggaggagaucgacgacaagcaggucacccaggaguccaaggagaagaaggucuccgagaacaacgagaccaucaaggacaacauccucaagaccgagaaguccuccgaggaggaccucuccggcaagcacgacaccgucaccgucuccuccgaccucgaccaguucaccaaggacgacuccaagcucuccaucucccccaccgcccucaacaccgaggagaacgucgccugccuccagaacauccagcacgucgaggaguccguccccaacggcgucgaggacguccuccagaccgacgacaacauggagaucugcacccccgaccgcuccucccccgccaaggucgaggagaccuccccccucggcaacgcccgccucgacacccccgacaucaacaucguccucaagcaggacauggccaccgagcacccccaggccgaggucgucaagcaggaguccuccauguccgaguccaagguccucggcgaggucggcaagcaggacuccuccuccgccucccucgccuccgccggcgaguccaccggcaagaaggaggucgccgagaagucccagaucaaccucaucgacaagaaguggaagccccuccagggcgucggcaaccucgccgcccccaacgccgccaccuccuccgccgucgaggucaagguccucaccaccguccccgagaugaagccccagggccuccgcaucgagaucaaguccaagaacaagguccgccccggcucccucuucgacgagguccgcaagaccgcccgccucaaccgccgcccccgcaaccaggaguccuccuccgacgagcagacccccucccgcgacgacgacucccagucccgcucccccucccgcucccgcuccaaguccgagaccaagucccgccaccgcacccgcuccgucuccuacucccacucccgcucccgcucccgcuccuccaccuccuccuaccgcucccgcuccuacucccgcucccgcucccgcggcugguacucccgcggccgcacccgcucccgcuccuccuccuaccgcuccuacaagucccaccgcaccuccucccgcucccgcucccgcuccuccuccuacgacccccacucccgcucccgcuccuacaccuacgacuccuacuacucccgcucccgcucccgcucccgcucccagcgcuccgacuccuaccaccgcggccgcuccuacaaccgccgcucccgcuccugccgcuccuacggcuccgacuccgaguccgaccgcuccuacucccaccaccgcucccccuccgaguccucccgcuacuccuga

SEQ ID NO: 46672 - RNA, 1347 nt, Artificial Sequence
  derived and/or modified sequence opt2 from NKX1-1__Homo_sapiens__NP_001277008
auguccgccuccggccccgaggcccccggcgacauccccgcccuccccccccccccccagcccggcuccggccccgccccccccgcccccgccgccgccgcccaggaggccauggacggccgcgccgagcuccccgccuucccccgcgccggcgcccccccccucgccgccuccgacaccguccccgccgcccccgagggcgccggcgccgcccgccccgccgccccccuccgccccaccuccuucuccguccucgacauccucgaccccaacaaguucaacucccgccgccgccgcugcguccuccucggccccgucgcccccgccgccugcgcccccugcgccuccgcccccugcgcccccgcccccgccgccuccggccgccccccccgcgccgaggagcucgagcgccgcgcccucgccggcgccggcggcgucggcgccgccggcgccgagccccccaacgccggcgaccccuucaaggccggcgaggccgagaccaacgacaccaacggcuacuccuccggcggcggcggccacucccccuccgccgacuccggcgacgagguccccgacgacgaggacgacgacgaggacgaggcccccgagaccgaggccgcccgcggcgccgaggaggcccgcggcggcggcggcggccucggcgcccgcggcuccggcugccagggcgccgccgagaccgacgccucccccggcgccaccgucgacgaggccgccgcccccggcccccgcgagaacucccccgucgcccagggcccccccggcggcgccgccgcccccggcggcgccggcaccaccccccagggcaccgccaccgccgccaagcccaagcgcaagcgcaccggcuccgacuccaaguccggcaagccccgccgcgcccgcaccgccuucaccuacgagcagcucgucgcccucgagaacaaguucaaggccacccgcuaccucuccgucugcgagcgccucaaccucgcccucucccucucccucaccgagacccaggucaagaucugguuccagaaccgccgcaccaaguggaagaagcagaaccccggcgccgacaccuccgcccccaccggcggcggcggcggccccggccccggcgccggccccggcaccggccuccccggcggccucuccccccucucccccuccccccccaugggcgccccccucggcaugcacggccccgccggcuaccccgcccacggccccggcggccucgucugcgccgcccagcuccccuuccucuccucccccgccguccucucccccuucguccucggcucccagaccuacggcgcccccgccuucuacgccccccaccucuga

SEQ ID NO: 46673 - RNA, 933 nt, Artificial Sequence
  derived and/or modified sequence opt2 from NKX1-2__Homo_sapiens__NP_001139812
augcucgccuggcaggacggcggcgccaaggccgcccccucccaccacaagaucuccuucuccguccucgacauccucgacccccagaaguucacccgcgccgcccuccccgccguccgccccgccccccgcgaggcccgcaagucccucgccgaggucgaggccggcaaggacgccuccucccgcgaccccguccgccagcucgagacccccgacgccgccggccccggcgccggccaggccuccccccucgagggcuccgaggccgaggaggaggaggacgccgaggacccccgccgcccccgccuccgcgagcgcgccgcccgccuccuccccggccucgcccgcucccccgacgcccccgccggcgcccucgccuccggcgagcccugcgaggacggcggcggcggccccguccgcuccccccccggcucccccggcuccccccgcccccgccgccgccgccucgagcccaacugcgccaagccccgccgcgcccgcaccgccuucaccuacgagcagcucgucgcccucgagaacaaguuccgcgccacccgcuaccucuccgucugcgagcgccucaaccucgcccucucccucucccucaccgagacccaggucaagaucugguuccagaaccgccgcaccaaguggaagaagcagaaccccggcgccgacggcgccgcccaggucggcggcggcgccccccagcccggcgccgccggcggcggcggcggcggcggcuccggcggcucccccggcccccccggcaccggcgcccuccacuuccagaccuuccccuccuacuccgccgccaacguccucuuccccuccgccgccuccuucccccucaccgccgccgcccccggcucccccuucgcccccuuccucggccccuccuaccucacccccuucuacgccccccgccucuga

SEQ ID NO: 46674 - RNA, 1206 nt, Artificial Sequence
  derived and/or modified sequence opt2 from NKX2-1__Homo_sapiens__NP_001073136
augugguccggcggcuccggcaaggcccgcggcugggaggccgccgccggcggccgcuccucccccggccgccucucccgccgccgcaucauguccaugucccccaagcacaccacccccuucuccgucuccgacauccucuccccccucgaggaguccuacaagaaggucggcauggagggcggcggccucggcgccccccucgccgccuaccgccagggccaggccgccccccccaccgccgccaugcagcagcacgccgucggccaccacggcgccgucaccgccgccuaccacaugaccgccgccggcgucccccagcucucccacuccgccgucggcggcuacugcaacggcaaccucggcaacauguccgagcucccccccuaccaggacaccaugcgcaacuccgccuccggccccggcugguacggcgccaaccccgacccccgcuuccccgccaucucccgcuucaugggccccgccuccggcaugaacauguccggcaugggcggccucggcucccucggcgacgucuccaagaacauggccccccuccccuccgccccccgccgcaagcgccgcguccucuucucccaggcccaggucuacgagcucgagcgccgcuucaagcagcagaaguaccucuccgcccccgagcgcgagcaccucgccuccaugauccaccucacccccacccaggucaagaucugguuccagaaccaccgcuacaagaugaagcgccaggccaaggacaaggccgcccagcagcagcuccagcaggacuccggcggcggcggcggcggcggcggcaccggcugcccccagcagcagcaggcccagcagcaguccccccgccgcgucgccguccccguccucgucaaggacggcaagcccugccaggccggcgcccccgcccccggcgccgccucccuccagggccacgcccagcagcaggcccagcaccaggcccaggccgcccaggccgccgccgccgccaucuccgucggcuccggcggcgccggccucggcgcccaccccggccaccagcccggcuccgccggccagucccccgaccucgcccaccacgccgccucccccgccgcccuccagggccaggucuccucccucucccaccucaacuccuccggcuccgacuacggcaccauguccugcuccacccuccucuacggccgcaccugguga

SEQ ID NO: 46675 - RNA, 822 nt, Artificial Sequence
  derived and/or modified sequence opt2 from NKX2-2__Homo_sapiens__NP_002500
augucccucaccaacaccaagaccggcuucuccgucaaggacauccucgaccuccccgacaccaacgacgaggagggcuccgucgccgagggccccgaggaggagaacgagggccccgagcccgccaagcgcgccggcccccucggccagggcgcccucgacgccguccagucccucccccucaagaaccccuucuacgacuccuccgacaaccccuacacccgcuggcucgccuccaccgagggccuccaguacucccuccacggccucgccgccggcgcccccccccaggacuccuccuccaagucccccgagcccuccgccgacgagucccccgacaacgacaaggagacccccggcggcggcggcgacgccggcaagaagcgcaagcgccgcguccucuucuccaaggcccagaccuacgagcucgagcgccgcuuccgccagcagcgcuaccucuccgcccccgagcgcgagcaccucgccucccucauccgccucacccccacccaggucaagaucugguuccagaaccaccgcuacaagaugaagcgcgcccgcgccgagaagggcauggaggucaccccccuccccuccccccgccgcgucgccguccccguccucguccgcgacggcaagcccugccacgcccucaaggcccaggaccucgccgccgccaccuuccaggccggcauccccuucuccgccuacuccgcccagucccuccagcacaugcaguacaacgcccaguacuccuccgccuccaccccccaguaccccaccgcccacccccucguccaggcccagcaguggaccugguga

SEQ ID NO: 46676 - RNA, 1095 nt, Artificial Sequence
  derived and/or modified sequence opt2 from NKX2-3__Homo_sapiens__NP_660328
augaugcuccccucccccgucaccuccacccccuucuccgucaaggacauccucaaccucgagcagcagcaccagcacuuccacggcgcccaccuccaggccgaccucgagcaccacuuccacuccgcccccugcaugcucgccgccgccgagggcacccaguucuccgacggcggcgaggaggacgaggaggacgagggcgagaagcucuccuaccucaacucccucgccgccgccgacggccacggcgacuccggccucugcccccagggcuacguccacaccguccuccgcgacuccugcuccgagcccaaggagcacgaggaggagcccgaggucguccgcgaccgcucccagaaguccugccagcucaagaagucccucgagaccgccggcgacugcaaggccgccgaggaguccgagcgccccaagccccgcucccgccgcaagccccgcguccucuucucccaggcccaggucuucgagcucgagcgccgcuucaagcagcagcgcuaccucuccgcccccgagcgcgagcaccucgccuccucccucaagcucaccuccacccaggucaagaucugguuccagaaccgccgcuacaagugcaagcgccagcgccaggacaagucccucgagcucggcgcccacgccccccccccccccccccgccgcgucgccguccccguccucguccgcgacggcaagcccugcgucacccccuccgcccaggccuacggcgcccccuacuccgucggcgccuccgccuacuccuacaacuccuuccccgccuacggcuacggcaacuccgccgccgccgccgccgccgccgccgccgccgccgccgccgccgccgccuacuccuccuccuacggcugcgccuaccccgccggcggcggcggcggcggcggcggcaccuccgccgccaccaccgccaugcagcccgccugcuccgccgccggcggcggccccuucgucaacgucuccaaccucggcggcuucggcuccggcggcuccgcccagccccuccaccagggcaccgccgccggcgccgccugcgcccagggcacccuccagggcauccgcgccugguga

SEQ ID NO: 46677 - RNA, 339 nt, Artificial Sequence
  derived and/or modified sequence opt2 from NKX2-5__Homo_sapiens__NP_001159647
auguuccccucccccgcccucacccccacccccuucuccgucaaggacauccucaaccucgagcagcagcagcgcucccucgccgccgccggcgagcucuccgcccgccucgaggccacccucgcccccuccuccugcaugcucgccgccuucaagcccgaggccuacgccggccccgaggccgccgcccccggccuccccgagcuccgcgccgagcucggccgcgcccccucccccgccaagugcgccuccgccuuccccgccgcccccgccuucuacccccgcgccuacuccgaccccgaccccgccaaggacccccgcgccgagaagaaggccuga

SEQ ID NO: 46678 - RNA, 906 nt, Artificial Sequence
  derived and/or modified sequence opt2 from NKX2-6__Homo_sapiens__NP_001129743
augcuccucucccccgucaccuccacccccuucuccgucaaggacauccuccgccucgagcgcgagcgcuccugccccgccgccuccccccacccccgcguccgcaagucccccgagaacuuccaguaccuccgcauggacgccgagccccgcggcuccgagguccacaacgccggcggcggcggcggcgaccgcaagcucgacggcuccgagccccccggcggccccugcgaggccguccucgagauggacgccgagcgcaugggcgagccccagcccggccucaacgccgccuccccccucggcggcggcacccgcguccccgagcgcggcgucggcaacuccggcgacuccguccgcggcggccgcuccgagcagcccaaggcccgccagcgccgcaagccccgcguccucuucucccaggcccagguccucgcccucgagcgccgcuucaagcagcagcgcuaccucuccgcccccgagcgcgagcaccucgccuccgcccuccagcucaccuccacccaggucaagaucugguuccagaaccgccgcuacaagugcaagcgccagcgccaggacaagucccucgagcucgccggccacccccucaccccccgccgcgucgccguccccguccucguccgcgacggcaagcccugccucggccccggccccggcgcccccgccuuccccucccccuacuccgccgccgucucccccuacuccugcuacggcggcuacuccggcgcccccuacggcgccggcuacggcaccugcuacgccggcgcccccuccggccccgccccccacaccccccucgccuccgccggcuucggccacggcggccagaacgccaccccccagggccaccucgccgccacccuccagggcguccgcgccugguga

SEQ ID NO: 46679 - RNA, 720 nt, Artificial Sequence
  derived and/or modified sequence opt2 from NKX2-8__Homo_sapiens__NP_055175
auggccaccuccggccgccucuccuucaccguccgcucccuccucgaccuccccgagcaggacgcccagcaccucccccgccgcgagcccgagccccgcgccccccagcccgaccccugcgccgccuggcucgacuccgagcgcggccacuaccccuccuccgacgaguccucccucgagaccuccccccccgacuccucccagcgccccuccgcccgccccgccucccccggcuccgacgccgagaagcgcaagaagcgccgcguccucuucuccaaggcccagacccucgagcucgagcgccgcuuccgccagcagcgcuaccucuccgcccccgagcgcgagcagcucgccucccuccuccgccucacccccacccaggucaagaucugguuccagaaccaccgcuacaagcucaagcgcgcccgcgcccccggcgccgccgagucccccgaccucgccgccuccgccgagcuccacgccgcccccggccuccuccgccgcgucgucguccccguccucguccgcgacggccagcccugcggcggcggcggcggcggcgaggucggcaccgccgccgcccaggagaagugcggcgccccccccgccgccgccugcccccuccccggcuaccccgccuucggccccggcuccgcccucggccucuuccccgccuaccagcaccucgccucccccgcccucgucuccuggaacugguga

SEQ ID NO: 46680 - RNA, 480 nt, Artificial Sequence
  derived and/or modified sequence opt2 from NKX3-1__Homo_sapiens__NP_001243268
augcuccgcguccccgagccccgccccggcgaggccgagacccucgccgagaccgagcccgagcgccaccucggcuccuaccuccucgacuccgagaacaccuccggcgcccucccccgccucccccagacccccaagcagccccagaagcgcucccgcgccgccuucucccacacccaggucaucgagcucgagcgcaaguucucccaccagaaguaccucuccgcccccgagcgcgcccaccucgccaagaaccucaagcucaccgagacccaggucaagaucugguuccagaaccgccgcuacaagaccaagcgcaagcagcucuccuccgagcucggcgaccucgagaagcacuccucccuccccgcccucaaggaggaggccuucucccgcgccucccucgucuccgucuacaacuccuaccccuacuaccccuaccucuacugcgucggcuccuggucccccgccuucugguga

SEQ ID NO: 46681 - RNA, 1104 nt, Artificial Sequence
  derived and/or modified sequence opt2 from NKX6-1__Homo_sapiens__XP_006714293
augcucgccgucggcgccauggagggcacccgccaguccgccuuccuccucuccucccccccccucgccgcccuccacuccauggccgagaugaagaccccccucuaccccgccgccuaccccccccuccccgccggcccccccuccuccuccuccuccuccuccuccuccuccucccccucccccccccucggcacccacaaccccggcggccucaagccccccgccaccggcggccucuccucccucggcucccccccccagcagcucuccgccgccaccccccacggcaucaacgacauccucucccgccccuccaugcccgucgccuccggcgccgcccuccccuccgccucccccuccggcuccuccuccuccuccuccuccuccgccuccgccuccuccgccuccgccgccgccgccgccgccgccgccgccgccgccgccgccuccucccccgccggccuccucgccggccucccccgcuucuccucccucuccccccccccccccccccccggccucuacuucucccccuccgccgccgccgucgccgccgucggccgcuaccccaagccccucgccgagcuccccggccgcacccccaucuucuggcccggcgucaugcaguccccccccuggcgcgacgcccgccucgccugcaccccccaccagggcuccauccuccucgacaaggacggcaagcgcaagcacacccgccccaccuucuccggccagcagaucuucgcccucgagaagaccuucgagcagaccaaguaccucgccggccccgagcgcgcccgccucgccuacucccucggcaugaccgagucccaggucaaggucugguuccagaaccgccgcaccaaguggcgcaagaagcacgccgccgagauggccaccgccaagaagaagcaggacuccgagaccgagcgccucaagggcgccuccgagaacgaggaggaggacgacgacuacaacaagccccucgaccccaacuccgacgacgagaagaucacccagcuccucaagaagcacaaguccuccuccggcggcggcggcggccuccuccuccacgccuccgagcccgaguccuccuccuga

SEQ ID NO: 46682 - RNA, 834 nt, Artificial Sequence
  derived and/or modified sequence opt2 from NKX6-2__Homo_sapiens__NP_796374
auggacaccaaccgccccggcgccuucguccucuccuccgccccccucgccgcccuccacaacauggccgagaugaagaccucccucuuccccuacgcccuccagggccccgccggcuucaaggcccccgcccucggcggccucggcgcccagcucccccucggcaccccccacggcaucuccgacauccucggccgccccgucggcgccgccggcggcggccuccucggcggccucccccgccucaacggccucgccuccuccgccggcgucuacuucggccccgccgccgccgucgcccgcggcuaccccaagccccucgccgagcuccccggccgcccccccaucuucuggcccggcgucguccagggcgcccccuggcgcgacccccgccucgccggccccgcccccgccggcggcguccucgacaaggacggcaagaagaagcacucccgccccaccuucuccggccagcagaucuucgcccucgagaagaccuucgagcagaccaaguaccucgccggccccgagcgcgcccgccucgccuacucccucggcaugaccgagucccaggucaaggucugguuccagaaccgccgcaccaaguggcgcaagcgccacgccgccgagauggccuccgccaagaagaagcaggacuccgacgccgagaagcucaaggucggcggcuccgacgccgaggacgacgacgaguacaaccgcccccucgaccccaacuccgacgacgagaagaucacccgccuccucaagaagcacaagcccuccaaccucgcccucgucucccccugcggcggcggcgccggcgacgcccucuga

SEQ ID NO: 46683 - RNA, 582 nt, Artificial Sequence
  derived and/or modified sequence opt2 from NLE1__Homo_sapiens__NP_001014445
auggcccucuccaccgacuacgcccuccgcaccggcgccuucgagcccgccgaggccuccgucaacccccaggaccuccagggcucccuccaggagcucaaggagcgcgcccucucccgcuacaaccucguccgcggccagggccccgagcgccucgucuccggcuccgacgacuucacccucuuccucuggucccccgccgaggacaagaagccccucacccgcaugaccggccaccaggcccucaucaaccagguccucuucucccccgacucccgcaucgucgccuccgccuccuucgacaaguccaucaagcucugggacggccgcaccggcaaguaccucgccucccuccgcggccacgucgccgccgucuaccagaucgccugguccgccgacucccgccuccucgucuccggcuccuccgacuccacccucaaggucugggacgucaaggcccagaagcucgccauggaccuccccggccacgccgacgaggucuacgccgucgacuggucccccgacggccagcgcgucgccuccggcggcaaggacaagugccuccgcaucuggcgccgcuga

SEQ ID NO: 46684 - RNA, 2472 nt, Artificial Sequence
  derived and/or modified sequence opt2 from NLGN1__Homo_sapiens__NP_055747
auggcccucccccgcugcaccuggcccaacuacgucuggcgcgccgucauggccugccucguccaccgcggccucggcgccccccucacccucugcaugcucggcugccuccuccaggccggccacguccucucccagaagcucgacgacgucgacccccucgucgccaccaacuucggcaagauccgcggcaucaagaaggagcucaacaacgagauccucggccccgucauccaguuccucggcguccccuacgccgccccccccaccggcgagcgccgcuuccagccccccgagccccccucccccugguccgacauccgcaacgccacccaguucgcccccgucugcccccagaacaucaucgacggccgccuccccgaggucaugcuccccgucugguucaccaacaaccucgacgucgucuccuccuacguccaggaccaguccgaggacugccucuaccucaacaucuacguccccaccgaggacgacauccgcgacuccggcggccccaagcccgucauggucuacauccacggcggcuccuacauggagggcaccggcaaccucuacgacggcuccguccucgccuccuacggcaacgucaucgucaucaccgucaacuaccgccucggcguccucggcuuccucuccaccggcgaccaggccgccaagggcaacuacggccuccucgaccucauccaggcccuccgcuggaccuccgagaacaucggcuucuucggcggcgacccccuccgcaucaccgucuucggcuccggcgccggcggcuccugcgucaaccuccucacccucucccacuacuccgagggcaaccgcugguccaacuccaccaagggccucuuccagcgcgccaucgcccaguccggcaccgcccucuccuccugggccgucuccuuccagcccgccaaguacgcccgcaugcucgccaccaaggucggcugcaacgucuccgacaccgucgagcucgucgagugccuccagaagaagcccuacaaggagcucgucgaccaggacauccagcccgcccgcuaccacaucgccuucggccccgucaucgacggcgacgucauccccgacgacccccagauccucauggagcagggcgaguuccucaacuacgacaucaugcucggcgucaaccagggcgagggccucaaguucgucgagaacaucgucgacuccgacgacggcaucuccgccuccgacuucgacuucgccgucuccaacuucgucgacaaccucuacggcuaccccgagggcaaggacguccuccgcgagaccaucaaguucauguacaccgacugggccgaccgccacaaccccgagacccgccgcaagacccuccucgcccucuucaccgaccaccagugggucgcccccgccgucgccaccgccgaccuccacuccaacuucggcucccccaccuacuucuacgccuucuaccaccacugccagaccgaccagguccccgccugggccgacgccgcccacggcgacgagguccccuacguccucggcauccccaugaucggccccaccgagcucuuccccugcaacuucuccaagaacgacgucaugcucuccgccgucgucaugaccuacuggaccaacuucgccaagaccggcgaccccaaccagcccgucccccaggacaccaaguucauccacaccaagcccaaccgcuucgaggaggucgccuggacccgcuacucccagaaggaccagcucuaccuccacaucggccucaagccccgcgucaaggagcacuaccgcgccaacaaggucaaccucuggcucgagcucgucccccaccuccacaaccucaacgacaucucccaguacaccuccaccaccaccaagguccccuccaccgacaucaccuuccgccccacccgcaagaacuccguccccgucaccuccgccuuccccaccgccaagcaggacgaccccaagcagcagcccucccccuucuccgucgaccagcgcgacuacuccaccgagcucuccgucaccaucgccgucggcgccucccuccucuuccucaacauccucgccuucgccgcccucuacuacaagaaggacaagcgccgccacgacguccaccgccgcugcuccccccagcgcaccaccaccaacgaccucacccacgcccaggaggaggagaucaugucccuccagaugaagcacaccgaccucgaccacgagugcgaguccauccacccccacgaggucguccuccgcaccgccugcccccccgacuacacccucgccaugcgccgcucccccgacgacgucccccucaugacccccaacaccaucaccaugauccccaacaccauccccggcauccagccccuccacaccuucaacaccuucaccggcggccagaacaacacccucccccacccccacccccacccccacucccacuccaccacccgcgucuga

SEQ ID NO: 46685 - RNA, 2508 nt, Artificial Sequence
  derived and/or modified sequence opt2 from NLGN2__Homo_sapiens__NP_065846
auguggcuccucgcccucugccucgucggccucgccggcgcccagcgcggcggcggcggccccggcggcggcgcccccggcggccccggccucggccucggcucccucggcgaggagcgcuuccccgucgucaacaccgccuacggccgcguccgcggcguccgccgcgagcucaacaacgagauccucggccccgucguccaguuccucggcguccccuacgccacccccccccucggcgcccgccgcuuccagccccccgaggcccccgccuccuggcccggcguccgcaacgccaccacccucccccccgccugcccccagaaccuccacggcgcccuccccgccaucaugcuccccgucugguucaccgacaaccucgaggccgccgccaccuacguccagaaccaguccgaggacugccucuaccucaaccucuacguccccaccgaggacggcccccucaccaagaagcgcgacgaggccacccucaacccccccgacaccgacauccgcgaccccggcaagaagcccgucaugcucuuccuccacggcggcuccuacauggagggcaccggcaacauguucgacggcuccguccucgccgccuacggcaacgucaucgucgccacccucaacuaccgccucggcguccucggcuuccucuccaccggcgaccaggccgccaagggcaacuacggccuccucgaccagauccaggcccuccgcuggcucuccgagaacaucgcccacuucggcggcgaccccgagcgcaucaccaucuucggcuccggcgccggcgccuccugcgucaaccuccucauccucucccaccacuccgagggccucuuccagaaggccaucgcccaguccggcaccgccaucuccuccugguccgucaacuaccagccccucaaguacacccgccuccucgccgccaaggucggcugcgaccgcgaggacuccgccgaggccgucgagugccuccgccgcaagcccucccgcgagcucgucgaccaggacguccagcccgcccgcuaccacaucgccuucggccccgucgucgacggcgacgucguccccgacgaccccgagauccucaugcagcagggcgaguuccucaacuacgacaugcucaucggcgucaaccagggcgagggccucaaguucgucgaggacuccgccgaguccgaggacggcgucuccgccuccgccuucgacuucaccgucuccaacuucgucgacaaccucuacggcuaccccgagggcaaggacguccuccgcgagaccaucaaguucauguacaccgacugggccgaccgcgacaacggcgagaugcgccgcaagacccuccucgcccucuucaccgaccaccagugggucgcccccgccgucgccaccgccaagcuccacgccgacuaccagucccccgucuacuucuacaccuucuaccaccacugccaggccgagggccgccccgagugggccgacgccgcccacggcgacgagcuccccuacgucuucggcguccccauggucggcgccaccgaccucuuccccugcaacuucuccaagaacgacgucaugcucuccgccgucgucaugaccuacuggaccaacuucgccaagaccggcgaccccaaccagcccgucccccaggacaccaaguucauccacaccaagcccaaccgcuucgaggaggucgucugguccaaguucaacuccaaggagaagcaguaccuccacaucggccucaagccccgcguccgcgacaacuaccgcgccaacaaggucgccuucuggcucgagcucgucccccaccuccacaaccuccacaccgagcucuucaccaccaccacccgccucccccccuacgccacccgcuggcccccccgcccccccgccggcgcccccggcacccgccgcccccccccccccgccacccucccccccgagcccgagcccgagcccggcccccgcgccuacgaccgcuuccccggcgacucccgcgacuacuccaccgagcucuccgucaccgucgccgucggcgccucccuccucuuccucaacauccucgccuucgccgcccucuacuacaagcgcgaccgccgccaggagcuccgcugccgccgccucuccccccccggcggcuccggcuccggcguccccggcggcggcccccuccuccccgccgccggccgcgagcucccccccgaggaggagcucgucucccuccagcucaagcgcggcggcggcgucggcgccgaccccgccgaggcccuccgccccgccugcccccccgacuacacccucgcccuccgccgcgcccccgacgacgucccccuccucgcccccggcgcccucacccuccuccccuccggccucggcccccccccccccccccccccccccucccuccaccccuucggccccuuccccccccccccccccaccgccaccucccacaacaacacccucccccacccccacuccaccacccgcgucuga

SEQ ID NO: 46686 - RNA, 2427 nt, Artificial Sequence
  derived and/or modified sequence opt2 from NLGN3__Homo_sapiens__NP_001160132
auguggcuccgccucggcccccccucccucucccucucccccaagcccaccgucggccgcucccucugccucacccucugguuccucucccucgcccuccgcgccuccacccaggcccccgcccccaccgucaacacccacuucggcaagcuccgcggcgcccgcgucccccuccccuccgagauccucggccccgucgaccaguaccucggcguccccuacgccgccccccccaucggcgagaagcgcuuccucccccccgagcccccccccuccugguccggcauccgcaacgccacccacuucccccccgucugcccccagaacauccacaccgccguccccgaggucaugcuccccgucugguucaccgccaaccucgacaucgucgccaccuacauccaggagcccaacgaggacugccucuaccucaacgucuacguccccaccgaggacgacauccgcgacuccggcgccaagcccgucauggucuacauccacggcggcuccuacauggagggcaccggcaacaugaucgacggcuccauccucgccuccuacggcaacgucaucgucaucacccucaacuaccgcgucggcguccucggcuuccucuccaccggcgaccaggccgccaagggcaacuacggccuccucgaccagauccaggcccuccgcugggucuccgagaacaucgccuucuucggcggcgacccccgccgcaucaccgucuucggcuccggcaucggcgccuccugcgucucccuccucacccucucccaccacuccgagggccucuuccagcgcgccaucauccaguccggcuccgcccucuccuccugggccgucaacuaccagcccgucaaguacaccucccuccucgccgacaaggucggcugcaacguccucgacaccgucgacauggucgacugccuccgccagaaguccgccaaggagcucgucgagcaggacauccagcccgcccgcuaccacgucgccuucggccccgucaucgacggcgacgucauccccgacgaccccgagauccucauggagcagggcgaguuccucaacuacgacaucaugcucggcgucaaccagggcgagggccucaaguucgucgagggcgucgucgaccccgaggacggcgucuccggcaccgacuucgacuacuccgucuccaacuucgucgacaaccucuacggcuaccccgagggcaaggacacccuccgcgagaccaucaaguucauguacaccgacugggccgaccgcgacaaccccgagacccgccgcaagacccucgucgcccucuucaccgaccaccagugggucgagcccuccgucgucaccgccgaccuccacgcccgcuacggcucccccaccuacuucuacgccuucuaccaccacugccagucccucaugaagcccgccugguccgacgccgcccacggcgacgagguccccuacgucuucggcguccccauggucggccccaccgaccucuuccccugcaacuucuccaagaacgacgucaugcucuccgccgucgucaugaccuacuggaccaacuucgccaagaccggcgaccccaacaagcccgucccccaggacaccaaguucauccacaccaaggccaaccgcuucgaggaggucgccugguccaaguacaacccccgcgaccagcucuaccuccacaucggccucaagccccgcguccgcgaccacuaccgcgccaccaaggucgccuucuggaagcaccucgucccccaccucuacaaccuccacgacauguuccacuacaccuccaccaccaccaagguccccccccccgacaccacccacuccucccacaucacccgccgccccaacggcaagaccugguccaccaagcgccccgccaucucccccgccuacuccaacgagaacgcccagggcuccuggaacggcgaccaggacgccggcccccuccucgucgagaacccccgcgacuacuccaccgagcucuccgucaccaucgccgucggcgccucccuccucuuccucaacguccucgccuucgccgcccucuacuaccgcaaggacaagcgccgccaggagccccuccgccagcccuccccccagcgcggcgccggcgcccccgagcucggcgccgcccccgaggaggagcucgccgcccuccagcucggccccacccaccacgagugcgaggccggccccccccacgacacccuccgccucaccgcccuccccgacuacacccucacccuccgccgcucccccgacgacaucccccucaugacccccaacaccaucaccaugauccccaacucccucgucggccuccagacccuccaccccuacaacaccuucgccgccggcuucaacuccaccggccucccccacucccacuccaccacccgcgucuga

SEQ ID NO: 46687 - RNA, 2451 nt, Artificial Sequence
  derived and/or modified sequence opt2 from NLGN4X__Homo_sapiens__NP_001269075
augucccgcccccagggccuccucuggcucccccuccucuucacccccgucugcgucaugcucaacuccaacguccuccucuggcucaccgcccucgccaucaaguucacccucaucgacucccaggcccaguaccccgucgucaacaccaacuacggcaagauccgcggccuccgcaccccccuccccaacgagauccucggccccgucgagcaguaccucggcguccccuacgccuccccccccaccggcgagcgccgcuuccagccccccgagccccccuccuccuggaccggcauccgcaacaccacccaguucgccgccgucugcccccagcaccucgacgagcgcucccuccuccacgacaugcuccccaucugguucaccgccaaccucgacacccucaugaccuacguccaggaccagaacgaggacugccucuaccucaacaucuacguccccaccgaggacgacauccacgaccagaacuccaagaagcccgucauggucuacauccacggcggcuccuacauggagggcaccggcaacaugaucgacggcuccauccucgccuccuacggcaacgucaucgucaucaccaucaacuaccgccucggcauccucggcuuccucuccaccggcgaccaggccgccaagggcaacuacggccuccucgaccagauccaggcccuccgcuggaucgaggagaacgucggcgccuucggcggcgaccccaagcgcgucaccaucuucggcuccggcgccggcgccuccugcgucucccuccucacccucucccacuacuccgagggccucuuccagaaggccaucauccaguccggcaccgcccucuccuccugggccgucaacuaccagcccgccaaguacacccgcauccucgccgacaaggucggcugcaacaugcucgacaccaccgacauggucgagugccuccgcaacaagaacuacaaggagcucauccagcagaccaucacccccgccaccuaccacaucgccuucggccccgucaucgacggcgacgucauccccgacgacccccagauccucauggagcagggcgaguuccucaacuacgacaucaugcucggcgucaaccagggcgagggccucaaguucgucgacggcaucgucgacaacgaggacggcgucacccccaacgacuucgacuucuccgucuccaacuucgucgacaaccucuacggcuaccccgagggcaaggacacccuccgcgagaccaucaaguucauguacaccgacugggccgacaaggagaaccccgagacccgccgcaagacccucgucgcccucuucaccgaccaccagugggucgcccccgccgucgccaccgccgaccuccacgcccaguacggcucccccaccuacuucuacgccuucuaccaccacugccaguccgagaugaagcccuccugggccgacuccgcccacggcgacgagguccccuacgucuucggcauccccaugaucggccccaccgagcucuucuccugcaacuucuccaagaacgacgucaugcucuccgccgucgucaugaccuacuggaccaacuucgccaagaccggcgaccccaaccagcccgucccccaggacaccaaguucauccacaccaagcccaaccgcuucgaggaggucgccugguccaaguacaaccccaaggaccagcucuaccuccacaucggccucaagccccgcguccgcgaccacuaccgcgccaccaaggucgccuucuggcucgagcucgucccccaccuccacaaccucaacgagaucuuccaguacgucuccaccaccaccaagguccccccccccgacaugaccuccuuccccuacggcacccgccgcucccccgccaagaucuggcccaccaccaagcgccccgccaucacccccgccaacaaccccaagcacuccaaggacccccacaagaccggccccgaggacaccaccguccucaucgagaccaagcgcgacuacuccaccgagcucuccgucaccaucgccgucggcgccucccuccucuuccucaacauccucgccuucgccgcccucuacuacaagaaggacaagcgccgccacgagacccaccgccgccccuccccccagcgcaacaccaccaacgacaucgcccacauccagaacgaggagaucaugucccuccagaugaagcagcucgagcacgaccacgagugcgagucccuccaggcccacgacacccuccgccucaccugcccccccgacuacacccucacccuccgccgcucccccgacgacaucccccucaugacccccaacaccaucaccaugauccccaacacccucaccggcaugcagccccuccacaccuucaacaccuucuccggcggccagaacuccaccaaccucccccacggccacuccaccacccgcgucuga

SEQ ID NO: 46688 - RNA, 1947 nt, Artificial Sequence
  derived and/or modified sequence opt2 from NLGN4Y__Homo_sapiens__NP_001193779
auggucuacauccacggcggcuccuacauggagggcaccggcaacaugaucgacggcuccauccucgccuccuacggcaacgucaucgucaucaccaucaacuaccgccucggcauccucggcuuccucuccaccggcgaccaggccgccaagggcaacuacggccuccucgaccagauccaggcccuccgcuggaucgaggagaacgucggcgccuucggcggcgaccccaagcgcgucaccaucuucggcuccggcgccggcgccuccugcgucucccuccucacccucucccacuacuccgagggccucuuccagaaggccaucauccaguccggcaccgcccucuccuccugggccgucaacuaccagcccgccaaguacacccgcauccucgccgacaaggucggcugcaacaugcucgacaccaccgacauggucgagugccucaagaacaagaacuacaaggagcucauccagcagaccaucacccccgccaccuaccacaucgccuucggccccgucaucgacggcgacgucauccccgacgacccccagauccucauggagcagggcgaguuccucaacuacgacaucaugcucggcgucaaccagggcgagggccucaaguucgucgacggcaucgucgacaacgaggacggcgucacccccaacgacuucgacuucuccgucuccaacuucgucgacaaccucuacggcuaccccgagggcaaggacacccuccgcgagaccaucaaguucauguacaccgacugggccgacaaggagaaccccgagacccgccgcaagacccucgucgcccucuucaccgaccaccagugggucgcccccgccgucgccaccgccgaccuccacgcccaguacggcucccccaccuacuucuacgccuucuaccaccacugccaguccgagaugaagcccuccugggccgacuccgcccacggcgacgagguccccuacgucuucggcauccccaugaucggccccaccgagcucuucuccugcaacuucuccaagaacgacgucaugcucuccgccgucgucaugaccuacuggaccaacuucgccaagaccggcgaccccaaccagcccgucccccaggacaccaaguucauccacaccaagcccaaccgcuucgaggaggucgccugguccaaguacaaccccaaggaccagcucuaccuccacaucggccucaagccccgcguccgcgaccacuaccgcgccaccaaggucgccuucuggcucgagcucgucccccaccuccacaaccucaacgagaucuuccaguacgucuccaccaccaccaagguccccccccccgacaugaccuccuuccccuacggcacccgccgcucccccgccaagaucuggcccaccaccaagcgccccgccaucacccccgccaacaaccccaagcacuccaaggacccccacaagaccggccccgaggacaccaccguccucaucgagaccaagcgcgacuacuccaccgagcucuccgucaccaucgccgucggcgccucccuccucuuccucaacauccucgccuucgccgcccucuacuacaagaaggacaagcgccgccacgagacccaccgccaccccuccccccagcgcaacaccaccaacgacaucacccacauccagaacgaggagaucaugucccuccagaugaagcagcucgagcacgaccacgagugcgagucccuccaggcccacgacacccuccgccucaccugcccccccgacuacacccucacccuccgccgcucccccgacgacauccccuucaugacccccaacaccaucaccaugauccccaacacccucaugggcaugcagccccuccacaccuucaagaccuucuccggcggccagaacuccaccaaccucccccacggccacuccaccacccgcgucuga

SEQ ID NO: 46689 - RNA, 1584 nt, Artificial Sequence
  derived and/or modified sequence opt2 from NLK__Homo_sapiens__NP_057315
augucccucugcggcgcccgcgccaacgccaagaugauggccgccuacaacggcggcaccuccgccgccgccgccggccaccaccaccaccaccaccaccaccucccccaccucccccccccccaccuccaccaccaccaccacccccagcaccaccuccaccccggcuccgccgccgccguccaccccguccagcagcacaccuccuccgccgccgccgccgccgccgccgccgccgccgccgccgccaugcucaaccccggccagcagcagcccuacuuccccucccccgcccccggccaggcccccggccccgccgccgccgcccccgcccagguccaggccgccgccgccgccaccgucaaggcccaccaccaccagcacucccaccacccccagcagcagcucgacaucgagcccgaccgccccaucggcuacggcgccuucggcgucgucugguccgucaccgacccccgcgacggcaagcgcgucgcccucaagaagaugcccaacgucuuccagaaccucgucuccugcaagcgcgucuuccgcgagcucaagaugcucugcuucuucaagcacgacaacguccucuccgcccucgacauccuccagcccccccacaucgacuacuucgaggagaucuacgucgucaccgagcucaugcaguccgaccuccacaagaucaucgucuccccccagccccucuccuccgaccacgucaaggucuuccucuaccagauccuccgcggccucaaguaccuccacuccgccggcauccuccaccgcgacaucaagcccggcaaccuccucgucaacuccaacugcguccucaagaucugcgacuucggccucgcccgcgucgaggagcucgacgagucccgccacaugacccaggaggucgucacccaguacuaccgcgcccccgagauccucaugggcucccgccacuacuccaacgccaucgacaucugguccgucggcugcaucuucgccgagcuccucggccgccgcauccucuuccaggcccagucccccauccagcagcucgaccucaucaccgaccuccucggcacccccucccucgaggccaugcgcaccgccugcgagggcgccaaggcccacauccuccgcggcccccacaagcagcccucccuccccguccucuacacccucuccucccaggccacccacgaggccguccaccuccucugccgcaugcucgucuucgaccccuccaagcgcaucuccgccaaggacgcccucgcccaccccuaccucgacgagggccgccuccgcuaccacaccugcaugugcaagugcugcuucuccaccuccaccggccgcgucuacaccuccgacuucgagcccgucaccaaccccaaguucgacgacaccuucgagaagaaccucuccuccguccgccaggucaaggagaucauccaccaguucauccucgagcagcagaagggcaaccgcgucccccucugcaucaacccccaguccgccgccuucaaguccuucaucuccuccaccgucgcccagcccuccgagaugccccccuccccccucgucugggaguga

SEQ ID NO: 46690 - RNA, 2115 nt, Artificial Sequence
  derived and/or modified sequence opt2 from NLN__Homo_sapiens__NP_065777
augaucgcccgcugccuccucgccguccgcucccuccgccgcgucggcggcucccgcauccuccuccgcaugacccucggccgcgaggucauguccccccuccaggccauguccuccuacaccgucgccggccgcaacguccuccgcugggaccucucccccgagcagaucaagacccgcaccgaggagcucaucguccagaccaagcaggucuacgacgccgucggcaugcucggcaucgaggaggucaccuacgagaacugccuccaggcccucgccgacgucgaggucaaguacaucgucgagcgcaccaugcucgacuucccccagcacgucuccuccgacaaggagguccgcgccgccuccaccgaggccgacaagcgccucucccgcuucgacaucgagauguccaugcgcggcgacaucuucgagcgcaucguccaccuccaggagaccugcgaccucggcaagaucaagcccgaggcccgccgcuaccucgagaaguccaucaagaugggcaagcgcaacggccuccaccuccccgagcagguccagaacgagaucaaguccaugaagaagcgcauguccgagcucugcaucgacuucaacaagaaccucaacgaggacgacaccuuccucgucuucuccaaggccgagcucggcgcccuccccgacgacuucaucgacucccucgagaagaccgacgacgacaaguacaagaucacccucaaguacccccacuacuuccccgucaugaagaagugcugcauccccgagacccgccgccgcauggagauggccuucaacacccgcugcaaggaggagaacaccaucauccuccagcagcuccucccccuccgcaccaaggucgccaagcuccucggcuacuccacccacgccgacuucguccucgagaugaacaccgccaaguccaccucccgcgucaccgccuuccucgacgaccucucccagaagcucaagccccucggcgaggccgagcgcgaguucauccucaaccucaagaagaaggagugcaaggaccgcggcuucgaguacgacggcaagaucaacgccugggaccucuacuacuacaugacccagaccgaggagcucaaguacuccaucgaccaggaguuccucaaggaguacuuccccaucgaggucgucaccgagggccuccucaacaccuaccaggagcuccucggccucuccuucgagcagaugaccgacgcccacgucuggaacaaguccgucacccucuacaccgucaaggacaaggccaccggcgagguccucggccaguucuaccucgaccucuacccccgcgagggcaaguacaaccacgccgccugcuucggccuccagcccggcugccuccuccccgacggcucccgcaugauggccgucgccgcccucgucgucaacuucucccagcccgucgccggccgccccucccuccuccgccacgacgagguccgcaccuacuuccacgaguucggccacgucaugcaccagaucugcgcccagaccgacuucgcccgcuucuccggcaccaacgucgagaccgacuucgucgagguccccucccagaugcucgagaacugggucugggacgucgacucccuccgccgccucuccaagcacuacaaggacggcucccccaucgccgacgaccuccucgagaagcucgucgccucccgccucgucaacaccggccuccucacccuccgccagaucguccucuccaaggucgaccagucccuccacaccaacaccucccucgacgccgccuccgaguacgccaaguacugcuccgagauccucggcgucgccgccacccccggcaccaacaugcccgccaccuucggccaccucgccggcggcuacgacggccaguacuacggcuaccucugguccgaggucuucuccauggacauguucuacuccugcuucaagaaggagggcaucaugaaccccgaggucggcaugaaguaccgcaaccucauccucaagcccggcggcucccucgacggcauggacaugcuccacaacuuccucaagcgcgagcccaaccagaaggccuuccucaugucccgcggccuccacgcccccuga

SEQ ID NO: 46691 - RNA, 3198 nt, Artificial Sequence
  derived and/or modified sequence opt2 from NLRC3__Homo_sapiens__NP_849172
augcgcaagcaggagguccgcaccggccgcgaggccggccagggccacggcaccggcucccccgccgagcaggucaaggcccucauggaccuccucgccggcaagggcucccagggcucccaggccccccaggcccucgaccgcacccccgacgccccccucggccccugcuccaacgacucccgcauccagcgccaccgcaaggcccuccucuccaaggucggcggcggccccgagcucggcggccccuggcaccgccucgccucccuccuccucgucgagggccucaccgaccuccagcuccgcgagcacgacuucacccaggucgaggccacccgcggcggcggccaccccgcccgcaccgucgcccucgaccgccucuuccucccccucucccgcgucuccguccccccccgcgucuccaucaccaucggcgucgccggcaugggcaagaccacccucguccgccacuucguccgccucugggcccacggccaggucggcaaggacuucucccucguccucccccucaccuuccgcgaccucaacacccacgagaagcucugcgccgaccgccucaucugcuccgucuucccccacgucggcgagcccucccucgccgucgccguccccgcccgcgcccuccucauccucgacggccucgacgagugccgcaccccccucgacuucuccaacaccgucgccugcaccgaccccaagaaggagauccccgucgaccaccucaucaccaacaucauccgcggcaaccucuuccccgaggucuccaucuggaucaccucccgccccuccgccuccggccagauccccggcggccucgucgaccgcaugaccgagauccgcggcuucaacgaggaggagaucaaggucugccucgagcagauguuccccgaggaccaggcccuccucggcuggaugcucucccagguccaggccgaccgcgcccucuaccucaugugcaccguccccgccuucugccgccucaccggcauggcccucggccaccucuggcgcucccgcaccggcccccaggacgccgagcucuggcccccccgcacccucugcgagcucuacuccugguacuuccgcauggcccucuccggcgagggccaggagaagggcaaggccuccccccgcaucgagcaggucgcccacggcggccgcaagauggucggcacccucggccgccucgccuuccacggccuccucaagaagaaguacgucuucuacgagcaggacaugaaggccuucggcgucgaccucgcccuccuccagggcgcccccugcuccugcuuccuccagcgcgaggagacccucgccuccuccgucgccuacugcuucacccaccucucccuccaggaguucgucgccgccgccuacuacuacggcgccucccgccgcgccaucuucgaccucuucaccgaguccggcgucuccuggccccgccucggcuuccucacccacuuccgcuccgccgcccagcgcgccaugcaggccgaggacggccgccucgacgucuuccuccgcuuccucuccggccuccucuccccccgcgucaacgcccuccucgccggcucccuccucgcccagggcgagcaccaggccuaccgcacccaggucgccgagcuccuccagggcugccuccgccccgacgccgccgucugcgcccgcgccaucaacguccuccacugccuccacgagcuccagcacaccgagcucgcccgcuccgucgaggaggccauggaguccggcgcccucgcccgccucaccggccccgcccaccgcgccgcccucgccuaccuccuccaggucuccgacgccugcgcccaggaggccaaccucucccucucccucucccagggcguccuccagucccuccucccccagcuccucuacugccgcaagcuccgccucgacaccaaccaguuccaggaccccgucauggagcuccucggcuccguccucuccggcaaggacugccgcauccagaagaucucccucgccgagaaccagaucuccaacaagggcgccaaggcccucgcccgcucccuccucgucaaccgcucccucaccucccucgaccuccgcggcaacuccaucggcccccagggcgccaaggcccucgccgacgcccucaagaucaaccgcacccucaccucccucucccuccagggcaacaccguccgcgacgacggcgcccgcuccauggccgaggcccucgccuccaaccgcacccucuccaugcuccaccuccagaagaacuccaucggccccaugggcgcccagcgcauggccgacgcccucaagcagaaccgcucccucaaggagcucauguucuccuccaacuccaucggcgacggcggcgccaaggcccucgccgaggcccucaaggucaaccagggccucgagucccucgaccuccaguccaacuccaucuccgacgccggcgucgccgcccucaugggcgcccucugcaccaaccagacccuccucucccucucccuccgcgagaacuccaucucccccgagggcgcccaggccaucgcccacgcccucugcgccaacuccacccucaagaaccucgaccucaccgccaaccuccuccacgaccagggcgcccgcgccaucgccgucgccguccgcgagaaccgcacccucaccucccuccaccuccaguggaacuucauccaggccggcgccgcccaggcccucggccaggcccuccagcucaaccgcucccucaccucccucgaccuccaggagaacgccaucggcgacgacggcgccugcgccgucgcccgcgcccucaaggucaacaccgcccucaccgcccucuaccuccaggucgccuccaucggcgccuccggcgcccagguccucggcgaggcccucgccgucaaccgcacccucgagauccucgaccuccgcggcaacgccaucggcgucgccggcgccaaggcccucgccaacgcccucaaggucaacuccucccuccgccgccucaaccuccaggagaacucccucggcauggacggcgccaucugcaucgccaccgcccucuccggcaaccaccgccuccagcacaucaaccuccagggcaaccacaucggcgacuccggcgcccgcaugaucuccgaggccaucaagaccaacgcccccaccugcaccgucgagauguga

SEQ ID NO: 46692 - RNA, 3075 nt, Artificial Sequence
  derived and/or modified sequence opt2 from NLRC4__Homo_sapiens__NP_001186068
augaacuucaucaaggacaacucccgcgcccucauccagcgcaugggcaugaccgucaucaagcagaucaccgacgaccucuucgucuggaacguccucaaccgcgaggaggucaacaucaucugcugcgagaaggucgagcaggacgccgcccgcggcaucauccacaugauccucaagaagggcuccgaguccugcaaccucuuccucaagucccucaaggaguggaacuacccccucuuccaggaccucaacggccagucccucuuccaccagaccuccgagggcgaccucgacgaccucgcccaggaccucaaggaccucuaccacacccccuccuuccucaacuucuacccccucggcgaggacaucgacaucaucuucaaccucaaguccaccuucaccgagcccguccucuggcgcaaggaccagcaccaccaccgcgucgagcagcucacccucaacggccuccuccaggcccuccagucccccugcaucaucgagggcgaguccggcaagggcaaguccacccuccuccagcgcaucgccaugcucuggggcuccggcaagugcaaggcccucaccaaguucaaguucgucuucuuccuccgccucucccgcgcccagggcggccucuucgagacccucugcgaccagcuccucgacauccccggcaccauccgcaagcagaccuucauggccaugcuccucaagcuccgccagcgcguccucuuccuccucgacggcuacaacgaguucaagccccagaacugccccgagaucgaggcccucaucaaggagaaccaccgcuucaagaacauggucaucgucaccaccaccaccgagugccuccgccacauccgccaguucggcgcccucaccgccgaggucggcgacaugaccgaggacuccgcccaggcccucauccgcgagguccucaucaaggagcucgccgagggccuccuccuccagauccagaagucccgcugccuccgcaaccucaugaagaccccccucuucgucgucaucaccugcgccauccagaugggcgaguccgaguuccacucccacacccagaccacccucuuccacaccuucuacgaccuccucauccagaagaacaagcacaagcacaagggcgucgccgccuccgacuucauccgcucccucgaccacugcggcgaccucgcccucgagggcgucuucucccacaaguucgacuucgagcuccaggacgucuccuccgucaacgaggacguccuccucaccaccggccuccucugcaaguacaccgcccagcgcuucaagcccaaguacaaguucuuccacaaguccuuccaggaguacaccgccggccgccgccucuccucccuccucaccucccacgagcccgaggaggucaccaagggcaacggcuaccuccagaagauggucuccaucuccgacaucaccuccaccuacuccucccuccuccgcuacaccugcggcuccuccgucgaggccacccgcgccgucaugaagcaccucgccgccgucuaccagcacggcugccuccucggccucuccaucgccaagcgcccccucuggcgccaggagucccuccaguccgucaagaacaccaccgagcaggagauccucaaggccaucaacaucaacuccuucgucgagugcggcauccaccucuaccaggaguccaccuccaaguccgcccucucccaggaguucgaggccuucuuccagggcaagucccucuacaucaacuccggcaacauccccgacuaccucuucgacuucuucgagcaccuccccaacugcgccuccgcccucgacuucaucaagcucgacuucuacggcggcgccauggccuccugggagaaggccgccgaggacaccggcggcauccacauggaggaggcccccgagaccuacauccccucccgcgccgucucccucuucuucaacuggaagcaggaguuccgcacccucgaggucacccuccgcgacuucuccaagcucaacaagcaggacauccgcuaccucggcaagaucuucuccuccgccaccucccuccgccuccagaucaagcgcugcgccggcgucgccggcucccucucccucguccucuccaccugcaagaacaucuacucccucauggucgaggccuccccccucaccaucgaggacgagcgccacaucaccuccgucaccaaccucaagacccucuccauccacgaccuccagaaccagcgccuccccggcggccucaccgacucccucggcaaccucaagaaccucaccaagcucaucauggacaacaucaagaugaacgaggaggacgccaucaagcucgccgagggccucaagaaccucaagaagaugugccucuuccaccucacccaccucuccgacaucggcgagggcauggacuacaucgucaagucccucuccuccgagcccugcgaccucgaggagauccagcucgucuccugcugccucuccgccaacgccgucaagauccucgcccagaaccuccacaaccucgucaagcucuccauccucgaccucuccgagaacuaccucgagaaggacggcaacgaggcccuccacgagcucaucgaccgcaugaacguccucgagcagcucaccgcccucaugcuccccuggggcugcgacguccagggcucccucuccucccuccucaagcaccucgaggaggucccccagcucgucaagcucggccucaagaacuggcgccucaccgacaccgagauccgcauccucggcgccuucuucggcaagaacccccucaagaacuuccagcagcucaaccucgccggcaaccgcgucuccuccgacggcuggcucgccuucaugggcgucuucgagaaccucaagcagcucgucuucuucgacuucuccaccaaggaguuccuccccgaccccgcccucguccgcaagcucucccagguccucuccaagcucaccuuccuccaggaggcccgccucgucggcuggcaguucgacgacgacgaccucuccgucaucaccggcgccuucaagcucgucaccgccuga

SEQ ID NO: 46693 - RNA, 5601 nt, Artificial Sequence
  derived and/or modified sequence opt2 from NLRC5__Homo_sapiens__XP_005256251
auggaccccgucggccuccagcucggcaacaagaaccucugguccugccucguccgccuccucaccaaggaccccgaguggcucaacgccaagaugaaguucuuccuccccaacaccgaccucgacucccgcaacgagacccucgaccccgagcagcgcgucauccuccagcucaacaagcuccacguccagggcuccgacaccuggcaguccuucauccacugcgucugcaugcagcucgaggucccccucgaccucgagguccuccuccucuccaccuucggcuacgacgacggcuucaccucccagcucggcgccgagggcaagucccagcccgagucccagcuccaccacggccucaagcgcccccaccaguccugcggcuccuccccccgccgcaagcagugcaagaagcagcagcucgagcucgccaagaaguaccuccagcuccuccgcaccuccgcccagcagcgcuaccgcucccagauccccggcuccggccagccccacgccuuccaccaggucuacgucccccccauccuccgccgcgccaccgccucccucgacacccccgagggcgccaucaugggcgacgucaaggucgaggacggcgccgacgucuccaucuccgaccucuucaacacccgcgucaacaagggcccccgcgucaccguccuccucggcaaggccggcaugggcaagaccacccucgcccaccgccucugccagaagugggccgagggccaccucaacugcuuccaggcccucuuccucuucgaguuccgccagcucaaccucaucacccgcuuccucacccccuccgagcuccucuucgaccucuaccucucccccgaguccgaccacgacaccgucuuccaguaccucgagaagaacgccgaccagguccuccucaucuucgacggccucgacgaggcccuccagcccaugggccccgacggccccggccccguccucacccucuucucccaccucugcaacggcacccuccuccccggcugccgcgucauggccaccucccgccccggcaagcuccccgccugccuccccgccgaggccgccaugguccacaugcucggcuucgacggcccccgcgucgaggaguacgucaaccacuucuucuccgcccagcccucccgcgagggcgcccucgucgagcuccagaccaacggccgccuccgcucccucugcgccguccccgcccucugccaggucgccugccucugccuccaccaccuccuccccgaccacgcccccggccaguccgucgcccuccuccccaacaugacccagcucuacaugcagaugguccucgcccucuccccccccggccaccuccccaccuccucccuccucgaccucggcgaggucgcccuccgcggccucgagaccggcaaggucaucuucuacgccaaggacaucgcccccccccucaucgccuucggcgccacccacucccuccucaccuccuucugcgucugcaccggccccggccaccagcagaccggcuacgccuucacccaccucucccuccaggaguuccucgccgcccuccaccucauggccucccccaaggucaacaaggacacccucacccaguacgucacccuccacucccgcuggguccagcgcaccaaggcccgccucggccucuccgaccaccuccccaccuuccucgccggccucgccuccugcaccugccgccccuuccucucccaccucgcccagggcaacgaggacugcgucggcgccaagcaggccgccgucguccagguccucaagaagcucgccacccgcaagcucaccggccccaaggucgucgagcucugccacugcgucgacgagacccaggagcccgagcucgccucccucaccgcccagucccuccccuaccagcuccccuuccacaacuucccccucaccugcaccgaccucgccacccucaccaacauccucgagcaccgcgaggcccccauccaccucgacuucgacggcugcccccucgagccccacugccccgaggcccucgucggcugcggccagaucgagaaccucuccuucaagucccgcaagugcggcgacgccuucgccgaggcccucucccgcucccuccccaccaugggccgccuccagaugcucggccucgccggcuccaagaucaccgcccgcggcaucucccaccucgucaaggcccucccccucugcccccagcucaaggaggucuccuuccgcgacaaccagcucuccgaccaggucguccucaacaucgucgagguccucccccaccucccccgccuccgcaagcucgaccucuccuccaacuccaucugcgucuccacccuccucugccucgcccgcgucgccgucaccugccccaccguccgcaugcuccaggcccgcgaggccgaccucaucuuccuccucuccccccccaccgagaccaccgccgagcuccagcgcgcccccgaccuccaggaguccgacggccagcgcaagggcgcccagucccgcucccucacccuccgccuccagaagugccagcuccagguccacgacgccgaggcccucaucgcccuccuccaggagggcccccaccucgaggaggucgaccucuccggcaaccagcucgaggacgagggcugccgccucauggccgaggccgccucccagcuccacaucgcccgcaagcucgaccucuccaacaacggccucuccgucgccggcguccacugcguccuccgcgccgucuccgccugcuggacccucgccgagcuccacaucucccuccagcacaagaccgucaucuucauguucgcccaggagcccgaggagcagaagggcccccaggagcgcgccgccuuccucgacucccucaugcuccagaugcccuccgagcucccccucuccucccgccgcaugcgccucacccacugcggccuccaggagaagcaccucgagcagcucugcaaggcccucggcggcuccugccaccucggccaccuccaccucgacuucuccggcaacgcccucggcgacgagggcgccgcccgccucgcccagcuccuccccggccucggcgcccuccagucccucaaccucuccgagaacggccucucccucgacgccguccucggccucguccgcugcuucuccacccuccaguggcucuuccgccucgacaucuccuucgagucccagcacauccuccuccgcggcgacaagaccucccgcgacaugugggccaccggcucccuccccgacuuccccgccgccgccaaguuccucggcuuccgccagcgcugcaucccccgcucccucugccucuccgagugcccccucgagccccccucccucacccgccucugcgccacccucaaggacugccccggcccccucgagcuccagcucuccugcgaguuccucuccgaccagucccucgagacccuccucgacugccucccccagcucccccagcucucccuccuccagcucucccagaccggccucucccccaagucccccuuccuccucgccaacacccucucccucugcccccgcgucaagaaggucgaccuccgcucccuccaccacgccacccuccacuuccgcuccaacgaggaggaggagggcgucugcugcggccgcuucaccggcugcucccucucccaggagcacgucgagucccucugcuggcuccucuccaagugcaaggaccucucccaggucgaccucuccgccaaccuccucggcgacuccggccuccgcugccuccucgagugccucccccagguccccaucuccggccuccucgaccucucccacaacuccaucucccaggaguccgcccucuaccuccucgagacccuccccuccugcccccgcguccgcgaggccuccgucaaccucggcuccgagcaguccuuccgcauccacuucucccgcgaggaccaggccggcaagacccuccgccucuccgagugcuccuuccgccccgagcacgucucccgccucgccaccggccucuccaagucccuccagcucaccgagcucacccucacccagugcugccucggccagaagcagcucgccauccuccucucccucgucggccgccccgccggccucuucucccuccgcguccaggagcccugggccgaccgcgcccgcguccucucccuccucgaggucugcgcccaggccuccggcuccgucaccgagaucuccaucuccgagacccagcagcagcucugcguccagcucgaguucccccgccaggaggagaaccccgaggccgucgcccuccgccucgcccacugcgaccucggcgcccaccacucccuccucgucggccagcucauggagaccugcgcccgccuccagcagcucucccucucccaggucaaccucugcgaggacgacgacgccuccucccuccuccuccagucccuccuccucucccucuccgagcucaagaccuuccgccucaccuccuccugcgucuccaccgagggccucgcccaccucgccuccggccucggccacugccaccaccucgaggagcucgaccucuccaacaaccaguucgacgaggagggcaccaaggcccucaugcgcgcccucgagggcaaguggaugcucaagcgccucgaccucucccaccuccuccucaacuccuccacccucgcccuccucacccaccgccucucccagaugaccugccuccagucccuccgccucaaccgcaacuccaucggcgacgucggcugcugccaccucuccgaggcccuccgcgccgccaccucccucgaggagcucgaccucucccacaaccagaucggcgacgccggcguccagcaccucgccaccauccuccccggccuccccgagcuccgcaagaucgaccucuccggcaacuccaucuccuccgccggcggcguccagcucgccgagucccucguccucugccgccgccucgaggagcucaugcucggcugcaacgcccucggcgaccccaccgcccucggccucgcccaggagcucccccagcaccuccgcguccuccaccuccccuucucccaccucggccccggcggcgcccucucccucgcccaggcccucgacggcuccccccaccucgaggagaucucccucgccgagaacaaccucgccggcggcguccuccgcuucugcauggagcucccccuccuccgccagaucgaccucgucuccugcaagaucgacaaccagaccgccaagcuccucaccuccuccuucaccuccugccccgcccucgaggucauccuccucuccuggaaccuccucggcgacgaggccgccgccgagcucgcccagguccucccccagaugggccgccucaagcgcgucgaccucgagaagaaccagaucaccgcccucggcgccuggcuccucgccgagggccucgcccagggcuccuccauccaggucauccgccucuggaacaaccccauccccugcgacauggcccagcaccucaagucccaggagccccgccucgacuucgccuucuucgacaaccagccccaggcccccuggggcaccuga

SEQ ID NO: 46694 - RNA, 1968 nt, Artificial Sequence
  derived and/or modified sequence opt2 from NLRP10__Homo_sapiens__XP_011518345
auggccauggccaaggcccgcaagccccgcgaggcccuccucugggcccucuccgaccucgaggagaacgacuucaagaagcucaaguucuaccuccgcgacaugacccucuccgagggccagcccccccucgcccgcggcgagcucgagggccucauccccgucgaccucgccgagcuccucaucuccaaguacggcgagaaggaggccgucaaggucguccucaagggccucaaggucaugaaccuccucgagcucgucgaccagcucucccacaucugccuccacgacuaccgcgaggucuaccgcgagcacguccgcugccucgaggaguggcaggaggccggcgucaacggccgcuacaaccagguccuccucgucgccaagcccuccuccgagucccccgagucccucgccugccccuuccccgagcaggagcucgaguccgucaccgucgaggcccucuucgacuccggcgagaagcccucccucgcccccucccucgucguccuccagggcuccgccggcaccggcaagaccacccucgcccgcaagaugguccucgacugggccaccggcacccucuaccccggccgcuucgacuacgucuucuacgucuccugcaaggaggucguccuccuccucgaguccaagcucgagcagcuccucuucuggugcugcggcgacaaccaggcccccgucaccgagauccuccgccagcccgagcgccuccucuucauccucgacggcuucgacgagcuccagcgccccuucgaggagaagcucaagaagcgcggccucucccccaaggagucccuccuccaccuccucauccgccgccacacccuccccaccugcucccuccucaucaccacccgcccccucgcccuccgcaaccucgagccccuccucaagcaggcccgccacguccacauccucggcuucuccgaggaggagcgcgcccgcuacuucuccuccuacuucaccgacgagaagcaggccgaccgcgccuucgacaucguccagaagaacgacauccucuacaaggccugccagguccccggcaucugcugggucgucugcuccuggcuccagggccagauggagcgcggcaaggucguccucgagaccccccgcaacuccaccgacaucuucauggccuacgucuccaccuuccucccccccgacgacgacggcggcugcuccgagcucucccgccaccgcguccuccgcucccucugcucccucgccgccgagggcauccagcaccagcgcuuccucuucgaggaggccgagcuccgcaagcacaaccucgacggcccccgccucgccgccuuccucuccuccaacgacuaccagcucggccucgccaucaagaaguucuacuccuuccgccacaucuccuuccaggacuucuuccacgccauguccuaccucgucaaggaggaccagucccgccucggcaaggagucccgccgcgagguccagcgccuccucgaggucaaggagcaggagggcaacgacgagaugacccucaccaugcaguuccuccucgacaucuccaagaaggacuccuucuccaaccucgagcucaaguucugcuuccgcaucucccccugccucgcccaggaccucaagcacuucaaggagcagauggaguccaugaagcacaaccgcaccugggaccucgaguucucccucuacgaggccaagaucaagaaccucgucaagggcauccagaugaacaacgucuccuucaagaucaagcacuccaacgagaagaagucccagucccagaaccucuucuccgucaaguccucccucucccacggccccaaggaggagcagaagugccccuccguccacggccagaaggagggcaaggacaacaucgccggcacccagaaggaggccuccaccggcaagggccgcggcaccgaggagacccccaagaacaccuacaucuga

SEQ ID NO: 46695 - RNA, 3102 nt, Artificial Sequence
  derived and/or modified sequence opt2 from NLRP11__Homo_sapiens__NP_659444
auggccgaguccgacuccaccgacuucgaccuccucugguaccucgagaaccucuccgacaaggaguuccaguccuucaagaaguaccucgcccgcaagauccucgacuucaagcucccccaguucccccucauccagaugaccaaggaggagcucgccaacguccuccccaucuccuacgagggccaguacaucuggaacaugcucuucuccaucuucuccaugaugcgcaaggaggaccucugccgcaagaucaucggccgccgcaaccgcaaccaggaggccugcaaggccgucaugcgccgcaaguucaugcuccagugggagucccacaccuucggcaaguuccacuacaaguucuuccgcgacgucuccuccgacgucuucuacauccuccagcucgccuacgacuccaccuccuacuacuccgccaacaaccucaacgucuuccucaugggcgagcgcgccuccggcaagaccaucgucaucaaccucgccguccuccgcuggaucaagggcgagauguggcagaacaugaucuccuacgucguccaccucaccgcccacgagaucaaccagaugaccaacuccucccucgccgagcucaucgccaaggacuggcccgacggccaggcccccaucgccgacauccucuccgaccccaagaagcuccucuucauccucgaggaccucgacaacauccgcuucgagcucaacgucaacgaguccgcccucugcuccaacuccacccagaagguccccauccccguccuccucgucucccuccucaagcgcaagauggcccccggcugcugguuccucaucuccucccgccccacccgcggcaacaacgucaagaccuuccucaaggaggucgacugcugcaccacccuccagcucuccaacggcaagcgcgagaucuacuucaacuccuucuucaaggaccgccagcgcgccuccgccgcccuccagcucguccacgaggacgagauccucgucggccucugccgcgucgccauccucugcuggaucaccugcaccguccucaagcgccagauggacaagggccgcgacuuccagcucugcugccagacccccaccgaccuccacgcccacuuccucgccgacgcccucaccuccgaggccggccucaccgccaaccaguaccaccucggccuccucaagcgccucugccuccucgccgccggcggccucuuccucuccacccucaacuucuccggcgaggaccuccgcugcgucggcuucaccgaggccgacgucuccguccuccaggccgccaacauccuccuccccuccaacacccacaaggaccgcuacaaguucauccaccucaacguccaggaguucugcaccgccaucgccuuccucauggccguccccaacuaccucauccccuccggcucccgcgaguacaaggagaagcgcgagcaguacuccgacuucaaccaggucuucaccuucaucuucggccuccucaacgccaaccgccgcaagauccucgagaccuccuucggcuaccagcuccccauggucgacuccuucaagugguacuccgucggcuacaugaagcaccucgaccgcgaccccgagaagcucacccaccacaugccccucuucuacugccucuacgagaaccgcgaggaggaguucgucaagaccaucgucgacgcccucauggaggucaccgucuaccuccaguccgacaaggacaugauggucucccucuacugccucgacuacugcugccaccuccgcacccucaagcucuccguccagcgcaucuuccagaacaaggagccccucauccgccccaccgccucccagaugaagucccucgucuacuggcgcgagaucugcucccucuucuacaccauggagucccuccgcgagcuccacaucuucgacaacgaccucaacggcaucuccgagcgcauccucuccaaggcccucgagcacuccuccugcaagcuccgcacccucaagcucuccuacgucuccaccgccuccggcuucgaggaccuccucaaggcccucgcccgcaaccgcucccucaccuaccucuccaucaacugcaccuccaucucccucaacauguucucccuccuccacgacauccuccacgagcccaccugccagaucucccaccucucccucaugaagugcgaccuccgcgccuccgagugcgaggagaucgccucccuccucaucuccggcggcucccuccgcaagcucacccucuccuccaacccccuccgcuccgacggcaugaacauccucugcgacgcccuccuccaccccaacugcacccucaucucccucguccucgucuucugcugccucaccgagaacugcugcuccgcccucggccgcguccuccucuucucccccacccuccgccagcucgaccucugcgucaaccgccucaagaacuacggcguccuccacgucaccuucccccuccucuuccccaccugccagcucgaggagcuccaccucuccggcugcuucuucuccuccgacaucugccaguacaucgccaucgucaucgccaccaacgagaagcuccgcucccucgagaucggcuccaacaagaucgaggacgccggcaugcagcuccucugcggcggccuccgccaccccaacugcaugcucgucaacaucggccucgaggagugcaugcucaccuccgccugcugccgcucccucgccuccguccucaccaccaacaagacccucgagcgccucaaccuccuccagaaccaccucggcaacgacggcgucgccaagcuccucgagucccucaucucccccgacugcguccucaaggucgucggccucccccucaccggccucaacacccagacccagcagcuccucaugaccgucaaggagcgcaagcccucccucaucuuccucuccgagaccuggucccucaaggagggccgcgagaucggcgucacccccgccucccagcccggcuccaucauccccaacuccaaccucgacuacauguucuucaaguucccccgcauguccgccgccaugcgcaccuccaacaccgccucccgccagccccucuga

SEQ ID NO: 46696 - RNA, 3189 nt, Artificial Sequence
  derived and/or modified sequence opt2 from NLRP12__Homo_sapiens__NP_001264055
augcuccgcaccgccggccgcgacggccucugccgccucuccaccuaccucgaggagcucgaggccgucgagcucaagaaguucaagcucuaccucggcaccgccaccgagcucggcgagggcaagauccccuggggcuccauggagaaggccggcccccucgagauggcccagcuccucaucacccacuucggccccgaggaggccuggcgccucgcccucuccaccuucgagcgcaucaaccgcaaggaccucugggagcgcggccagcgcgaggaccucguccgcgacaccccccccggcggccccuccucccucggcaaccaguccaccugccuccucgaggucucccucgucaccccccgcaaggacccccaggagaccuaccgcgacuacguccgccgcaaguuccgccucauggaggaccgcaacgcccgccucggcgagugcgucaaccucucccaccgcuacacccgccuccuccucgucaaggagcacuccaaccccaugcagguccagcagcagcuccucgacaccggccgcggccacgcccgcaccgucggccaccaggccucccccaucaagaucgagacccucuucgagcccgacgaggagcgccccgagcccccccgcaccgucgucaugcagggcgccgccggcaucggcaaguccaugcucgcccacaaggucaugcucgacugggccgacggcaagcucuuccagggccgcuucgacuaccucuucuacaucaacugccgcgagaugaaccaguccgccaccgagugcuccaugcaggaccucaucuucuccugcuggcccgagcccuccgccccccuccaggagcucauccgcguccccgagcgccuccucuucaucaucgacggcuucgacgagcucaagcccuccuuccacgacccccagggccccuggugccucugcugggaggagaagcgccccaccgagcuccuccucaacucccucauccgcaagaagcuccuccccgagcucucccuccucaucaccacccgccccaccgcccucgagaagcuccaccgccuccucgagcacccccgccacgucgagauccucggcuucuccgaggccgagcgcaaggaguacuucuacaaguacuuccacaacgccgagcaggccggccaggucuucaacuacguccgcgacaacgagccccucuucaccaugugcuucgucccccucgucugcugggucgucugcaccugccuccagcagcagcucgagggcggcggccuccuccgccagaccucccgcaccaccaccgccgucuacaugcucuaccuccucucccucaugcagcccaagcccggcgccccccgccuccagcccccccccaaccagcgcggccucugcucccucgccgccgacggccucuggaaccagaagauccucuucgaggagcaggaccuccgcaagcacggccucgacggcgaggacgucuccgccuuccucaacaugaacaucuuccagaaggacaucaacugcgagcgcuacuacuccuucauccaccucuccuuccaggaguucuucgccgccauguacuacauccucgacgagggcgagggcggcgccggccccgaccaggacgucacccgccuccucaccgaguacgccuucuccgagcgcuccuuccucgcccucaccucccgcuuccucuucggccuccucaacgaggagacccgcucccaccucgagaagucccucugcuggaaggucuccccccacaucaagauggaccuccuccaguggauccaguccaaggcccaguccgacggcuccacccuccagcagggcucccucgaguucuucuccugccucuacgagauccaggaggaggaguucauccagcaggcccucucccacuuccaggucaucgucgucuccaacaucgccuccaagauggagcacauggucuccuccuucugccucaagcgcugccgcuccgcccagguccuccaccucuacggcgccaccuacuccgccgacggcgaggaccgcgcccgcugcuccgccggcgcccacacccuccucguccagcuccgccccgagcgcaccguccuccucgacgccuacuccgagcaccucgccgccgcccucugcaccaaccccaaccucaucgagcucucccucuaccgcaacgcccucggcucccgcggcgucaagcuccucugccagggccuccgccaccccaacugcaagcuccagaaccuccgccucaagcgcugccgcaucuccuccuccgccugcgaggaccucuccgccgcccucaucgccaacaagaaccucacccgcauggaccucuccggcaacggcgucggcuuccccggcaugaugcuccucugcgagggccuccgccacccccagugccgccuccagaugauccagcuccgcaagugccagcucgaguccggcgccugccaggagauggccuccguccucggcaccaacccccaccucgucgagcucgaccucaccggcaacgcccucgaggaccucggccuccgccuccucugccagggccuccgccaccccgucugccgccuccgcacccucuggcucaagaucugccgccucaccgccgccgccugcgacgagcucgccuccacccucuccgucaaccagucccuccgcgagcucgaccucucccucaacgagcucggcgaccucggcguccuccuccucugcgagggccuccgccaccccaccugcaagcuccagacccuccgccucggcaucugccgccucggcuccgccgccugcgagggccucuccgucguccuccaggccaaccacaaccuccgcgagcucgaccucuccuucaacgaccucggcgacuggggccucuggcuccucgccgagggccuccagcaccccgccugccgccuccagaagcucuggcucgacuccugcggccucaccgccaaggccugcgagaaccucuacuucacccucggcaucaaccagacccucaccgaccucuaccucaccaacaacgcccucggcgacaccggcguccgccuccucugcaagcgccucucccaccccggcugcaagcuccgcguccucuggcucuucggcauggaccucaacaagaugacccacucccgccucgccgcccuccgcgucaccaagcccuaccucgacaucggcugcuga

SEQ ID NO: 46697 - RNA, 3132 nt, Artificial Sequence
  derived and/or modified sequence opt2 from NLRP13__Homo_sapiens__NP_789780
augaacuucuccgucaucaccugccccaacggcggcaccaaccagggccuccuccccuaccucauggcccucgaccaguaccagcucgaggaguucaagcucugccucgagccccagcagcucauggacuucugguccgccccccagggccacuucccccgcauccccugggccaaccuccgcgccgccgacccccucaaccucuccuuccuccucgacgagcacuuccccaagggccaggccuggaaggucguccucggcaucuuccagaccaugaaccucaccucccucugcgagaagguccgcgccgagaugaaggagaacguccagacccaggagcuccaggaccccacccaggaggaccucgagaugcucgaggccgccgccggcaacaugcagacccagggcugccaggaccccaaccaggaggagcucgacgagcucgaggaggagaccggcaacguccaggcccagggcugccaggaccccaaccaggaggagcccgagaugcucgaggaggccgaccaccgccgcaaguaccgcgagaacaugaaggccgagcuccucgagaccugggacaacaucuccuggcccaaggaccacgucuacauccgcaacaccuccaaggacgagcacgaggagcuccagcgccuccucgaccccaaccgcacccgcgcccaggcccagaccaucguccucgucggccgcgccggcgucggcaagaccacccucgccaugcaggccaugcuccacugggccaacggcguccucuuccagcagcgcuucuccuacgucuucuaccucuccugccacaagauccgcuacaugaaggagaccaccuucgccgagcucaucucccucgacuggcccgacuucgacgcccccaucgaggaguucaugucccagcccgagaagcuccucuucaucaucgacggcuucgaggagaucaucaucuccgagucccgcuccgagucccucgacgacggcucccccugcaccgacugguaccaggagcuccccgucaccaagauccuccacucccuccucaagaaggagcucgucccccucgccacccuccucaucaccaucaagaccugguucguccgcgaccucaaggccucccucgucaaccccugcuucguccagaucaccggcuucaccggcgacgaccuccgcgucuacuucaugcgccacuucgacgacuccuccgaggucgagaagauccuccagcagcuccgcaagaacgagacccucuuccacuccugcuccgcccccauggucugcuggaccgucugcuccugccucaagcagcccaagguccgcuacuacgaccuccaguccaucacccagaccaccaccucccucuacgccuacuucuucuccaaccucuucuccaccgccgaggucgaccucgccgacgacuccuggcccggccaguggcgcgcccucugcucccucgccaucgagggccucugguccaugaacuucaccuucaacaaggaggacaccgagaucgagggccucgagguccccuucaucgacucccucuacgaguucaacauccuccagaagaucaacgacugcggcggcugcaccaccuucacccaccucuccuuccaggaguucuucgccgccauguccuucguccucgaggagccccgcgaguuccccccccacuccaccaagccccaggagaugaagaugcuccuccagcacguccuccucgacaaggaggccuacuggacccccgucguccucuucuucuucggccuccucaacaagaacaucgcccgcgagcucgaggacacccuccacugcaagaucuccccccgcgucauggaggagcuccucaaguggggcgaggagcucggcaaggccgaguccgccucccuccaguuccacauccuccgccucuuccacugccuccacgagucccaggaggaggacuucaccaagaagaugcucggccgcaucuucgaggucgaccucaacauccucgaggacgaggagcuccaggccuccuccuucugccucaagcacugcaagcgccucaacaagcuccgccucuccgucuccucccacauccucgagcgcgaccucgagauccucgagaccuccaaguucgacucccgcaugcacgccuggaacuccaucugcuccacccucgucaccaacgagaaccuccacgagcucgaccucuccaacuccaagcuccacgccuccuccgucaagggccucugccucgcccucaagaacccccgcugcaagguccagaagcucaccugcaaguccgucacccccgaguggguccuccaggaccucaucaucgcccuccagggcaacuccaagcucacccaccucaacuucuccuccaacaagcucggcaugaccgucccccucauccucaaggcccuccgccacuccgccugcaaccucaaguaccucugccucgagaagugcaaccucuccgccgccuccugccaggaccucgcccucuuccucaccuccauccagcacgucacccgccucugccucggcuucaaccgccuccaggacgacggcaucaagcuccucugcgccgcccucacccaccccaagugcgcccucgagcgccucgagcucugguucugccagcucgccgcccccgccugcaagcaccucuccgacgcccuccuccagaaccgcucccucacccaccucaaccucuccaagaacucccuccgcgacgagggcgucaaguuccucugcgaggcccucggccgccccgacggcaaccuccagucccucaaccucuccggcugcuccuucacccgcgagggcugcggcgagcucgccaacgcccucucccacaaccacaacgucaagauccucgaccucggcgagaacgaccuccaggacgacggcgucaagcuccucugcgaggcccucaagccccaccgcgcccuccacacccucggccucgccaagugcaaccucaccaccgccugcugccagcaccucuucuccguccucuccuccuccaagucccucgucaaccucaaccuccucggcaacgagcucgacaccgacggcgucaagaugcucugcaaggcccucaagaaguccaccugccgccuccagaagcucggcuga

SEQ ID NO: 46698 - RNA, 3282 nt, Artificial Sequence
  derived and/or modified sequence opt2 from NLRP14__Homo_sapiens__NP_789792
auggccgacuccuccuccuccuccuucuuccccgacuucggccuccuccucuaccucgaggagcucaacaaggaggagcucaacaccuucaagcucuuccucaaggagaccauggagcccgagcacggccucacccccuggaacgaggucaagaaggcccgccgcgaggaccucgccaaccucaugaagaaguacuaccccggcgagaaggccugguccgucucccucaagaucuucggcaagaugaaccucaaggaccucugcgagcgcgccaaggaggagaucaacugguccgcccagaccaucggccccgacgacgccaaggccggcgagacccaggaggaccaggaggccguccucggcgacggcaccgaguaccgcaaccgcaucaaggagaaguucugcaucaccugggacaagaagucccucgccggcaagcccgaggacuuccaccacggcaucgccgagaaggaccgcaagcuccucgagcaccucuucgacgucgacgucaagaccggcgcccagccccagaucgucguccuccagggcgccgccggcgucggcaagaccacccucguccgcaaggccaugcucgacugggccgagggcucccucuaccagcagcgcuucaaguacgucuucuaccucaacggccgcgagaucaaccagcucaaggagcgcuccuucgcccagcucaucuccaaggacuggcccuccaccgagggccccaucgaggagaucauguaccagcccuccucccuccucuucaucaucgacuccuucgacgagcucaacuucgccuucgaggagcccgaguucgcccucugcgaggacuggacccaggagcaccccgucuccuuccucauguccucccuccuccgcaaggucaugcuccccgaggccucccuccucgucaccacccgccucaccaccuccaagcgccucaagcagcuccucaagaaccaccacuacgucgagcuccucggcauguccgaggacgcccgcgaggaguacaucuaccaguucuucgaggacaagcgcugggccaugaaggucuucuccucccucaaguccaacgagaugcucuucuccaugugccaggucccccucgucugcugggccgccugcaccugccucaagcagcagauggagaagggcggcgacgucacccucaccugccagaccaccaccgcccucuucaccugcuacaucuccucccucuucacccccgucgacggcggcucccccucccuccccaaccaggcccagcuccgccgccucugccaggucgccgccaagggcaucuggaccaugaccuacgucuucuaccgcgagaaccuccgccgccucggccucacccaguccgacgucuccuccuucauggacuccaacaucauccagaaggacgccgaguacgagaacugcuacgucuucacccaccuccacguccaggaguucuucgccgccauguucuacaugcucaagggcuccugggaggccggcaaccccuccugccagcccuucgaggaccucaagucccuccuccaguccaccuccuacaaggacccccaccucacccagaugaagugcuuccucuucggccuccucaacgaggaccgcgucaagcagcucgagcgcaccuucaacugcaagaugucccucaagaucaaguccaagcuccuccagugcauggagguccucggcaacuccgacuacucccccucccagcucggcuuccucgagcucuuccacugccucuacgagacccaggacaaggccuucaucucccaggccaugcgcugcuuccccaaggucgccaucaacaucugcgagaagauccaccuccucgucuccuccuucugccucaagcacugccgcugccuccgcaccauccgccucuccgucaccgucgucuucgagaagaagauccucaagaccucccuccccaccaacaccugggacggcgaccgcaucacccacugcuggcaggaccucugcuccguccuccacaccaacgagcaccuccgcgagcucgaccucuaccacuccaaccucgacaaguccgccaugaacauccuccaccacgagcuccgccaccccaacugcaagcuccagaagcuccuccucaaguucaucaccuuccccgacggcugccaggacaucuccaccucccucauccacaacaagaaccucaugcaccucgaccucaagggcuccgacaucggcgacaacggcgucaagucccucugcgaggcccucaagcaccccgagugcaagcuccagacccuccgccucgaguccugcaaccucaccgucuucugcugccucaacaucuccaacgcccucauccgcucccagucccucaucuuccucaaccucuccaccaacaaccuccucgacgacggcguccagcuccucugcgaggcccuccgccaccccaagugcuaccucgagcgccucucccucgaguccugcggccucaccgaggccggcugcgaguaccucucccucgcccucaucuccaacaagcgccucacccaccucugccucgccgacaacguccucggcgacggcggcgucaagcucauguccgacgcccuccagcacgcccagugcacccucaagucccucguccuccgccgcugccacuucaccucccucuccuccgaguaccucuccaccucccuccuccacaacaagucccucacccaccucgaccucggcuccaacuggcuccaggacaacggcgucaagcuccucugcgacgucuuccgccaccccuccugcaaccuccaggaccucgagcucaugggcugcguccucaccaacgccugcugccucgaccucgccuccgucauccucaacaaccccaaccuccgcucccucgaccucggcaacaacgaccuccaggacgacggcgucaagauccucugcgacgcccuccgcuaccccaacugcaacauccagcgccucggccucgaguacugcggccucaccucccucugcugccaggaccucuccuccgcccucaucugcaacaagcgccucaucaagaugaaccucacccagaacacccucggcuacgagggcaucgucaagcucuacaagguccucaagucccccaagugcaagcuccagguccucggccucugcaaggaggccuucgacgaggaggcccagaagcuccucgaggccgucggcgucuccaacccccaccucaucaucaagcccgacugcaacuaccacaacgaggaggacgucuccuggugguggugcuucuga

SEQ ID NO: 46699 - RNA, 4128 nt, Artificial Sequence
  derived and/or modified sequence opt2 from NLRP1__Homo_sapiens__NP_001028225
auggccggcggcgccuggggccgccucgccugcuaccucgaguuccucaagaaggaggagcucaaggaguuccagcuccuccucgccaacaaggcccacucccgcuccuccuccggcgagacccccgcccagcccgagaagaccuccggcauggaggucgccuccuaccucgucgcccaguacggcgagcagcgcgccugggaccucgcccuccacaccugggagcagaugggccuccgcucccucugcgcccaggcccaggagggcgccggccacucccccuccuuccccuacucccccuccgagccccaccucggcucccccucccagcccaccuccaccgccguccucaugcccuggauccacgagcuccccgccggcugcacccagggcuccgagcgccgcguccuccgccagcuccccgacaccuccggccgccgcuggcgcgagaucuccgccucccuccucuaccaggcccuccccuccucccccgaccacgagucccccucccaggagucccccaacgcccccaccuccaccgccguccucggcuccuggggcucccccccccagcccucccucgccccccgcgagcaggaggcccccggcacccaguggccccucgacgagaccuccggcaucuacuacaccgagauccgcgagcgcgagcgcgagaaguccgagaagggccgcccccccugggccgccgucgucggcacccccccccaggcccacaccucccuccagccccaccaccaccccugggagcccuccguccgcgagucccucugcuccaccuggcccuggaagaacgaggacuucaaccagaaguucacccagcuccuccuccuccagcgcccccacccccgcucccaggacccccucgucaagcgcuccuggcccgacuacgucgaggagaaccgcggccaccucaucgagauccgcgaccucuucggccccggccucgacacccaggagccccgcaucgucauccuccagggcgccgccggcaucggcaaguccacccucgcccgccaggucaaggaggccuggggccgcggccagcucuacggcgaccgcuuccagcacgucuucuacuucuccugccgcgagcucgcccaguccaaggucgucucccucgccgagcucaucggcaaggacggcaccgccacccccgcccccauccgccagauccucucccgccccgagcgccuccucuucauccucgacggcgucgacgagcccggcuggguccuccaggagcccuccuccgagcucugccuccacuggucccagccccagcccgccgacgcccuccucggcucccuccucggcaagaccauccuccccgaggccuccuuccucaucaccgcccgcaccaccgcccuccagaaccucauccccucccucgagcaggcccgcugggucgagguccucggcuucuccgaguccucccgcaaggaguacuucuaccgcuacuucaccgacgagcgccaggccauccgcgccuuccgccucgucaaguccaacaaggagcucugggcccucugccucguccccugggucuccuggcucgccugcaccugccucaugcagcagaugaagcgcaaggagaagcucacccucaccuccaagaccaccaccacccucugccuccacuaccucgcccaggcccuccaggcccagccccucggcccccagcuccgcgaccucugcucccucgccgccgagggcaucuggcagaagaagacccucuucucccccgacgaccuccgcaagcacggccucgacggcgccaucaucuccaccuuccucaagaugggcauccuccaggagcaccccaucccccucuccuacuccuucauccaccucugcuuccaggaguucuucgccgccauguccuacguccucgaggacgagaagggccgcggcaagcacuccaacugcaucaucgaccucgagaagacccucgaggccuacggcauccacggccucuucggcgccuccaccacccgcuuccuccucggccuccucuccgacgagggcgagcgcgagauggagaacaucuuccacugccgccucucccagggccgcaaccucaugcaguggguccccucccuccagcuccuccuccagccccacucccucgagucccuccacugccucuacgagacccgcaacaagaccuuccucacccaggucauggcccacuucgaggagaugggcaugugcgucgagaccgacauggagcuccucgucugcaccuucugcaucaaguucucccgccacgucaagaagcuccagcucaucgagggccgccagcaccgcuccaccuggucccccaccauggucguccucuuccgcuggguccccgucaccgacgccuacuggcagauccucuucuccguccucaaggucacccgcaaccucaaggagcucgaccucuccggcaacucccucucccacuccgccgucaagucccucugcaagacccuccgccgcccccgcugccuccucgagacccuccgccucgccggcugcggccucaccgccgaggacugcaaggaccucgccuucggccuccgcgccaaccagacccucaccgagcucgaccucuccuucaacguccucaccgacgccggcgccaagcaccucugccagcgccuccgccagcccuccugcaagcuccagcgccuccagcucgucuccugcggccucaccuccgacugcugccaggaccucgccuccguccucuccgccucccccucccucaaggagcucgaccuccagcagaacaaccucgacgacgucggcguccgccuccucugcgagggccuccgccaccccgccugcaagcucauccgccucggccucgaccagaccacccucuccgacgagaugcgccaggagcuccgcgcccucgagcaggagaagccccagcuccucaucuucucccgccgcaagcccuccgucaugacccccaccgagggccucgacaccggcgagauguccaacuccaccuccucccucaagcgccagcgccucggcuccgagcgcgccgccucccacgucgcccaggccaaccucaagcuccucgacgucuccaagaucuuccccaucgccgagaucgccggcaagucccacgaggaguccucccccgaggucguccccgucgagcuccucugcguccccucccccgccucccagggcgaccuccacaccaagccccucggcaccgacgacgacuucuggggccccaccggccccgucgccaccgaggucgucgacaaggagaagaaccucuaccgcguccacuuccccgucgccggcuccuaccgcuggcccaacaccggccucugcuucgucaugcgcgaggccgucaccgucgagaucgaguucugcgucugggaccaguuccucggcgagaucaacccccagcacuccuggauggucgccggcccccuccucgacaucaaggccgagcccggcgccgucgaggccguccaccucccccacuucgucgcccuccagggcggccacgucgacaccucccucuuccagauggcccacuucaaggaggagggcaugcuccucgagaagcccgcccgcgucgagcuccaccacaucguccucgagaaccccuccuucuccccccucggcguccuccucaagaugauccacaacgcccuccgcuucauccccgucaccuccgucguccuccucuaccaccgcguccaccccgaggaggucaccuuccaccucuaccucauccccuccgacugcuccauccgcaaggccaucgacgaccucgagaugaaguuccaguucguccgcauccacaagccccccccccucaccccccucuacaugggcugccgcuacaccgucuccggcuccggcuccggcaugcucgagauccuccccaaggagcucgagcucugcuaccgcucccccggcgaggaccagcucuucuccgaguucuacgucggccaccucggcuccggcauccgccuccaggucaaggacaagaaggacgagacccucgucugggaggcccucgucaagcccggccgcaacaccucccagcccuggaaccuccgcugcaaccgcgacgcccgccgcuacuga

SEQ ID NO: 46700 - RNA, 3189 nt, Artificial Sequence
  derived and/or modified sequence opt2 from NLRP2__Homo_sapiens__NP_001167552
auggucuccuccgcccagaugggcuucaaccuccaggcccuccucgagcagcucucccaggacgagcucuccaaguucaaguaccucaucaccaccuucucccucgcccacgagcuccagaagaucccccacaaggaggucgacaaggccgacggcaagcagcucgucgagauccucaccacccacugcgacuccuacugggucgagauggccucccuccaggucuucgagaagaugcaccgcauggaccucuccgagcgcgccaaggacgagguccgcgaggccgcccucaaguccuucaacaagcgcaagccccucucccucggcaucacccgcaaggagcgccccccccucgacgucgacgagaugcucgagcgcuucaagaccgaggcccaggccuucaccgagaccaagggcaacgucaucugccucggcaaggaggucuucaagggcaagaagcccgacaaggacaaccgcugccgcuacauccucaagaccaaguuccgcgagauguggaaguccuggcccggcgacuccaaggagguccaggucauggccgagcgcuacaagaugcucauccccuucuccaacccccgcguccuccccggccccuucuccuacaccgucguccucuacggccccgccggccucggcaagaccacccucgcccagaagcucaugcucgacugggccgaggacaaccucauccacaaguucaaguacgccuucuaccucuccugccgcgagcucucccgccucggccccugcuccuucgccgagcucgucuuccgcgacuggcccgagcuccaggacgacaucccccacauccucgcccaggcccgcaagauccucuucgucaucgacggcuucgacgagcucggcgccgcccccggcgcccucaucgaggacaucugcggcgacugggagaagaagaagcccguccccguccuccucggcucccuccucaaccgcgucaugcuccccaaggccgcccuccucgucaccacccgcccccgcgcccuccgcgaccuccgcauccucgccgaggagcccaucuacauccgcgucgagggcuuccucgaggaggaccgccgcgccuacuuccuccgccacuucggcgacgaggaccaggccaugcgcgccuucgagcucaugcgcuccaacgccgcccucuuccagcucggcuccgcccccgccgucugcuggaucgucugcaccacccucaagcuccagauggagaagggcgaggaccccguccccaccugccucacccgcaccggccucuuccuccgcuuccucugcucccgcuucccccagggcgcccagcuccgcggcgcccuccgcacccucucccuccucgccgcccagggccucugggcccagaccuccguccuccaccgcgaggaccucgagcgccucggcguccaggaguccgaccuccgccucuuccucgacggcgacauccuccgccaggaccgcgucuccaagggcugcuacuccuucauccaccucuccuuccagcaguuccucaccgcccucuucuacacccucgagaaggaggaggaggaggaccgcgacggccacaccugggacaucggcgacguccagaagcuccucuccggcgucgagcgccuccgcaaccccgaccucauccaggccggcuacuacuccuucggccucgccaacgagaagcgcgccaaggagcucgaggccaccuucggcugccgcaugucccccgacaucaagcaggagcuccuccgcugcgacaucuccugcaagggcggccacuccaccgucaccgaccuccaggagcuccucggcugccucuacgagucccaggaggaggagcucgucaaggaggucauggcccaguucaaggagaucucccuccaccucaacgccgucgacgucguccccuccuccuucugcgucaagcacugccgcaaccuccagaagaugucccuccaggucaucaaggagaaccuccccgagaacgucaccgccuccgaguccgacgccgaggucgagcgcucccaggacgaccagcacaugcuccccuucuggaccgaccucugcuccaucuucggcuccaacaaggaccucaugggccucgccaucaacgacuccuuccucuccgccucccucguccgcauccucugcgagcagaucgccuccgacaccugccaccuccagcgcgucgucuucaagaacaucucccccgccgacgcccaccgcaaccucugccucgcccuccgcggccacaagaccgucaccuaccucacccuccagggcaacgaccaggacgacauguuccccgcccucugcgagguccuccgccaccccgagugcaaccuccgcuaccucggccucgucuccugcuccgccaccacccagcagugggccgaccucucccucgcccucgaggucaaccagucccucaccugcgucaaccucuccgacaacgagcuccucgacgagggcgccaagcuccucuacaccacccuccgccaccccaagugcuuccuccagcgccucucccucgagaacugccaccucaccgaggccaacugcaaggaccucgccgccguccucgucgucucccgcgagcucacccaccucugccucgccaagaaccccaucggcaacaccggcgucaaguuccucugcgagggccuccgcuaccccgagugcaagcuccagacccucguccucuggaacugcgacaucaccuccgacggcugcugcgaccucaccaagcuccuccaggagaaguccucccuccucugccucgaccucggccucaaccacaucggcgucaagggcaugaaguuccucugcgaggcccuccgcaagccccucugcaaccuccgcugccucuggcucuggggcugcuccaucccccccuucuccugcgaggaccucugcuccgcccucuccugcaaccagucccucgucacccucgaccucggccagaacccccucggcuccuccggcgucaagaugcucuucgagacccucaccugcuccuccggcacccuccgcacccuccgccucaagaucgacgacuucaacgacgagcucaacaagcuccucgaggagaucgaggagaagaacccccagcucaucaucgacaccgagaagcaccaccccugggccgagcgccccuccucccacgacuucaugaucuga

SEQ ID NO: 46701 - RNA, 2940 nt, Artificial Sequence
  derived and/or modified sequence opt2 from NLRP3__Homo_sapiens__NP_001120933
augaagauggccuccacccgcugcaagcucgcccgcuaccucgaggaccucgaggacgucgaccucaagaaguucaagaugcaccucgaggacuaccccccccagaagggcugcaucccccucccccgcggccagaccgagaaggccgaccacgucgaccucgccacccucaugaucgacuucaacggcgaggagaaggccugggccauggccgucuggaucuucgccgccaucaaccgccgcgaccucuacgagaaggccaagcgcgacgagcccaaguggggcuccgacaacgcccgcgucuccaaccccaccgucaucugccaggaggacuccaucgaggaggaguggaugggccuccucgaguaccucucccgcaucuccaucugcaagaugaagaaggacuaccgcaagaaguaccgcaaguacguccgcucccgcuuccagugcaucgaggaccgcaacgcccgccucggcgaguccgucucccucaacaagcgcuacacccgccuccgccucaucaaggagcaccgcucccagcaggagcgcgagcaggagcuccucgccaucggcaagaccaagaccugcgagucccccgucucccccaucaagauggagcuccucuucgaccccgacgacgagcacuccgagcccguccacaccgucgucuuccagggcgccgccggcaucggcaagaccauccucgcccgcaagaugaugcucgacugggccuccggcacccucuaccaggaccgcuucgacuaccucuucuacauccacugccgcgaggucucccucgucacccagcgcucccucggcgaccucaucauguccugcugccccgaccccaacccccccauccacaagaucguccgcaagcccucccgcauccucuuccucauggacggcuucgacgagcuccagggcgccuucgacgagcacaucggcccccucugcaccgacuggcagaaggccgagcgcggcgacauccuccucuccucccucauccgcaagaagcuccuccccgaggccucccuccucaucaccacccgccccgucgcccucgagaagcuccagcaccuccucgaccacccccgccacgucgagauccucggcuucuccgaggccaagcgcaaggaguacuucuucaaguacuucuccgacgaggcccaggcccgcgccgccuucucccucauccaggagaacgagguccucuucaccaugugcuucaucccccucgucugcuggaucgucugcaccggccucaagcagcagauggaguccggcaagucccucgcccagaccuccaagaccaccaccgccgucuacgucuucuuccucuccucccuccuccagccccgcggcggcucccaggagcacggccucugcgcccaccucuggggccucugcucccucgccgccgacggcaucuggaaccagaagauccucuucgaggaguccgaccuccgcaaccacggccuccagaaggccgacgucuccgccuuccuccgcaugaaccucuuccagaaggaggucgacugcgagaaguucuacuccuucauccacaugaccuuccaggaguucuucgccgccauguacuaccuccucgaggaggagaaggagggccgcaccaacguccccggcucccgccucaagcuccccucccgcgacgucaccguccuccucgagaacuacggcaaguucgagaagggcuaccucaucuucgucguccgcuuccucuucggccucgucaaccaggagcgcaccuccuaccucgagaagaagcucuccugcaagaucucccagcagauccgccucgagcuccucaaguggaucgaggucaaggccaaggccaagaagcuccagauccagcccucccagcucgagcucuucuacugccucuacgagaugcaggaggaggacuucguccagcgcgccauggacuacuuccccaagaucgagaucaaccucuccacccgcauggaccacauggucuccuccuucugcaucgagaacugccaccgcgucgagucccucucccucggcuuccuccacaacaugcccaaggaggaggaggaggaggagaaggagggccgccaccucgacaugguccagugcguccuccccuccuccucccacgccgccugcucccacggccucgucaacucccaccucaccuccuccuucugccgcggccucuucuccguccucuccaccucccagucccucaccgagcucgaccucuccgacaacucccucggcgaccccggcaugcgcguccucugcgagacccuccagcaccccggcugcaacauccgccgccucuggcucggccgcugcggccucucccacgagugcugcuucgacaucucccucguccucuccuccaaccagaagcucgucgagcucgaccucuccgacaacgcccucggcgacuucggcauccgccuccucugcgucggccucaagcaccuccucugcaaccucaagaagcucuggcucgucaacuccggccucaccuccgucugcugcuccgcccucuccuccguccucuccaccaaccagaaccucacccaccucuaccuccgcggcaacacccucggcgacaagggcaucaagcuccucugcgagggccuccuccaccccgacugcaagcuccagguccucgagcucgacaacugcaaccucaccucccacugcugcugggaccucuccacccuccucaccuccucccagucccuccgcaagcucucccucggcaacaacgaccucggcgaccucggcgucaugauguucugcgagguccucaagcagcaguccugccuccuccagaaccucggccucuccgagauguacuucaacuacgagaccaaguccgcccucgagacccuccaggaggagaagcccgagcucaccgucgucuucgagcccuccugguga

SEQ ID NO: 46702 - RNA, 3087 nt, Artificial Sequence
  derived and/or modified sequence opt2 from NLRP4__Homo_sapiens__XP_006723105
augucccgcgccaucaacggcauggacgaggaguucggcuucaucuaccuccucuuccucgucaccgucucccuccgcaucggcaucuccgcccccgagaagauggccgccuccuucuucuccgacuucggccucaugugguaccucgaggagcucaagaaggaggaguuccgcaaguucaaggagcaccucaagcagaugacccuccagcucgagcucaagcagauccccuggaccgaggucaagaaggccucccgcgaggagcucgccaaccuccucaucaagcacuacgaggagcagcaggccuggaacaucacccuccgcaucuuccagaagauggaccgcaaggaccucugcaugaaggucaugcgcgagcgcaccggcuacaccaagaccuaccaggcccacgccaagcagaaguucucccgccucugguccuccaaguccgucaccgagauccaccucuacuucgaggaggaggucaagcaggaggagugcgaccaccucgaccgccucuucgcccccaaggaggccggcaagcagccccgcaccgucaucauccagggcccccagggcaucggcaagaccacccuccucaugaagcucaugauggccugguccgacaacaagaucuuccgcgaccgcuuccucuacaccuucuacuucugcugccgcgagcuccgcgagcucccccccaccucccucgccgaccucaucucccgcgaguggcccgaccccgccgcccccaucaccgagaucgucucccagcccgagcgccuccucuucgucaucgacuccuucgaggagcuccagggcggccucaacgagcccgacuccgaccucugcggcgaccucauggagaagcgccccguccagguccuccucuccucccuccuccgcaagaagaugcuccccgaggccucccuccucaucgccaucaagcccgucugccccaaggagcuccgcgaccaggucaccaucuccgagaucuaccagccccgcggcuucaacgaguccgaccgccucgucuacuucugcugcuucuucaaggaccccaagcgcgccauggaggccuucaaccucguccgcgaguccgagcagcucuucuccaucugccagaucccccuccucugcuggauccucugcaccucccucaagcaggagaugcagaagggcaaggaccucgcccucaccugccaguccaccaccuccgucuacuccuccuucgucuucaaccucuucacccccgagggcgccgagggccccaccccccagacccagcaccagcucaaggcccucugcucccucgccgccgagggcauguggaccgacaccuucgaguucugcgaggacgaccuccgccgcaacggcgucgucgacgccgacauccccgcccuccucggcaccaagauccuccucaaguacggcgagcgcgaguccuccuacgucuuccuccacgucugcauccaggaguucugcgccgcccucuucuaccuccucaagucccaccucgaccacccccaccccgccguccgcugcguccaggagcuccucgucgccaacuucgagaaggcccgccgcgcccacuggaucuuccucggcugcuuccucaccggccuccucaacaagaaggagcaggagaagcucgacgccuucuucggcuuccagcucucccaggagaucaagcagcagauccaccagugccucaagucccucggcgagcgcggcaacccccagggccaggucgacucccucgccaucuucuacugccucuucgagaugcaggaccccgccuucgucaagcaggccgucaaccuccuccaggaggccaacuuccacaucaucgacaacgucgaccucgucgucuccgccuacugccucaaguacugcuccucccuccgcaagcucugcuucuccguccagaacgucuucaagaaggaggacgagcacuccuccaccuccgacuacucccucaucugcuggcaccacaucugcuccguccucaccaccuccggccaccuccgcgagcuccagguccaggacuccacccucuccgaguccaccuucgucaccuggugcaaccagcuccgccaccccuccugccgccuccagaagcucggcaucaacaacgucuccuucuccggccaguccguccuccucuucgagguccucuucuaccagcccgaccucaaguaccucuccuucacccucaccaagcucucccgcgacgacauccgcucccucugcgacgcccucaacuaccccgccggcaacgucaaggagcucgcccucgucaacugccaccucucccccaucgacugcgagguccucgccggccuccucaccaacaacaagaagcucaccuaccucaacgucuccugcaaccagcucgacaccggcgucccccuccucugcgaggcccucugcucccccgacaccguccucgucuaccucaugcucgccuucugccaccucuccgagcagugcugcgaguacaucuccgagaugcuccuccgcaacaaguccguccgcuaccucgaccucuccgccaacguccucaaggacgagggccucaagacccucugcgaggcccucaagcaccccgacugcugccucgacucccucugccucgucaagugcuucaucaccgccgccggcugcgaggaccucgccuccgcccucaucuccaaccagaaccucaagauccuccagaucggcugcaacgagaucggcgacgucggcguccagcuccucugccgcgcccucacccacaccgacugccgccucgagauccucggccucgaggagugcggccucaccuccaccugcugcaaggaccucgccuccguccucaccugcuccaagacccuccagcagcucaaccucacccucaacacccucgaccacaccggcgucgucguccucugcgaggcccuccgccaccccgagugcgcccuccagguccucggccuccgcaagaccgacuucgacgaggagacccaggcccuccucaccgccgaggaggagcgcaaccccaaccucaccaucaccgacgacugcgacaccaucacccgcgucgagaucuga

SEQ ID NO: 46703 - RNA, 3603 nt, Artificial Sequence
  derived and/or modified sequence opt2 from NLRP5__Homo_sapiens__NP_703148
augaaggucgccggcggccucgagcucggcgccgccgcccuccucuccgccuccccccgcgcccucgucacccucuccaccggccccaccugcuccauccuccccaagaacccccucuucccccagaaccucuccucccagcccugcaucaagauggagggcgacaagucccucaccuucuccuccuacggccuccaguggugccucuacgagcucgacaaggaggaguuccagaccuucaaggagcuccucaagaagaaguccuccgaguccaccaccugcuccaucccccaguucgagaucgagaacgccaacgucgagugccucgcccuccuccuccacgaguacuacggcgccucccucgccugggccaccuccaucuccaucuucgagaacaugaaccuccgcacccucuccgagaaggcccgcgacgacaugaagcgccacucccccgaggaccccgaggccaccaugaccgaccagggccccuccaaggagaagguccccggcaucucccaggccguccagcaggacuccgccaccgccgccgagaccaaggagcaggagaucucccaggccauggagcaggagggcgccaccgccgccgagaccgaggagcaggagaucucccaggccauggagcaggagggcgccaccgccgccgagaccgaggagcagggccacggcggcgacaccugggacuacaagucccacgucaugaccaaguucgccgaggaggaggacguccgccgcuccuucgagaacaccgccgccgacuggcccgagaugcagacccucgccggcgccuucgacuccgaccgcuggggcuuccgcccccgcaccgucguccuccacggcaaguccggcaucggcaaguccgcccucgcccgccgcaucguccucugcugggcccagggcggccucuaccagggcauguucuccuacgucuucuuccuccccguccgcgagaugcagcgcaagaaggaguccuccgucaccgaguucaucucccgcgaguggcccgacucccaggcccccgucaccgagaucaugucccgccccgagcgccuccucuucaucaucgacggcuucgacgaccucggcuccguccucaacaacgacaccaagcucugcaaggacugggccgagaagcagccccccuucacccucauccgcucccuccuccgcaagguccuccuccccgaguccuuccucaucgucaccguccgcgacgucggcaccgagaagcucaaguccgaggucgucuccccccgcuaccuccucguccgcggcaucuccggcgagcagcgcauccaccuccuccucgagcgcggcaucggcgagcaccagaagacccagggccuccgcgccaucaugaacaaccgcgagcuccucgaccagugccagguccccgccgucggcucccucaucugcgucgcccuccagcuccaggacgucgucggcgaguccgucgcccccuucaaccagacccucaccggccuccacgccgccuucgucuuccaccagcucaccccccgcggcgucguccgccgcugccucaaccucgaggagcgcgucguccucaagcgcuucugccgcauggccgucgagggcgucuggaaccgcaaguccgucuucgacggcgacgaccucaugguccagggccucggcgaguccgagcuccgcgcccucuuccacaugaacauccuccuccccgacucccacugcgaggaguacuacaccuucuuccaccucucccuccaggacuucugcgccgcccucuacuacguccucgagggccucgagaucgagcccgcccucugcccccucuacgucgagaagaccaagcgcuccauggagcucaagcaggccggcuuccacauccacucccucuggaugaagcgcuuccucuucggccucgucuccgaggacguccgccgcccccucgagguccuccucggcugccccgucccccucggcgucaagcagaagcuccuccacugggucucccuccucggccagcagcccaacgccaccacccccggcgacacccucgacgccuuccacugccucuucgagacccaggacaaggaguucguccgccucgcccucaacuccuuccaggaggucuggcuccccaucaaccagaaccucgaccucaucgccuccuccuucugccuccagcacugccccuaccuccgcaagauccgcgucgacgucaagggcaucuucccccgcgacgaguccgccgaggccugccccgucgucccccucuggaugcgcgacaagacccucaucgaggagcagugggaggacuucugcuccaugcucggcacccacccccaccuccgccagcucgaccucggcuccuccauccucaccgagcgcgccaugaagacccucugcgccaagcuccgccaccccaccugcaagauccagacccucauguuccgcaacgcccagaucacccccggcguccagcaccucuggcgcaucgucauggccaaccgcaaccuccgcucccucaaccucggcggcacccaccucaaggaggaggacguccgcauggccugcgaggcccucaagcaccccaagugccuccucgagucccuccgccucgacugcugcggccucacccacgccugcuaccucaagaucucccagauccucaccaccucccccucccucaagucccucucccucgccggcaacaaggucaccgaccagggcgucaugccccucuccgacgcccuccgcgucucccagugcgcccuccagaagcucauccucgaggacugcggcaucaccgccaccggcugccagucccucgccuccgcccucgucuccaaccgcucccucacccaccucugccucuccaacaacucccucggcaacgagggcgucaaccuccucugccgcuccaugcgccucccccacugcucccuccagcgccucaugcucaaccagugccaccucgacaccgccggcugcggcuuccucgcccucgcccucaugggcaacuccuggcucacccaccucucccucuccaugaaccccgucgaggacaacggcgucaagcuccucugcgaggucaugcgcgagcccuccugccaccuccaggaccucgagcucgucaagugccaccucaccgccgccugcugcgagucccucuccugcgucaucucccgcucccgccaccucaagucccucgaccucaccgacaacgcccucggcgacggcggcgucgccgcccucugcgagggccucaagcagaagaacuccguccucgcccgccucggccucaaggccugcggccucaccuccgacugcugcgaggcccucucccucgcccucuccugcaaccgccaccucaccucccucaaccucguccagaacaacuucucccccaagggcaugaugaagcucugcuccgccuucgccugccccaccuccaaccuccagaucaucggccucuggaaguggcaguaccccguccagauccgcaagcuccucgaggagguccagcuccucaagccccgcgucgucaucgacggcuccuggcacuccuucgacgaggacgaccgcuacugguggaagaacuga

SEQ ID NO: 46704 - RNA, 2676 nt, Artificial Sequence
  derived and/or modified sequence opt2 from NLRP6__Homo_sapiens__NP_001263629
auggaccagcccgaggcccccugcuccuccaccggcccccgccucgccgucgcccgcgagcuccuccucgccgcccucgaggagcucucccaggagcagcucaagcgcuuccgccacaagcuccgcgacgucggccccgacggccgcuccauccccuggggccgccucgagcgcgccgacgccgucgaccucgccgagcagcucgcccaguucuacggccccgagcccgcccucgaggucgcccgcaagacccucaagcgcgccgacgcccgcgacgucgccgcccagcuccaggagcgccgccuccagcgccucggccucggcuccggcacccuccucuccgucuccgaguacaagaagaaguaccgcgagcacguccuccagcuccacgcccgcgucaaggagcgcaacgcccgcuccgucaagaucaccaagcgcuucaccaagcuccucaucgcccccgaguccgccgcccccgaggaggccaugggccccgccgaggagcccgagcccggccgcgcccgccgcuccgacacccacaccuucaaccgccucuuccgccgcgacgaggagggccgccgcccccucaccgucguccuccagggccccgccggcaucggcaagaccauggccgccaagaagauccucuacgacugggccgccggcaagcucuaccagggccaggucgacuucgccuucuucaugcccugcggcgagcuccucgagcgccccggcacccgcucccucgccgaccucauccucgaccagugccccgaccgcggcgcccccgucccccagaugcucgcccagccccagcgccuccucuucauccucgacggcgccgacgagcuccccgcccucggcggccccgaggccgcccccugcaccgaccccuucgaggccgccuccggcgcccgcguccucggcggccuccucuccaaggcccuccuccccaccgcccuccuccucgucaccacccgcgccgccgcccccggccgccuccagggccgccucugcuccccccagugcgccgagguccgcggcuucuccgacaaggacaagaagaaguacuucuacaaguacuuccgcgacgagcgccgcgccgagcgcgccuaccgcuucgucaaggagaacgagacccucuucgcccucugcuucguccccuucgucugcuggaucgucugcaccguccuccgccagcagcucgagcucggccgcgaccucucccgcaccuccaagaccaccaccuccgucuaccuccucuucaucaccuccguccucuccuccgcccccgucgccgacggcccccgccuccagggcgaccuccgcaaccucugccgccucgcccgcgagggcguccucggccgccgcgcccaguucgccgagaaggagcucgagcagcucgagcuccgcggcuccaagguccagacccucuuccucuccaagaaggagcuccccggcguccucgagaccgaggucaccuaccaguucaucgaccaguccuuccaggaguuccucgccgcccucuccuaccuccucgaggacggcggcgucccccgcaccgccgccggcggcgucggcacccuccuccgcggcgacgcccagccccacucccaccucguccucaccacccgcuuccucuucggccuccucuccgccgagcgcaugcgcgacaucgagcgccacuucggcugcauggucuccgagcgcgucaagcaggaggcccuccgcuggguccagggccagggccagggcugccccggcgucgcccccgaggucaccgagggcgccaagggccucgaggacaccgaggagcccgaggaggaggaggagggcgaggagcccaacuacccccucgagcuccucuacugccucuacgagacccaggaggacgccuucguccgccaggcccucugccgcuuccccgagcucgcccuccagcgcguccgcuucugccgcauggacgucgccguccucuccuacugcguccgcugcugccccgccggccaggcccuccgccucaucuccugccgccucgucgccgcccaggagaagaagaagaagucccucggcaagcgccuccaggccucccucggcggcggcuccucccagggcaccaccaagcagcuccccgccucccuccuccacccccucuuccaggccaugaccgacccccucugccaccucuccucccucacccucucccacugcaagcuccccgacgccgucugccgcgaccucuccgaggcccuccgcgccgcccccgcccucaccgagcucggccuccuccacaaccgccucuccgaggccggccuccgcaugcucuccgagggccucgccuggccccagugccgcguccagaccguccgcguccagcuccccgacccccagcgcggccuccaguaccucgucggcaugcuccgccagucccccgcccucaccacccucgaccucuccggcugccagcuccccgcccccauggucaccuaccucugcgccguccuccagcaccagggcugcggccuccagacccucucccucgccuccgucgagcucuccgagcagucccuccaggagcuccaggccgucaagcgcgccaagcccgaccucgucaucacccaccccgcccucgacggccacccccagccccccaaggagcucaucuccaccuucuga

SEQ ID NO: 46705 - RNA, 3030 nt, Artificial Sequence
  derived and/or modified sequence opt2 from NLRP7__Homo_sapiens__NP_631915
augaccuccccccagcucgaguggacccuccagacccuccucgagcagcucaacgaggacgagcucaaguccuucaagucccuccucugggccuucccccucgaggacguccuccagaagacccccugguccgaggucgaggaggccgacggcaagaagcucgccgagauccucgucaacaccuccuccgagaacuggauccgcaacgccaccgucaacauccucgaggagaugaaccucaccgagcucugcaagauggccaaggccgagaugauggaggacggccagguccaggagaucgacaaccccgagcucggcgacgccgaggaggacuccgagcucgccaagcccggcgagaaggagggcuggcgcaacuccauggagaagcagucccucgucuggaagaacaccuucuggcagggcgacaucgacaacuuccacgacgacgucacccuccgcaaccagcgcuucauccccuuccucaacccccgcaccccccgcaagcucacccccuacaccgucguccuccacggccccgccggcgucggcaagaccacccucgccaagaagugcaugcucgacuggaccgacugcaaccucucccccacccuccgcuacgccuucuaccucuccugcaaggagcucucccgcaugggccccugcuccuucgccgagcucaucuccaaggacuggcccgagcuccaggacgacauccccuccauccucgcccaggcccagcgcauccucuucgucgucgacggccucgacgagcucaaggucccccccggcgcccucauccaggacaucugcggcgacugggagaagaagaagcccguccccguccuccucggcucccuccucaagcgcaagaugcucccccgcgccgcccuccucgucaccacccgcccccgcgcccuccgcgaccuccagcuccucgcccagcagcccaucuacguccgcgucgagggcuuccucgaggaggaccgccgcgccuacuuccuccgccacuucggcgacgaggaccaggccaugcgcgccuucgagcucaugcgcuccaacgccgcccucuuccagcucggcuccgcccccgccgucugcuggaucgucugcaccacccucaagcuccagauggagaagggcgaggaccccguccccaccugccucacccgcaccggccucuuccuccgcuuccucugcucccgcuucccccagggcgcccagcuccgcggcgcccuccgcacccucucccuccucgccgcccagggccucugggcccagauguccgucuuccaccgcgaggaccucgagcgccucggcguccaggaguccgaccuccgccucuuccucgacggcgacauccuccgccaggaccgcgucuccaagggcugcuacuccuucauccaccucuccuuccagcaguuccucaccgcccucuucuacgcccucgagaaggaggagggcgaggaccgcgacggccacgccugggacaucggcgacguccagaagcuccucuccggcgaggagcgccucaagaaccccgaccucauccaggucggccacuuccucuucggccucgccaacgagaagcgcgccaaggagcucgaggccaccuucggcugccgcaugucccccgacaucaagcaggagcuccuccagugcaaggcccaccuccacgccaacaagccccucuccgucaccgaccucaaggagguccucggcugccucuacgagucccaggaggaggagcucgccaaggucgucgucgcccccuucaaggagaucuccauccaccucaccaacaccuccgaggucaugcacugcuccuucucccucaagcacugccaggaccuccagaagcucucccuccaggucgccaagggcgucuuccucgagaacuacauggacuucgagcucgacaucgaguucgaguccuccaacuccaaccucaaguuccucgaggucaagcaguccuuccucuccgacuccuccguccgcauccucugcgaccacgucacccgcuccaccugccaccuccagaaggucgagaucaagaacgucacccccgacaccgccuaccgcgacuucugccucgccuucaucggcaagaagacccucacccaccucacccucgccggccacaucgagugggagcgcaccaugaugcucaugcucugcgaccuccuccgcaaccacaagugcaaccuccaguaccuccgccucggcggccacugcgccacccccgagcagugggccgaguucuucuacguccucaaggccaaccagucccucaagcaccuccgccucuccgccaacguccuccucgacgagggcgccaugcuccucuacaagaccaugacccgccccaagcacuuccuccagaugcucucccucgagaacugccgccucaccgaggccuccugcaaggaccucgccgccguccucgucgucuccaagaagcucacccaccucugccucgccaagaaccccaucggcgacaccggcgucaaguuccucugcgagggccucuccuaccccgacugcaagcuccagacccucguccuccagcagugcuccaucaccaagcucggcugccgcuaccucuccgaggcccuccaggaggccugcucccucaccaaccucgaccucuccaucaaccagaucgcccgcggccucuggauccucugccaggcccucgagaaccccaacugcaaccucaagcaccuccgccucugguccugcucccucaugcccuucuacugccagcaccucggcuccgcccuccucuccaaccagaagcucgagacccucgaccucggccagaaccaccucuggaaguccggcaucaucaagcucuucggcguccuccgccagcgcaccggcucccucaagauccuccgccucaagaccuacgagaccaaccucgagaucaagaagcuccucgaggaggucaaggagaagaaccccaagcucaccaucgacugcaacgccuccggcgccaccgccccccccugcugcgacuucuucugcuga

SEQ ID NO: 46706 - RNA, 3147 nt, Artificial Sequence
  derived and/or modified sequence opt2 from NLRP8__Homo_sapiens__NP_789781
auguccgacgucaacccccccuccgacacccccauccccuucuccuccuccuccacccacuccucccacaucccccccuggaccuucuccugcuaccccggcucccccugcgagaacggcgucaugcucuacaugcgcaacgucucccacgaggagcuccagcgcuucaagcagcuccuccucaccgagcucuccaccggcaccaugcccaucaccugggaccaggucgagaccgccuccugggccgaggucguccaccuccucaucgagcgcuuccccggccgccgcgccugggacgucaccuccaacaucuucgccaucaugaacugcgacaagaugugcgucgucguccgccgcgagaucaacgccauccuccccacccucgagcccgaggaccucaacgucggcgagacccaggucaaccucgaggagggcgaguccggcaagauccgccgcuacaaguccaacgucauggagaaguucuuccccaucugggacaucaccaccuggcccggcaaccagcgcgacuucuucuaccagggcguccaccgccacgaggaguaccuccccugccuccuccuccccaagcgcccccagggccgccagcccaagaccgucgccauccagggcgcccccggcaucggcaagaccauccucgccaagaaggucauguucgagugggcccgcaacaaguucuacgcccacaagcgcuggugcgccuucuacuuccacugccaggaggucaaccagaccaccgaccaguccuucuccgagcucaucgagcagaaguggcccggcucccaggaccucgucuccaagaucauguccaagcccgaccagcuccuccuccuccucgacggcuucgaggagcucaccuccacccucaucgaccgccucgaggaccucuccgaggacuggcgccagaagcuccccggcuccguccuccucuccucccuccucuccaagaccaugcuccccgaggccacccuccucaucaugauccgcuucaccuccuggcagaccugcaagccccuccucaagugccccucccucgucacccuccccggcuucaacaccauggagaagaucaaguacuuccagauguacuucggccacaccgaggagggcgaccagguccucuccuucgccauggagaacaccauccucuucuccaugugccgcguccccgucgucugcuggauggucugcuccggccucaagcagcagauggagcgcggcaacaaccucacccaguccugccccaacgccaccuccgucuucguccgcuacaucuccucccucuuccccacccgcgccgagaacuucucccgcaagauccaccaggcccagcucgagggccucugccaccucgccgccgacuccauguggcaccgcaaguggguccucggcaaggaggaccucgaggaggccaagcucgaccagaccggcgucaccgccuuccucggcauguccauccuccgccgcaucgccggcgaggaggaccacuacgucuucacccucgucaccuuccaggaguucuucgccgcccucuucuacguccucugcuucccccagcgccucaagaacuuccacguccucucccacgucaacauccagcgccucaucgccuccccccgcggcuccaaguccuaccucucccacaugggccucuuccucuucggcuuccucaacgaggccugcgccuccgccgucgagcaguccuuccagugcaaggucuccuucggcaacaagcgcaagcuccucaaggucaucccccuccuccacaagugcgacccccccucccccggcuccggcgucccccagcucuucuacugccuccacgagauccgcgaggaggccuucgucucccaggcccucaacgacuaccacaaggucguccuccgcaucggcaacaacaaggagguccaggucuccgccuucugccucaagcgcugccaguaccuccacgaggucgagcucaccgucacccucaacuucaugaacgucuggaagcucuccuccuccucccaccccggcuccgaggcccccgaguccaacggccuccaccgcugguggcaggaccucugcuccgucuucgccaccaacgacaagcucgagguccucaccaugaccaacuccguccucggcccccccuuccucaaggcccucgccgccgcccuccgccacccccagugcaagcuccagaagcuccuccuccgccgcgucaacuccaccaugcucaaccaggaccucaucggcguccucaccggcaaccagcaccuccgcuaccucgagauccagcacgucgaggucgaguccaaggccgucaagcuccucugccgcguccuccgcuccccccgcugccgccuccagugccuccgccucgaggacugccucgccaccccccgcaucuggaccgaccucggcaacaaccuccagggcaacggccaccucaagacccucauccuccgcaagaacucccucgagaacugcggcgccuacuaccucuccgucgcccagcucgagcgccucuccaucgagaacugcaaccucacccagcucaccugcgagucccucgccuccugccuccgccaguccaagaugcucacccaccucucccucgccgagaacgcccucaaggacgagggcgccaagcacaucuggaacgcccucccccaccuccgcugcccccuccagcgccucguccuccgcaagugcgaccucaccuucaacugcugccaggacaugaucuccgcccucugcaagaacaagacccucaagucccucgaccucuccuucaacucccucaaggacgacggcgucauccuccucugcgaggcccucaagaaccccgacugcacccuccagauccucgagcucgagaacugccucuucaccuccaucugcugccaggccauggccuccaugcuccgcaagaaccagcaccuccgccaccucgaccucuccaagaacgccaucggcgucuacggcauccucacccucugcgaggccuucuccucccagaagaagcgcgaggaggucaucuucugcauccccgccuggacccgcaucaccuccuucucccccaccccccacccccccgacuucaccggcaaguccgacugccucucccagaucaaccccuga

SEQ ID NO: 46707 - RNA, 2976 nt, Artificial Sequence
  derived and/or modified sequence opt2 from NLRP9__Homo_sapiens__XP_011525195
auggccgaguccuucuucuccgacuucggccuccucugguaccucaaggagcuccgcaaggaggaguucuggaaguucaaggagcuccucaagcagccccucgagaaguucgagcucaagcccauccccugggccgagcucaagaaggccuccaaggaggacgucgccaagcuccucgacaagcacuaccccggcaagcaggccugggaggucacccucaaccucuuccuccagaucaaccgcaaggaccucuggaccaaggcccaggaggagaugcgcaacaagcucaaccccuaccgcaagcacaugaaggagaccuuccagcucaucugggagaaggagaccugccuccacguccccgagcacuucuacaaggagaccaugaagaacgaguacaaggagcucaacgacgccuacaccgccgccgcccgccgccacaccgucguccucgagggccccgacggcaucggcaagaccacccuccuccgcaaggucaugcucgacugggccgagggcaaccucuggaaggaccgcuucaccuucgucuucuuccucaacgucugcgagaugaacggcaucgccgagaccucccuccucgagcuccucucccgcgacuggcccgaguccuccgagaagaucgaggacaucuucucccagcccgagcgcauccucuucaucauggacggcuucgagcagcucaaguucaaccuccagcucaaggccgaccucuccgacgacuggcgccagcgccagcccaugcccaucauccucuccucccuccuccagaagaagaugcuccccgaguccucccuccucaucgcccucggcaagcucgccaugcagaagcacuacuucaugcuccgccaccccaagcucaucaagcuccucggcuucuccgaguccgagaagaaguccuacuucuccuacuucuucggcgagaaguccaaggcccucaaggucuucaacuucguccgcgacaacggcccccucuucauccucugccacaaccccuucaccugcuggcucgucugcaccugcgucaagcagcgccucgagcgcggcgaggaccucgagaucaacucccagaacaccaccuaccucuacgccuccuuccucaccaccgucuucaaggccggcucccaguccuucccccccaaggucaaccgcgcccgccucaagucccucugcgcccucgccgccgagggcaucuggaccuacaccuucgucuucucccacggcgaccuccgccgcaacggccucuccgaguccgagggcgucaugugggucggcaugcgccuccuccagcgccgcggcgacugcuucgccuucaugcaccucugcauccaggaguucugcgccgccauguucuaccuccucaagcgccccaaggacgaccccaaccccgccaucggcuccaucacccagcucguccgcgccuccgucguccagccccagacccuccucacccaggucggcaucuucauguucggcaucuccaccgaggagaucgucuccaugcucgagaccuccuucggcuucccccucuccaaggaccucaagcaggagaucacccagugccucgagucccucucccagugcgaggccgaccgcgaggccaucgccuuccaggagcucuucaucggccucuucgagacccaggagaaggaguucgucaccaaggucaugaacuucuucgaggaggucuucaucuacaucggcaacaucgagcaccucgucaucgccuccuucugccucaagcacugccagcaccucaccacccuccgcaugugcgucgagaacaucuuccccgacgacuccggcugcaucuccgacuacaacgagaagcucgucuacuggcgcgagcucugcuccauguucaucaccaacaagaacuuccagauccucgacauggagaacaccucccucgacgaccccucccucgccauccucugcaaggcccucgcccagcccgucugcaagcuccgcaagcucaucuucaccuccgucuacuucggccacgacuccgagcucuucaaggccguccuccacaacccccaccucaagcuccucucccucuacggcaccucccucucccaguccgacauccgccaccucugcgagacccucaagcaccccaugugcaagaucgaggagcucauccucggcaagugcgacaucuccuccgaggucugcgaggacaucgccuccguccucgccugcaacuccaagcucaagcaccucucccucgucgagaacccccuccgcgacgagggcaugacccuccucugcgaggcccucaagcacucccacugcgcccucgagcgccucaugcucauguacugcugccucaccuccgucuccugcgacuccaucuccgagguccuccucugcuccaagucccucucccuccucgaccucggcuccaacgcccucgaggacaacggcgucgccucccucugcgccgcccucaagcaccccggcugcuccauccgcgagcucuggcucaugggcugcuuccucaccuccgacuccugcaaggacaucgccgccguccucaucugcaacggcaagcucaagacccucaagcucggccacaacgagaucggcgacaccggcguccgccagcucugcgccgcccuccagcacccccacugcaagcucgagugccucggccuccagaccugccccaucacccgcgccugcugcgacgacaucgccgccgcccucaucgccugcaagacccuccgcucccucaaccucgacuggaucgcccucgacgccgacgccgucgucguccucugcgaggcccucucccaccccgacugcgcccuccagaugcucggccuccacaaguccggcuucgacgaggagacccagaagauccucauguccgucgaggagaagaucccccaccucaccaucucccacggccccuggaucgacgaggaguacaagauccgcggcguccuccucuga

SEQ ID NO: 46708 - RNA, 366 nt, Artificial Sequence
  derived and/or modified sequence opt2 from NMB__Homo_sapiens__NP_066563
auggcccgccgcgccggcggcgcccgcauguucggcucccuccuccucuucgcccuccucgccgccggcgucgccccccucuccugggaccuccccgagccccgcucccgcgccuccaagauccgcguccacucccgcggcaaccucugggccaccggccacuucaugggcaagaagucccucgagcccuccucccccuccccccucggcaccgccccccacaccucccuccgcgaccagcgccuccagcucucccacgaccuccucggcauccuccuccucaagaaggcccucggcgucucccucucccgccccgccccccagauccaguaccgccgccuccucguccagauccuccagaaguga

SEQ ID NO: 46709 - RNA, 1173 nt, Artificial Sequence
  derived and/or modified sequence opt2 from NMBR__Homo_sapiens__NP_002502
augcccuccaagucccucuccaaccucuccgucaccaccggcgccaacgaguccggcuccguccccgagggcugggagcgcgacuuccuccccgccuccgacggcaccaccaccgagcucgucauccgcugcgucauccccucccucuaccuccucaucaucaccgucggccuccucggcaacaucaugcucgucaagaucuucaucaccaacuccgccaugcgcuccguccccaacaucuucaucuccaaccucgccgccggcgaccuccuccuccuccucaccugcguccccgucgacgccucccgcuacuucuucgacgaguggauguucggcaaggucggcugcaagcucauccccgucauccagcucaccuccgucggcgucuccgucuucacccucaccgcccucuccgccgaccgcuaccgcgccaucgucaaccccauggacaugcagaccuccggcgcccuccuccgcaccugcgucaaggccaugggcaucugggucgucuccguccuccucgccguccccgaggccgucuucuccgaggucgcccgcaucuccucccucgacaacuccuccuucaccgccugcauccccuacccccagaccgacgagcuccaccccaagauccacuccguccucaucuuccucgucuacuuccucaucccccucgccaucaucuccaucuacuacuaccacaucgccaagacccucaucaaguccgcccacaaccuccccggcgaguacaacgagcacaccaagaagcagauggagacccgcaagcgccucgccaagaucguccucgucuucgucggcugcuucaucuucugcugguuccccaaccacauccucuacauguaccgcuccuucaacuacaacgagaucgaccccucccucggccacaugaucgucacccucgucgcccgcguccucuccuucggcaacuccugcgucaaccccuucgcccucuaccuccucuccgaguccuuccgccgccacuucaacucccagcucugcugcggccgcaaguccuaccaggagcgcggcaccuccuaccuccucuccuccuccgccguccgcaugaccucccucaaguccaacgccaagaacauggucaccaacuccguccuccucaacggccacuccaugaagcaggagauggcccucuga
